(12) United States Patent
Pavco et al.

(10) Patent No.: US 7,034,009 B2
(45) Date of Patent: Apr. 25, 2006

(54) ENZYMATIC NUCLEIC ACID-MEDIATED TREATMENT OF OCULAR DISEASES OR CONDITIONS RELATED TO LEVELS OF VASCULAR ENDOTHELIAL GROWTH FACTOR RECEPTOR (VEGF-R)

(75) Inventors: Pamela Pavco, Lafayette, CO (US); James McSwiggen, Boulder, CO (US); Dan Stinchcomb, Ft. Collins, CO (US); Jaime Escobedo, Alamo, CA (US)

(73) Assignees: Sirna Therapeutics, Inc., Boulder, CO (US); Chiron Corporation, Emeryville, CA (US)

( * ) Notice: Subject to any disclaimer, the term of this patent is extended or adjusted under 35 U.S.C. 154(b) by 317 days.

(21) Appl. No.: 10/138,674

(22) Filed: May 3, 2002

(65) Prior Publication Data
US 2004/0077565 A1 Apr. 22, 2004

Related U.S. Application Data

(63) Continuation-in-part of application No. 09/870,161, filed on May 29, 2001, now abandoned, which is a continuation-in-part of application No. 09/708,690, filed on Nov. 7, 2000, now abandoned, which is a continuation-in-part of application No. 09/371,722, filed on Aug. 10, 1999, now Pat. No. 6,534,872, which is a continuation-in-part of application No. 08/584,040, filed on Jan. 11, 1996, now Pat. No. 6,346,398.
(60) Provisional application No. 60/005,974, filed on Oct. 26, 1995.

(51) Int. Cl.
*A01N 43/44* (2006.01)

(52) U.S. Cl. .............................. 514/44; 435/6; 435/325; 435/375; 536/23.1; 536/23.2; 536/24.33; 536/24.5

(58) Field of Classification Search ................. 435/325, 435/91.31; 536/24.5
See application file for complete search history.

(56) References Cited

U.S. PATENT DOCUMENTS

| 4,987,071 A | 1/1991 | Cech et al. |
| 5,334,711 A | 8/1994 | Sproat et al. |
| 5,359,051 A | 10/1994 | Cook et al. |

(Continued)

FOREIGN PATENT DOCUMENTS

| EP | 360257 | 3/1990 |
| WO | WO8902439 | 3/1989 |
| WO | WO9103162 | 3/1991 |

(Continued)

OTHER PUBLICATIONS

Parry et al. Bioactivity of anti–angiogenic ribozymes targeting Flt–1 and KDR mRNA. Nucleic Acids Research, 1999 vol. 27:2569–2577.*

Branch, A. A Good Antisense is Hard to Find. TIBS, Feb. 1998 vol. 23, pp. 45–50.*

Jen et al. Suppression of Gene Expression by Targeted Disruption of Messenger RNA: Available Options and Current Strategies. Stem Cells, 2000, vol. 18:307–319.*

(Continued)

*Primary Examiner*—Andrew Wang
*Assistant Examiner*—Terra Gibbs
(74) *Attorney, Agent, or Firm*—McDonnell Boehnen Hulbert & Berghoff LLP

(57) ABSTRACT

The present invention relates to nucleic acid molecules such as ribozymes, DNAzymes, and antisense which modulate the synthesis, expression and/or stability of an mRNA encoding one or more receptors of vascular endothelial growth factor, such as flt-1 and KDR. Nucleic acid molecules and methods for the inhibition of angiogenesis and treatment of cancer and ocular diseases are provided, optionally in conjunction with other therapeutic agents.

20 Claims, 39 Drawing Sheets

*Hammerhead Ribozyme*

U.S. PATENT DOCUMENTS

| | | |
|---|---|---|
| 5,525,468 A | 6/1996 | McSwiggen |
| 5,589,332 A | 12/1996 | Shih et al. |
| 5,631,359 A | 5/1997 | Chowrira et al. |
| 5,672,695 A | 9/1997 | Eckstein et al. |
| 5,741,679 A | 4/1998 | George et al. |
| 5,834,186 A | 11/1998 | George et al. |
| 5,871,914 A | 2/1999 | Nathan |

FOREIGN PATENT DOCUMENTS

| | | |
|---|---|---|
| WO | WO9207065 | 9/1991 |
| WO | WO9312569 | 4/1993 |
| WO | WO9315187 | 8/1993 |
| WO | WO9323057 | 11/1993 |
| WO | WO9402595 | 2/1994 |
| WO | WO9411499 | 5/1994 |
| WO | WO9421679 | 9/1994 |
| WO | WO9421791 | 9/1994 |
| WO | WO9511304 | 10/1994 |
| WO | WO9504142 | 2/1995 |
| WO | WO9504818 | 2/1995 |
| WO | WO9506731 | 3/1995 |
| WO | WO9511910 | 5/1995 |
| WO | WO9513380 | 5/1995 |
| WO | WO9521868 | 8/1995 |
| WO | WO9523225 | 8/1995 |
| WO | WO9610390 | 4/1996 |
| WO | WO9610391 | 4/1996 |
| WO | WO9610392 | 4/1996 |
| WO | WO9622689 | 8/1996 |
| WO | WO9700957 | 1/1997 |
| WO | WO9726270 | 7/1997 |
| WO | WO9813526 | 4/1998 |
| WO | WO9827104 | 6/1998 |
| WO | WO9828317 | 7/1998 |
| WO | WO9858058 | 12/1998 |
| WO | WO9904819 | 2/1999 |
| WO | WO9916871 | 4/1999 |
| WO | WO9929842 | 6/1999 |
| WO | WO9955857 | 11/1999 |
| WO | WO0024931 | 5/2000 |
| WO | WO0026226 | 5/2000 |

OTHER PUBLICATIONS

Dias et al. Potential roles of antisense oligonucleotides in cancer therapy. The example of bcl–2 antisense oligonucleotides. European Journal of Pharmaceutics and Biopharmaceutics, 2002 vol. 54:263–269.*

Ma et al. Synthetic oligonucleotides are therapeutics: the coming of age. Biotechnology Annual Review, 2000 vol. 5:155–196.*

Usman et al., "Chemical modification of hammerhead ribozymes: activity and nuclease resistance," *Nucleic Acids Syposium Series* 31:163–164 (1994).

Parry et al. 1999. "Bioactivity of anti–angiogenic ribozymes targeting *Flt*–1 and *KDR* mRNA," *Nucleic Acid Res.* 27:2569–77.

Aiello et al., "Suppression of Retinal Neovascularization in vivo by inhibition of Vascular Endothelial Growth Factor (VEGF) Using Soluble VEGF–Receptor Chimeric Proteins," *Proc. Natl. Acad. Sci. USA* 92: 10457–10461 (1995).

Aiello, et al., "Vascular Endothelial Growth Factor in Ocular Fluid of Patients with Diabetic Retinopathy and Other Retinal Disorders," 1994 *New Engl. J. Med.* 331, 1480.

Akhtar and Juliano, "Cellular Uptake and Intracellular Fate of AntiSense Oligonucleotides," *Trends Cell Biol.* 2:139–144 (1992).

Bartel and Szostak, "Isolation of New Ribozymes From a Large Pool of Random Sequences," *Science* 261:1411–1418 (1993).

Beaucage and Iyer, "The Functionalization of Oligonucleotides Via Phosphoramidite Derivatives," *Tetrahedron* 49:1925–1963 (1993).

Beigelman et al., "Chemical Modification of Hammerhead Ribozymes," *J. Biol. Chem.* 270:25702–25708 (1995).

Berkman et al., "Expression of the Vascular Permeability Factor/Vascular Endothelial Growth Factor Gene in Central Nervous System Neoplasms," 1993 *J. Clini. Invest.*91, 153.

Breaker and Joyce, "Inventing and improving ribozyme function: rational design versus iterative selection methods," *TIBTECH* 12:268–275 (1994).

Breaker et al., "A DNA enzyme with $Mg^2$–dependent RNA phosphoesterase activity," *Chemistry & Biology* 2(10):655–660 (1995).

Breaker, "Are engineered proteins getting competition from RNA?" *Current Opinion in Biotechnology* 7:442–448 (1996).

Burger et al., "Experimental Corneal Neovascularization: Biomicroscopic, Angiographic, and Morphologic Correlation," *Cornea* 4:35–41 (1985/1986).

Burgin et al., "Chemically Modified Hammerhead Ribozymes with Improved Catalytic Rates," *Biochemistry* 35:14090–14097 (1996) (volume no mistakenly listed as 6).

Carter, "Adeno–Associated Virus Vectors," *Curr. Opi. Biotech.* 3:533–539 (1992).

Caruthers et al., "Chemical Synthesis of Deoxyoligonucleotides and Deoxyoligonucleotide Analogs," *Methods in Enzymology* 211:3–19 (1992).

Cech, "Ribozymes and Their Medical Implications," *JAMA* 260:3030–3034 (1988).

Chartrand et al., "An oligodeoxyribonucleotide that supports catalytic activity in the hammerhead ribozyme domain," *Nucleic Acids Research* 23(20):4092–4096 (1995).

Chen et al., "Multitarget–Ribozyme Directed to Cleave at up to Nine Highly Conserved HIV–1 env RNA Regions Inhibits HIV–1 Replication–Potential Effectiveness Against Most Presently Sequenced HIV–1 Isolates," *Nucleic Acids Research* 20:4581–4589 (1992).

Chowrira et al., "In Vitro and in Vivo Comparison of Hammerhead, Hairpin, and Hepatitis Delta Virus Self–Processing Ribozyme Cassettes," *J. Biol. Chem.* 269:25856–25864 (1994).

Christoffersen and Marr, "Riobozymes as Human Therapeutic Agents," *J. Med. Chem.* 38:2023–2037 (1995) (also referred to as Christofferson and Marr).

Cload and Schepartz, "Polyether Tethered Oligonucleotide Probes," *J. Am. Chem. Soc.* 113:6324–6326 (1991).

Collins and Olive, "Reaction Conditions and Kinetics of Self–Cleavage of a Ribozyme Derived From *Neurospora* VS RNA," *Biochemistry* 32:2795–2799 (1993).

Detmar et al., "Overexpression of Vascular Permeability Factor/Vascular Endothelial Growth Factor and its Receptors in Psoriasisi," 1994 *J. Exp. Med.* 180, 1141.

Dreyfus, "Restriction Ribozymes?" *Einstein Quarterly Journal of Biology and Medicine* 6:92–93 (1988).

Dropulic et al., "Functional Characterization of a U5 Ribozyme: Intracellular Suppression of Human Immunodeficiency Virus Type I Expression," *Journal of Virology* 66:1432–1441 (1992).

Durand et al., "Circular Dichroism Studies of an Oligodeoxyribonucleotide Containing a Hairpin Loop Made of a Hexaethylene Glycol Chain: Conformation and Stability," *Nucleic Acids Research* 18:6353–6359 (1990).

Duval–Valentin, "Specific inhibition of transcription by triple helix–forming oligonucleotides," *Proc. Natl. Acad. Sci. USA* 89:504–508 (1992).

Egholm et al., "PNA hybridizes to complementary oligonucleotides obeying the Watson–Crick hydrogen–bonding rules," *Nature* 365:566–568 (1993).

Elkins and Rossi, "Ch. 2—Cellular Delivery of Ribozymes," in *Delivery Strategies for Antisense Oligonucleotide Therapeutics*, edited by Akhtar, CRC Press, pp. 17–220 (1995).

Elroy–Stein and Moss, "Cytoplasmic Expression System Based on Constitutive Synthesis of Bacteriophage T7 RNA Polymerase in Mammalian Cells," *Proc. Natl. Acad. Sci. USA* 87:6743–6747 (1990).

Fava et al., "Vascular Permeability Factor/Endothelial Growth Factor (VPF/VEGF): Accumulation and Expression in Human Synovial Fluids and Rheumatoid Synovial Tissue," 1994 *J. Exp. Med.* 180, 341.

Feldstein et al., "Two sequences participating in the autolytic processing of satellite tobacco ringspot virus complementary RNA," *Gene* 82:53–61 (1989).

Ferentz and Verdine, "Disulfied Cross–Linked Oligonucleotides," *J. Am. Chem. Soc.* 113:4000–4002 (1991).

Ferrara, "Vascular Endothelial Growth Factor," 1993 *Trends Cardiovas. Med.* 3, 2244.

Folkman and Shing, "Angiogenesis," *J. Biol. Chem.* 267:10931–10934 (1992).

Folkman, "What is the Evidence that Tumors are Angiogenesis Dependent?" *Journal of the National Cancer Institute* 82:4–6 (1990).

Folkman, "Tumor Agniogenesis" 1985 *Adv. Cancer. Res.* 43, 175.

Forster and Altman, "External Guide Sequences for an RNA Enzyme," *Science* 249:783–786 (1990).

Frier et al., 1986, *Proc. Nat. Acad. Sci. USA* 83:9373–9377.

Fong et al., "Role of the Flt–1 Receptor Tyrosine Kinase in Regulating the Assembly of Vascular Endothelium," 1995 *Nature* 376, 66 Corrected from specification.

Gao and Huang, "Cytoplasmic Expression of a Reporter Gene by Co–Delivery of T7 RNA Polymerase and T7 Promoter Sequence with Cationic Liposomes," *Nucleic Acids Research* 21:2867–2872 (1993).

Gitay–Goren et al., "The Binding of Vascular Endothelial Growth Factor to Its Receptos is Dependent on Cell Surface–associated Heparin–like Molecules," 1992 *J. Biol. Chem.* 267, 6093.

Gold et al., Diversity of Oligonucleotide Functions, *Annu. Rev. Biochem.* 64:763–797 (1995).

Grant et al., "Insulin–like growth factor I acts as an angiogenic agent in rabbit cornea and retina: comparative studies with basic fibroblast growth factor," *Diabetologia* 36:282–291 (1993).

Griffin et al., "Group II intron ribozymes that cleave DNA and RNA linkages with similar efficiency, and lack contacts with substrate 2'–hydroxyl groups," *Chemistry & Biology* 2:761–770 (1995).

Guerrier–Takada et al., "The RNA Moiety of Ribonuclease P Is the Catalytic Subunit of the Enzyme," *Cell* 35:849–857 (1983).

Hampel and Tritz, "RNA Catalytic Properties of the Minimum (–)sTRSV Sequence," *Biochemistry* 28:4929–4933 (1989).

Hampel et al., "Hairpin'Catalytic RNA Model: Evidence for Helices and Sequence Requirement for Substrate RNA," *Nucleic Acids Research* 18:299–304 (1990).

Haseloff and Gerlach, "Sequences required for self–catalysed cleavage of the satellite RNA of tobacco ringspot virus," *Gene* 82:43–52 (1989).

Haseloff and Gerlach, "Simple RNA Enzymes with New and Highly Specific Endoribonuclease Activities," *Nature* 334:585–591 (1988).

Hertel et al., "Numbering System for the Hammerhead," *Nucleic Acids Research* 20:3252 (1992).

Ishiwata et al., "Physical–Chemistry Characteristics and Biodistribution of Poly(ethylene glycol)–Coated Liposomes Using Poly(oxyethylene) Cholesteryl Ether," *Chem. Pharm. Bull.* 43:1005–1011 (1995) (mistakenly referred to as Ishiwataet).

Ishizaka et al., "Isolation of Active Ribozymes from an RNA Pool of Random Sequences Using an Anchored Substrate RNA," *Biochemical and Biophysical Research Communication* 214(2):403–409 (1995).

Izant and Weintraub, "Constitutive and Conditional Suppression of Exogenous and Endogenous Genes by Anti–Sense RNA," *Science* 229:345–352 (1985).

Jaeger et al., "Improved Predictions of Secondary Structures for RNA," *Proc. Natl. Acad. Sci. USA* 86:7706–7710 (1989).

Jaschke et al., "Automated incorporation of Polyethylene Glycol into Synthetic Oligonucleotides," *Tetrahedron Letters* 34:301–304 (1993).

Jeffries and Symons, "A Catalytic 13–mer Ribozyme," *Nucleic Acids Research* 17:1371–1377 (1989) (also referred to as Jefferies).

Jellinek et al., "Inhibitions of Receptor Binding by High–Affinity RNA Ligands to Vascular Endothelial Growth Factor," *Biochemistry* 33:10450–10456 (1994).

Joyce et al., "Amplification, mutation and selection of catalytic RNA," *Gene* 82:83–87 (1989).

Joyce, "Directed Molecular Evolution," *Scientific American* 267:90–97 (1992).

Kashani–Sabet et al., "Reversal of the Malignant Phenotype by an Anti–*ras* Ribozyme," *Antisense Research & Development* 2:3–15 (1992).

Kim and Cech, "Three–dimensional model of the active site of the self–splicing rRNA precursor of *Tetrahymena*," *Proc. Natl. Acad. Sci. USA* 84:8788–8792 (1987).

Kim et al., "Inhibition of vascular endothelial growth factor–induced angiogenesis suppresses tumour growth in vivo," *Nature* 362:841–844 (1993).

Koch et al., "Vascular Endothelial Growth Factor: A Cytokine Modulating Endothelial Function in Rheumatoid Arthritis," 1994 *J. Immunol.* 152, 4149.

Kore, et al., "Sequence specificity of the hammerhead ribozyme revisistsed; the NIH rule," *Nucleic Acids Research*, 26(18):4116–4120 (1998).

Kumar and Ellington, "Artificial evolution and natural ribozymes," *FASEB J.* 9:1183–1195 (1995).

Lasic and Needham "The 'Stealth' Liposome: A Prototypical Biomaterial," *Chemical Reviews* 95:2601–2627 (1995).

Lepri et al., "Effect of Low Molecular Weight Heparan Sulphate on Angiogenesis in the Rat Cornea after Chemical Cauterization," *Journal of Ocular Pharmacology* 10:273–281 (1994).

L'Huillier et al., "Cytoplasmic Delivery of Ribozymes Leads to Efficient Reduction in α–Lactalbumin mRNA Levels in C1271 Mouse," *EMBO J.* 11:4411–4418 (1992).

Li and Altman, "Cleavage by RNase P of gene N mRNA reduces bacteriophage λ burst size," *Nucleic Acids Research* 24:835–842 (1996).

Lieber et al., "Stable High–Level Gene Expression in Mammalian Cells by T7 Phage RNA Polymerase," *Methods Enzymol.* 217:47–66 (1993).

Limbach et al., "Summary: the modified nucleosides of RNA," *Nucleic Acids Research* 22(12):2183–2196 (1994).

Lisziewicz et al., "Inhibition of Human Immunodeficiency Virus Type 1 Replication by Regulated Expression of a Polymeric Tat Activation Response RNA Decoy as a Strategy for Gene Therapy in AIDS," *Proc. Natl. Acad. Sci. U.S.A.* 90:8000–8004 (1993).

Liu et al., "Cationic Liposome–mediated Intravenous Gene Delivery," *J. Biol. Chem.* 270(42):24864–24870 (1995).

Long and Uhlenbeck, "Kinetic characterization of intramolecular and intermolecular hammerhead RNAs with stem II deletions," *Proc. Natl. Acad. Sci. USA* 91:6977–6981 (1994).

Ma et al., "Design and Synthesis of RNA Miniduplexes via a Synthetic Linker Approach," *Biochemistry* 32:1751–1758 (1993).

Ma et al., "Design and Synthesis of RNA Miniduplexes via a Synthetic Linker Approach. 2. Generation of Covalently Closed, Double–Stranded Cyclic HIV–1 TAR RNA Analogs with High Tat–Binding Affinity," *Nucleic Acids Research* 21:2585–2589 (1993).

Mathews et al., "A Receptor Tyrosine Kinase cDNA Isolated from a Population of Enriched Primitive Hematopoietic cells and Exhibiting Close Genetic Linkage of c–kit," 1991, *Proc. Natl. Acad. Sci.*, USA, 88, 9026.

McCurdy et al., "Deoxyoligonucleotides with Inverted Polarity: Synthesis and Use in Triple–Helix Formation" *Nucleosides & Nucleotides* 10:287–290 (1991).

McGarry and Lindquist, "Inhibition of heat shock protein synthesis by heat–inducible antisense RNA," *Proc. Natl. Acad. Sci. USA* 83:399–403 (1986).

Michels and Pyle, "Conversion of a Group II Intron into a New Multiple–Turnover Ribozyme that Selectively Cleaves Oligonucleotides: Elucidation of Reaction Mechanism and Structure/Function Relationships," *Biochemistry* 34:2965–2977 (1995).

Millauer et al., "Glioblastoma Growth Inhibited in vivo by a Dominant–negative Flk–1 Mutant," 1994, *Nature* 367, 576.

Millauer, "High Affintiy VEGF Binding and Developmental Expression Suggest Flk–1 as a Major Regulator of Vasculogenesis and Angiogenesis," *Cell* 72:835–846 (1993).

Miller et al., "Vascular Endothelial Growth Factor/Vascular Permeability Factor is Temporally and Spatially Correlated with Ocular Angiogenesis in a Primate Model," 1994 *Am. J. Pathol.* 145, 574.

Mitra et al., "A mammalian 2–5A system functions as an antiviral pathway in transgenic plants," *Proc. Natl. Acad. Sci. USA* 93:6780–6785 (1996).

Mukhopadhyay et al., "Antisense Regulation of Oncogenes in Human Cancer," *Critical Reviews in Oncogenesis* 7:151–190 (1996).

Nakamaye and Eckstein, "AUA–Cleaving Hammerhead Ribozymes: Attempted Selection for Improved Cleavage," *Biochemistry* 33:1271–1277 (1994.

Nathans and Smith, "Restriction Endonucleases in the Analysis and Restructuring of DNA Molecules," *Ann. Rev. Biochem.* 44:273–293 (1975).

Neufeld et al., "Vascular Endothelial Growth Factor and Its Receptors," *Progress in Growth Factor Research* 5:89–97 (1994).

Norrby, 1997, *APMIS* 105, 417–437.

Ohkawa et al., "Activities of HIV–RNA Targeted Ribozymes Transcribed From a 'Shot–Gun' Type Ribozyme–trimming Plasmid," *Nucleic Acids Symp. Ser.* 27:15–16 (1992).

Ojwang et al., "Inhibition of Human Immunodeficiency Virus Type 1 Expression by a Hairpin Ribozyme," *Proc. Natl. Acad. Sci. USA* 89:10802–10806 (1992).

Oku et al., "Real–time analysis of liposomal trafficking in tumor–bearing mice by use of positron emission tomography," *Biochimica et Biophysica Acta* 1238:86–90 (1995).

Ono et al., "DNA Triplex Formation of Oligonucleotide Analogues Consisting of Linker Groups and Octamer Segments That Have Opposite Sugar–Phosphate Backbone Polarities," *Biochemistry* 30:9914–9921 (1991).

O'Reilly et al., "Angiostatin: A Novel Angiogenesis Inhibitor That Mediates the Suppression of Metastases by a Lewis Lung Carcinoma," *Cell* 79:315–328 (1994).

Orgel, "Selection in vitro," *Proc. R. Soc. London B.* 205:435–442 (1979).

Ormerod et al., "Effects of Altering the Eicosanoid Precursor Pool on Neovascularization and Inflammation in the Alkali–burned Rabbit Cornea," *American Journal of Pathology* 137:1243–1252 (1990).

Pandey et al., "Role ov B61, the Ligand for the Eck Receptor Tyrosine Kinase, in TNF– α–Induced Angiogenesis," *Science* 268:567–569 (1995).

Passaniti et al., "A Simple, Quantitative Method for Assessing Angiogenesis and Antiangiogenic Agents Using Reconstituted Basement Membrane, Heparin, and Fibroblast Growth Factor," *Laboratory Investigation* 67:519–528 (1992).

Perreault et al., "Mixed Deoxyribo– and Ribo–Oligonucleotides with Catalytic Activity," *Nature* 344:565–567 (1990) (often mistakenly listed as Perrault).

Perrotta and Been, "Cleavage of Oligoribonucleotides by a Ribozyme Derived from the Hepatitis Δ Virus RNA Sequence," *Biochemistry* 31:16–21 (1992).

Pieken et al., "Kinetic Characterization of Ribonuclease–Resistant 2'–Modified Hammerhead Ribozymes," *Science* 253:314–317 (1991).

Pierce et al., "Vascular endothelial growth factor/vascular permeability factor expression in a mouse model of retinal neovascularization," *Proc. Natl. Acad. Sci. USA* 92:905–909 (1995).

Plouet et al., "Isolation and Characterization of a Newly Identified Endothelial Cell Mitogen Produced by AtT–20 Cells," 1989 *EMBO J.* 8, 3801.

Richardson and Schepartz, "Tethered Oligonucleotide Probes. A Strategy for the Recognition of Structured RNA," *J. Am. Chem. Soc.* 113:5109–5111 (1991).

Robinson et al., "Oligodeozynucleotides Inhibit Retinal Neovascularization in a Murine Model of Proliferation Retinopathy," *Proc. Natl. Acad. Sci. USA* 93: 4851–4856 (1996).

Rossi et al., "Ribozymes as Anti–HIV–1 Therapeutic Agents: Principles, Applications, and Problems," *Aids Research and Human Retroviruses* 8:183–189 (1992).

Santoro and Joyce, "A general purpose RNA–cleaving DNA enzyme," *Proc. Natl. Acad. Sci. USA* 94:4262–4266 (1997).

Sarver et al., "Ribozymes as Potential Anti–HIV–1 Therapeutic Agents" *Science* 247:1222–1225 (1990).

Saville and Collins, "A Site–Specific Self–Cleavage Reaction Performed by a Novel RNA in Neurospora Mitochondria," *Cell* 61:685–696 (1990).

Saville and Collins, "RNA–Mediated Ligation of Self–Cleavage Products of a *Neurospora* Mitochondrial Plasmid Transcript," *Proc. Natl. Acad. Sci. USA* 88:8826–8830 (1991).

Scanlon et al., "Ribozyme–Mediated Cleavage of c–fos mRNA Reduces Gene Expression of DNA Synthesis Enzymes and Metallothionein," *Proc. Natl. Acad. Sci. USA* 88:10591–10595 (1991).

Scaringe et al., "Chemical synthesis of biologically active oligoribonucleotides using β–cyanoethyl protected ribonucleoside phosphoramidites," *Nucl Acids Res.* 18:5433–5441 (1990).

Seela and Kaiser, "Oligodeoxyribonucleotides containing 1,3–propanediol as nucleoside substitute," *Nucleic Acids Research* 15:3113–3129 (1987).

Senger et al., "Vascular permeability factor (VPF, VEGF) in tumor biology," *Cancer and Matastasis Reviews* 12:303–324 (1993).

Shalaby et al., "Failure of Blood–island Formation and Vasculogenesis in Flk–1–deficient Mice," 1995 *Nature* 376, 62.

Shweiki et al., "Patterns of Expression of Vascular Endothelial Growth Factor (VEGF) and VEGF Receptors in Mice Suggest a Role in Hormonally Regulated Angiogenesis," 1993 *Clin. Invest.* 91:2235–2243.

Stein and Cheng, "Antisense Oligonucleotides as Therapeutic Agents—Is the Bullet Really Magical?" *Science* 261:1004–1288 (1993).

Szostak, "In Vitro Genes," *TIBS* 17:89–93 (1993).

Szostak and Ellington, "Ch. 20—In Vitro Selection of Functional RNA Sequences," in *The RNA World*, edited by Gesteland and Atkins, Cold Spring Harbor Laboratory Press, pp. 511–533 (1993).

Taira et al., "Construction of a novel RNA–transcript–trimming plasmid which can be used both in vitro in place of run–off and (G)–free transcriptions and in vivo as multi–sequences transcription vectors," *Nucleic Acids Research* 19:5125–5130 (1991).

Takahashi et al., "Markedly Increased Amounts of Messenger RNAs for Vascular Endothelial Growth Factor and Placenta Growth Factor in Renal Cell Carcinoma Associated with Angiogenesis," *Cancer Research* 54:4233–4237 (1994).

Takeshita et al., "Therapeutic Angiogenesis: A Single Intraarterial Blous of Vascular Endothelial Growth Factor Augments Revascularization in a Rabbit Ischemic Hind Limb Model," 1995 *J. Clin. Invest.* 93, 662 Corrected from Specification.

Tang et al., "Examination of the catalytic fitness of the hammerhead ribozyme by in vitor selection," *RNA* 3:914–925 (1997).

Terman et al., "Identification of a New Endothelial Cell Growth Factor Receptor Tyrosine Kinase," 1991 *Oncogene* 6, 1677.

Thompson et al., "Improved accumulation and activity of ribozymes expressed from a tRNA–based RNA polymerase III promoter," *Nucleic Acids Research* 23:2259–2268 (1995).

Torrence et al., "Targeting RNA for degradation with a (2'–5') oligoadenylate–antisense chimera," *Proc. Natl. Acad. Sci. USA* 90:1300–1304 (1993).

Turner et al., "Free Energy Increments for Hydrogen Bonds in Nucleic Acid Base Pairs," *J. Am. Chem. Soc.* 109:3783–3785 (1987).

Turner et al., "Improved Parameters for Prediction of RNA Structure," *Cold Spring Harbor Symposia on Quantitative Biology* vol. Lii, pp. 123–133 (1987).

Uhlenbeck, "A Small Catalytic Oligoribonucleotide," *Nature* 328:596–600 (1987).

Usman and Cedergren, "Exploiting the chemical synthesis of RNA," *TIBS* 17:334–339 (1992) (Corrected from Specification).

Usman and McSwiggen, "Ch. 30—Catalytic RNA (Ribozymes) as Drugs," *Annual Reports in Medicinal Chemistry* 30:285–294 (1995).

Usman et al., "Automated Chemical Synthesis of Long Oligoribonucleotides Using 2'–O–Silylated Ribonucleoside 3'–O–Phosphoramidites on a Controlled–Pore Glass Support: Synthesis of a 43–Nucleotide Sequence Similar to the 3'–Half Molecule of an *Escherichia coli* Formylmethoionine tRNA," *J. Am. Chem. Soc.* 109:7845–7854 (1987).

Usman et al., "Chemical modification of hammerhead ribozymes: activity and nuclease resistance," *Nucleic Acids Syposium Series* 31:163–164 (1994).

Vaish et al., "Isolation of Hammerhead Ribozymes with Altered Core Sequences by in Vitro Selection," *Biochemistry* 36:6495–6501 (1997).

Vaisman et al., "Characterization of the Receptors for Vascular Endothelial Growth," 1990 *J. Biol. Chem.* 265, 19461.

Ventura et al., "Activation of HIV–Specific Ribozyme Activity by Self–Cleavage," *Nucleic Acids Research* 21:3249–3255 (1993).

Weerasinghe et al., "Resistance to Human Immunodeficiency Virus Type 1 (HIV–1) Infection in Human CD4+ Lymphocyte–Derived Cell Lines Conferred by Using Retroviral Vectors Expressing an HIV–1 RNA–Specific Ribozyme," *Journal of Virology* 65:5531–5534 (1994) (Correction from Specification).

Weckbecker et al., 1992, *Angiogenesis: Key principles–Science–Technology–Medicine*, ed R. Steiner).

Wincott et al., "Synthesis, deprotection, analysis and purification of RNA and ribozymes," *Nucleic Acids Research* 23(14):2677–2684 (1995).

Yu et al., "A Hairpin Ribozyme Inhibits Expression of Diverse Strains of Human Immunodeficiency Virus Type 1," *Proc. Natl. Acad. Sci. USA* 90:6340–6344 (1993).

Zabner et al., "Adenovirus–Mediated Gene Transfer Transiently Corrects the Chloride Transport Defect in Nasal Epithelia of Patients with Cystic Fibrosis," *Cell* 75:207–216 (1993).

Zaug et al., "The *Tetrahymena* Ribozyme Acts Like an RNA Restriction Endonuclease," *Nature* 324:429–433 (1986).

Zhou et al., "Synthesis of Functional mRNA in Mammalian Cells by Bacteriophage T3 RNA Polymerase," *Mol. Cell. Biol.* 10:4529–4537 (1990).

Ziche et al., "Angiogenesis Can Be Stimulated or Repressed In vivo by a Change in GM3:GD3 Ganglioside Ratio" 1992 *Lab. Invest.* 67:711–715.

Pierce, "Regulation of Vascular Endothelial Growth Factor by Oxygen in a Model of Retinopathy of Prematurity," Archives of Ophthalmology 114: 1219–1228 (1996).

Shibuya et al., "Nucleotide sequence and expression of a novel human receptor–type tyrosine kinase gene (*flt*) closely related to the *fms* family," *Oncogene* 5:519–524 (1990).

Usman et al., "Chemical modification of hammerhead ribozymes: activity and nuclease resistance," *Nucleic Acids Syposium Series* 31:163–164 (1994).

Parry et al. 1999. "Bioactivity of anti–angiogenic ribozymes targeting *Flt*–1 and *KDR* mRNA," *Nucleic Acid Res.* 27:2569–77.

U.S. Appl. No. 60/005974, filed Oct. 26, 1995, Pavco et al.

U.S. Appl. No. 60/082404, filed Apr. 20, 1998, Thompson et al.

U.S. Appl. No. 60/101171, filed Sep. 21, 1998, Hartman et al.

* cited by examiner

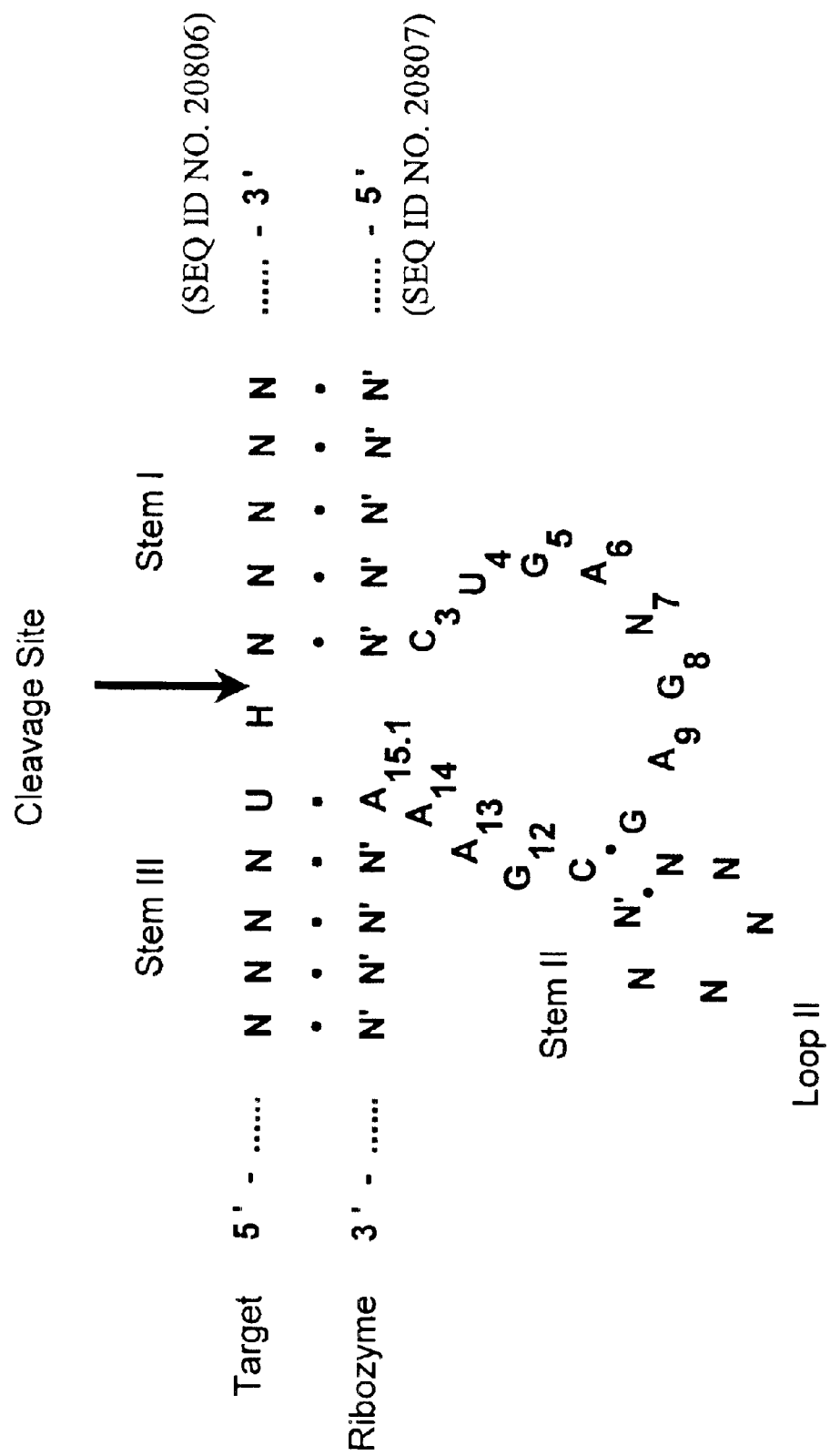
Figure 1: Hammerhead Ribozyme

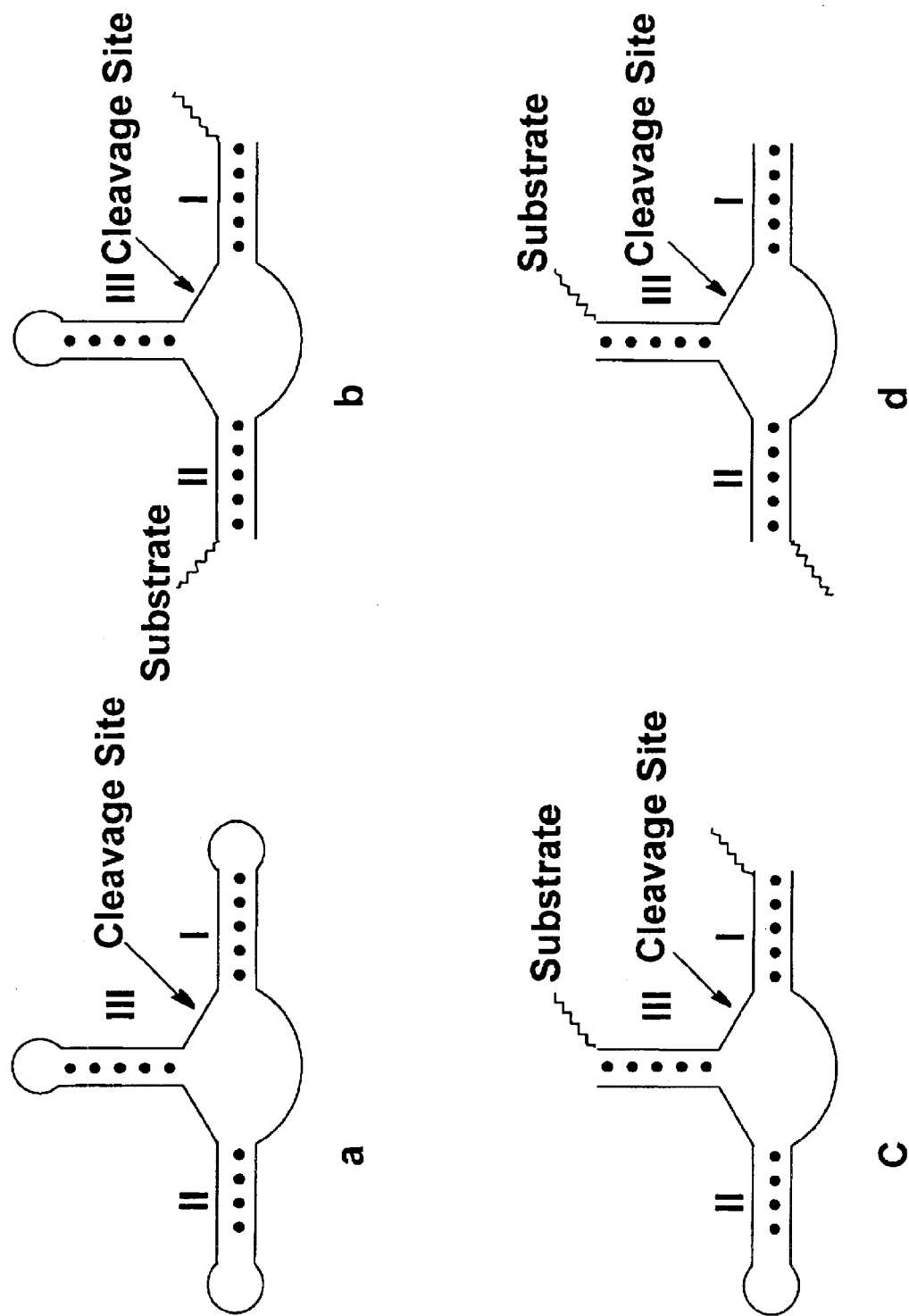
Figure 2. Hammerhead Ribozyme Substrate Motifs

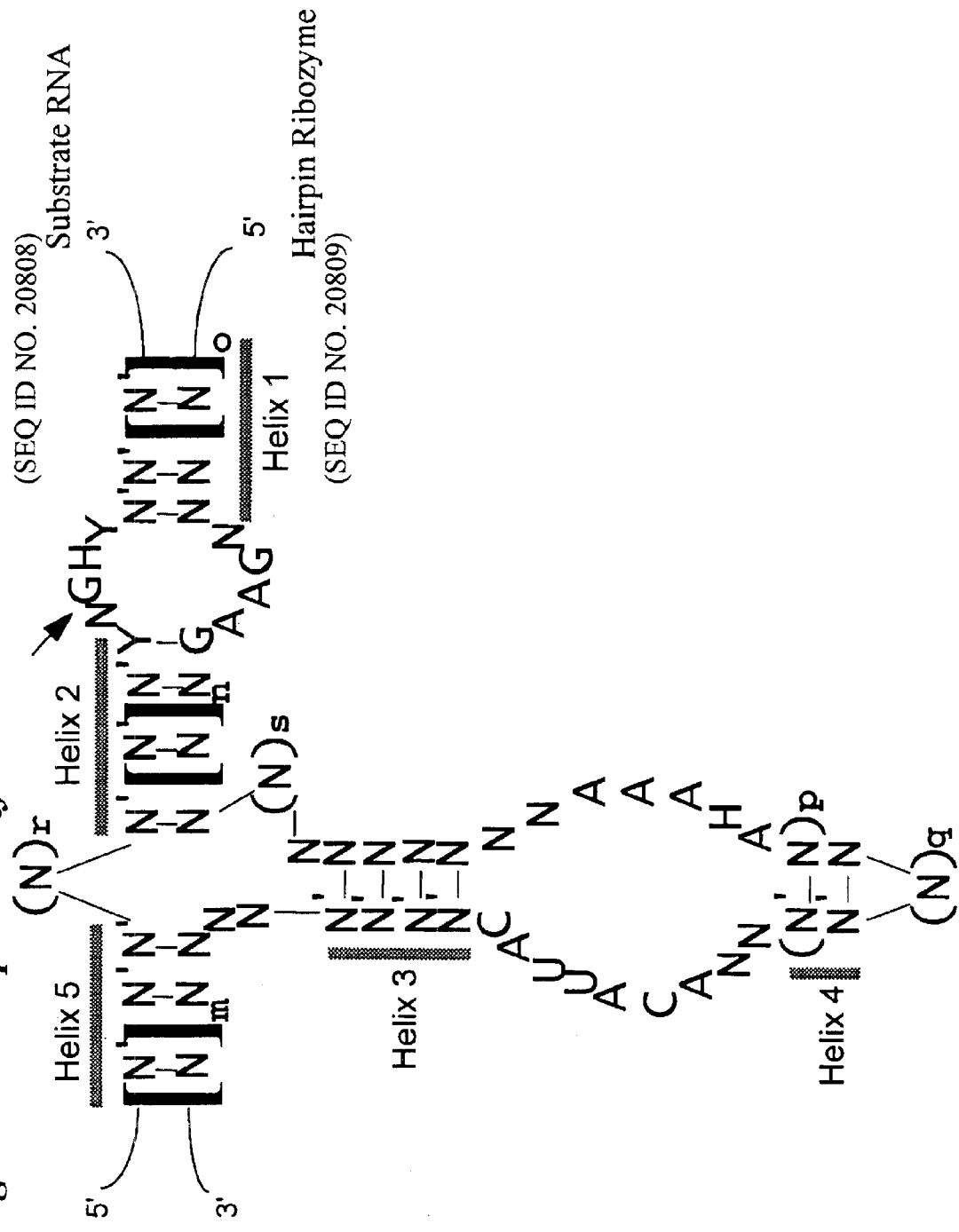
Figure 3: Hairpin Ribozyme

Figure 4: Hepatitis Delta Virus Ribozyme
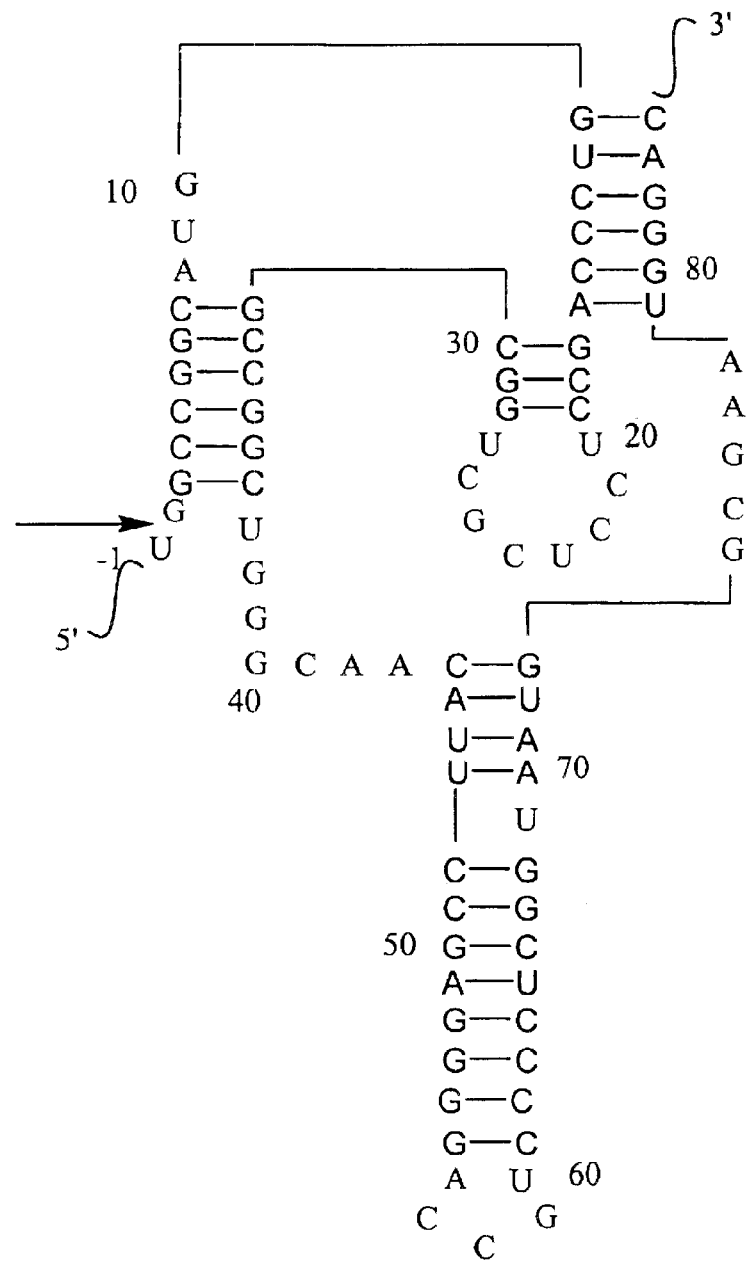
(SEQ ID NO 20810)

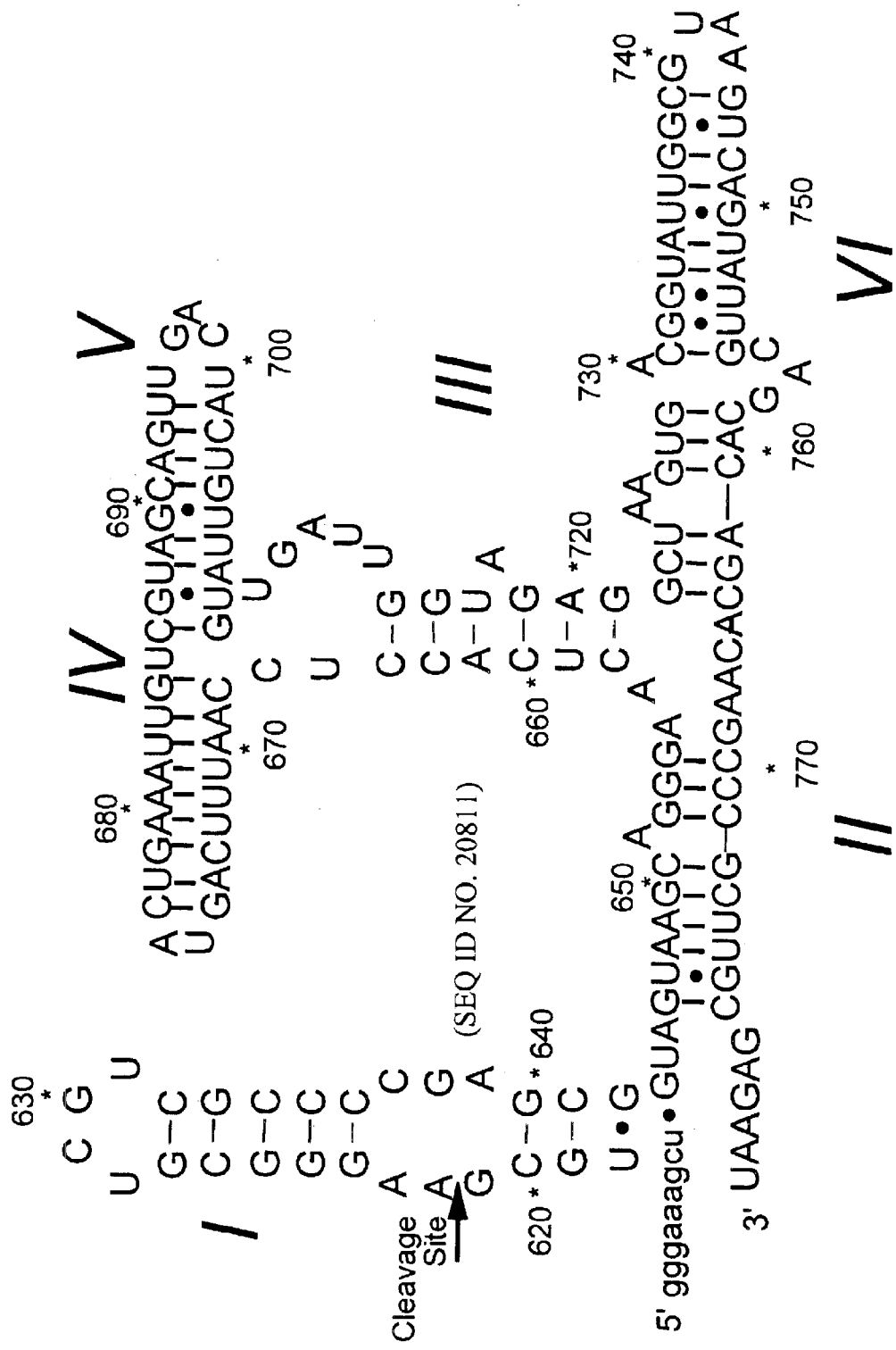
Figure 5. Neurospora vs Ribozyme

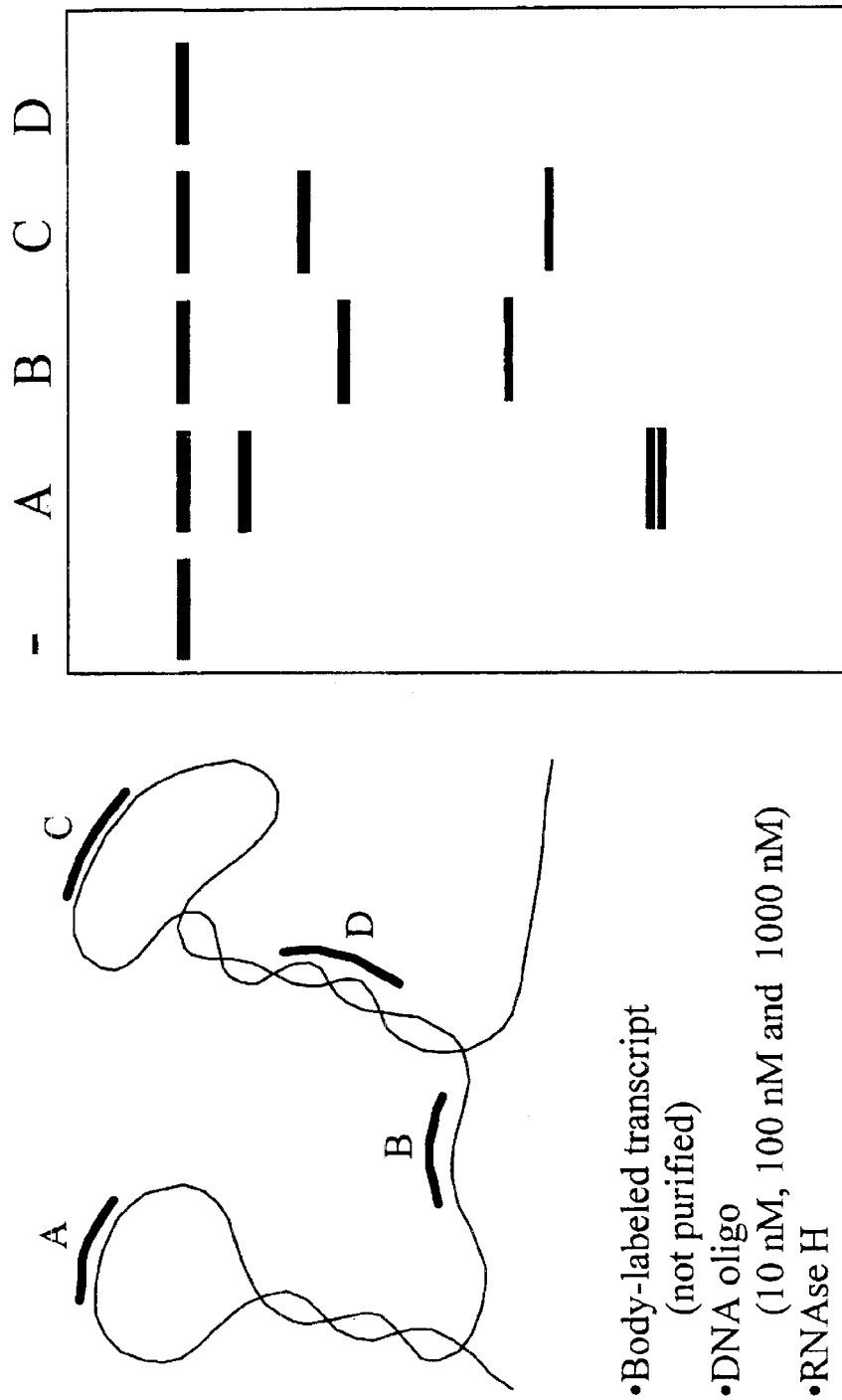
Figure 6: RNase H Assay

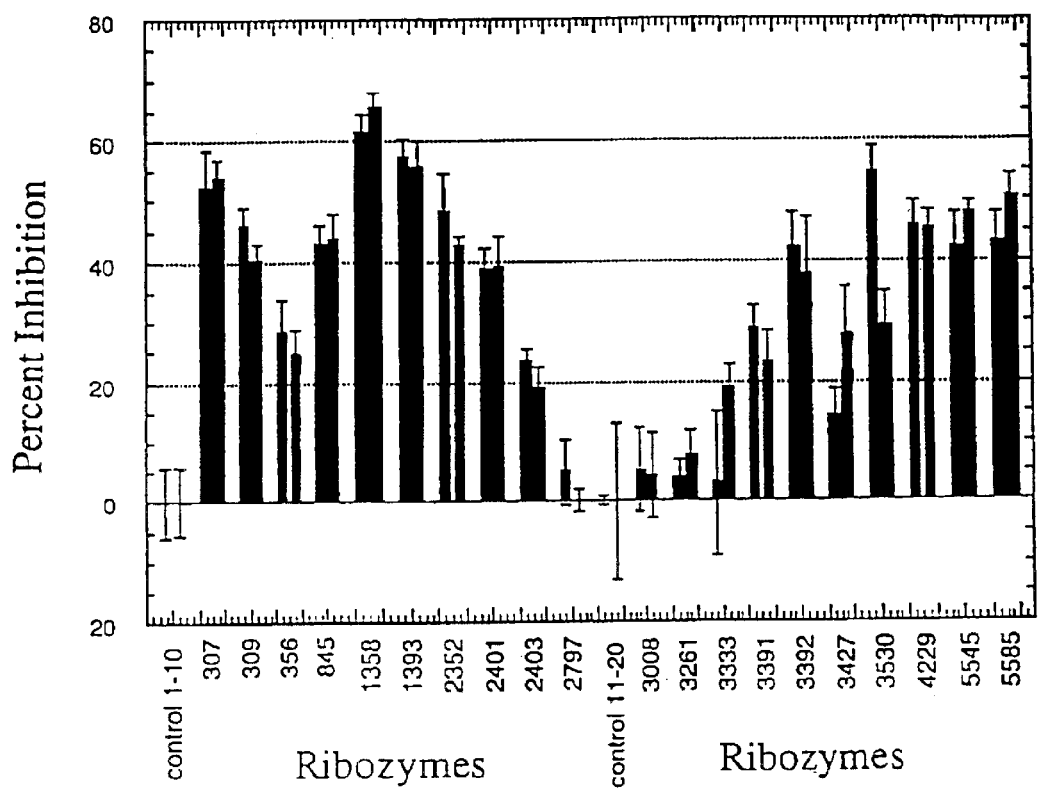
Figure 7: Anti-FLT Ribozyme-Mediated Inhibition of VEGF Binding to FLT Receptor (Human Microvascular Endothelial Cells)

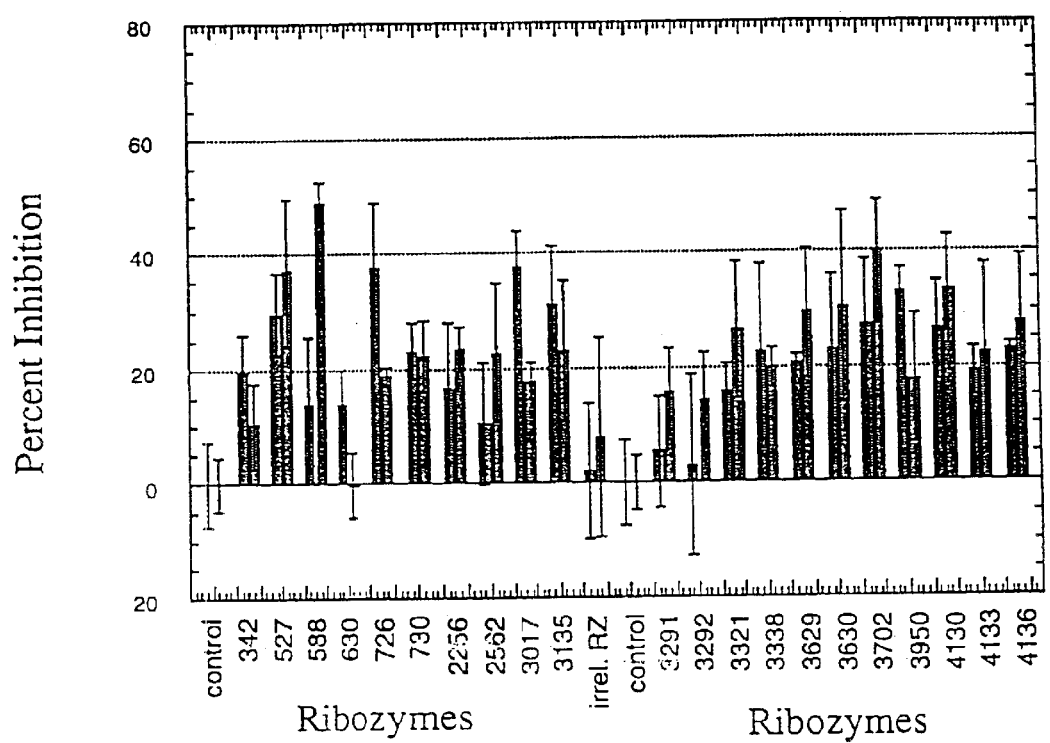
Figure 8: Anti-KDR Ribozyme-Mediated Inhibition of VEGF Binding to KDR Receptor (Human Microvascular Endothelial Cells)

Figure 9: Specificity of Anti-FLT Ribozyme-Mediated Inhibition of VEGF Binding
(Human Microvascular Endothelial Cells)
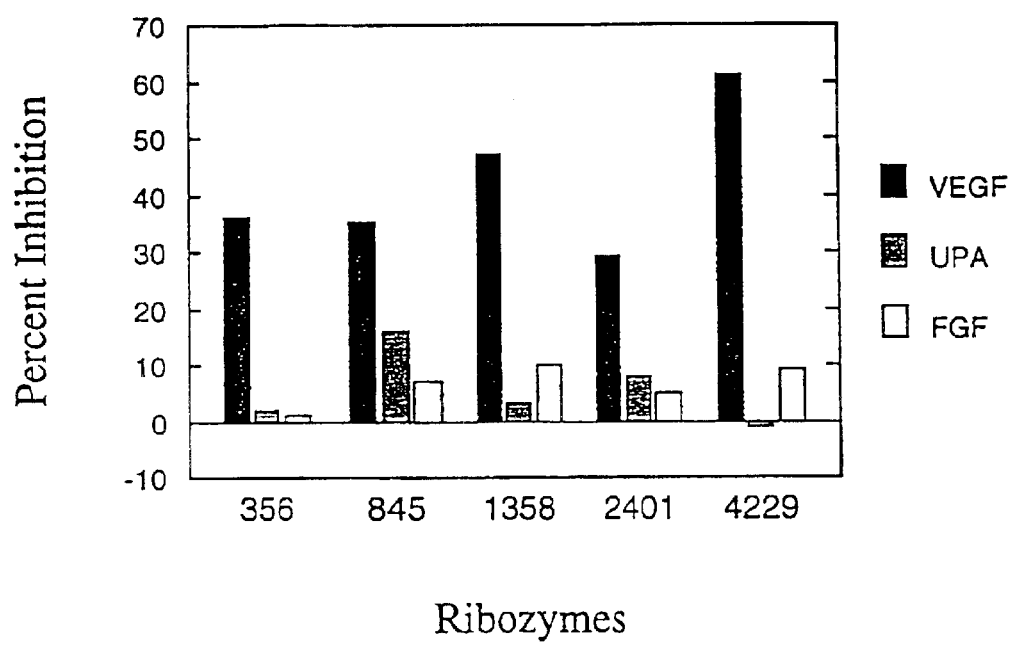

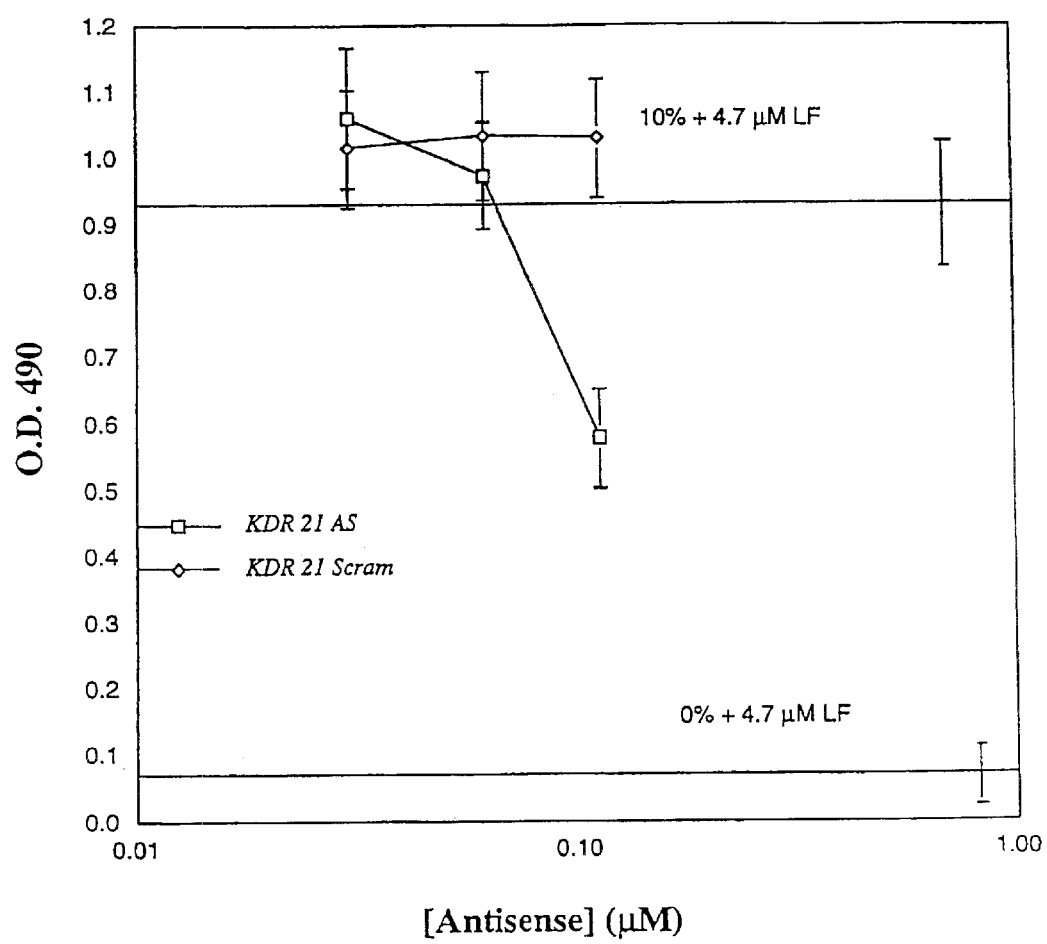
Figure 10: Anti-KDR Antisense-Mediated Inhibition of Human aortic endothelial cell (HAEC) Proliferation

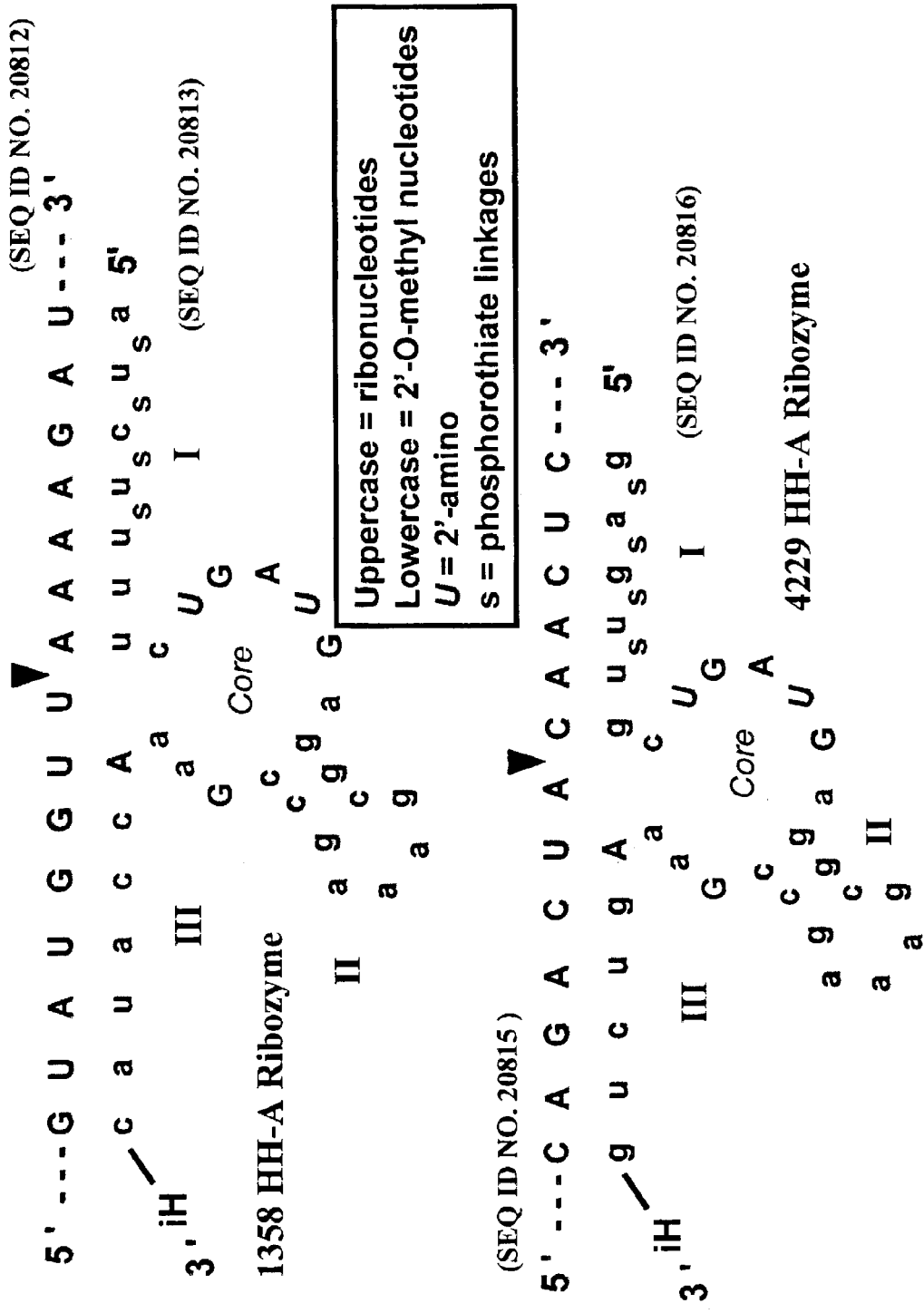
Figure 11A: Hammerhead Ribozymes Targeted Against flt-1 RNA

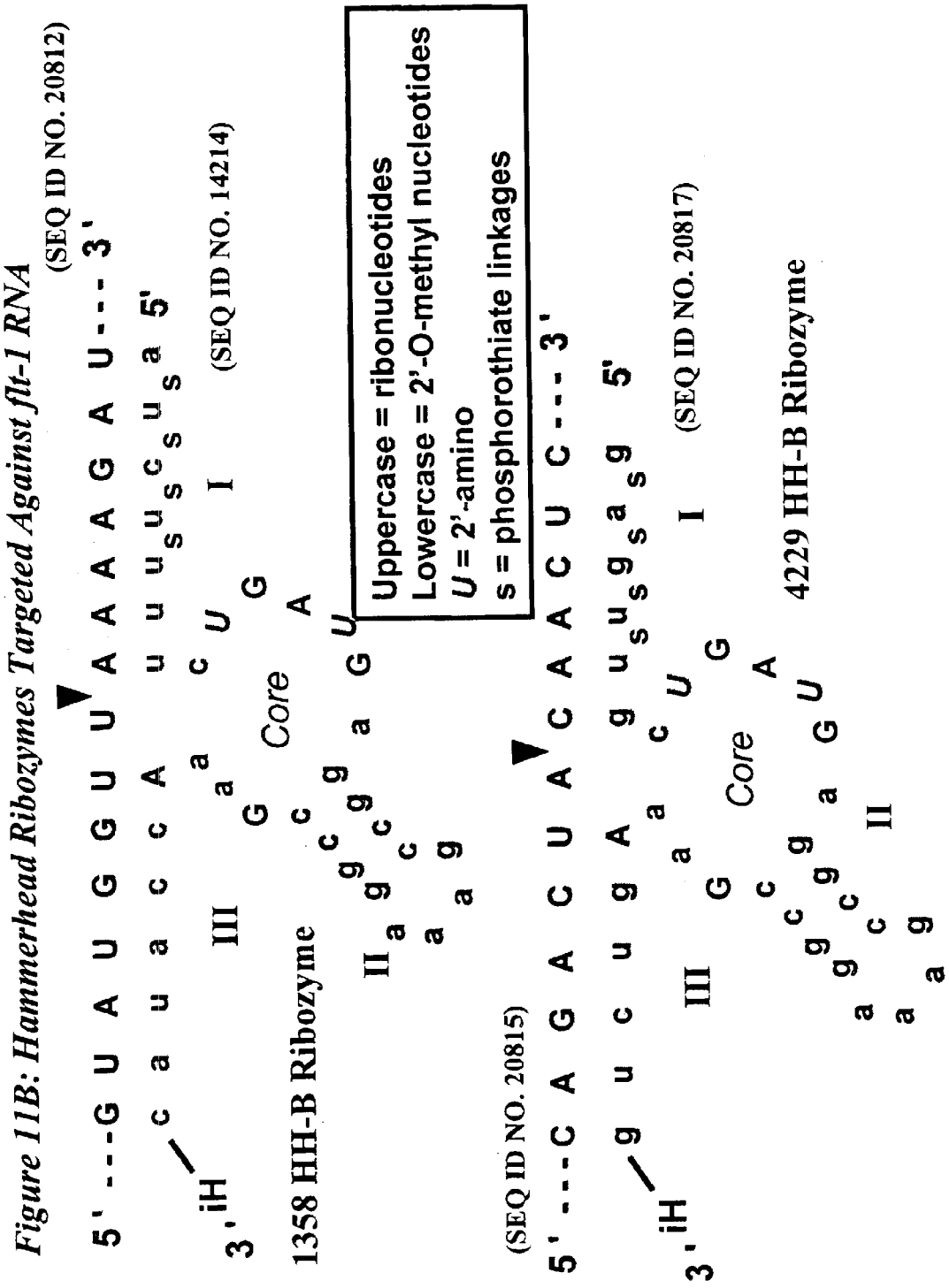
Figure 11B: Hammerhead Ribozymes Targeted Against flt-1 RNA

Figure 11C: Cleavage of flt-1 RNA by 1358 HH Ribozymes
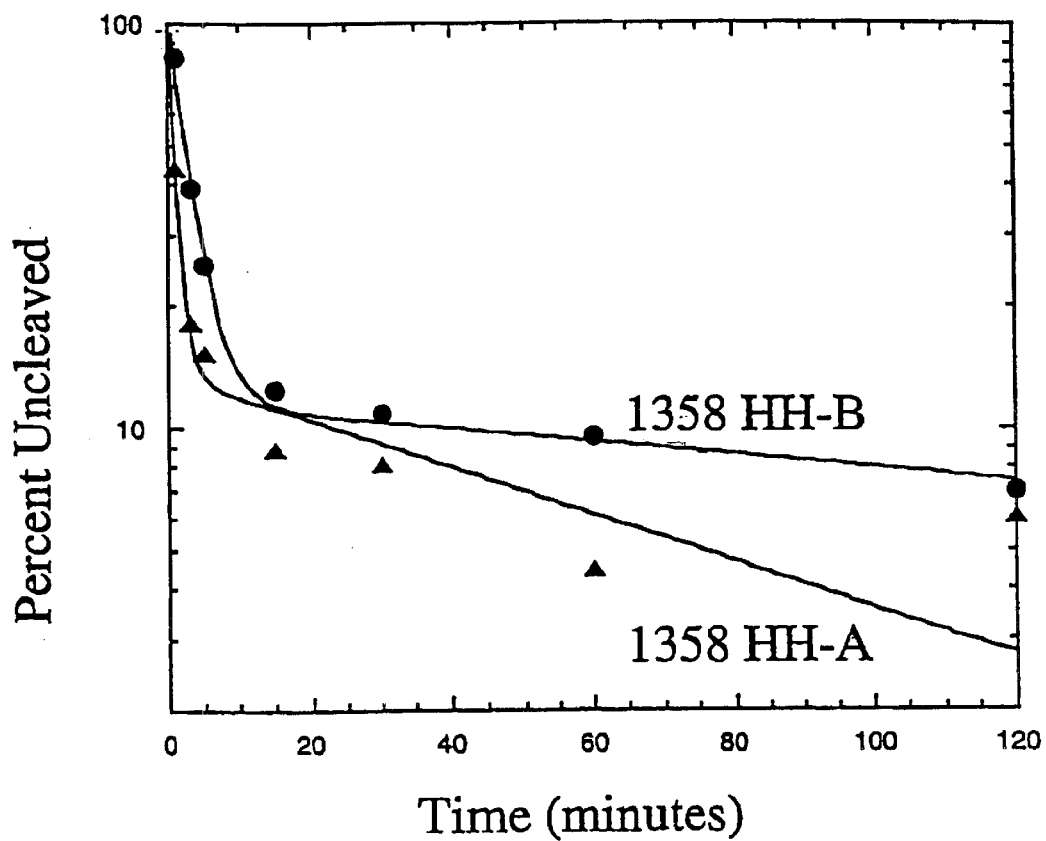
[Ribozyme] = 40 nM   [Substrate] = ~1nM Figure 11D : Cleavage of flt-1 RNA by 4229 HH Ribozymes
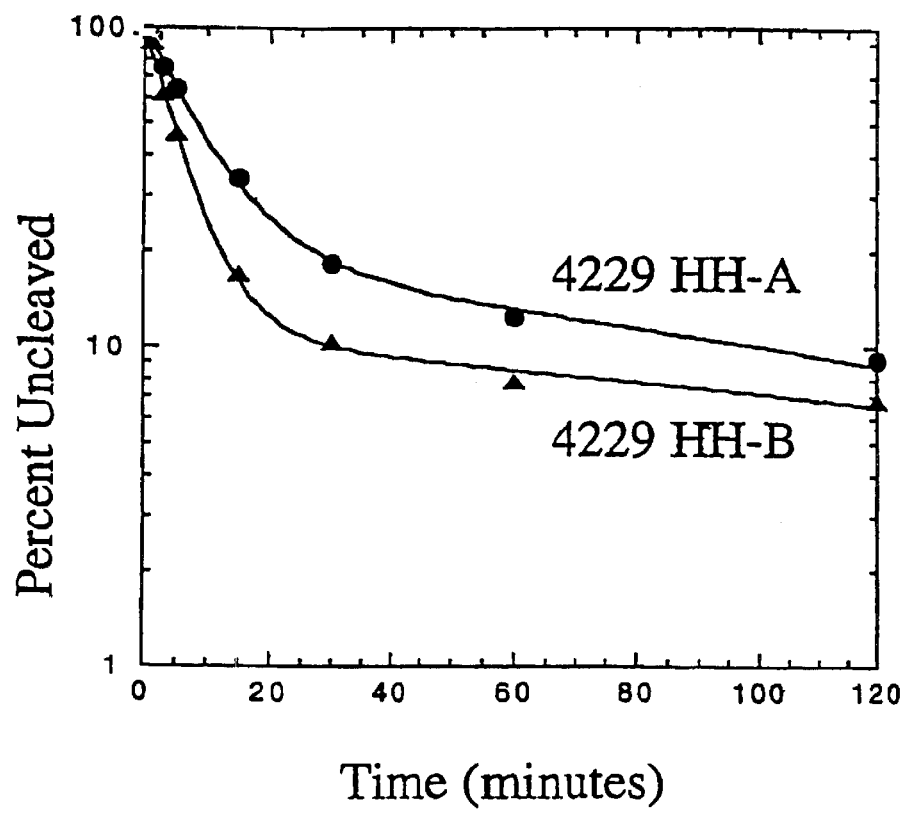
[Ribozyme] = 40 nM   [Substrate] = ~1nM

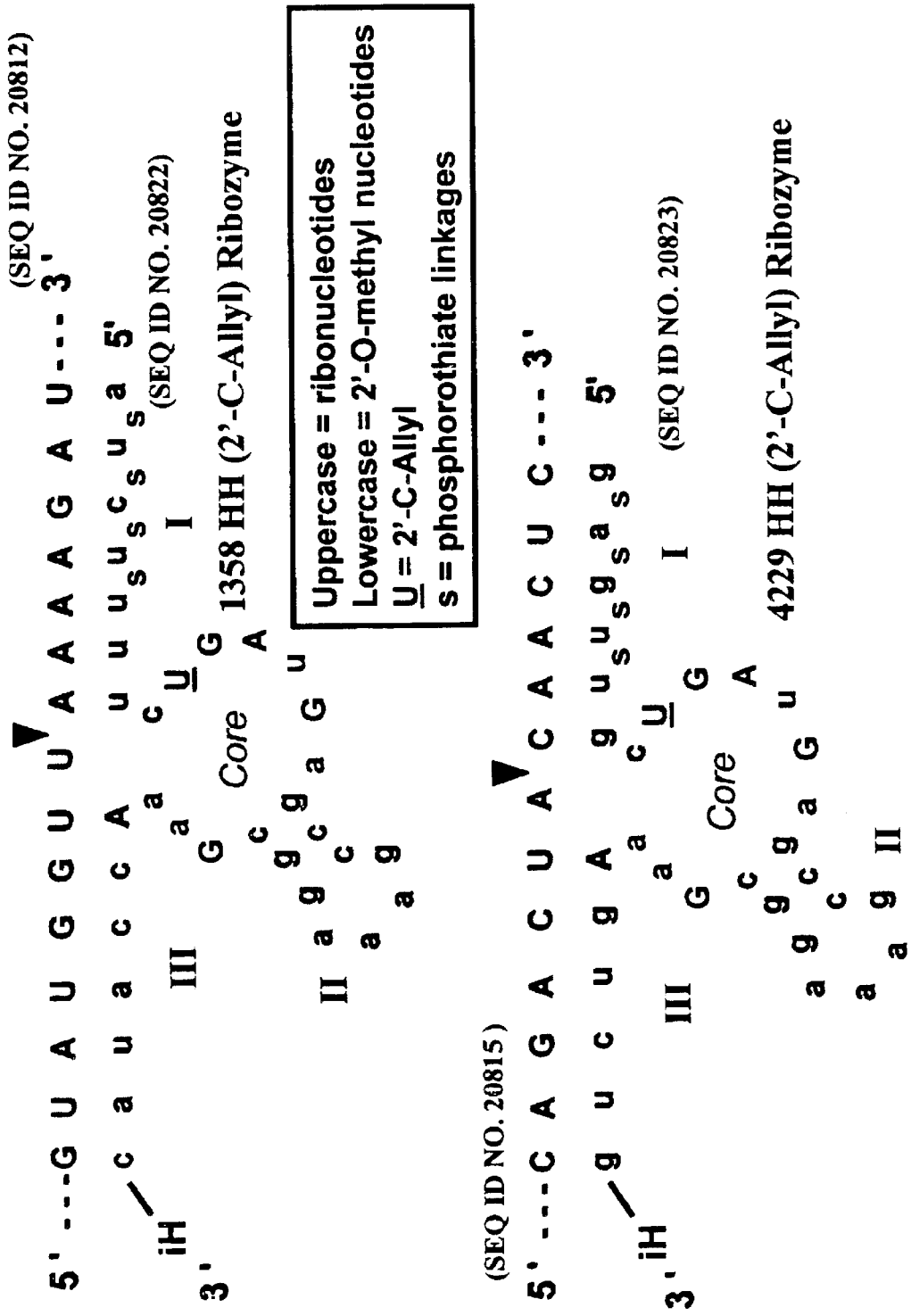
Figure 12A: Hammerhead Ribozymes Targeted Against flt-1 RNA

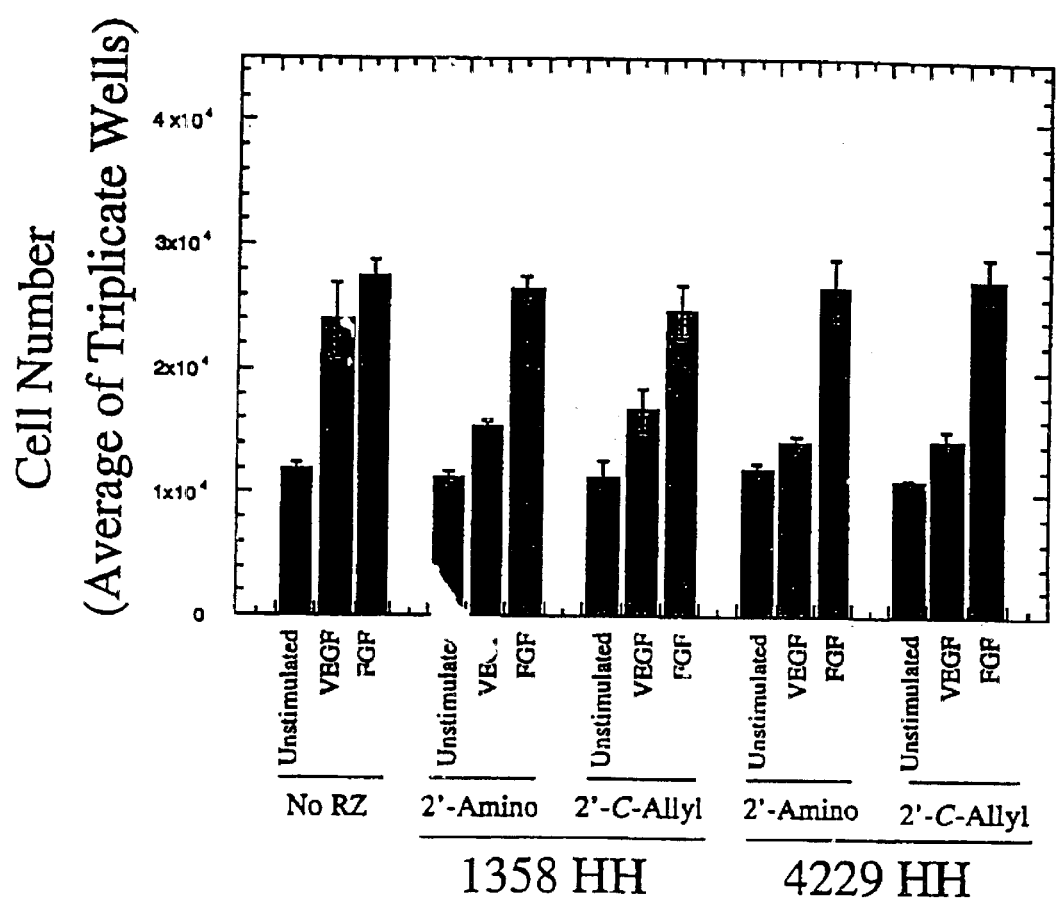
Figure 12B: Anti-flt-1 Ribozyme-Mediated Inhibition of Cell Proliferation

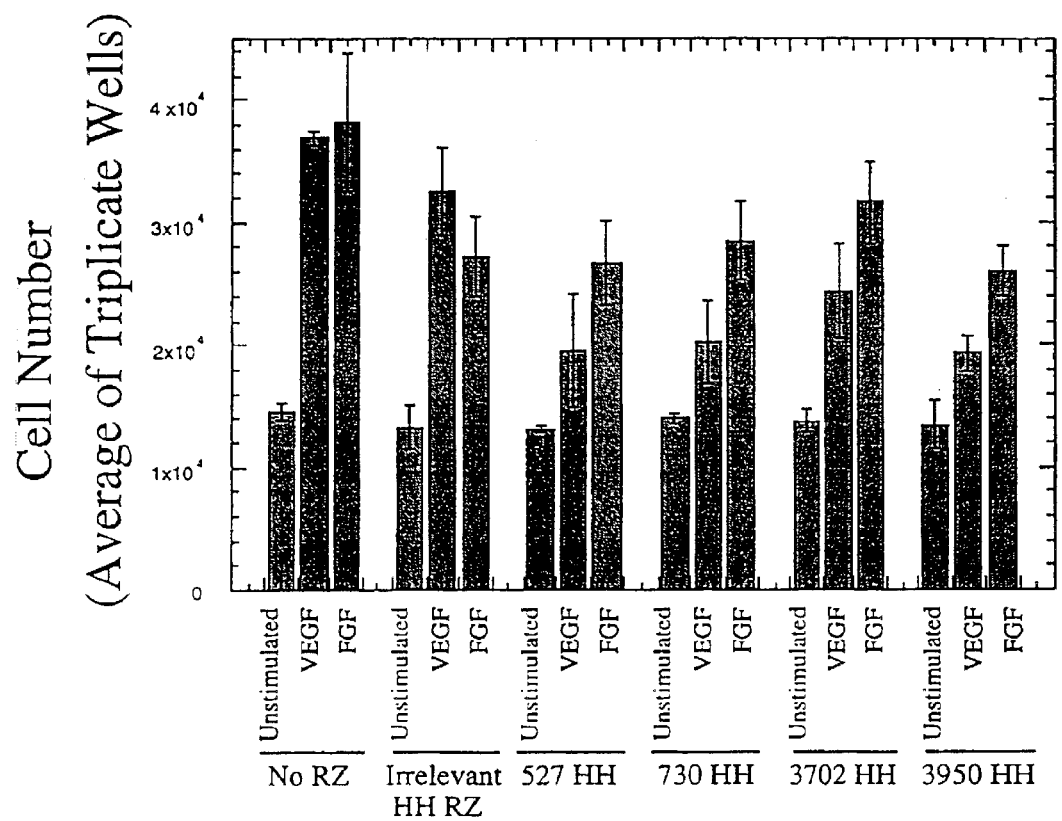
Figure 13: Anti-KDR Ribozyme-Mediated Inhibition of Cell Proliferation

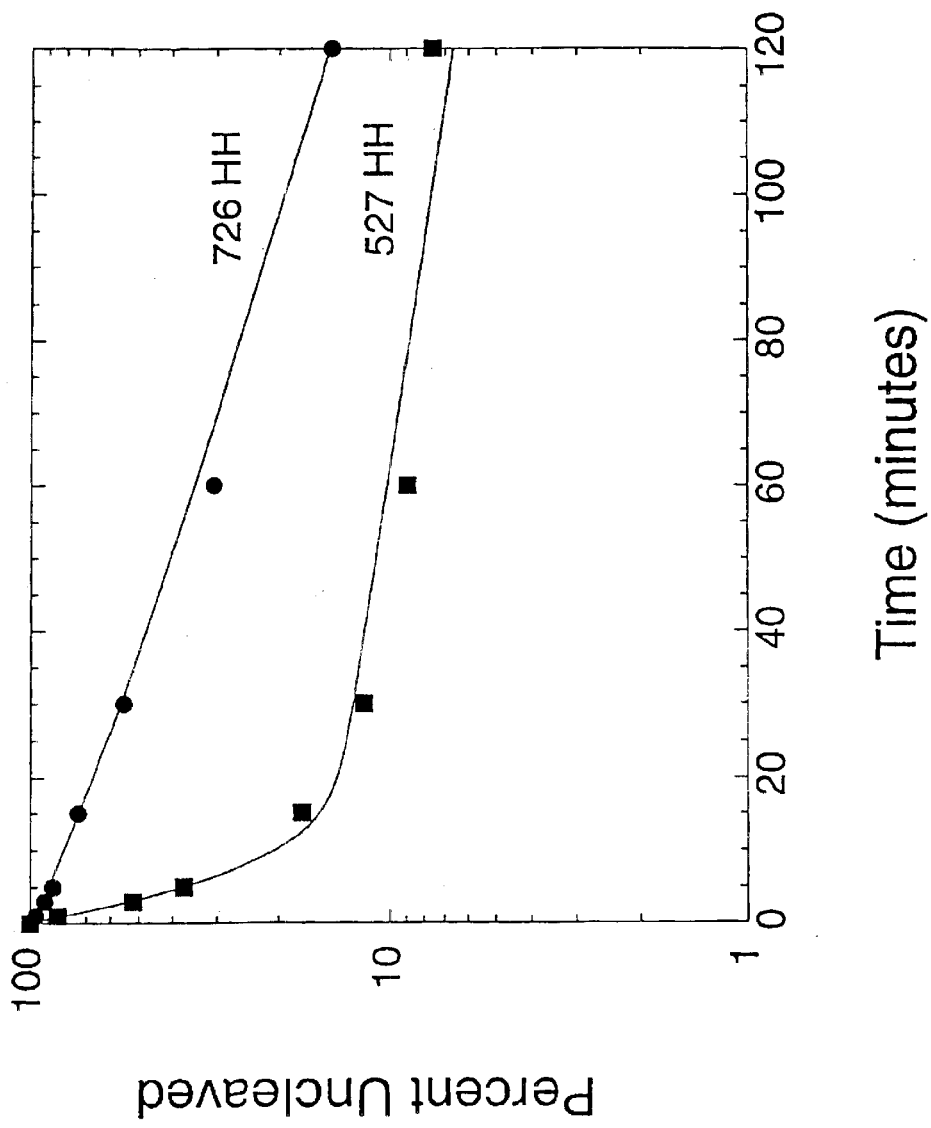
Figure 14: Cleavage of KDR RNA by Hammerhead Ribozymes

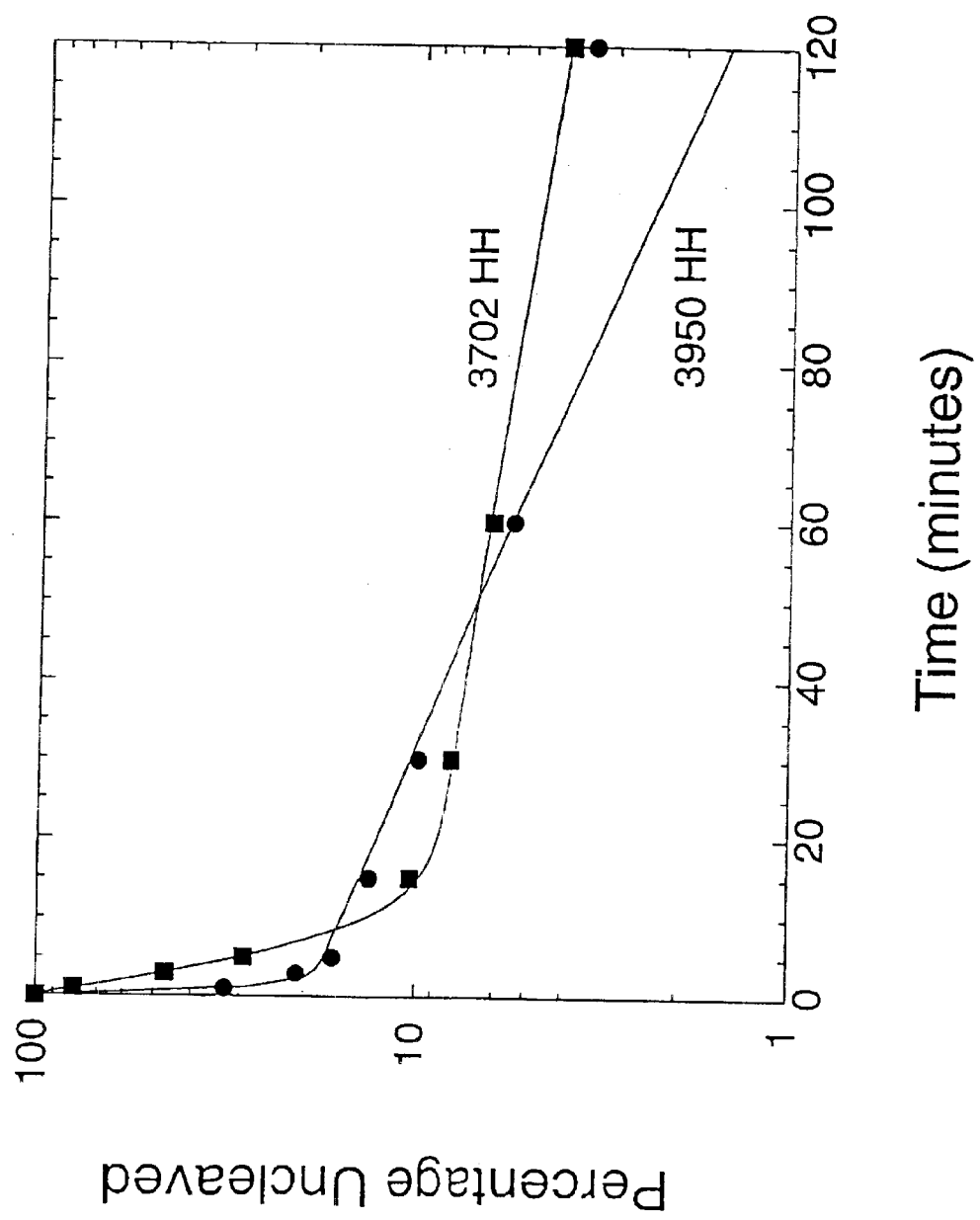
Figure 15: Cleavage of KDR RNA by Hammerhead ribozymes

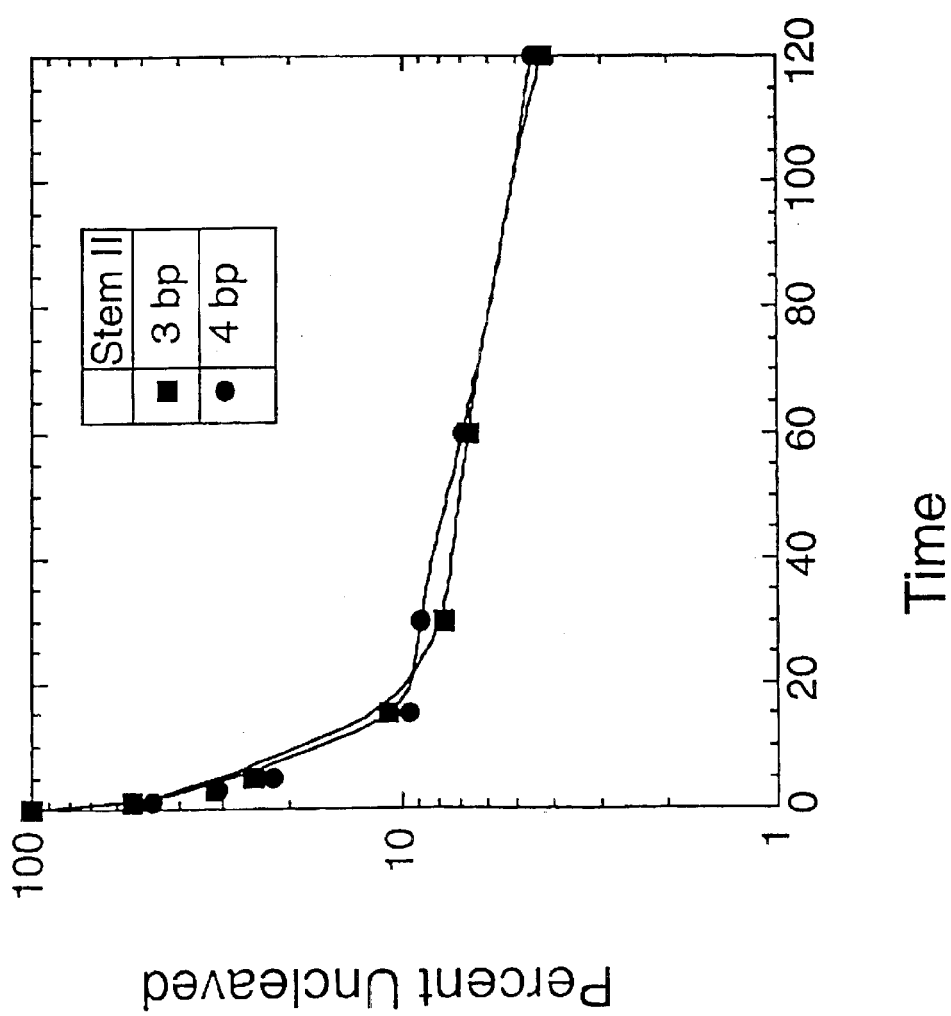
Figure 16: RNA Cleavage by FLT/KDR-I Hammerhead Ribozyme

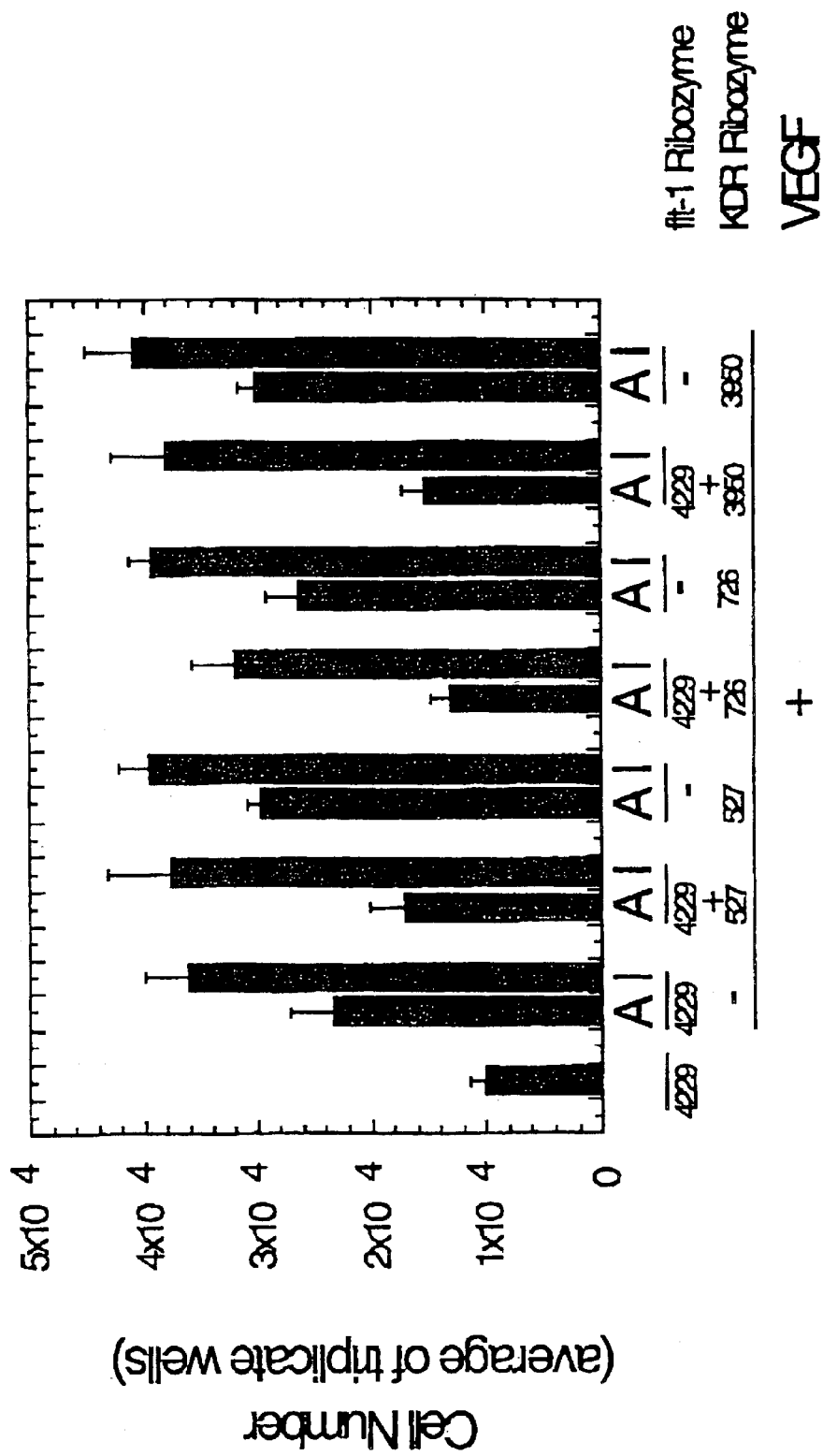

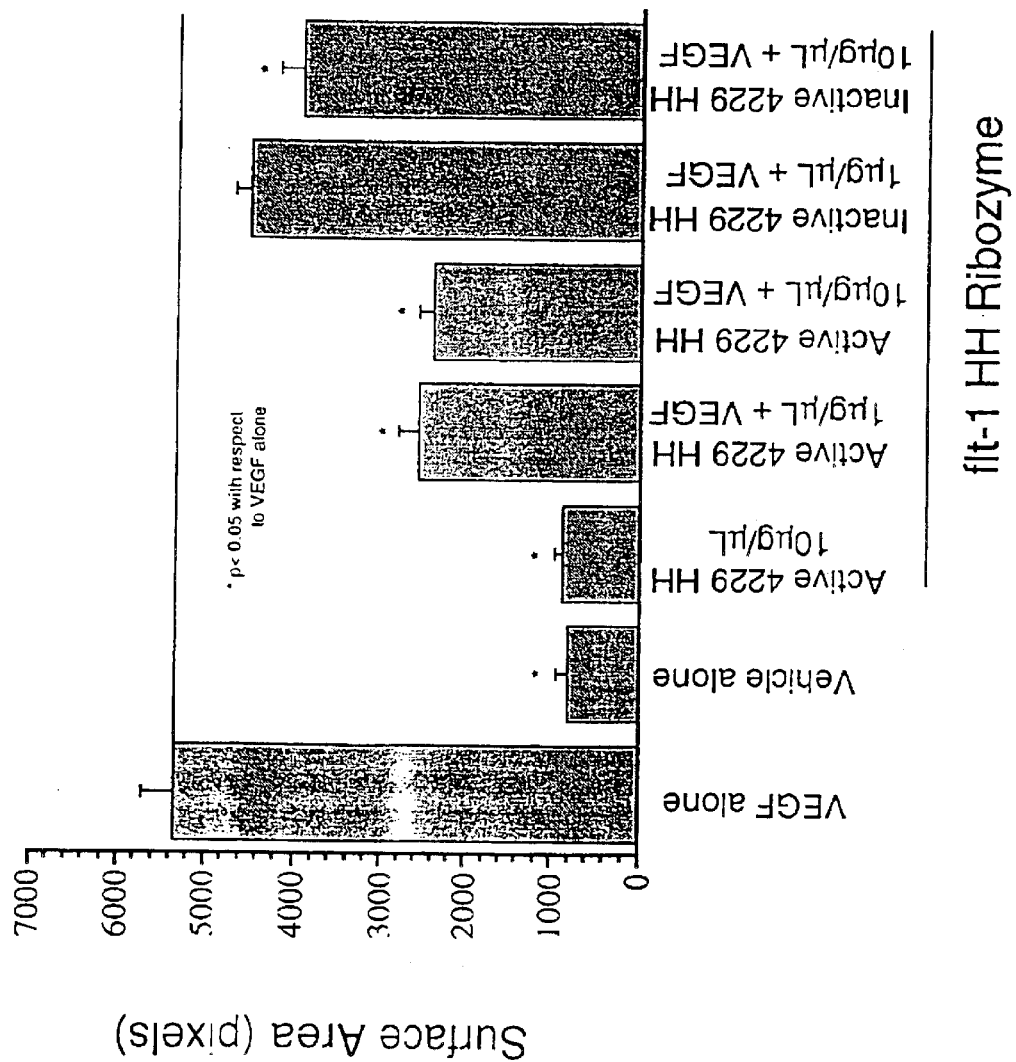
Figure 18: Inhibition of Angiogenesis by Hammerhead Ribozymes *In Vivo*

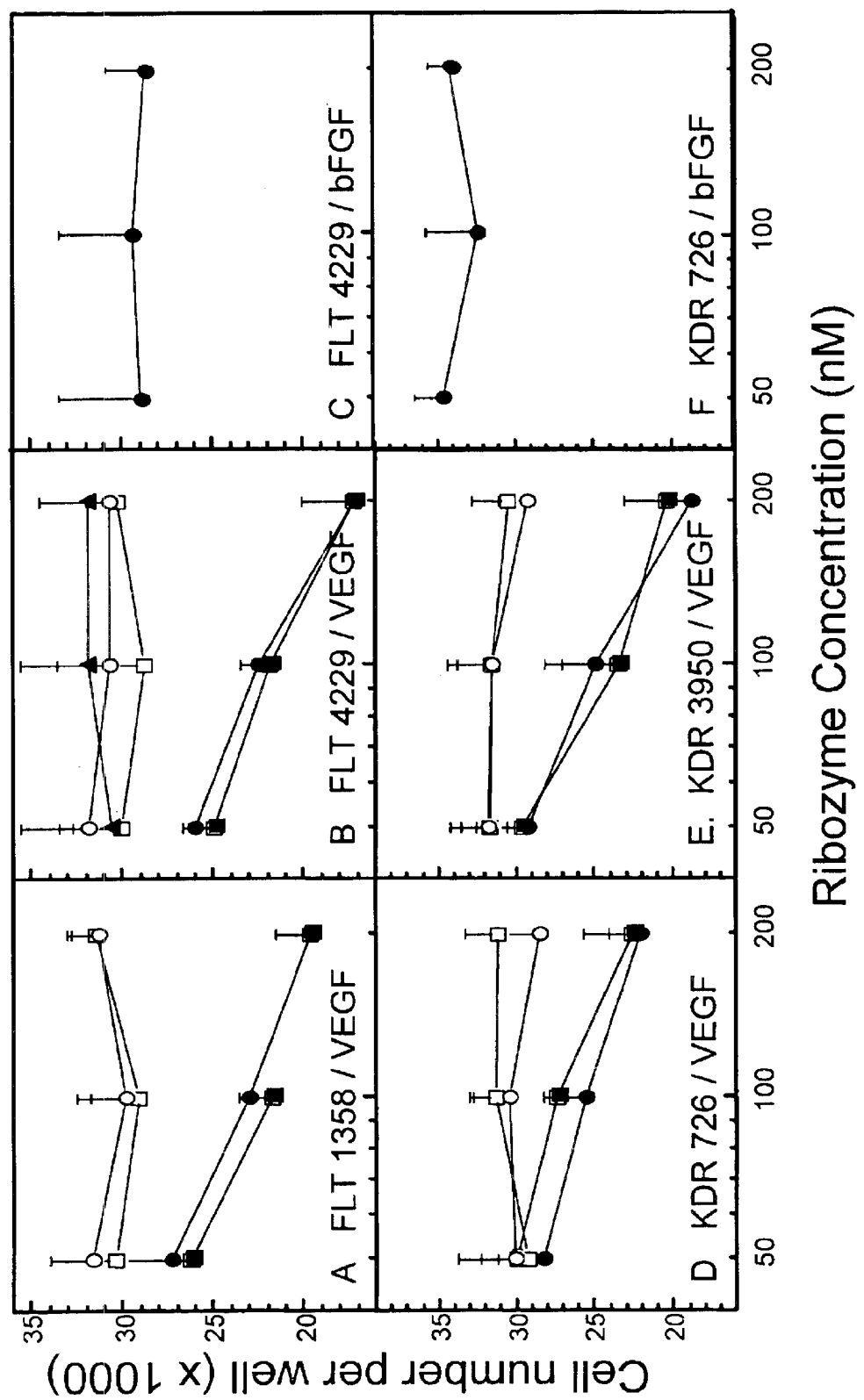
Figure 19: Ribozyme-mediated inhibition of Cell Proliferation

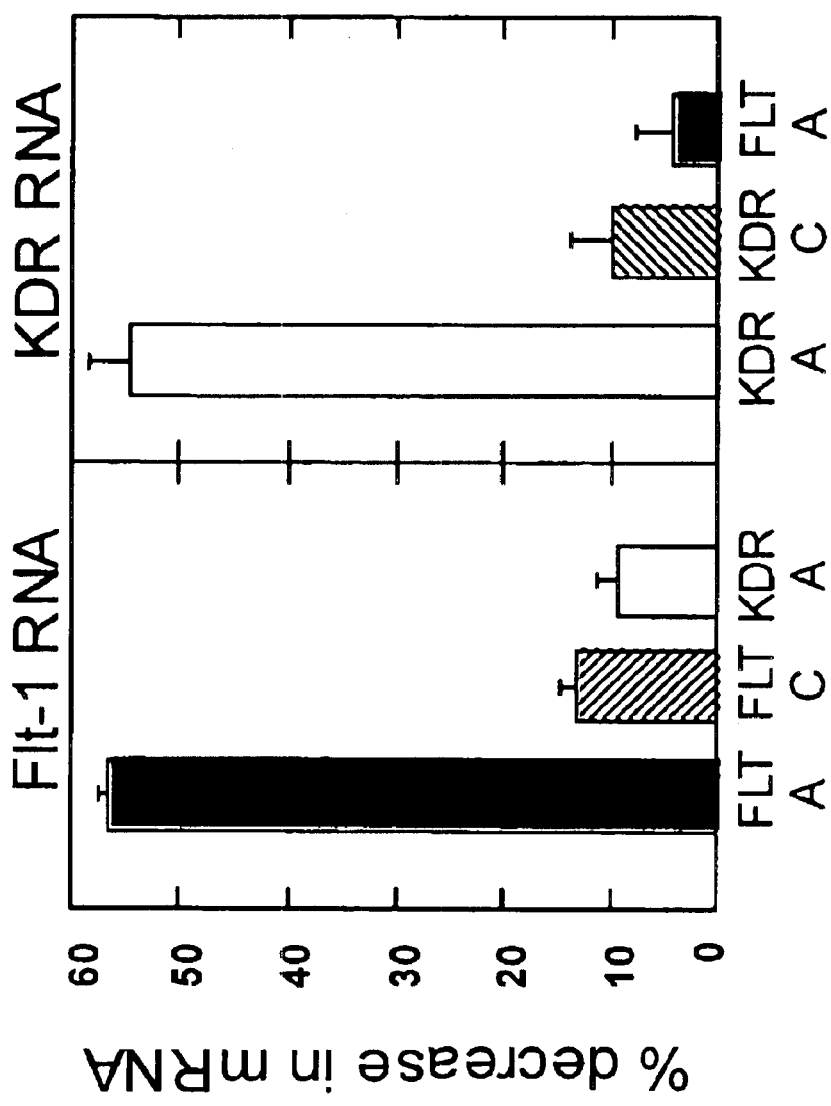
Figure 20: Target Specificity of Ribozymes

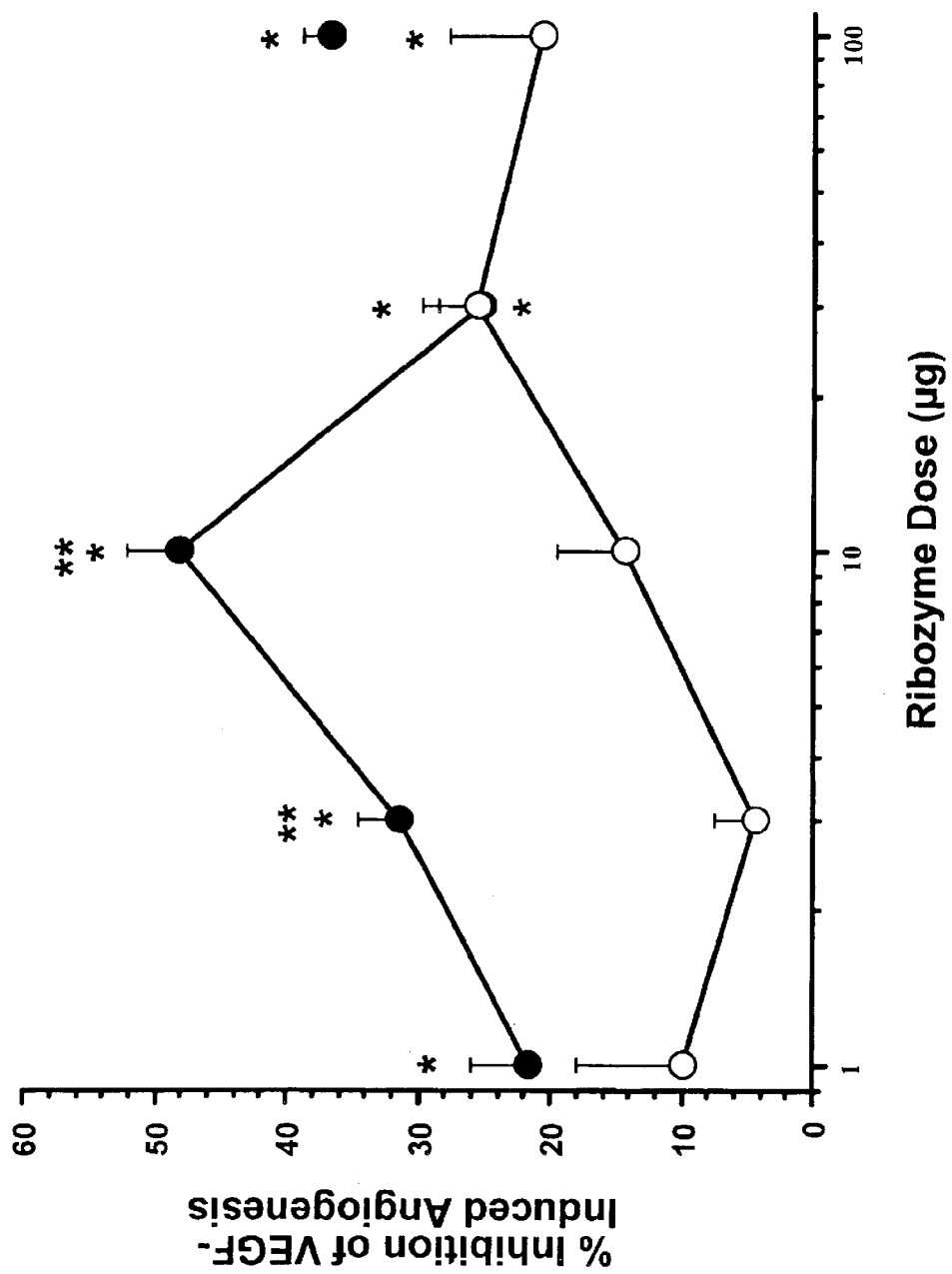
Figure 21: Anti-angiogenic activity of anti-flt ribozyme

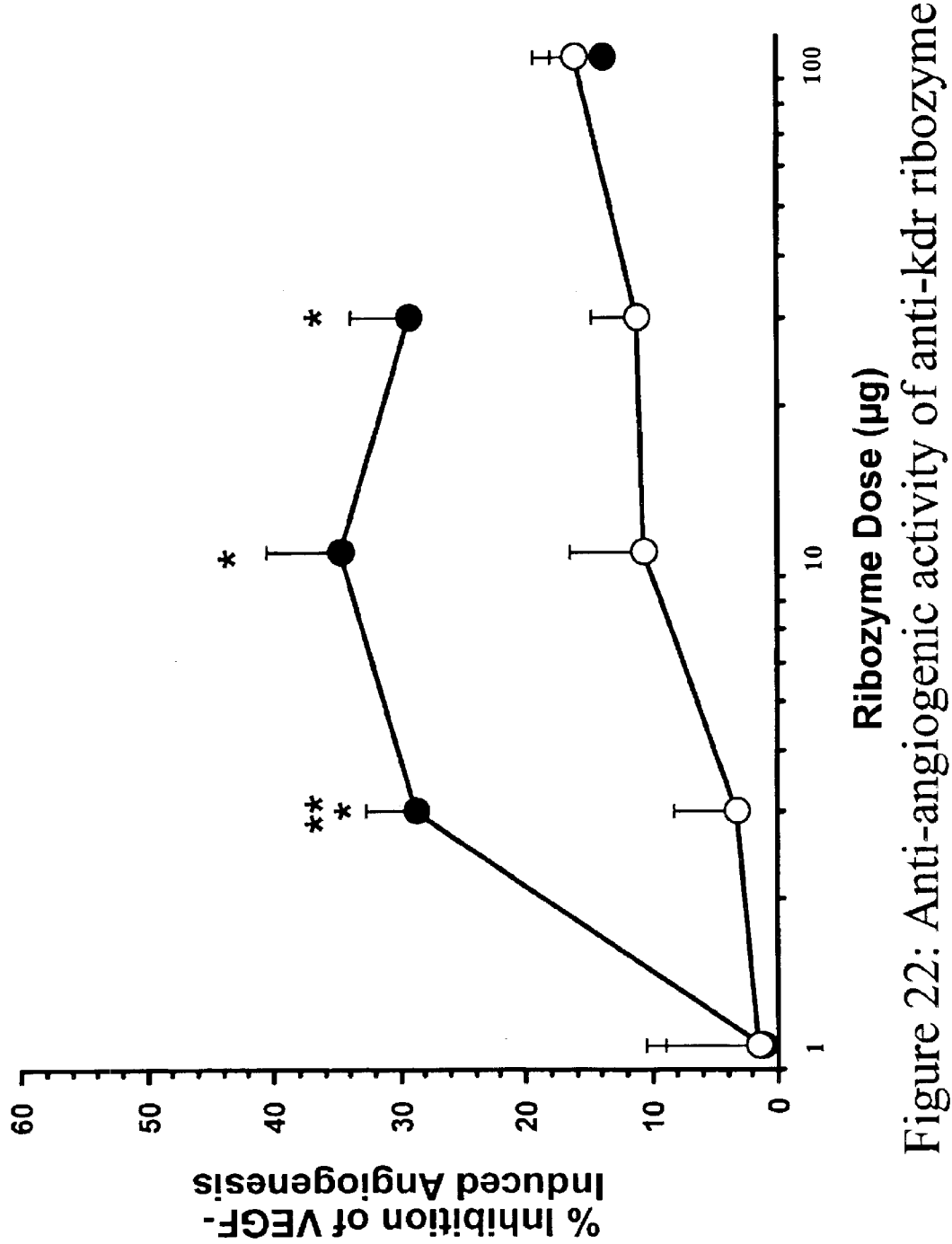
Figure 22: Anti-angiogenic activity of anti-kdr ribozyme

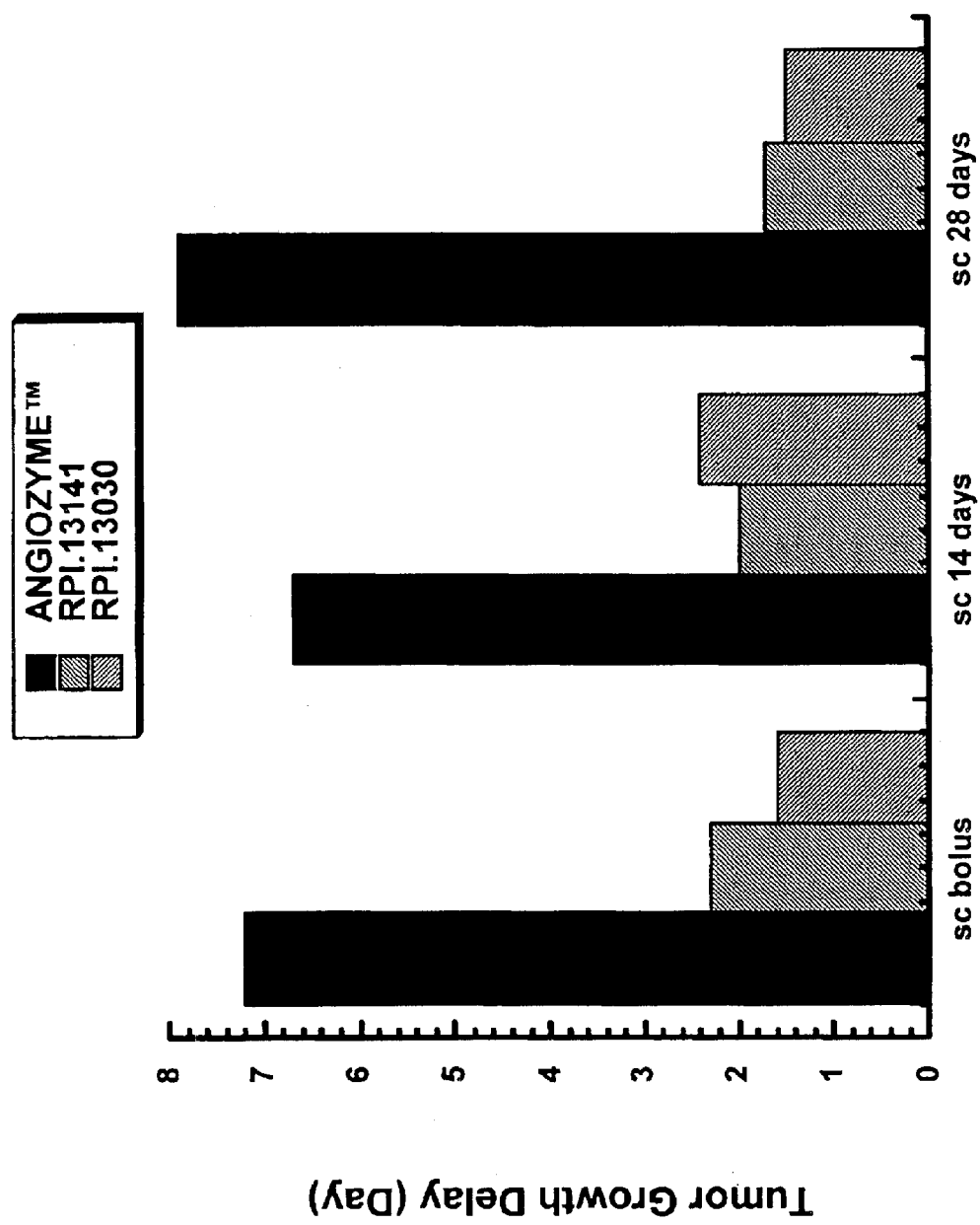
Figure 23: Ribozyme-Mediated Inhibition of Tumor Growth

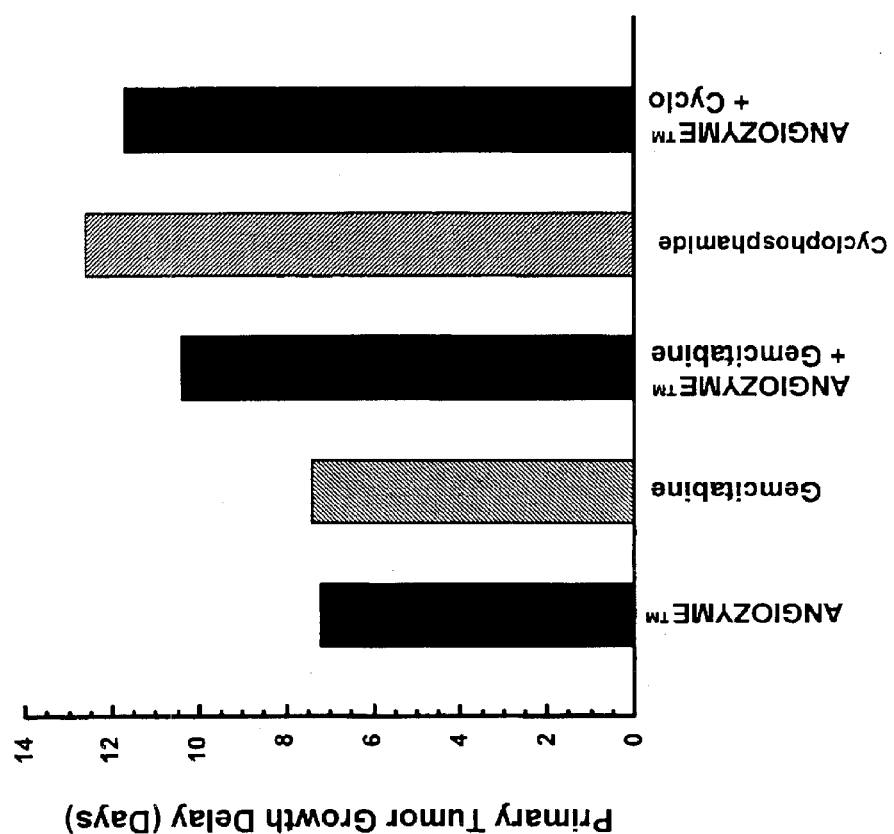
Figure 24: Effect of Ribozyme in Combination with Cytotoxic Agents on Primary Tumor Growth

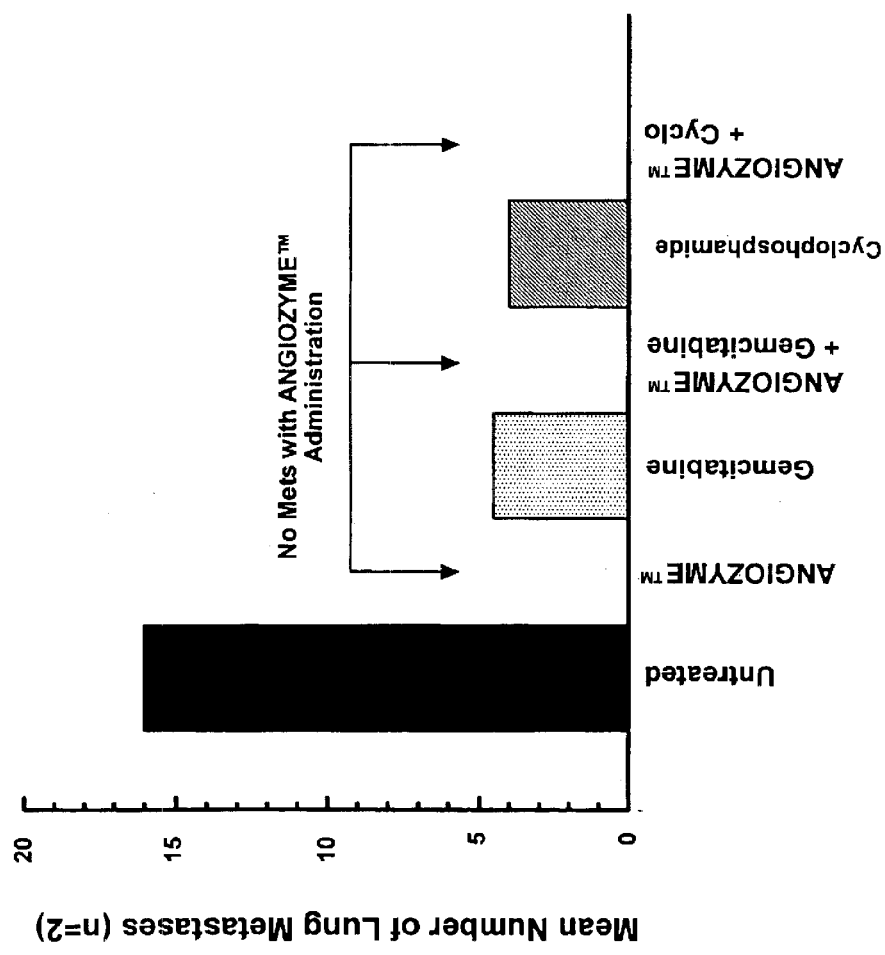
Figure 25: Effect of Ribozyme in Combination with Cytotoxic Agents on Lung Metastases

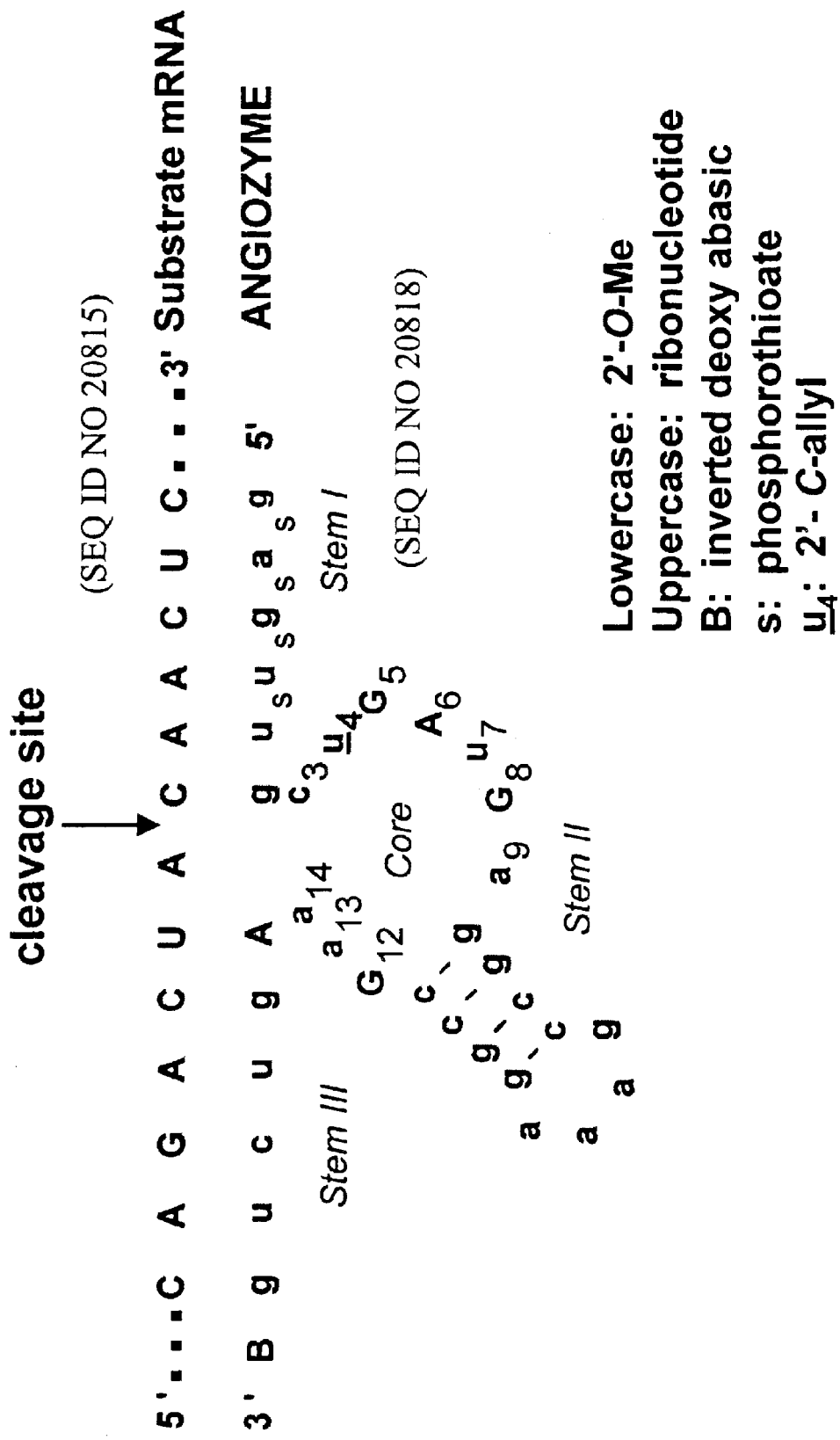
Figure 26 Anti-Flt-1 Ribozyme: ANGIOZYME

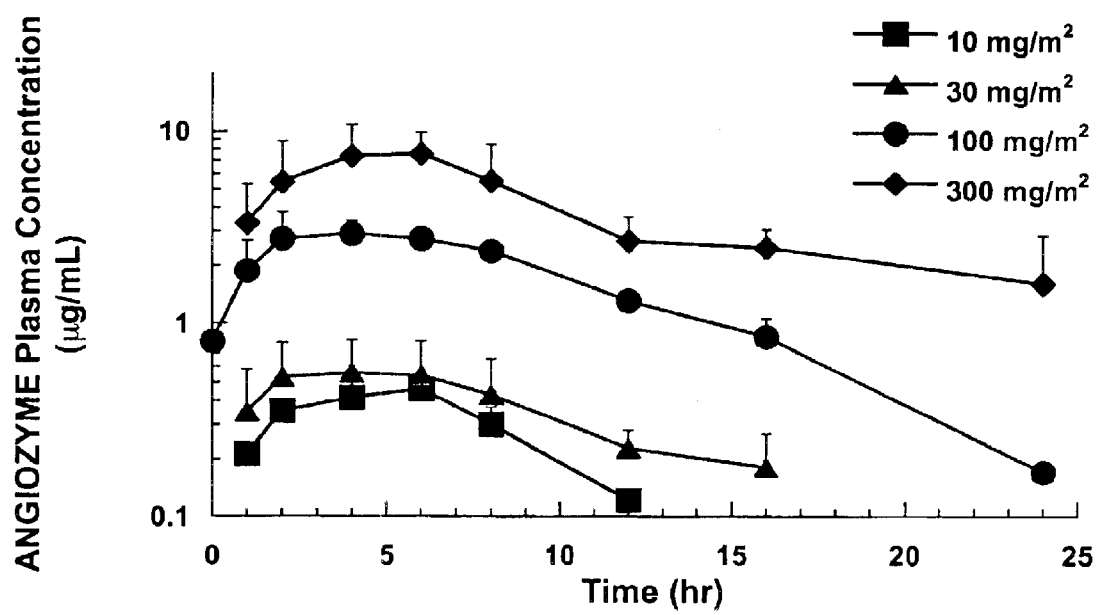
Figure 31: Plasma concentration profile of ANGIOZYME after a single subcutaneous dose of 10, 30, 100 or 300 mg/m$^2$

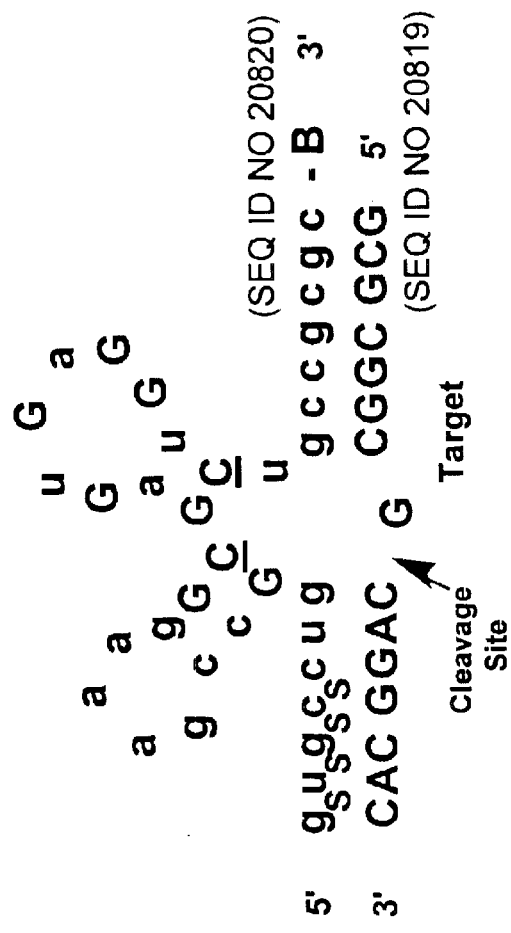
Figure 32: Stabilized Zinzyme Ribozyme Motif
Legend
Uppercase indicates natural ribo residues
C indicates 2'- d-NH$_2$-C
Lowercase indicates 2'- O-Me
Subscript s indicates phosphothioate linkage
B indicates 5'- 3' abasic moiety

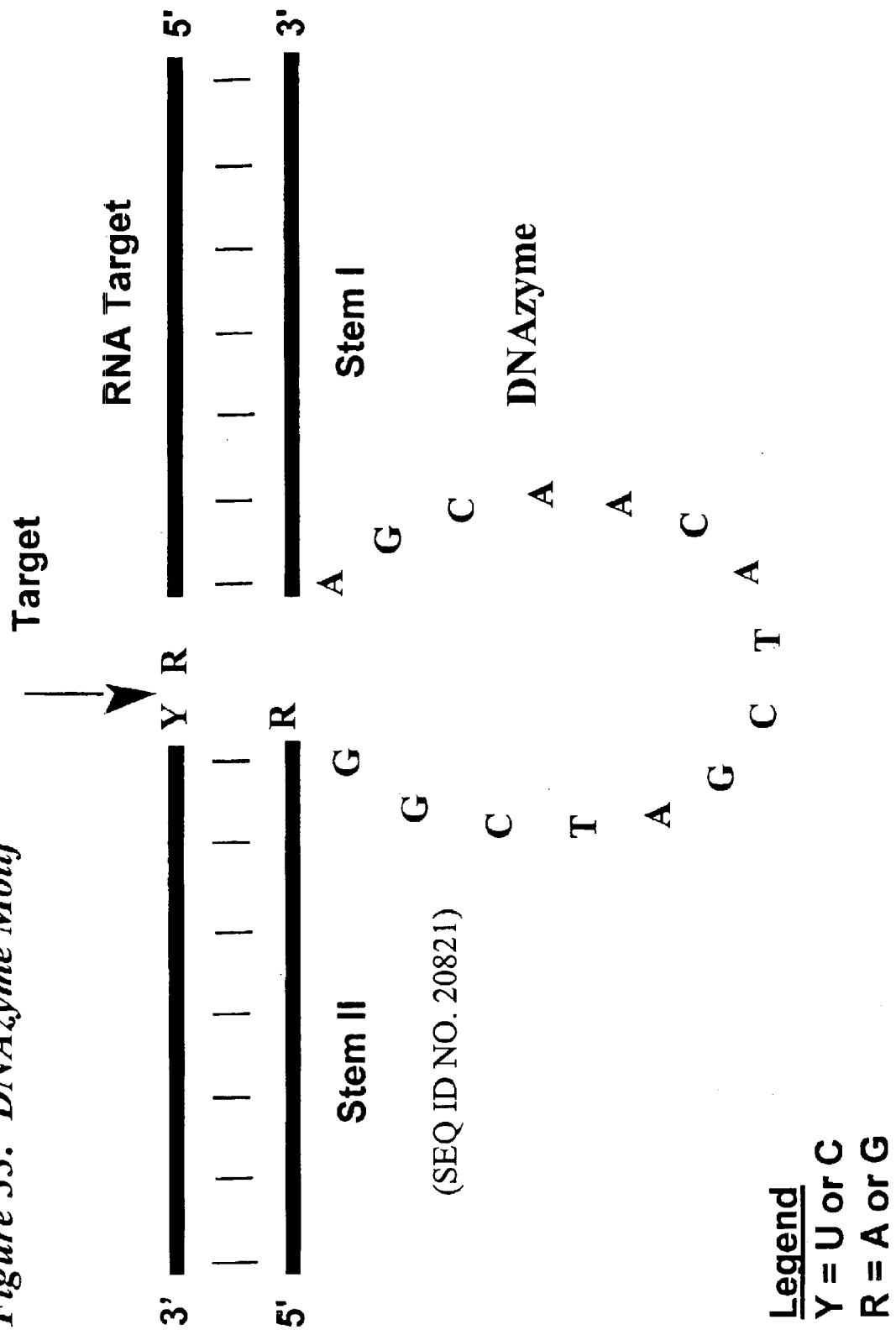
Figure 33: DNAzyme Motif

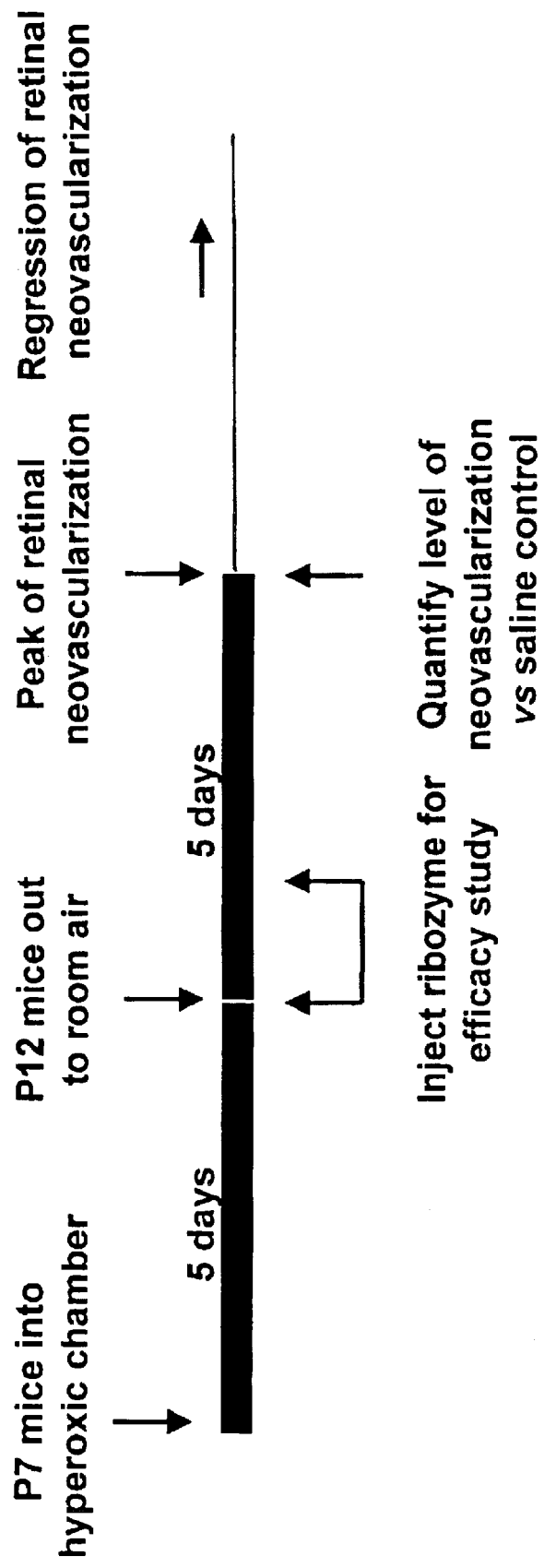
Figure 34A: Mouse Model of Proliferative Retinopathy

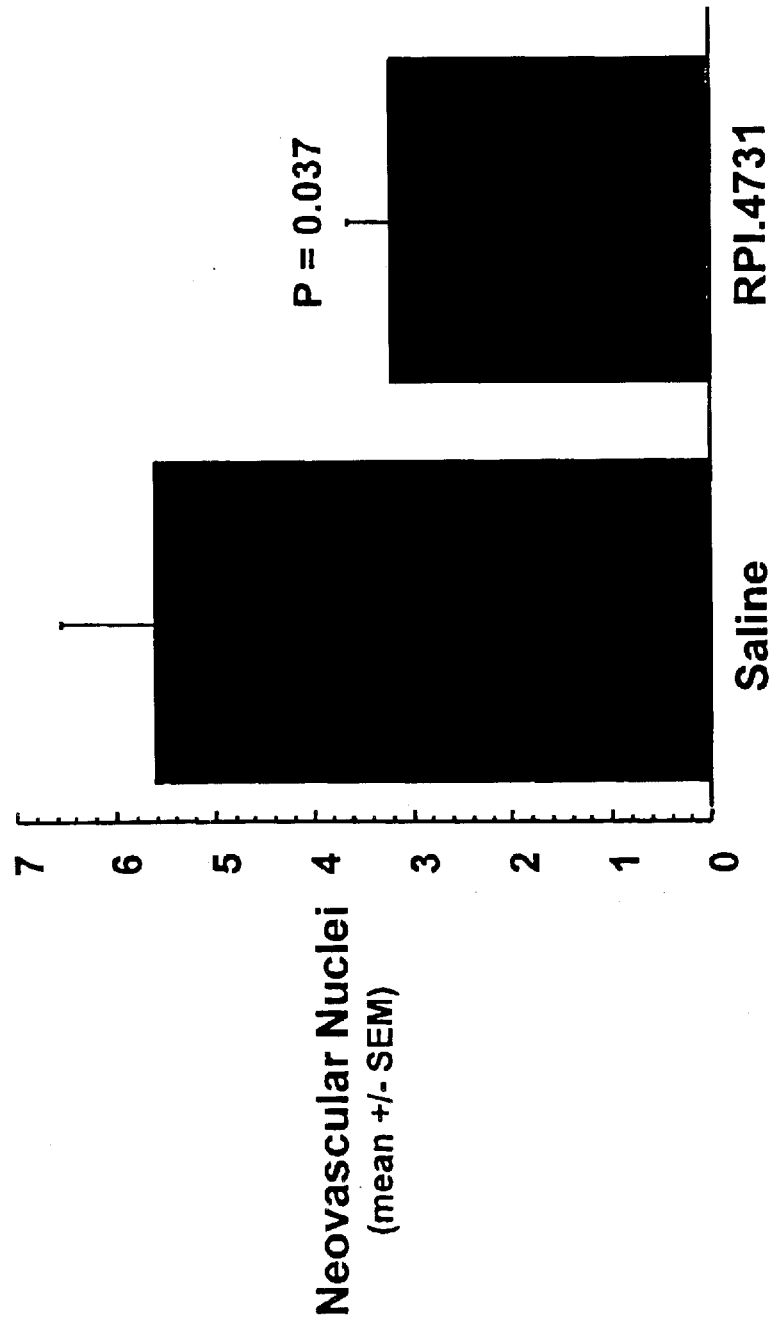

ENZYMATIC NUCLEIC ACID-MEDIATED TREATMENT OF OCULAR DISEASES OR CONDITIONS RELATED TO LEVELS OF VASCULAR ENDOTHELIAL GROWTH FACTOR RECEPTOR (VEGF-R)

This patent application is a continuation-in-part of Pavco et al., U.S. application Ser. No. 09/870,161, now abandoned, filed May 29, 2001, which is a continuation-in-part of Pavco et al., U.S. application Ser. No. 09/708,690, now abandoned, filed Nov. 7, 2000, which is a continuation-in-part of Pavco et al., U.S. application Ser. No. 09/371,722, now U.S. Pat. No. 6,534,872, filed Aug. 10, 1999, which is a continuation-in-part of Pavco et al., U.S. application Ser. No. 08/584,040, now U.S. Pat. No. 6,346,398, filed Jan. 11, 1996, which claims the benefit of Pavco et al., U.S. Application Ser. No. 60/005,974, filed Oct. 26, 1995, all of these earlier applications are entitled "Method and Reagent for Treatment of Diseases or Conditions Related to Levels of Vascular Endothelial Growth Factor Receptor". Each of these applications is hereby incorporated by reference herein in its entirety including the drawings and tables.

The sequence listing submitted on compact disc, in compliance with 37 C.F.R. § 1.52(e)(5), is incorporated by reference. Two separate compact discs are submitted, each containing the file "400.049 Sequence Listing—Revised Apr. 23, 2004, txt" (4,511,993 bytes in size), each created on CD on May 24, 2004.

BACKGROUND OF THE INVENTION

This invention relates to methods and reagents for the treatment of diseases or conditions relating to the levels of expression of vascular endothelial growth factor (VEGF) receptor(s).

The following is a discussion of relevant art, none of which is admitted to be prior art to the present invention.

VEGF, also referred to as vascular permeability factor (VPF) and vasculotropin, is a potent and highly specific mitogen of vascular endothelial cells (for a review see Ferrara, 1993 *Trends Cardiovas. Med.* 3, 244; Neufeld et al., 1994 *Prog. Growth Factor Res.* 5, 89). VEGF induced neovascularization is implicated in various pathological conditions such as tumor angiogenesis, proliferative diabetic retinopathy, hypoxia-induced angiogenesis, rheumatoid arthritis, psoriasis, wound healing and others.

VEGF, an endothelial cell-specific mitogen, is a 34–45 kDa glycoprotein with a wide range of activities that include promotion of angiogenesis, enhancement of vascular-permeability and others. VEGF belongs to the platelet-derived growth factor (PDGF) family of growth factors with approximately 18% homology with the A and B chain of PDGF at the amino acid level. Additionally, VEGF contains the eight conserved cysteine residues common to all growth factors belonging to the PDGF family (Neufeld et al., supra). VEGF protein is believed to exist predominantly as disulfide-linked homodimers; monomers of VEGF have been shown to be inactive (Plouet et al., 1989 *EMBO J.* 8, 3801).

VEGF exerts its influence on vascular endothelial cells by binding to specific high-affinity cell surface receptors. Covalent cross-linking experiments with $^{125}$I-labeled VEGF protein have led to the identification of three high molecular weight complexes of 225, 195 and 175 kDa presumed to be VEGF and VEGF receptor complexes (Vaisman et al., 1990 *J. Biol. Chem.* 265, 19461). Based on these studies VEGF-specific receptors of 180, 150 and 130 kDa molecular mass were predicted. In endothelial cells, receptors of 150 and the 130 kDa have been identified. The VEGF receptors belong to the superfamily of receptor tyrosine kinases (RTKs) characterized by a conserved cytoplasmic catalytic kinase domain and a hydrophylic kinase sequence. The extracellular domains of the VEGF receptors consist of seven immunoglobulin-like domains that are thought to be involved in VEGF binding functions.

The two most abundant and high-affinity receptors of VEGF are flt-1 (fms-like tyrosine kinase) cloned by Shibuya et al., 1990 *Oncogene* 5, 519 and KDR (kinase-insert-domain-containing receptor) cloned by Terman et al., 1991 *Oncogene* 6, 1677. The murine homolog of KDR, cloned by Mathews et al., 1991, *Proc. Natl. Acad. Sci., USA*, 88, 9026, shares 85% amino acid homology with KDR and is termed as flk-1 (fetal liver kinase-1). Recently it has been shown that the high-affinity binding of VEGF to its receptors is modulated by cell surface-associated heparin and heparin-like molecules (Gitay-Goren et al., 1992 *J. Biol. Chem.* 267, 6093).

VEGF expression has been associated with several pathological states such as tumor angiogenesis, several forms of blindness, rheumatoid arthritis, psoriasis and others. Following is a brief summary of evidence supporting the involvement of VEGF in various diseases:

1) Tumor angiogenesis: Increased levels of VEGF gene expression have been reported in vascularized and edema-associated brain tumors (Berkman et al., 1993 *J. Clini. Invest.* 91, 153). A more direct demostration of the role of VEGF in tumor angiogenesis was demonstrated by Jim Kim et al., 1993 *Nature* 362, 841 wherein, monoclonal antibodies against VEGF were successfully used to inhibit the growth of rhabdomyosarcoma, glioblastoma multiforme cells in nude mice. Similarly, expression of a dominant negative mutated form of the flt-1 VEGF receptor inhibits vascularization induced by human glioblastoma cells in nude mice (Millauer et al., 1994, *Nature* 367, 576).

2) Ocular diseases: Aiello et al., 1994 *New Engl. J. Med.* 331, 1480, showed that the ocular fluid of a majority of patients suffering from diabetic retinopathy and other retinal disorders, contains a high concentration of VEGF. Miller et al., 1994 *Am. J. Pathol.* 145, 574, reported elevated levels of VEGF mRNA in patients suffering from retinal ischemia. These observations support a direct role for VEGF in ocular diseases.

3) Psoriasis: Detmar et al., 1994 *J. Exp. Med.* 180, 1141 reported that VEGF and its receptors were over-expressed in psoriatic skin and psoriatic dermal microvessels, suggesting that VEGF plays a significant role in psoriasis.

4) Rheumatoid arthritis: Immunohistochemistry and in situ hybridization studies on tissues from the joints of patients suffering from rheumatoid arthritis show an increased level of VEGF and its receptors (Fava et al., 1994 *J. Exp. Med.* 180, 341). Additionally, Koch et al., 1994 *J. Immunol.* 152, 4149, found that VEGF-specific antibodies were able to significantly reduce the mitogenic activity of synovial tissues from patients suffering from rheumatoid arthritis. These observations support a direct role for VEGF in rheumatoid arthritis.

In addition to the above data on pathological conditions involving excessive angiogenesis, a number of studies have demonstrated that VEGF is both necessary and sufficient for neovascularization. Takashita et al., 1995 *J. Clin. Invest.* 93, 662, demonstrated that a single injection of VEGF augmented collateral vessel development in a rabbit model of ischemia. VEGF also can induce neovascularization when injected into the cornea. Expression of the VEGF gene in CHO cells is sufficient to confer tumorigenic potential to the cells. Kim et al., supra and Millauer et al., supra used monoclonal antibodies against VEGF or a dominant negative form of flk-1 receptor to inhibit tumor-induced neovascularization.

During development, VEGF and its receptors are associated with regions of new vascular growth (Millauer et al., 1993 *Cell* 72, 835; Shalaby et al., 1993 *J. Clin. Invest*. 91, 2235). Furthermore, transgenic mice lacking either of the VEGF receptors are defective in blood vessel formation, in fact these mice do not survive; flk-1 appears to be required for differentiation of endothelial cells, while flt-1 appears to be required at later stages of vessel formation (Shalaby et al., 1995 *Nature* 376, 62; Fung et al., 1995 *Nature* 376, 66). Thus, these receptors must be present to properly signal endothelial cells or their precursors to respond to vascularization-promoting stimuli.

All of the conditions listed above, involve extensive vascularization. This hyper-stimulation of endothelial cells may be alleviated by VEGF antagonists. Thus most of the therapeutic efforts for the above conditions have concentrated on finding inhibitors of the VEGF protein.

Kim et al., 1993 *Nature* 362, 841 have been successful in inhibiting VEGF-induced tumor growth and angiogenesis in nude mice by treating the mice with VEGF-specific monoclonal antibody.

Koch et al., 1994 *J. Immunol*. 152, 4149 showed that the mitogenic activity of microvascular endothelial cells found in rheumatoid arthritis (RA) synovial tissue explants and the chemotactic property of endothelial cells from RA synovial fluid can be neutralized significantly by treatment with VEGF-specific antibodies.

Ullrich et al., International PCT Publication No. WO 94/11499 and Millauer et al., 1994 *Nature* 367, 576 used a soluble form of flk-1 receptor (dominant-negative mutant) to prevent VEGF-mediated tumor angiogenesis in immunodeficient mice.

Kendall and Thomas, International PCT Publication No. WO 94/21679 describe the use of naturally occuring or recombinantly-engineered soluble forms of VEGF receptors to inhibit VEGF activity.

Robinson, International PCT Publication No. WO 95/04142 describes the use of antisense oligonucleotides targeted against VEGF RNA to inhibit VEGF expression.

Jellinek et al., 1994 *Biochemistry* 33, 10450 describe the use of VEGF-specific high-affinity RNA aptamers to inhibit the binding of VEGF to its receptors.

Rockwell and Goldstein, International PCT Publication No. WO 95/21868, describe the use of anti-VEGF receptor monoclonal antibodies to neutralize the effect of VEGF on endothelial cells.

SUMMARY OF THE INVENTION

The invention features novel nucleic acid-based compounds [e.g., enzymatic nucleic acid molecules (ribozymes such as Inozyme, G-cleaver, amberzyme, zinzyme), DNAzyme, antisense nucleic acids, 2–5A antisense chimeras, triplex forming nucleic acid, decoy nucleic acids, aptamers, allozymes, antisense nucleic acids containing RNA cleaving chemical groups (Cook et al., U.S. Pat. No. 5,359,051)] and methods for their use to down regulate or inhibit the expression of receptors of VEGF (VEGF-R).

In one embodiment, the invention features the use of one or more of the nucleic acid-based compounds to inhibit the expression of flt-1 and/or flk-1/KDR receptors.

In another embodiment, the present invention features a compound having Formula I: (SEQ ID NO: 20818).

5' $g_s a_s g_s u_s$ugc$\underline{U}$GAuGagg ccgaaa ggccGaaAgucugB 3' wherein each a is 2'-O-methyl adenosine nucleotide, each g is a 2'-O-methyl guanosine nucleotide, each c is a 2'-O-methyl cytidine nucleotide, each u is a 2'-O-methyl uridine nucleotide, each A is adenosine, each G is guanosine, each s individually represents a phosphorothioate internucleotide linkage, $\underline{U}$ is 2'-deoxy-2'-C-allyl uridine, and B is an inverted deoxyabasic moiety.

In another embodiment, the present invention features a compound having Formula II: (SEQ ID NO: 13488).

5'-$u_s a_s c_s$ $a_s$au uc$\underline{U}$ GAu Gag gcg aaa gcc Gaa Aag aca aB-3' wherein each a is 2'-O-methyl adenosine nucleotide, each g is a 2'-O-methyl guanosine nucleotide, each c is a 2'-O-methyl cytidine nucleotide, each u is a 2'-O-methyl uridine nucleotide, each A is adenosine, each G is guanosine, each s individually represents a phosphorothioate internucleotide linkage, $\underline{U}$ is 2'-deoxy-2'-C-allyl uridine, and B is an inverted deoxyabasic moiety.

In one embodiment, the invention features a composition comprising a compound of Formula I and/or II in a pharmaceutically acceptable carrier or diluent.

In another embodiment, the invention features a method of administering to a cell, for example a mammalian cell or human cell, the compound of Formula I and/or II, comprising contacting the cell with the compound under conditions suitable for administration, for example in the presence of a delivery reagent. Examples of suitable delivery reagents include a lipid, cationic lipid, phospholipid, or liposome as described herein and known in the art.

In one embodiment, the invention features a method of administering to a cell the compound of Formula I or II in conjunction with a chemotherapeutic agent comprising contacting the cell with the compound and the chemotherapeutic agent under conditions suitable for administration.

Examples of chemotherapeutic agents that can be combined with the compound of Formula I and/or II include but are not limited to 5-fluoro uridine, Leucovorin, Irinotecan (CAMPTOSAR® or CPT-11 or Camptothecin-11 or Campto), Paclitaxel, or Carboplatin or a combination thereof.

In another embodiment, the present invention also features a cell comprising the compound of Formula I and/or II, wherein the cell is a mammalian cell. For example, in one embodiment the mammalian cell is a human cell.

In one embodiment, the invention features a method of inhibiting angiogenesis, for example tumor angiogenesis, in a patient comprising the step of contacting the patient with the compound of Formula I and/or II under conditions suitable for said inhibition. In one embodiment, the patient is a mammal, for example, a human.

In another embodiment, the invention features a method of treatment of a patient having a condition associated with an increased level of VEGF receptor, for example, cancers such as breast cancer, lung cancer, colorectal cancer, renal cancer, pancreatic cancer, or melanoma, or ocular indications such as diabetic retinopathy, or age related macular degeneration, comprising contacting one or more cells of the patient with the compound of Formula I and/or II, under conditions suitable for the treatment. In one embodiment, the patient is a human.

In another embodiment, the invention features a method of treatment of a patient having an ocular condition associated with an increased level of a VEGF receptor, for example, diabetic retinopathy, or age related macular degeneration, comprising contacting one or more cells of the patient with a nucleic acid molecule, such as an enzymatic nucleic acid molecule, targeted against a VEGF receptor RNA, e.g., a molecule according to Formula I and/or II, under conditions suitable for the treatment. In one embodiment, the patient is a human.

In yet another embodiment, a method of treatment of the invention further comprises the use of one or more drug therapies under conditions suitable for the treatment.

In one embodiment, the present invention also features a method of cleaving RNA comprising a sequence of flt-1 comprising contacting the compound of Formula I with the RNA under conditions suitable for the cleavage of the RNA, for example, where the cleavage is carried out in the presence of a divalent cation such as Mg2+.

In another embodiment, the invention features a method of administering to a mammal, for example a human, the compound of Formula I and/or II comprising contacting the mammal with the compound under conditions suitable for the administration, for example, in the presence of a delivery reagent such as a lipid, cationic lipid, phospholipid, or liposome.

In yet another embodiment, the invention features a method of administering to a mammal the compound of Formula I and/or II in conjunction with a chemotherapeutic agent comprising contacting the mammal, for example a human, with the compound and the chemotherapeutic agent under conditions suitable for the administration.

In another embodiment, the invention features a composition comprising the nucleic acid molecule of the instant invention and a pharmaceutically acceptable carrier or diluent.

By "inhibit" it is meant that the activity of VEGF-R or level of VEGF-R mRNAs or equivalent RNAs encoding VEGF-R is reduced below that observed in the absence of a nucleic acid molecule of the instant invention. In one embodiment, inhibition with enzymatic nucleic acid preferably is below that level observed in the presence of an enzymatically inactive or attenuated molecule that is able to bind to the same site on the mRNA, but is unable to cleave that RNA. In another embodiment, inhibition with antisense oligonucleotides is preferably below that level observed in the presence of, for example, an oligonucleotide with scrambled sequence or with mismatches. In another embodiment, inhibition of a VEGF-R gene with the nucleic acid molecule of the instant invention is greater in the presence of the nucleic acid molecule than in its absence.

By "enzymatic nucleic acid molecule" it is meant an RNA molecule which has complementarity in a substrate binding region to a specified gene target, and also has an enzymatic activity which is active to specifically cleave target RNA. That is, the enzymatic RNA molecule is able to intermolecularly cleave RNA and thereby inactivate a target RNA molecule. The complementary region(s) allows sufficient hybridization of the enzymatic RNA molecule to the target RNA and thus permit cleavage. One hundred percent complementarity is preferred, but complementarity as low as 50–75% can also be useful in this invention. The nucleic acids can be modified at the base, sugar, and/or phosphate groups. The term enzymatic nucleic acid is used interchangeably with phrases such as ribozymes, catalytic RNA, enzymatic RNA, enzymatic DNA, catalytic DNA, catalytic oligonucleotides, nucleozyme, DNAzyme, Zinzyme, RNA enzyme, endoribonuclease, endonuclease, minizyme, leadzyme, oligozyme or DNA enzyme. All of these terminologies describe nucleic acid molecules with enzymatic activity. The specific enzymatic nucleic acid molecules described in the instant application are not meant to be limiting and those skilled in the art will recognize that all that is important in an enzymatic nucleic acid molecule of this invention is that it have a specific substrate binding site which is complementary to one or more of the target nucleic acid regions, and that it have nucleotide sequences within or surrounding that substrate binding site which impart a nucleic acid cleaving activity to the molecule (Cech et al., U.S. Pat. No. 4,987,071; Cech et al., 1988, JAMA).

By "enzymatic portion" or "catalytic domain" is meant that portion/region of the enzymatic nucleic acid essential for cleavage of a nucleic acid substrate (for example see FIG. 1).

By "substrate binding arm" or "substrate binding domain" is meant that portion/region of a enzymatic nucleic acid which is complementary to (i.e., able to base-pair with) a portion of its substrate. Generally, such complementarity is 100%, but can be less if desired. For example, as few as 10 bases out of 14 can be base-paired. Such arms are shown generally in FIG. 1. That is, these arms contain sequences within an enzymatic nucleic acid are intended to bring enzymatic nucleic acid and target RNA together through complementary base-pairing interactions. The enzymatic nucleic acid of the invention can have binding arms that are contiguous or non-contiguous and can be of varying lengths. The length of the binding arm(s) are preferably greater than or equal to four nucleotides, and are of sufficient length to stably interact with the target RNA; specifically 12–100 nucleotides; more specifically 14–24 nucleotides long. If two binding arms are chosen, the design is such that the length of the binding arms are symmetrical (i.e., each of the binding arms is of the same length; e.g., five and five nucleotides, six and six nucleotides or seven and seven nucleotides long) or asymmetrical (i.e., the binding arms are of different length; e.g., six and three nucleotides; three and six nucleotides long; four and five nucleotides long; four and six nucleotides long; four and seven nucleotides long; and the like).

By "DNAzyme" is meant an enzymatic nucleic acid molecule lacking a 2'-OH group. In particular embodiments, the enzymatic nucleic acid molecule can have an attached linker(s) or other attached or associated groups, moieties, or chains containing one or more nucleotides with 2'-OH groups.

By "zinzyme" motif or configuration is meant a class II enzymatic nucleic acid molecule comprising a motif as generally described in FIG. 32 and in Beigelman et al., International PCT publication No. WO 99/55857 and U.S. patent application Ser. No. 09/918,728, which is herein incorporated by reference in its entirety, including the drawings. Zinzymes possess endonuclease activity to cleave RNA substrates having a cleavage triplet including but not limited to, YG/Y, where Y is uridine or cytidine, and G is guanosine and/represents the cleavage site. Zinzymes can be chemically modified to increase nuclease stability through various substitutions, including substituting 2'-O-methyl guanosine nucleotides for guanosine nucleotides. In addition, differing nucleotide and/or non-nucleotide linkers can be used to substitute the 5'-gaaa-2' loop of the motif. Zinzymes represent a non-limiting example of an enzymatic nucleic acid molecule that does not require a ribonucleotide (2'-OH) group within its own nucleic acid sequence for activity.

By "sufficient length" is meant a nucleic acid molecule long enough to provide the intended function under the expected condition. For example, a nucleic acid molecule of the invention needs to be of "sufficient length" to provide stable binding to a target site under the expected binding conditions and environment. In another non-limiting example, for the binding arms of an enzymatic nucleic acid, "sufficient length" means that the binding arm sequence is long enough to provide stable binding to a target site under the expected reaction conditions and environment. The binding arms are not so long as to prevent useful turnover of the nucleic acid molecule.

By "stably interact" is meant interaction of the oligonucleotides with target, such as a target protein or target nucleic acid (e.g., by forming hydrogen bonds with complementary amino acids or nucleotides in the target under physiological conditions) that is sufficient for the intended purpose (e.g., specific binding to a protein target to disrupt the function of that protein or cleavage of target RNA/DNA by an enzyme).

By "equivalent" RNA to VEGF-R is meant to include those naturally occurring RNA molecules having homology (partial or complete) to VEGF-R, or encoding for proteins with similar function as VEGF-R in various animals, including human, rodent, primate, rabbit and pig. The equivalent RNA sequence also includes in addition to the coding region, regions such as 5'untranslated region, 3'-untranslated region, introns, intron-exon junction and the like.

By "homology" is meant the nucleotide sequence of two or more nucleic acid molecules is partially or completely identical.

By "antisense nucleic acid" it is meant a non-enzymatic nucleic acid molecule that binds to target RNA by means of RNA-RNA or RNA-DNA or RNA-PNA (protein nucleic acid; Egholm et al., 1993 *Nature* 365, 566) interactions and alters the activity of the target RNA (for a review see Stein and Cheng, 1993 *Science* 261, 1004). Typically, antisense molecules will be complementary to a target sequence along a single contiguous sequence of the antisense molecule. However, in certain embodiments, an antisense molecule may bind to substrate such that the substrate molecule forms a loop, and/or an antisense molecule may bind such that the antisense molecule forms a loop. Thus, the antisense molecule may be complementary to two (or even more) non-contiguous substrate sequences or two (or even more) non-contiguous sequence portions of an antisense molecule may be complementary to a target sequence or both.

By "2–5A antisense chimera" it is meant, an antisense oligonucleotide containing a 5' phosphorylated 2'-5'-linked adenylate residues. These chimeras bind to target RNA in a sequence-specific manner and activate a cellular 2–5A-dependent ribonuclease which, in turn, cleaves the target RNA (Torrence et al., 1993 *Proc. Natl. Acad. Sci. USA* 90, 1300).

By "triplex DNA" it is meant an oligonucleotide that can bind to a double-stranded DNA in a sequence-specific manner to form a triple-strand helix. Formation of such triple helix structure has been shown to inhibit transcription of the targeted gene (Duval-Valentin et al., 1992 *Proc. Natl. Acad. Sci. USA* 89, 504).

By "gene" it is meant a nucleic acid that encodes an RNA, for example, nucleic acid sequences including, but not limited to, structural genes encoding a polypeptide.

By "complementarity" is meant that a nucleic acid can form hydrogen bond(s) with another nucleic acid sequence by either traditional Watson-Crick or other non-traditional types. In reference to the nucleic molecules of the present invention, the binding free energy for a nucleic acid molecule with its target or complementary sequence is sufficient to allow the relevant function of the nucleic acid to proceed, e.g., ribozyme cleavage, antisense or triple helix inhibition. Determination of binding free energies for nucleic acid molecules is well known in the art (see, e.g., Turner et al., 1987, CSH Symp. Quant. Biol. LII pp. 123–133; Frier et al., 1986, Proc. Nat. Acad. Sci. USA 83:9373–9377; Turner et al., 1987, J. Am. Chem. Soc. 109:3783–3785. A percent complementarity indicates the percentage of contiguous residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence.

Seven basic varieties of naturally-occurring enzymatic RNAs are known presently. Each can catalyze the hydrolysis of RNA phosphodiester bonds in trans (and thus can cleave other RNA molecules) under physiological conditions. Table I summarizes some of the characteristics of these ribozymes. In general, enzymatic nucleic acids act by first binding to a target RNA. Such binding occurs through the target binding portion of a enzymatic nucleic acid which is held in close proximity to an enzymatic portion of the molecule that acts to cleave the target RNA. Thus, the enzymatic nucleic acid first recognizes and then binds a target RNA through complementary base-pairing, and once bound to the correct site, acts enzymatically to cut the target RNA. Strategic cleavage of such a target RNA destroys its ability to direct synthesis of an encoded protein. After an enzymatic nucleic acid has bound and cleaved its RNA target, it is released from that RNA to search for another target and can repeatedly bind and cleave new targets. Thus, a single enzymatic nucleic acid molecule is able to cleave many molecules of target RNA. In addition, the enzymatic nucleic acid is a highly specific inhibitor of gene expression, with the specificity of inhibition depending not only on the base-pairing mechanism of binding to the target RNA, but also on the mechanism of target RNA cleavage. Single mismatches, or base-substitutions, near the site of cleavage can completely eliminate catalytic activity of a ribozyme.

Enzymatic nucleic acids that cleave the specified sites in VEGF-R mRNAs represent a novel therapeutic approach to treat tumor angiogenesis, and cancers including, but not limited to, tumor and cancer types shown under Diagnosis in Table XX, ocular diseases, rhuematoid arthritis, psoriasis and others. The enzymatic nucleic acid molecules of the instant invention are able to inhibit the activity of VEGF-R (specifically flt-1 and flk-1/KDR) and the catalytic activity of the enzymatic nucleic acid molecules is required for their inhibitory effect. Those of ordinary skill in the art will find it clear from the exemplary nucleic acid molecules described that other enzymatic nucleic acid molecules that cleave VEGF-R mRNAs can be readily designed and are within the scope of the invention.

In one of the embodiments of the inventions described herein, the enzymatic nucleic acid molecule is formed in a hammerhead or hairpin motif, but can also be formed in the motif of a hepatitis delta virus, group I intron, group II intron or RNase P RNA (in association with an RNA guide sequence), Neurospora VS RNA, DNAzymes, Zinzymes, NCH cleaving motifs, or G-cleavers. Examples of such hammerhead motifs are described by Dreyfus, supra, Rossi et al., 1992, *AIDS Research and Human Retroviruses* 8, 183; of hairpin motifs by Hampel et al., EP0360257, Hampel and Tritz, 1989 *Biochemistry* 28, 4929, Feldstein et al., 1989, *Gene* 82, 53, Haseloff and Gerlach, 1989, *Gene*, 82, 43, and Hampel et al., 1990 *Nucleic Acids Res*. 18, 299; Chowrira &

McSwiggen, U.S. Pat. No. 5,631,359; of the hepatitis delta virus motif is described by Perrotta and Been, 1992 *Biochemistry* 31, 16; of the RNase P motif by Guerrier-Takada et al., 1983 *Cell* 35, 849; Forster and Altman, 1990, *Science* 249, 783; Li and Altman, 1996, *Nucleic Acids Res.* 24, 835; Neurospora VS RNA ribozyme motif is described by Collins (Saville and Collins, 1990 *Cell* 61, 685–696; Saville and Collins, 1991 *Proc. Natl. Acad. Sci. USA* 88, 8826–8830; Collins and Olive, 1993 *Biochemistry* 32, 2795–2799; Guo and Collins, 1995, *EMBO. J.* 14, 363); Group II introns are described by Griffin et al., 1995, *Chem. Biol.* 2, 761; Michels and Pyle, 1995, *Biochemistry* 34, 2965; Pyle et al., International PCT Publication No. WO 96/22689; of the Group I intron by Cech et al., U.S. Pat. No. 4,987,071; of Zinzymes as is generally described by Beigelman et al., International PCT publication No. WO 99/55857 (see for example FIG. 32); and of DNAzymes as is generally described by Usman et al., International PCT Publication No. WO 95/11304; Chartrand et al., 1995, *NAR* 23, 4092; Breaker et al., 1995, *Chem. Bio.* 2, 655; Santoro et al., 1997, *PNAS* 94, 4262 (see for example FIG. 33). NCH cleaving motifs are described in Ludwig & Sproat, International PCT Publication No. WO 98/58058; and G-cleavers are described in Kore et al., 1998, *Nucleic Acids Research* 26, 4116–4120 and Eckstein et al., International PCT Publication No. WO 99/16871. These specific motifs are not limiting in the invention and those skilled in the art will recognize that all that is important in an enzymatic nucleic acid molecule of this invention is that it has a specific substrate binding site which is complementary to one or more of the target gene RNA regions, and that it have nucleotide sequences within or surrounding that substrate binding site which impart an RNA cleaving activity to the molecule (Cech et al., U.S. Pat. No. 4,987,071).

Enzymatic nucleic acid molecules of the invention that are allosterically regulated ("allozymes") can be used to modulate VEGR receptor expression. These allosteric enzymatic nucleic acids or allozymes (see for example George et al., U.S. Pat. Nos. 5,834,186 and 5,741,679, Shih et al., U.S. Pat. No. 5,589,332, Nathan et al., U.S. Pat. No. 5,871,914, Nathan and Ellington, International PCT publication No. WO 00/24931, Breaker et al., International PCT Publication Nos. WO 00/26226 and 98/27104, and Sullenger et al., International PCT publication No. WO 99/29842) are designed to respond to a signaling agent. For example, allozymes can be designed to respond to signaling agents, such as flt-1 or kdr protein, flt-1 or kdr RNA, other proteins and/or RNAs involved in VEGF activity, and also, for example, compounds, metals, polymers, molecules and/or drugs that are targeted to VEGF or VEGF receptor, such as flt-1 or kdr expressing cells etc., which in turn modulate the activity of the enzymatic nucleic acid molecule. In response to interaction with a predetermined signaling agent, the activity of the allosteric enzymatic nucleic acid molecule is activated or inhibited such that the expression of a particular target is selectively down-regulated. The target can comprise flt-1 or kdr and/or a predetermined cellular component or receptor that modulates VEGF activity.

In a specific example, allosteric enzymatic nucleic acid molecules that are activated by interaction with a RNA encoding a flt-1 protein are used as therapeutic agents in vivo. The presence of RNA encoding the flt-1 protein activates the allosteric enzymatic nucleic acid molecule that subsequently cleaves the RNA encoding the flt-1 protein, resulting in the inhibition of flt-1 protein expression. In this manner, cells that express the flt-1 protein are selectively targeted.

In another non-limiting example, an allozyme can be activated by an flt-1 protein or peptide that caused the allozyme to inhibit the expression of flt-1 gene by, for example, cleaving RNA encoded by flt-1 gene. In this non-limiting example, the allozyme acts as a decoy to inhibit the function of flt-1 and also inhibit the expression of flt-1 once activated by the flt-1 protein.

In one embodiment, the nucleic acid molecule of the invention, e.g., antisense molecule, triplex DNA, or ribozyme, is 13 to 100 nucleotides in length, e.g., in specific embodiments 35, 36, 37, or 38 nucleotides in length (e.g., for particular ribozymes). In particular embodiments, the nucleic acid molecule is 15–100, 17–100, 20–100, 21–100, 23–100, 25–100, 27–100, 30–100, 32–100, 35–100, 40–100, 50–100, 60–100, 70–100, or 80–100 nucleotides in length. Instead of 100 nucleotides being the upper limit on the length ranges specified above, the upper limit of the length range can be, for example, 30, 40, 50, 60, 70, or 80 nucleotides. Thus, for any of the length ranges, the length range for particular embodiments has a lower limit as specified, with an upper limit as specified which is greater than the lower limit. For example, in a particular embodiment, the length range can be 35–50 nucleotides in length. All such ranges are expressly included. Also in particular embodiments, a nucleic acid molecule can have a length which is any of the lengths specified above, for example, 21 nucleotides in length.

In one embodiment, the invention provides a method for producing a class of enzymatic cleaving agents which exhibit a high degree of specificity for the RNA of a desired target. The enzymatic nucleic acid molecule is preferably targeted to a highly conserved sequence region of target mRNAs encoding VEGF-R proteins (specifically flt-1 and flk-1/KDR) such that specific treatment of a disease or condition can be provided with either one or several enzymatic nucleic acids. Such enzymatic nucleic acid molecules can be delivered exogenously to specific tissue or cellular targets as required. Alternatively, the enzymatic nucleic acid molecules can be expressed from DNA and/or RNA vectors that are delivered to specific cells.

By "highly conserved sequence region" is meant a nucleotide sequence of one or more regions in a nucleic acid molecule that does not vary significantly from one generation to the other or from one biological system to the other.

Synthesis of nucleic acids greater than 100 nucleotides in length is difficult using automated methods, and the therapeutic cost of such molecules is prohibitive. In this invention, small nucleic acid motifs (e.g., antisense oligonucleotides, hammerhead or the hairpin ribozymes) are used for exogenous delivery. The simple structure of these molecules increases the ability of the nucleic acid to invade targeted regions of the mRNA structure. However, these nucleic acid molecules can also be expressed within cells from eukaryotic promoters (e.g., Izant and Weintraub, 1985 *Science* 229, 345; McGarry and Lindquist, 1986 *Proc. Natl. Acad. Sci. USA* 83, 399; SullengerScanlon et al., 1991, *Proc. Natl. Acad. Sci. USA*, 88, 10591–5; Kashani-Sabet et al., 1992 *Antisense Res. Dev.*, 2, 3–15; Dropulic et al., 1992 *J. Virol*, 66, 1432–41; Weerasinghe et al., 1991 *J. Virol*, 65, 5531–4; Ojwang et al., 1992 *Proc. Natl. Acad. Sci. USA* 89, 10802–6; Chen et al., 1992 *Nucleic Acids Res.*, 20, 4581–9; Sarver et al., 1990 *Science* 247, 1222–1225; Thompson et al., 1995 *Nucleic Acids Res.* 23, 2259). Those skilled in the art realize that any nucleic acid can be expressed in eukaryotic cells from the appropriate DNA/RNA vector. The activity of such nucleic acids can be augmented by their release from the primary transcript by a ribozyme (Draper et al., PCT WO93/23569, and Sullivan et al., PCT WO94/02595, both hereby incorporated in their totality by reference herein; Ohkawa et al., 1992 *Nucleic Acids Symp. Ser.*, 27, 15–6; Taira et al., 1991, *Nucleic Acids Res.*, 19, 5125–30; Ventura et al., 1993 *Nucleic Acids Res.*, 21, 3249–55; Chowrira et al., 1994 *J. Biol. Chem.* 269, 25856).

The nucleic acid molecules of the invention are useful for the prevention of diseases and conditions related to the level of VEGF-R, including cancer (including but not limited to tumor and cancer types shown under Diagnosis in Table XX), diabetic retinopathy, macular degeneration, neovascular glaucoma, myopic degeneration, arthritis, psoriasis, verruca vulgaris, angiofibroma of tuberous sclerosis, pot-wine stains, Sturge Weber syndrome, Kippel-Trenaunay-Weber syndrome, Osler-Weber-Rendu syndrome and any other diseases or conditions that are related to the levels of VEGF-R (specifically flt-1 and flk-1/KDR) in a cell or tissue.

By "diseases or conditions related to the level of VEGF-R" is meant that the reduction of VEGF-R (specifically flt-1 and flk-1/KDR) RNA levels and thus reduction in the level of the respective protein will relieve, to some extent, the symptoms of the disease or condition.

Nucleic acid molecules of the invention are added directly, or can be complexed with cationic lipids, packaged within liposomes, or otherwise delivered to target cells or tissues. The nucleic acid or nucleic acid complexes can be locally administered to relevant tissues ex vivo, or in vivo through injection, infusion pump or stent, with or without their incorporation in biopolymers.

In one embodiment, the enzymatic nucleic acid molecule of the invention has one or more binding arms which are complementary to the substrate sequences in Tables II to IX, XIV–XIX, XXII, and XXIII. Examples of such enzymatic nucleic acid molecules also are shown in Tables II to IX, XIV–XIX, XXII, and XXIII. Examples of such enzymatic nucleic acid molecules consist essentially of sequences defined in these Tables.

In yet another embodiment, the invention features antisense nucleic acid molecules and 2–5A chimera including sequences complementary to the target sequences shown in Tables II to IX, XIV–XIX, XXII, and XXIII. Such nucleic acid molecules can include sequences as shown for the binding arms of the enzymatic nucleic acid molecules in Tables II to IX, XIV–XIX, XXII, and XXIII. Similarly, triplex molecules can be provided targeted to the corresponding DNA target regions, and containing the DNA equivalent of a target sequence or a sequence complementary to the specified target (substrate) sequence. Typically, antisense molecules are complementary to a target sequence along a single contiguous sequence of the antisense molecule. However, in certain embodiments, an antisense molecule can bind to substrate such that the substrate molecule forms a loop, and/or an antisense molecule can bind such that the antisense molecule forms a loop. Thus, the antisense molecule can be complementary to two (or even more) non-contiguous substrate sequences or two (or even more) non-contiguous sequence portions of an antisense molecule can be complementary to a target sequence or both.

By "consists essentially of" is meant that the active nucleic acid molecule of the invention, for example, an enzymatic nucleic acid molecule, contains an enzymatic center or core equivalent to those in the examples, and binding arms able to bind RNA such that cleavage at the target site occurs. Other sequences can be present that do not interfere with such cleavage. Thus, a core region can, for example, include one or more loop, stem-loop structure, or linker that does not prevent enzymatic activity. Thus, the underlined regions in the sequences in Tables II, IV, VI, VIII, XIV and XVI can be such a loop, stem-loop, nucleotide linker, and/or non-nucleotide linker and can be represented generally as sequence "X". For example, a core sequence for a hammerhead enzymatic nucleic acid can comprise a conserved sequence, such as 5'-CUGAUGAG-3' and 5'-CGAA-3' connected by "X", where X is 5'-<u>GCCGUUAGGC</u>-3' (SEQ ID NO: 20822), or any other Stem II region known in the art, or a nucleotide and/or non-nucleotide linker. Similarly, for other nucleic acid molecules of the instant invention, such as Inozyme, G-cleaver, amberzyme, zinzyme, DNAzyme, antisense, 2–5A antisense, triplex forming nucleic acid, and decoy nucleic acids, other sequences or non-nucleotide linkers can be present that do not interfere with the function of the nucleic acid molecule.

X can be a linker of $\geq 2$ nucleotides in length, preferably 3, 4, 5, 6, 7, 8, 9, 10, 15, 20, 26, 30, where the nucleotides can preferably be internally base-paired to form a stem of preferably $\geq 2$ base pairs. Alternatively or in addition, X may be a non-nucleotide linker. In yet another embodiment, the nucleotide linker (X) can be a nucleic acid aptamer, such as an ATP aptamer, HIV Rev aptamer (RRE), HIV Tat aptamer (TAR) and others (for a review see Gold et al., 1995, *Annu. Rev. Biochem.*, 64, 763; and Szostak & Ellington, 1993, in *The RNA World*, ed. Gesteland and Atkins, pp. 511, CSH Laboratory Press).

A "nucleic acid aptamer" as used herein is meant to indicate a nucleic acid sequence capable of interacting with a ligand. The ligand can be any natural or a synthetic molecule, including but not limited to a resin, metabolites, nucleosides, nucleotides, drugs, toxins, transition state analogs, peptides, lipids, proteins, amino acids, nucleic acid molecules, hormones, carbohydrates, receptors, cells, viruses, bacteria and others.

In yet another embodiment, the non-nucleotide linker (X) is as defined herein. The term "non-nucleotide" as used herein include either abasic nucleotide, polyether, polyamine, polyamide, peptide, carbohydrate, lipid, or polyhydrocarbon compounds. Specific examples include those described by Seela and Kaiser, *Nucleic Acids Res.* 1990, 18:6353 and *Nucleic Acids Res.* 1987, 15:3113; Cload and Schepartz, *J. Am. Chem. Soc.* 1991, 113:6324; Richardson and Schepartz, *J. Am. Chem. Soc.* 1991, 113:5109; Ma et al., *Nucleic Acids Res.* 1993, 21:2585 and *Biochemistry* 1993, 32:1751; Durand et al., *Nucleic Acids Res.* 1990, 18:6353; McCurdy et al., *Nucleosides & Nucleotides* 1991, 10:287; Jschke et al., *Tetrahedron Lett.* 1993, 34:301; Ono et al., *Biochemistry* 1991, 30:9914; Arnold et al., International Publication No. WO 89/02439; Usman et al., International Publication No. WO 95/06731; Dudycz et al., International Publication No. WO 95/11910 and Ferentz and Verdine, *J. Am. Chem. Soc.* 1991, 113:4000, all hereby incorporated by reference herein. A "non-nucleotide" further means any group or compound which can be incorporated into a nucleic acid chain in the place of one or more nucleotide units, including either sugar and/or phosphate substitutions, and allows the remaining bases to exhibit their enzymatic activity. The group or compound can be abasic in that it does not contain a commonly recognized nucleotide base, such as adenosine, guanine, cytosine, uracil or thymine. Thus, in one embodiment, the invention features an enzymatic nucleic acid molecule having one or more non-nucleotide moieties, and having enzymatic activity to cleave an RNA or DNA molecule.

In another aspect of the invention, enzymatic nucleic acid molecules that cleave target RNA molecules and inhibit VEGF-R (specifically flt-1 and flk-1/KDR) activity are expressed from transcription units inserted into DNA or RNA vectors. The recombinant vectors are preferably DNA plasmids or viral vectors. Enzymatic nucleic acid expressing viral vectors can be constructed based on, but not limited to, adeno-associated virus, retrovirus, adenovirus, or alphavirus vectors. Preferably, the recombinant vectors capable of expressing the enzymatic nucleic acid molecules are delivered as described above, and persist in target cells. Alternatively, viral vectors can be used that provide for transient expression of enzymatic nucleic acids. Such vectors can be repeatedly administered as necessary. Once expressed, the enzymatic nucleic acids cleave the target mRNA. Delivery of enzymatic nucleic acids expressing vectors can be systemic, such as by intravenous or intramuscular administration, by administration to target cells ex-planted from the patient followed by reintroduction into the patient, or by any other means that would allow for introduction into the desired target cell.

By "vectors" is meant any nucleic acid- and/or viral-based technique used to deliver a desired nucleic acid.

By "patient" is meant an organism which is a donor or recipient of explanted cells or the cells themselves. "Patient" also refers to an organism to which the nucleic acid molecules of the invention can be administered. In one embodiment, the patient is a mammal or mammalian cells. Preferably, the patient is a human or human cells.

The nucleic acid molecules of the instant invention, individually, or in combination or in conjunction with other drugs, can be used to treat diseases or conditions discussed above. For example, to treat a disease or condition associated with VEGF-R, the patient can be treated, or other appropriate cells can be treated, as is evident to those skilled in the art, individually with a nucleic acid molecule of the invention or in combination with one or more drugs under conditions suitable for the treatment.

For example, to treat a disease or condition associated with VEGF-R levels, such as cancer (e.g., colorectal cancer, breast cancer) or ocular diseases (e.g., diabetic retinopathy or age related macular degeneration) a patient may be treated, or other appropriate cells may be treated, as is evident to those skilled in the art, individually or in combination with one or more drugs under conditions suitable for the treatment.

In a further embodiment, the described molecules, such as antisense or enzymatic nucleic acid molecules can be used in combination with other known treatments to treat conditions or diseases discussed above. For example, the described molecules can be used in combination with one or more known therapeutic agents to treat cancer.

In another embodiment, the invention features nucleic acid-based techniques (e.g., enzymatic nucleic acid molecules (ribozymes such as Inozyme, G-cleaver, amberzyme, zinzyme), DNAzyme, antisense nucleic acids, 2–5A antisense chimeras, triplex forming nucleic acid, decoy nucleic acids, aptamers, allozymes, antisense nucleic acids containing RNA cleaving chemical groups (Cook et al., U.S. Pat. No. 5,359,051)] and methods for their use to down regulate or inhibit the expression of genes capable of inducing angiogenesis (e.g., flt-1 and kdr).

In another embodiment, the invention features nucleic acid-based techniques (e.g., enzymatic nucleic acid molecules (ribozymes such as Inozyme, G-cleaver, amberzyme, zinzyme), DNAzyme, antisense nucleic acids, 2–5A antisense chimeras, triplex forming nucleic acid, decoy nucleic acids, aptamers, allozymes, antisense nucleic acids containing RNA cleaving chemical groups (Cook et al., U.S. Pat. No. 5,359,051)] and methods for their use to down regulate or inhibit the expression of VEGF receptor.

Other features and advantages of the invention will be apparent from the following description of the preferred embodiments thereof, and from the claims.

BRIEF DESCRIPTION OF THE DRAWINGS

FIG. 1 is a diagrammatic representation of the hammerhead ribozyme domain known in the art. Stem II can be $\geq 2$ base-pair long.

FIGS. 2a–d show hammerhead ribozyme substrate motifs. FIG. 2a is a diagrammatic representation of the hammerhead ribozyme domain known in the art; FIG. 2b is a diagrammatic representation of the hammerhead ribozyme as divided by Uhlenbeck (1987, Nature, 327, 596–600) into a substrate and enzyme portion; FIG. 2c is a similar diagram showing the hammerhead divided by Haseloff and Gerlach (1988, Nature, 334, 585–591) into two portions; and FIG. 2d is a similar diagram showing the hammerhead divided by Jeffries and Symons (1989, Nucl. Acids. Res., 17, 1371–1371) into two portions.

FIG. 3 is a diagrammatic representation of the general structure of a hairpin ribozyme. Helix 2 (H2) is provided with at least 4 base pairs (i.e., n is 1, 2, 3 or 4) and helix 5 can be optionally provided of length 2 or more bases (preferably 3–20 bases, i.e., m is from 1–20 or more). Helix 2 and helix 5 can be covalently linked by one or more bases (i.e., r is $\geq 1$ base). Helix 1, 4 or 5 can also be extended by 2 or more base pairs (e.g., 4–20 base pairs) to stabilize the ribozyme structure, and preferably is a protein binding site. In each instance, each N and N' independently is any normal or modified base and each dash represents a potential base-pairing interaction. These nucleotides can be modified at the sugar, base or phosphate. Complete base-pairing is not required in the helices, but is preferred. Helix 1 and 4 can be of any size (i.e., o and p is each independently from 0 to any number, e.g., 20) as long as some base-pairing is maintained. Essential bases are shown as specific bases in the structure, but those in the art will recognize that one or more can be modified chemically (abasic, base, sugar and/or phosphate modifications) or replaced with another base without significant effect. Helix 4 can be formed from two separate molecules, i.e., without a connecting loop. The connecting loop when present can be a ribonucleotide with or without modifications to its base, sugar or phosphate. "q" is $\geq 2$ bases. The connecting loop can also be replaced with a non-nucleotide linker molecule. H refers to bases A, U, or C. Y refers to pyrimidine bases. "_____" refers to a covalent bond.

FIG. 4 is a representation of the general structure of the hepatitis delta virus ribozyme domain known in the art.

FIG. 5 is a representation of the general structure of the VS RNA ribozyme domain.

FIG. 6 is a schematic representation of an RNAseH accessibility assay. Specifically, the left side of FIG. 6 is a diagram of complementary DNA oligonucleotides bound to accessible sites on the target RNA. Complementary DNA oligonucleotides are represented by broad lines labeled A, B, and C. Target RNA is represented by the thin, twisted line. The right side of FIG. 6 is a schematic of a gel separation of uncut target RNA from a cleaved target RNA. Detection of target RNA is by autoradiography of body-labeled, T7 transcript. The bands common to each lane represent uncleaved target RNA; the bands unique to each lane represent the cleaved products.

FIG. 7 shows the effect of hammerhead ribozymes targeted against flt-1 receptor on the binding of VEGF to the surface of human microvascular endothelial cells.

Figure 27:
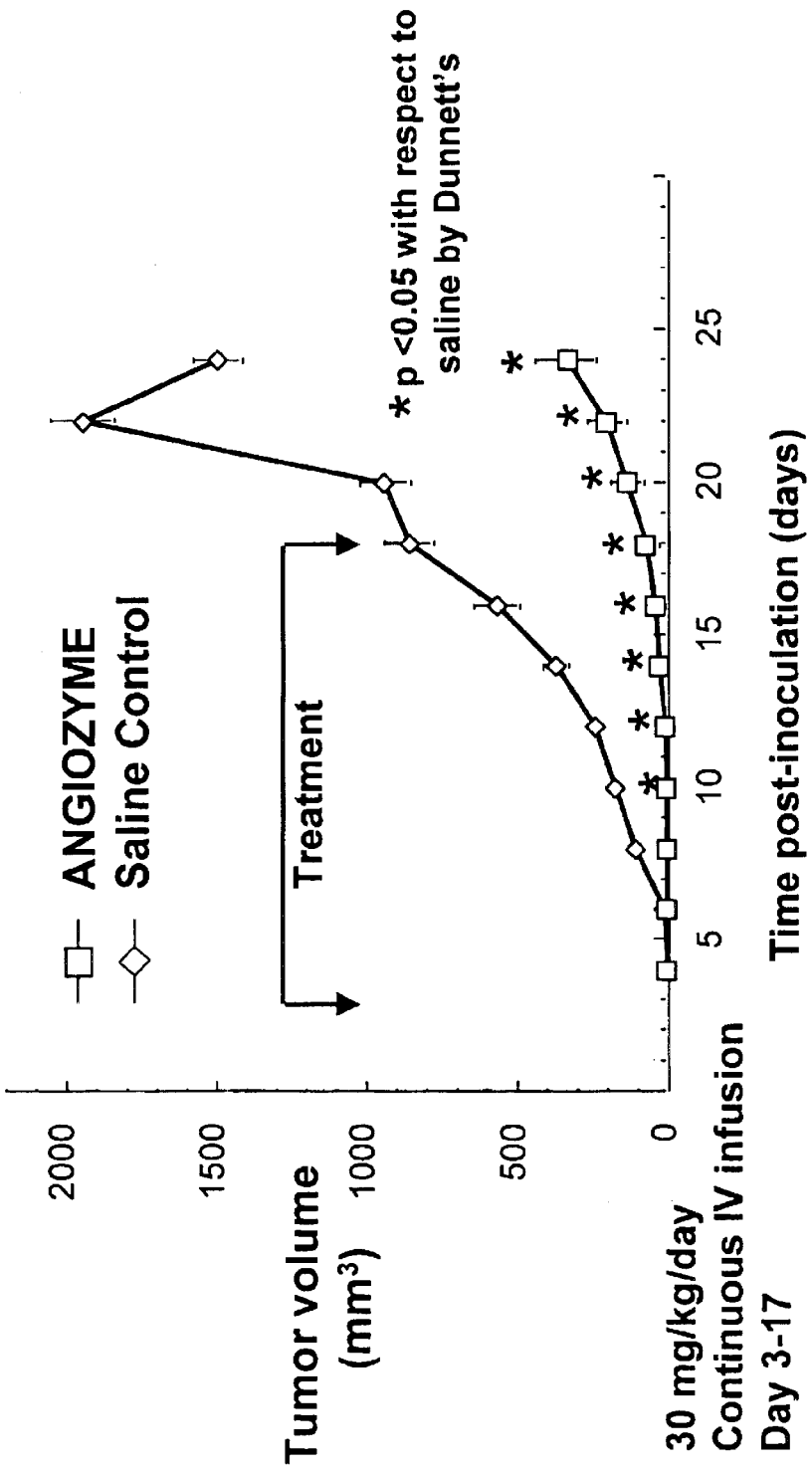

Sequences of the ribozymes used are shown in Table II; the length of stem II region is 3 bp. The hammerhead ribozymes were chemically modified such that the ribozyme consists of ribose residues at five positions (see FIG. 11); U4 and U7 positions contain 2'-NH$_2$ modifications, the remaining nucleotide positions contain 2'-O-methyl substitutions; four nucleotides at the 5' terminus contains phosphorothioate substitutions. Additionally, the 3' end of the ribozyme contains a 3'-3' linked inverted abasic deoxyribose. The results of two separate experiments are shown as separate bars for each set. Each bar represents the average of triplicate samples. The standard deviation is shown with error bars. For the flt-1 data, 500 nM ribozyme (3:1 charge ratio with LipofectAMINE®) was used. Control 1–10 is the control for ribozymes 307–2797, control 11–20 is the control for ribozymes 3008–5585. The Control 1–10 and Control 11–20 represent the treatment of cells with LipofectAMINE® alone without any ribozymes.

FIG. 8 shows the effect of hammerhead ribozymes targeted against KDR receptor on the binding of VEGF to KDR on the surface of human microvascular endothelial cells. Sequences of the ribozymes used are shown in Table IV; the length of stem II region is 3 bp. The hammerhead ribozymes were chemically modified such that the ribozyme consists of ribose residues at five positions (see FIG. 11); U4 and U7 positions contain 2'-NH$_2$ modifications, the remaining nucleotide positions contain 2'-O-methyl substitutions; four nucleotides at the 5' terminus contains phosphorothioate substitutions. Additionally, the 3' end of the ribozyme contains a 3'-3' linked inverted abasic deoxyribose. The Control 1–10 and Control 11–20 represent the treatment of cells with LipofectAMINE® alone without any ribozymes. Irrel. RZ, is a control experiment wherein the cells are treated with a non-KDR-targeted ribozyme complexed with Lipofectamine®. 200 nM ribozyme (3:1 charge ratio with LipofectAMINE®) was used. In addition to the KDR-targeted ribozymes, the effect on VEGF binding of a ribozyme targeted to an irrelevant mRNA (irrel. RZ) is also shown. Because the affinity of KDR for VEGF is about 10-fold lower than the affinity of flt-1 for VEGF, a higher concentration of VEGF was used in the binding assay.

FIG. 9 shows the specificity of hammerhead ribozymes targeted against flt-1 receptor. Inhibition of the binding of VEGF, urokinase plasminogen activator (UPA) and fibroblast growth factor (FGF) to their corresponding receptors as a function of anti-FLT ribozymes is shown. The sequence and description of the ribozymes used are as described in FIG. 7 above. The average of triplicate samples is given; percent inhibition as calculated below.

FIG. 10 shows the inhibition of the proliferation of Human aortic endothelial cells (HAEC) mediated by phosphorothioate antisense oligodeoxynucleotides targeted against human KDR receptor RNA. Cell proliferation (O.D. 490) as a function of antisense oligodeoxynucleotide concentration is shown. KDR 21AS represents a 21 nt phosphorothioate antisense oligodeoxynucleotide targeted against KDR RNA. KDR 21 Scram represents a 21 nt phosphorothioate oligodeoxynucleotide having a scrambled sequence. LF represents the lipid carrier Lipofectin.

"FIGS. 11A and B show a diagrammatic representation of hammerhead ribozymes targeted against flt-1 RNA and in vitro cleavage of flt-1 RNA by hammerhead ribozymes. The hammerhead (HH) ribozymes were chemically modified such that the ribozyme consists of ribose residues at five positions; U4 and U7 positions contain 2'-NH$_2$ modifications, the remaining nucleotide positions contain 2'-O-methyl substitutions; four nucleotides at the 5' terminus contains phosphorothioate substitutions. Additionally, the 3' end of the ribozyme contains a 3'-3' linked inverted abasic deoxyribose (designated as 3'-iH). FIG. 11A shows hammerhead ribozymes 1358 HH-A and 4229 HH-A, which contain a 3 base-paired stem II region. FIG. 11B shows hammerhead ribozymes 1358 HH-B and 4229 HH-B, which contain a 4 base-paired stem II region. FIGS. 11C and 11D show in vitro cleavage kinetics of hammerhead ribozymes targeted against sites 1358 and 4229 within the flt-1 RNA."

"FIG. 12A shows a diagrammatic representation of hammerhead (HH) ribozymes targeted against sites 1358 and 4229 within the flt-1 RNA. The hammerhead (HH) ribozymes were chemically modified such that the ribozyme consists of ribose residues at five positions; U4 position contains 2'-C-allyl modification, the remaining nucleotide positions contain 2'-O-methyl substitutions; four nucleotides at the 5' terminus contains phosphorothioate substitutions. Additionally, the 3' end of the ribozyme contains a 3'-3' linked inverted abasic deoxyribose (designated as 3'-iH). FIG. 12B shows a graphical representation of the inhibition of cell proliferation mediated by 1358HH and 4229HH ribozymes."

FIG. 13 shows inhibition of human microvascular endothelial cell proliferation mediated by anti-KDR hammerhead ribozymes. The figure is a graphical representation of the inhibition of cell proliferation mediated by hammerhead ribozymes targeted against sites 527, 730, 3702 and 3950 within the KDR RNA. Irrelevant HH RZ is a hammerhead ribozyme targeted to an irrelevant target. All of these ribozymes, including the Irrelevant HH RZ, were chemically modified such that the ribozyme consists of ribose residues at five positions; U4 and U7 positions contain 2'-NH$_2$ modifications, the remaining nucleotide positions contain 2'-O-methyl substitutions; four nucleotides at the 5' termini contain phosphorothioate substitutions. Additionally, the 3' end of the ribozyme contains a 3'-3' linked inverted abasic deoxyribose (3'-iH).

FIG. 14 shows in vitro cleavage of KDR RNA by hammerhead ribozymes. The hammerhead (HH) ribozymes were chemically modified such that the ribozyme consists of ribose residues at five positions; U4 and U7 positions contain 2'-NH$_2$ modifications, the remaining nucleotide positions contain 2'-O-methyl substitutions. Additionally, the 3' end of the ribozyme contains a 3'-3' linked inverted abasic deoxyribose (designated as 3'-iH). 726 HH and 527 HH contain 4 base-paired stem II region. Percent in vitro cleavage kinetics as a function of time of HH ribozymes targeted against sites 527 and 726 within the KDR RNA is shown.

FIG. 15 shows in vitro cleavage of KDR RNA by hammerhead ribozymes. The hammerhead (HH) ribozymes were chemically modified such that the ribozyme consists of ribose residues at five positions; U4 and U7 positions contain 2'-NH$_2$ modifications, the remaining nucleotide positions contain 2'-O-methyl substitutions. Additionally, the 3' end of the ribozyme contains a 3'-3' linked inverted abasic deoxyribose (designated as 3'-iH). 3702 HH and 3950 HH contain 4 base-paired stem II region. Percent in vitro cleavage kinetics as a function of time of HH ribozymes targeted against sites 3702 and 3950 within the KDR RNA is shown.

FIG. 16 shows in vitro cleavage of RNA by hammerhead ribozymes that are targeted to sites that are conserved between flt-1 and KDR RNA. The hammerhead (HH) ribozymes were chemically modified such that the ribozyme consists of ribose residues at five positions; U4 and U7 positions contain 2'-NH$_2$ modifications, the remaining nucleotide positions contain 2'-O-methyl substitutions. Additionally, the 3' end of the ribozyme contains a 3'-3' linked inverted abasic deoxyribose (designated as 3'-iH). FLT/KDR-IHH ribozyme was synthesized with either a 4 base-paired or a 3 base-paired stem II region. FLT/KDR-IHH can cleave site 3388 within flt-1 RNA and site 3151 within KDR RNA. Percent in vitro cleavage kinetics as a function of time of HH ribozymes targeted against sites 3702 and 3950 within the KDR RNA is shown.

FIG. 17 shows inhibition of human microvascular endothelial cell proliferation mediated by anti-KDR and anti-flt-1 hammerhead ribozymes. The figure is a graphical representation of the inhibition of cell proliferation mediated by hammerhead ribozymes targeted against sites KDR sites 527, 726 or 3950 or flt-1 site 4229. The figure also shows enhanced inhibition of cell proliferation by a combination of flt-1 and KDR hammerhead ribozymes. 4229+527, indicates the treatment of cells with both the flt 4229 and the KDR 527 ribozymes. 4229+726, indicates the treatment of cells with both the flt 4229 and the KDR 726 ribozymes. 4229+3950, indicates the treatment of cells with both the flt 4229 and the KDR 3950 ribozymes. VEGF-, indicates the basal level of cell proliferation in the absence of VEGF. A, indicates catalytically active ribozyme; I, indicates catalytically inactive ribozyme. All of these ribozymes were chemically modified such that the ribozyme consists of ribose residues at five positions; U4 and U7 positions contain 2'-NH$_2$ modifications, the remaining nucleotide positions contain 2'-O-methyl substitutions; four nucleotides at the 5' termini contain phosphorothioate substitutions. Additionally, the 3' end of the ribozyme contains a 3'-3' linked inverted abasic deoxyribose (3'-iH).

FIG. 18 shows the inhibition of VEGF-induced angiogenesis in rat cornea mediated by anti-flt-1 hammerhead ribozyme. All of these ribozymes were chemically modified such that the ribozyme consists of ribose residues at five positions; U4 position contains 2'-C-allyl modifications, the remaining nucleotide positions contain 2'-O-methyl substitutions; four nucleotides at the 5' termini contain phosphorothioate substitutions. Additionally, the 3' end of the ribozyme contains a 3'-3' linked inverted abasic deoxyribose (3'-iH). A decrease in the Surface Area corresponds to a reduction in angiogenesis. VEGF alone corresponds to treatment of the cornea with VEGF and no ribozymes. Vehicle alone corresponds to the treatment of the cornea with the carrier alone and no VEGF. This control gives a basal level of Surface Area. Active 4229 HH, corresponds to the treatment of cornea with the flt-1 4229 HH ribozyme in the absence of any VEGF. This control also gives a basal level of Surface Area. Active 4229 HH+VEGF, corresponds to the co-treatment of cornea with the flt-1 4229 HH ribozyme and VEGF. Inactive 4229 HH+VEGF, corresponds to the co-treatment of cornea with a catalytically inactive version of 4229 HH ribozyme and VEGF.

FIG. 19 shows ribozyme-mediated inhibition of cell proliferation. Cultured HMVEC-d were treated with ribozyme or attenuated controls as LIPOFECTAMINE™ complexes. After treatment, cells were stimulated with VEGF$_{165}$ or bFGF and allowed to grow for 48 h prior to determining the cell number. Each ribozyme was tested in triplicate at three concentrations and data are presented as mean cell number per well +SD. The data obtained following ribozyme treatment and VEGF stimulation are presented in panels A & B for anti-Flt-1 ribozymes and panels D & E for anti-KDR ribozymes. Representative data obtained following ribozyme treatment and bFGF stimulation are shown in panel C for one anti-Flt-1 ribozyme and in panel F for one anti-KDR ribozyme. In all panels, active ribozymes are represented with filled symbols; attenuated controls with open symbols. In addition to the ribozymes and attenuated controls listed in Table XII, a second set having the same sequences but with an additional basepair in the "stem II" region of the ribozyme are also shown for VEGF-induced proliferation studies. These 4 bp stem II ribozymes and attenuated controls have one additional base pair such that the stem II/loop sequence is ggccgaaaggcc (SEQ ID NO: 20823). Therefore, ribozymes and controls with 3 or 4 basepair stem IIs are denoted with circles and squares, respectively. The data for one irrelevant ribozyme (filled triangle, panel B) are also shown. This irrelevant ribozyme contains an active core sequence but has no binding site in either Flt-1 or KDR mRNA. Its sequence is 5'-g$_s$a$_s$a$_s$g$_s$gaacUGAuGaggccgaaaggccGaaA gauggcT-3' (SEQ ID NO: 20824) with modifications as in Table XII except that T indicates a 3'-3' inverted deoxythymidine. For reference, the average number of cells in control wells after 48 h in the absence of VEGF or bFGF for each of the panels are as follows: A, B, C, 12477±617; D, E, F, 17182±1053.

FIG. 20 shows target specificity of anti-Flt-1 and KDR ribozymes. Cultured HMVEC-d were treated with LIPOFECTAMINE™ complexes containing 200 nM active ribozyme (A) or attenuated control (C) and analyzed by RNAse protection following 24 h of VEGF-stimulated growth. Data obtained for ribozymes and attenuated controls that target Flt-1 site 4229 or KDR site 726 are shown. Data were normalized to the level of an internal mRNA control (cyclophilin) and are presented as percent decrease in Flt-1 (left panel) or KDR mRNA (right panel) relative to an untreated control. Error bars indicate the range of duplicate samples.

FIG. 21 shows antiangiogenic efficacy of ribozyme in the rat corneal model of VEGF-induced angiogenesis. The percent inhibition of VEGF-induced angiogenesis for locally administered anti-Flt-1 (site 4229) ribozyme (filled circles) and their attenuated controls (open circles) are plotted over the dose range tested. Pixels associated with background structures including the iris were subtracted from all treatment groups. Data are expressed as mean percent reduction in VEGF-induced angiogenesis ±SEM. *$p<0.05$ relative to VEGF/vehicle treated controls by Dunnett's, **$p<0.05$ relative to attenuated dose-matched controls by Tukey-Kramer.

FIG. 22 shows antiangiogenic efficacy of ribozyme in the rat corneal model of VEGF-induced angiogenesis. The percent inhibition of VEGF-induced angiogenesis for locally administered anti-KDR (site 726) ribozyme (filled circles) and their attenuated controls (open circles) are plotted over the dose range tested. Pixels associated with background structures including the iris were subtracted from all treatment groups. Data are expressed as mean percent reduction in VEGF-induced angiogenesis ±SEM. *$p<0.05$ relative to VEGF/vehicle treated controls by Dunnett's, **$p<0.05$ relative to attenuated dose-matched controls by Tukey-Kramer.

FIG. 23 shows the effect of subcutaneous bolus administration of ANGIOZYME™ in a mouse Lewis Lung Carcinoma (LLC) model.

FIG. 24 shows the effect of ANGIOZYME™ in combination with gemcitabine or cyclophosphamide on primary tumor growth in the mouse LLC model.

FIG. 25 shows the effect of ANGIOZYME™ in combination with gemcitabine or cyclophosphamide on tumor metastases in the mouse LLC model.

FIG. 26 shows a secondary structure model of ANGIOZYME™ ribozyme bound to its RNA target.

FIG. 27 shows a time course of inhibition of primary tumor growth following systemic administration of ANGIOZYME™ in the LLC mouse model.

Figure 28:
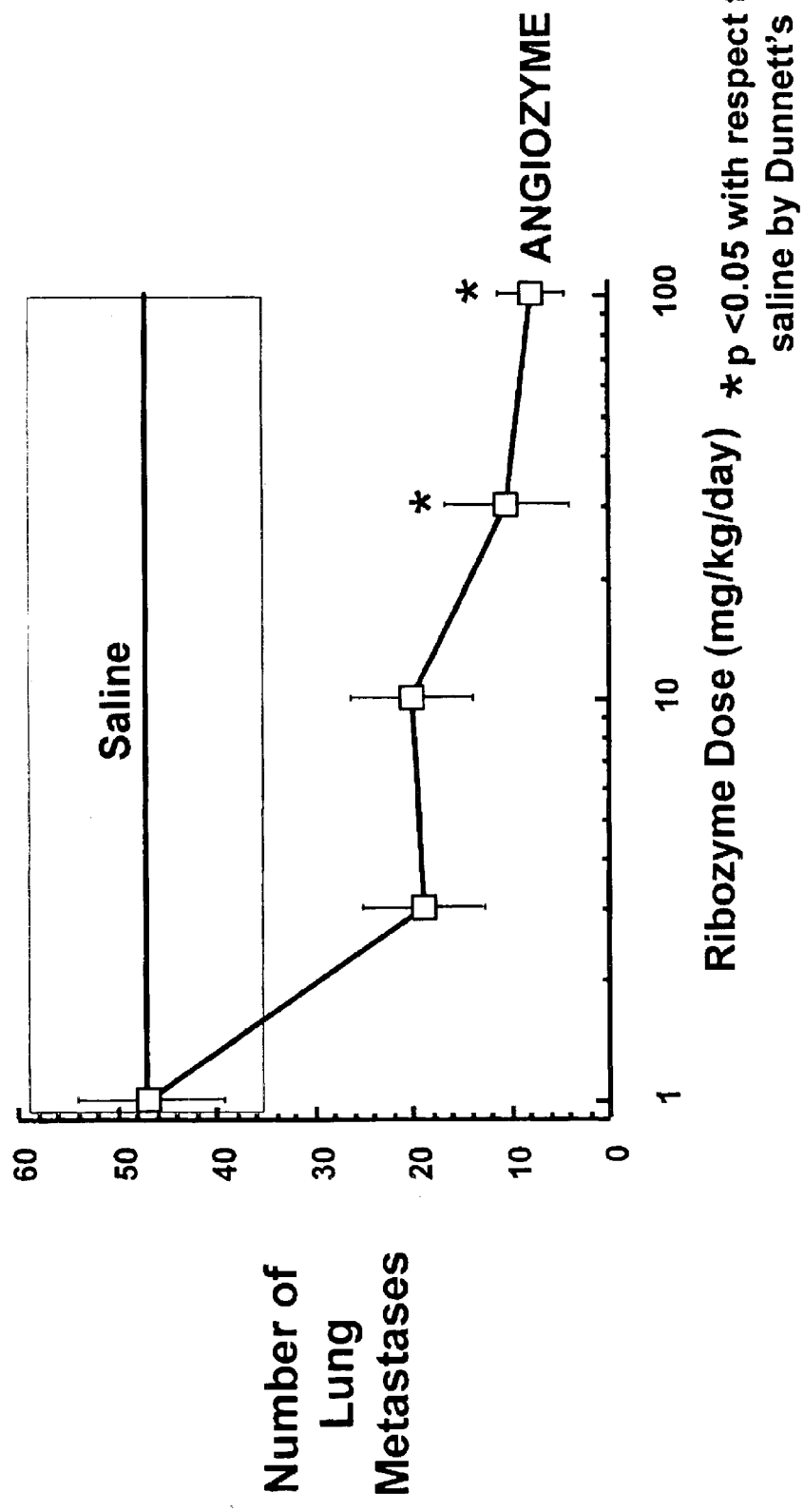

FIG. 28 shows inhibition of primary tumor growth following systemic administration of ANGIOZYME™ according to a certain dosing regimen in the LLC mouse model.

Figure 29:
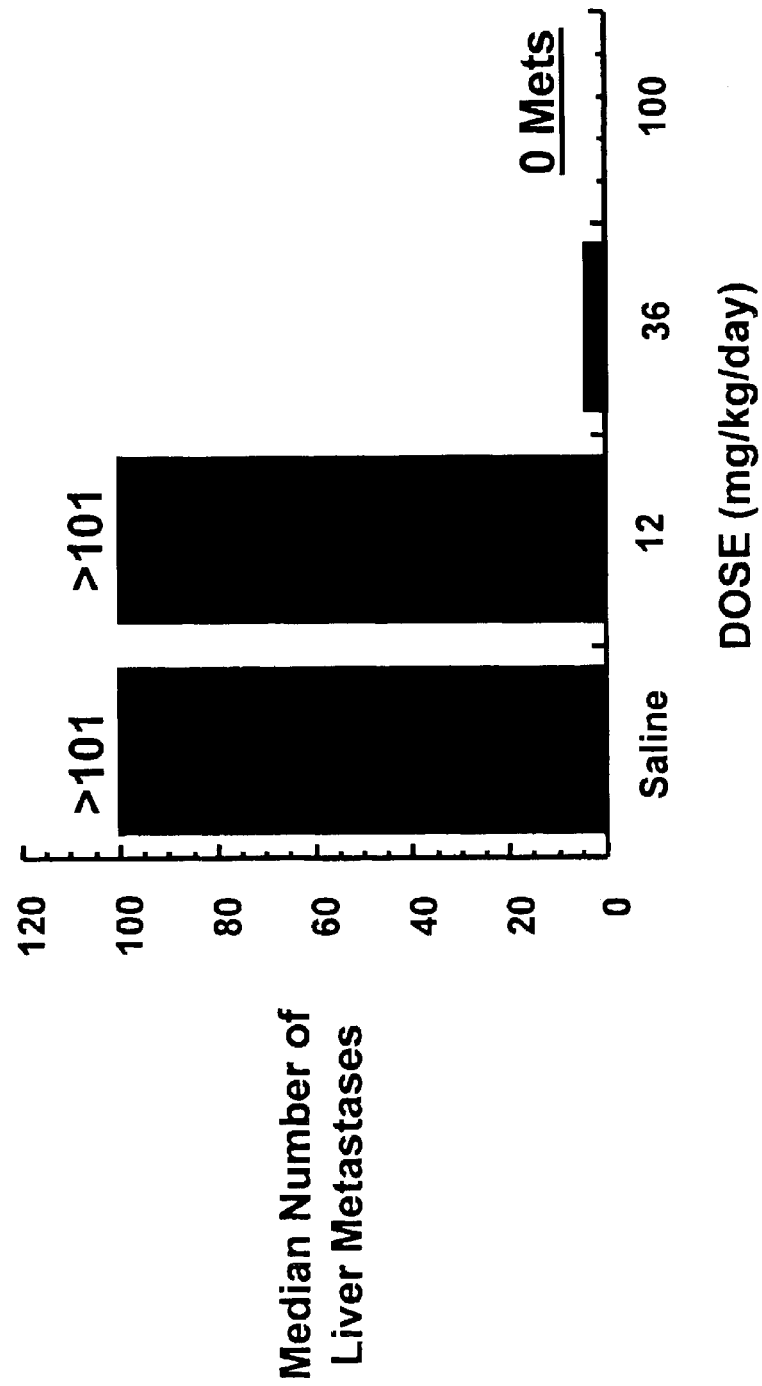

FIG. 29 shows a dose-dependent inhibition of tumor metastases following systemic administration of ANGIOZYME™ in a mouse colorectal model.

Figure 30:
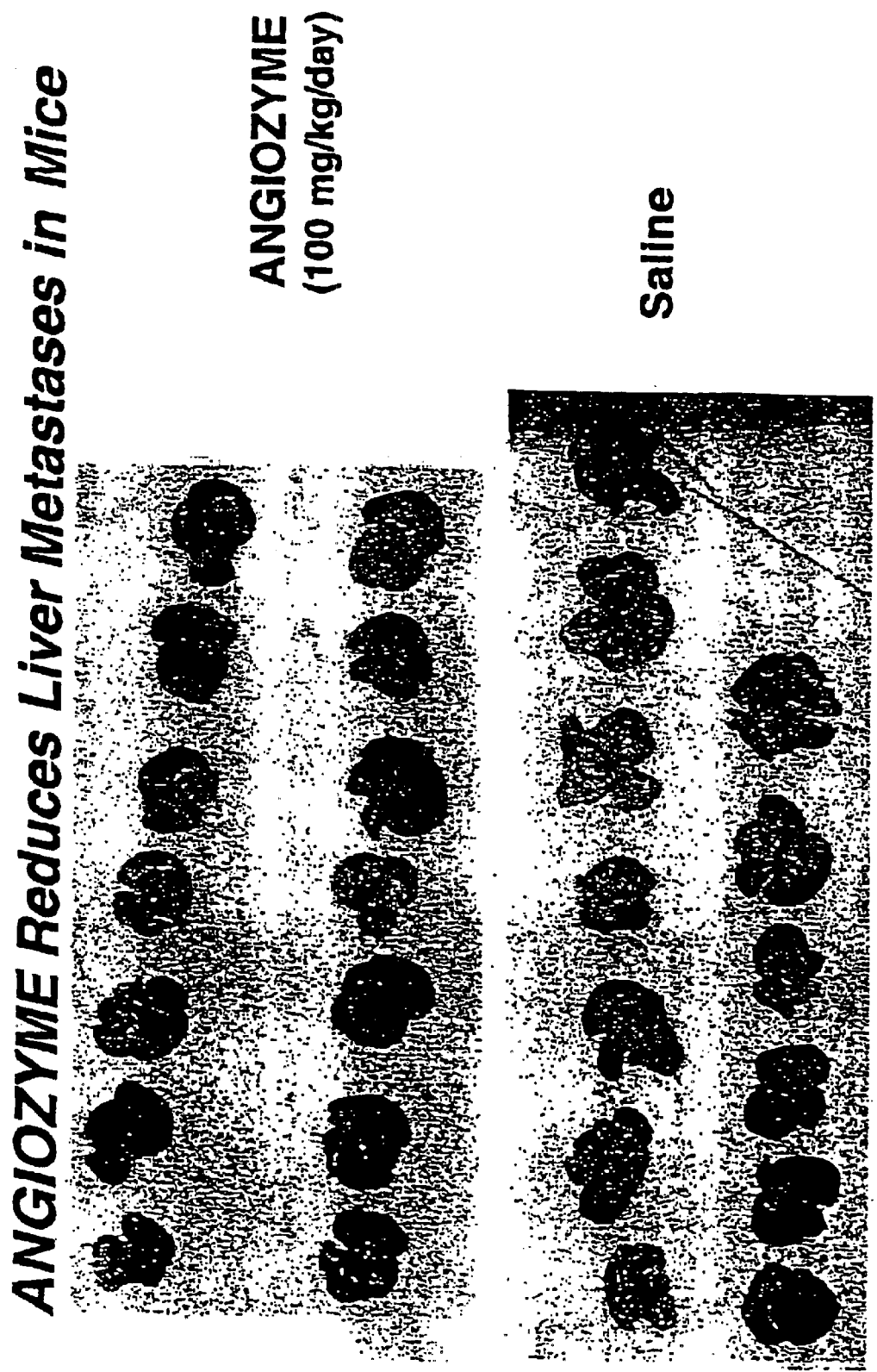

FIG. 30 shows inhibition of liver metastases following systemic administration of ANGIOZYME™ in a mouse colorectal model.

FIG. 31 is a graph showing the plasma concentration profile of ANGIOZYME™ after a single subcutaneous (SC) dose of 10, 30, 100 or 300 mg/m$^2$.

FIG. 32 shows an example of the Zinzyme enzymatic nucleic acid motif that is chemically stabilized (see for example Beigelman et al., International PCT publication No. WO 99/55857, incorporated by reference herein; also referred to as Class A or Class II Motif). The Zinzyme motif is a class of enzymatic nucleic molecules that do not require the presence of a ribonucleotide (2'-OH) group for its activity.

FIG. 33 shows an example of a DNAzyme motif described generally, for example in Santoro et al., 1997, *PNAS*, 94, 4262.

FIGS. 34A and B show a mouse model protocol and results of proliferative retinopathy. FIG. 34A shows anoutline for the mouse model of proliferative retinopathy showing the points of ribozyme administration. FIG. 34B shows a graph demonstrating the efficacy of a VEGF-receptor-targeted enzymatic nucleic acid molecule in a mouse model of proliferative retinopathy.

DETAILED DESCRIPTION OF THE INVENTION

Mechanism of Action of Nucleic Acid Molecules of the Invention

Antisense: Antisense molecules can be modified or unmodified RNA, DNA, or mixed polymer oligonucleotides and primarily function by specifically binding to matching sequences resulting in inhibition of peptide synthesis (Wu-Pong, November 1994, *BioPharm*, 20–33). The antisense oligonucleotide binds to target RNA by Watson Crick base-pairing and blocks gene expression by preventing ribosomal translation of the bound sequences either by steric blocking or by activating RNase H enzyme. Antisense molecules can also alter protein synthesis by interfering with RNA processing or transport from the nucleus into the cytoplasm (Mukhopadhyay & Roth, 1996, *Crit. Rev. in Oncogenesis* 7, 151–190).

In addition, binding of single stranded DNA to RNA can result in nuclease degradation of the heteroduplex (Wu-Pong, supra; Crooke, supra). To date, the only backbone modified DNA chemistry which acts as substrates for RNase H are phosphorothioates and phosphorodithioates. Recently it has been reported that 2'-arabino and 2'-fluoro arabino-containing oligos can also activate RNase H activity.

A number of antisense molecules have been described that utilize novel configurations of chemically modified nucleotides, secondary structure, and/or RNase H substrate domains (Woolf et al., International PCT Publication No. WO 98/13526; Thompson et al., U.S. Ser. No. 60/082,404 which was filed on Apr. 20, 1998; Hartmann et al., U.S. Ser. No. 60/101,174 which was filed on Sep. 21, 1998) all of these are incorporated by reference herein in their entirety.

Triplex Forming Oligonucleotides (TFO): Single stranded DNA can be designed to bind to genomic DNA in a sequence specific manner. TFOs are comprised of pyrimidine-rich oligonucleotides which bind DNA helices through Hoogsteen Base-pairing (Wu-Pong, supra). The resulting triple helix composed of the DNA sense, DNA antisense, and TFO disrupts RNA synthesis by RNA polymerase. The TFO mechanism can result in gene expression or cell death since binding may be irreversible (Mukhopadhyay & Roth, supra).

2–5A Antisense Chimera: The 2–5A system is an interferon mediated mechanism for RNA degradation found in higher vertebrates (Mitra et al., 1996, *Proc Nat Acad Sci USA* 93, 6780–6785). Two types of enzymes, 2–5A synthetase and RNase L, are required for RNA cleavage. The 2–5A synthetases require double stranded RNA to form 2'-5' oligoadenylates (2–5A). 2–5A then acts as an allosteric effector for utilizing RNase L which has the ability to cleave single stranded RNA. The ability to form 2–5A structures with double stranded RNA makes this system particularly useful for inhibition of viral replication.

(2'-5') oligoadenylate structures can be covalently linked to antisense molecules to form chimeric oligonucleotides capable of RNA cleavage (Torrence, supra). These molecules putatively bind and activate a 2–5A dependent RNase, the oligonucleotide/enzyme complex then binds to a target RNA molecule which can then be cleaved by the RNase enzyme.

Enzymatic Nucleic Acid: Seven basic varieties of naturally-occurring enzymatic RNAs are presently known. In addition, several in vitro selection (evolution) strategies (Orgel, 1979, *Proc. R. Soc. London*, B 205, 435) have been used to evolve new nucleic acid catalysts capable of catalyzing cleavage and ligation of phosphodiester linkages (Joyce, 1989, *Gene*, 82, 83–87; Beaudry et al., 1992, *Science* 257, 635–641; Joyce, 1992, *Scientific American* 267, 90–97; Breaker et al., 1994, *TIBTECH* 12, 268; Bartel et al., 1993, *Science* 261:1411–1418; Szostak, 1993, *TIBS* 17, 89–93; Kumar et al., 1995, *FASEB J.*, 9, 1183; Breaker, 1996, *Curr. Op. Biotech.*, 7, 442; Santoro et al., 1997, *Proc. Natl. Acad. Sci.*, 94, 4262; Tang et al., 1997, *RNA* 3, 914; Nakamaye & Eckstein, 1994, supra; Long & Uhlenbeck, 1994, supra; Ishizaka et al., 1995, supra; Vaish et al., 1997, *Biochemistry* 36, 6495; all of these are incorporated by reference herein). Each can catalyze a series of reactions including the hydrolysis of phosphodiester bonds in trans (and thus can cleave other RNA molecules) under physiological conditions.

Enzymatic nucleic acid molecules of this invention block to some extent VEGF-R (specifically flt-1 and flk-1/KDR) production and can be used to treat disease or diagnose such disease. Enzymatic nucleic acid molecules are delivered to cells in culture, to cells or tissues in animal models of angiogenesis and/or RA and to human cells or tissues ex vivo or in vivo. Enzymatic nucleic acid molecule cleavage of VEGF-R RNAs (specifically RNAs that encode flt-1 and flk-1/KDR) in these systems can alleviate disease symptoms.

The enzymatic nature of enzymatic nucleic acid molecules, such as ribozymes, has significant advantages, such as the concentration of enzymatic nucleic acid necessary to affect a therapeutic treatment is lower. This advantage reflects the ability of the enucleic acid molecule to act enzymatically. Thus, a single enzymatic nucleic acid molecule is able to cleave many molecules of target RNA. In addition, the enzymatic nucleic acid molecule is a highly specific inhibitor, with the specificity of inhibition depending not only on the base-pairing mechanism of binding to the target RNA, but also on the mechanism of target RNA cleavage. Single mismatches, or base-substitutions, near the site of cleavage can be chosen to completely eliminate catalytic activity of an enzymatic nucleic acid molecule.

Nucleic acid molecules having an endonuclease enzymatic activity are able to repeatedly cleave other separate RNA molecules in a nucleotide base sequence-specific manner. Such enzymatic nucleic acid molecules can be targeted to virtually any RNA transcript, and achieved efficient cleavage in vitro (Zaug et al., 324, *Nature* 429 1986; Uhlenbeck, 1987 *Nature* 328, 596; Kim et al., 84 *Proc. Natl. Acad. Sci. USA* 8788, 1987; Dreyfus, 1988, *Einstein Quart. J. Bio. Med.*, 6, 92; Haseloff and Gerlach, 334 *Nature* 585, 1988; Cech, 260 *JAMA* 3030, 1988; and Jefferies et al., 17 *Nucleic Acids Research* 1371, 1989; Santoro et al., 1997 supra).

Because of their sequence specificity, enzymatic nucleic acids, such as trans-cleaving ribozymes can be used as therapeutic agents for human disease (Usman & McSwiggen, 1995 *Ann. Rep. Med. Chem.* 30, 285–294; Christoffersen and Marr, 1995 *J. Med. Chem.* 38, 2023–2037). Enzymatic nucleic acid molecules can be designed to cleave specific RNA targets within the background of cellular RNA. Such a cleavage event renders the RNA non-functional and abrogates protein expression from that RNA. In this manner, synthesis of a protein associated with a disease state can be selectively inhibited.

Target sites

Targets for useful enzymatic nucleic acid molecules and antisense nucleic acids can be determined as disclosed in Draper et al., WO 93/23569; Sullivan et al., WO 93/23057; Thompson et al., WO 94/02595; Draper et al., WO 95/04818; McSwiggen et al., U.S. Pat. No. 5,525,468, and hereby incorporated by reference herein in totality. Other examples include the following PCT applications which concern inactivation of expression of disease-related genes: WO 95/23225, WO 95/13380, WO 94/02595, incorporated by reference herein. Rather than repeat the guidance provided in those documents here, below are provided specific examples of such methods, not limiting to those with skill in the art. Enzymatic nucleic acid molecules to such targets are designed as described in those applications and synthesized to be tested in vitro and in vivo, as also described. The sequence of human and mouse flt-1, KDR and/or flk-1 mRNAs were screened for optimal enzymatic nucleic acid target sites using a computer folding algorithm. Hammerhead, hairpin, NCH, or G-Cleaver ribozyme cleavage sites were identified. These sites are shown in Tables II to IX, XIV–XIX, XXII, and XXIII (all sequences are 5' to 3' in the tables; X can be any base-paired sequence, the actual sequence is not relevant here). The nucleotide base position is noted in the Tables as that site to be cleaved by the designated type of ribozyme. While mouse and human sequences can be screened and enzymatic nucleic acid molecules thereafter designed, the human targeted sequences are of most utility. However, as discussed in Stinchcomb et al., WO 95/23225, mouse targeted enzymatic nucleic acid can be useful to test efficacy of action of the enzymatic nucleic acid molecule prior to testing in humans. The nucleotide base position is noted in the Tables as that site to be cleaved by the designated type of enzymatic nucleic acid.

For example, hammerhead or hairpin ribozymes were designed that could bind and cleave target RNA in a sequence-specific manner. The ribozymes were individually analyzed by computer folding (Jaeger et al., 1989 *Proc. Natl. Acad. Sci. USA*, 86, 7706) to assess whether the ribozyme sequences fold into the appropriate secondary structure. Those ribozymes with unfavorable intramolecular interactions between the binding arms and the catalytic core were eliminated from consideration. Varying binding arm lengths can be chosen to optimize activity.

Referring to FIG. 6, mRNA was screened for accessible cleavage sites by the method described generally in Draper et al., PCT WO93/23569, hereby incorporated by reference herein. Briefly, DNA oligonucleotides complementary to potential hammerhead or hairpin ribozyme cleavage sites were synthesized. A polymerase chain reaction was used to generate substrates for T7 RNA polymerase transcription from human and mouse flt-1, KDR and/or flk-1 cDNA clones. Labeled RNA transcripts were synthesized in vitro from the templates. The oligonucleotides and the labeled transcripts were annealed, RNAseH was added and the mixtures were incubated for the designated times at 37° C. Reactions were stopped and RNA separated on sequencing polyacrylamide gels. The percentage of the substrate cleaved was determined by autoradiographic quantitation using a PhosphorImaging system. From these data, antisense oligonucleotides, and ribozymes, such as hammerhead or hairpin ribozyme sites are chosen as the most accessible.

Ribozymes of the hammerhead or hairpin motif were designed to anneal to various sites in the mRNA message. The binding arms are complementary to the target site sequences described above. The ribozymes were chemically synthesized. The method of synthesis used follows the procedure for normal RNA synthesis as described below and in Usman et al., 1987 *J. Am. Chem. Soc.*, 109, 7845; Scaringe et al., 1990 *Nucleic Acids Res.*, 18, 5433; and Wincott et al., 1995 *Nucleic Acids Res.* 23, 2677–2684.

Synthesis of Nucleic Acid Molecules

Synthesis of nucleic acids greater than 100 nucleotides in length is difficult using automated methods, and the therapeutic cost of such molecules is prohibitive. In this invention, small nucleic acid motifs ("small refers to nucleic acid motifs no more than 100 nucleotides in length, preferably no more than 80 nucleotides in length, and most preferably no more than 50 nucleotides in length; e.g., antisense oligonucleotides, hammerhead or the hairpin ribozymes) are preferably used for exogenous delivery. The simple structure of these molecules increases the ability of the nucleic acid to invade targeted regions of RNA structure. Exemplary molecules of the instant invention were chemically synthesized, and others can similarly be synthesized. Oligodeoxyribonucleotides were synthesized using standard protocols as described in Caruthers et al., 1992, *Methods in Enzymology* 211, 3–19, and is incorporated herein by reference.

The method of synthesis used for normal RNA including certain enzymatic nucleic acid molecules follows the procedure as described in Usman et al., 1987 *J. Am. Chem. Soc.*, 109, 7845; Scaringe et al., 1990 *Nucleic Acids Res.*, 18, 5433; and Wincott et al., 1995 *Nucleic Acids Res.* 23, 2677–2684 and makes use of common nucleic acid protecting and coupling groups, such as dimethoxytrityl at the 5'-end, and phosphoramidites at the 3'-end. In a non-limiting example, small scale syntheses were conducted on a 394 Applied Biosystems, Inc. synthesizer using a 0.2 μmol scale protocol with a 7.75 min coupling step for alkylsilyl protected nucleotides and a 2.5 min coupling step for 2'-O-methylated nucleotides. Table XI outlines the amounts and the contact times of the reagents used in the synthesis cycle. Alternatively, syntheses at the 0.2 μmol scale can be done on a 96-well plate synthesizer, such as the instrument produced by Protogene (Palo Alto, Calif.) with minimal modification to the cycle. A 15-fold excess (31 μL of 0.1 M=3.1 μmol) of phosphoramidite and a 38.7-fold excess of S-ethyl tetrazole (31 μL of 0.25 M=7.75 μmol) relative to polymer-bound 5'-hydroxyl was used in each coupling cycle. Average coupling yields on the 394 Applied Biosystems, Inc. synthesizer, determined by colorimetric quantitation of the trityl fractions, were 97.5–99%. Other oligonucleotide synthesis reagents for the 394 Applied Biosystems, Inc. synthesizer; detritylation solution was 3% TCA in methylene chloride (ABI); capping was performed with 16% N-methylimidazole in THF (ABI) and 10% acetic anhydride/10% 2,6-lutidine in THF (ABI); oxidation solution was 16.9 mM $I_2$, 49 mM pyridine, 9% water in THF (PERSEPTIVE™). Burdick & Jackson Synthesis Grade acetonitrile was used directly from the reagent bottle. S-Ethyltetrazole solution (0.25 M in acetonitrile) was made up from the solid obtained from American International Chemical, Inc.

Deprotection of the RNA was performed using either a two-pot or one-pot protocol. For the two-pot protocol, the polymer-bound trityl-on oligoribonucleotide was transferred to a 4 mL glass screw top vial and suspended in a solution of 40% aq. methylamine (1 mL) at 65° C. for 10 min. After cooling to −20° C., the supernatant was removed from the polymer support. The support was washed three times with 1.0 mL of EtOH:MeCN:H2O/3:1:1, vortexed and the supernatant was then added to the first supernatant. The combined supernatants, containing the oligoribonucleotide, were dried to a white powder. The base deprotected oligoribonucleotide was resuspended in anhydrous TEA/HF/NMP solution (300 μL of a solution of 1.5 mL N-methylpyrrolidinone, 750 μL TEA and 1 mL TEA.3HF to provide a 1.4 M HF concentration) and heated to 65° C. After 1.5 h, the oligomer was quenched with 1.5 M $NH_4HCO_3$.

Alternatively, for the one-pot protocol, the polymer-bound trityl-on oligoribonucleotide was transferred to a 4 mL glass screw top vial and suspended in a solution of 33% ethanolic methylamine/DMSO:1/1 (0.8 mL) at 65° C. for 15 min. The vial was brought to r.t. TEA.3HF (0.1 mL) was added and the vial was heated at 65° C. for 15 min. The sample was cooled at −20° C. and then quenched with 1.5 M $NH_4HCO_3$.

For purification of the trityl-on oligomers, the quenched $NH_4HCO_3$ solution was loaded onto a C-18 containing cartridge that had been prewashed with acetonitrile followed by 50 mM TEAA. After washing the loaded cartridge with water, the RNA was detritylated with 0.5% TFA for 13 min. The cartridge was then washed again with water, salt exchanged with 1 M NaCl and washed with water again. The oligonucleotide was then eluted with 30% acetonitrile.

Inactive hammerhead ribozymes or binding attenuated control (BAC) oligonucleotides) were synthesized by substituting a U for $G_5$ and a U for $A_{14}$ (numbering from Hertel, K. J., et al., 1992, *Nucleic Acids Res.*, 20, 3252).

The average stepwise coupling yields were >98% (Wincott et al., 1995 *Nucleic Acids Res.* 23, 2677–2684). Those of ordinary skill in the art will recognize that the scale of synthesis can be adapted to be larger or smaller than the example described above including but not limited to 96 well format, all that is important is the ratio of chemicals used in the reaction.

Alternatively, the nucleic acid molecules of the present invention can be synthesized separately and joined together by ligation (Moore et al., 1992, *Science* 256, 9923; Draper et al., International PCT publication No. WO 93/23569; Shabarova et al., 1991, *Nucleic Acids Research* 19, 4247).

Enzymatic nucleic acid molecules are modified extensively to enhance stability by modification with nuclease resistant groups, for example, 2'-amino, 2'-C-allyl, 2'-flouro, 2'-O-methyl, 2'-H (for a review see Usman and Cedergren, 1992 *TIBS* 17, 34; Usman et al., 1994 *Nucleic Acids Symp. Ser.* 31, 163). Enzymatic nucleic acid molecules are purified by gel electrophoresis using general methods or are purified by high pressure liquid chromatography (HPLC; See Wincott et al., Supra, the totality of which is hereby incorporated herein by reference) and are resuspended in water.

For example, the sequences of the ribozymes that are chemically synthesized, useful in this study, are shown in Tables II to IX, XIV–XIX, XXII, and XXIII. Those in the art will recognize that these sequences are representative only of many more such sequences where the enzymatic portion of the ribozyme (all but the binding arms) is altered to affect activity. Stem-loop IV sequence of hairpin ribozymes listed in, for example, Table III (5'-CACGUUGUG-3') can be altered (substitution, deletion, and/or insertion) to contain any sequence, provided a minimum of two base-paired stem structure can form. Preferably, no more than 200 bases are inserted at these locations. The sequences listed in Tables II to X, XII–XIX, XXII, and XXIII may be formed of ribonucleotides or other nucleotides or non-nucleotides. Such ribozymes with enzymatic activity are equivalent to the ribozymes described specifically in the Tables.

Optimizing Activity of the Nucleic Acid Molecule of the Invention.

Enzymatic nucleic acid activity can be optimized as described by Stinchcomb et al., supra. The details will not be repeated here, but include altering the length of the enzymatic nucleic acid binding arms (stems I and III, see FIG. 2c), or chemically synthesizing enzymatic nucleic acid with modifications that prevent their degradation by serum ribonucleases (see e.g., Eckstein et al., International Publication No. WO 92/07065; Perrault et al., 1990 *Nature* 344, 565; Pieken et al., 1991 *Science* 253, 314; Usman and Cedergren, 1992 *Trends in Biochem. Sci.* 17, 334; Usman et al., International Publication No. WO 93/15187; Rossi et al., International Publication No. WO 91/03162; Beigelman et al., 1995 *J. Biol. Chem.* in press; as well as Sproat, U.S. Pat. No. 5,334,711 which describe various chemical modifications that can be made to the sugar moieties of enzymatic RNA molecules). Modifications which enhance their efficacy in cells, and removal of stem II bases to shorten RNA synthesis times and reduce chemical requirements are desired. (All these publications are hereby incorporated by reference herein).

There are several examples in the art describing sugar, base and phosphate modifications that can be introduced into enzymatic nucleic acid molecules without significantly effecting catalysis and with significant enhancement in their nuclease stability and efficacy. For example, enzymatic nucleic acid molecules are modified to enhance stability and/or enhance catalytic activity by modification with nuclease resistant groups, for example, 2'-amino, 2'-C-allyl, 2'-fluoro, 2'-O-methyl, 2'-H, nucleotide base modifications (for a review see Usman and Cedergren, 1992 *TIBS* 17, 34; Usman et al., 1994 *Nucleic Acids Symp. Ser.* 31, 163; Burgin et al., 1996 *Biochemistry* 35, 14090). Sugar modification of enzymatic nucleic acid molecules have been extensively described in the art (see Eckstein et al., International Publication PCT No. WO 92/07065; Perrault et al. *Nature* 1990, 344, 565–568; Pieken et al. *Science* 1991, 253, 314–317; Usman and Cedergren, *Trends in Biochem. Sci.* 1992, 17, 334–339; Usman et al. International Publication PCT No. WO 93/15187; Sproat, U.S. Pat. No. 5,334,711 and Beigelman et al., 1995 *J. Biol. Chem.* 270, 25702; all of the references are hereby incorporated in their totality by reference herein). Such publications describe general methods and strategies to determine the location of incorporation of sugar, base and/or phosphate modifications and the like into enzymatic nucleic acid without inhibiting catalysis, and are incorporated by reference herein. In view of such teachings, similar modifications can be used as described herein to modify the nucleic acid catalysts of the instant invention.

Nucleic acid catalysts having chemical modifications which maintain or enhance enzymatic activity are provided. Such nucleic acid is also generally more resistant to nucleases than unmodified nucleic acid. Thus, in a cell and/or in vivo the activity may not be significantly lowered. As exemplified herein such enzymatic nucleic acid molecules are useful in a cell and/or in vivo even if activity over all is reduced 10 fold (Burgin et al., 1996, *Biochemistry*, 35, 14090). Such enzymatic nucleic acid molecules herein are said to "maintain" the enzymatic activity of an all RNA enzymatic nucleic acid molecules.

Therapeutic nucleic acid molecules (e.g., enzymatic nucleic acid molecules and antisense nucleic acid molecules) delivered exogenously must optimally be stable within cells until translation of the target RNA has been inhibited long enough to reduce the levels of the undesirable protein. This period of time varies between hours to days depending upon the disease state. Clearly, these nucleic acid molecules must be resistant to nucleases in order to function as effective intracellular therapeutic agents. Improvements in the chemical synthesis of nucleic acid molecules described in the instant invention and in the art have expanded the ability to modify nucleic acid molecules by introducing nucleotide modifications to enhance their nuclease stability as described above.

By "enhanced enzymatic activity" is meant to include activity measured in cells and/or in vivo where the activity is a reflection of both catalytic activity and enzymatic nucleic acid stability. In this invention, the product of these properties is increased or not significantly (less that 10 fold) decreased in vivo compared to an all RNA enzymatic nucleic acid molecule.

In one embodiment, the nucleic acid molecules comprises a 5' and/or a 3'-cap structure.

By "cap structure" is meant chemical modifications, which have been incorporated at the terminus of the oligonucleotide (see for example Wincott et al., WO 97/26270, incorporated by reference herein). These terminal modifications protect the nucleic acid molecule from exonuclease degradation, and may help in delivery and/or localization within a cell. The cap may be present at the 5'-terminus (5'-cap) or at the 3'-terminus (3'-cap) or may be present on both terminus. In non-limiting examples: the 5'-cap is selected from the group comprising inverted abasic residue (moiety), 4',5'-methylene nucleotide; 1-(beta-D-erythrofuranosyl)nucleotide, 4'-thio nucleotide, carbocyclic nucleotide; 1,5-anhydrohexitol nucleotide; L-nucleotides; alpha-nucleotides; modified base nucleotide; phosphorodithioate linkage; threo-pentofuranosyl nucleotide; acyclic 3',4'-seco nucleotide; acyclic 3,4-dihydroxybutyl nucleotide; acyclic 3,5-dihydroxypentyl nucleotide, 3'-3'-inverted nucleotide moiety; 3'-3'-inverted abasic moiety; 3'-2'-inverted nucleotide moiety; 3'-2'-inverted abasic moiety; 1,4-butanediol phosphate; 3'-phosphoramidate; hexylphosphate; aminohexyl phosphate; 3'-phosphate; 3'-phosphorothioate; phosphorodithioate; or bridging or non-bridging methylphosphonate moiety (for more details see Beigelman et al., International PCT publication No. WO 97/26270, incorporated by reference herein).

In yet another embodiment, the 3'-cap is selected from a group comprising, 4',5'-methylene nucleotide; 1-(beta-D-erythrofuranosyl)nucleotide; 4'-thio nucleotide, carbocyclic nucleotide; 5'-amino-alkyl phosphate; 1,3-diamino-2-propyl phosphate, 3-aminopropyl phosphate; 6-aminohexyl phosphate; 1,2-aminododecyl phosphate; hydroxypropyl phosphate; 1,5-anhydrohexitol nucleotide; L-nucleotide; alpha-nucleotide; modified base nucleotide; phosphorodithioate; threo-pentofuranosyl nucleotide; acyclic 3',4'-seco nucleotide; 3,4-dihydroxybutyl nucleotide; 3,5-dihydroxypentyl nucleotide, 5'-5'-inverted nucleotide moeity; 5'-5'-inverted abasic moeity; 5'-phosphoramidate; 5'-phosphorothioate; 1,4-butanediol phosphate; 5'-amino; bridging and/or non-bridging 5'-phosphoramidate, phosphorothioate and/or phosphorodithioate, bridging or non bridging methylphosphonate and 5'-mercapto moeities (for more details see Beaucage and Iyer, 1993, *Tetrahedron* 49, 1925; incorporated by reference herein).

By the term "non-nucleotide" is meant any group or compound which can be incorporated into a nucleic acid chain in the place of one or more nucleotide units, including either sugar and/or phosphate substitutions, and allows the remaining bases to exhibit their enzymatic activity. The group or compound is abasic in that it does not contain a commonly recognized nucleotide base, such as adenosine, guanine, cytosine, uracil or thymine.

By "nucleotide" as used herein is as recognized in the art to include natural bases (standard), and modified bases well known in the art. Such bases are generally located at the 1' position of a sugar moiety. A nucleotide generally comprises a base, sugar and a phosphate group. The nucleotide may also be abasic, i.e., lacking a base. The nucleotides can be unmodified or modified at the sugar, phosphate and/or base moiety, (also referred to interchangeably as nucleotide analogs, modified nucleotides, non-natural nucleotides, non-standard nucleotides and other; see for example, Usman and McSwiggen, supra; Eckstein et al., International PCT Publication No. WO 92/07065; Usman et al., International PCT Publication No. WO 93/15187; all hereby incorporated by reference herein). Several examples of modified nucleic acid bases are known in the art and has recently been summarized by Limbach et al., 1994, *Nucleic Acids Res.* 22, 2183. Some of the non-limiting examples of base modifications that can be introduced into enzymatic nucleic acids without significantly effecting their catalytic activity include, inosine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine) and others (Burgin et al., 1996, *Biochemistry*, 35, 14090).

By "modified bases" in this aspect is meant nucleotide bases other than adenine, guanine, cytosine and uracil at 1' position or their equivalents; such bases may be used within the catalytic core of the enzyme and/or in the substrate-binding regions.

By "abasic" is meant sugar moieties lacking a base or having other chemical groups in place of a base at the 1' position.

By "unmodified nucleoside" is meant one of the bases adenine, cytosine, guanine, uracil joined to the 1' carbon of β-D-ribo-furanose.

By "modified nucleoside" is meant any nucleotide base that contains a modification in the chemical structure of an unmodified nucleotide base, sugar and/or phosphate.

In connection with 2'-modified nucleotides as described for the present invention, by "amino" is meant 2'-$NH_2$ or 2'-O—$NH_2$, which can be modified or unmodified. Such modified groups are described, for example, in Eckstein et al., U.S. Pat. No. 5,672,695 and Matulic-Adamic et al., WO 98/28317, respectively, which are both incorporated by reference in their entireties.

Various modifications to nucleic acid (e.g., antisense and ribozyme) structure can be made to enhance the utility of these molecules. Such modifications enhance shelf-life, half-life in vitro, stability, and ease of introduction of such oligonucleotides to the target site, e.g., to enhance penetration of cellular membranes, and confer the ability to recognize and bind to targeted cells.

Use of these molecules can lead to better treatment of the disease progression by affording the possibility of combination therapies (e.g., multiple enzymatic nucleic acid molecules targeted to different genes, enzymatic nucleic acid molecules coupled with known small molecule inhibitors, or intermittent treatment with combinations of enzymatic nucleic acid molecules (including different ribozyme motifs) and/or other chemical or biological molecules). The treatment of patients with nucleic acid molecules can also include combinations of different types of nucleic acid molecules. Therapies can be devised which include a mixture of enzymatic nucleic acid molecules (including different ribozyme motifs), antisense and/or 2–5A chimera molecules to one or more targets to alleviate symptoms of a disease.

Administration of Nucleic Acid Molecules

Sullivan, et al., supra, describes the general methods for delivery of enzymatic RNA molecules. Enzymatic nucleic acid molecules can be administered to cells by a variety of methods known to those familiar to the art, including, but not restricted to, encapsulation in liposomes, by iontophoresis, or by incorporation into other vehicles, such as hydrogels, cyclodextrins, biodegradable nanocapsules, and bioadhesive microspheres. For some indications, enzymatic nucleic acid molecules can be directly delivered ex vivo to cells or tissues with or without the aforementioned vehicles. Alternatively, the nucleic acid/vehicle combination is locally delivered by direct injection or by use of a catheter, infusion pump or stent. Other routes of delivery include, but are not limited to, intravascular, intramuscular, subcutaneous or joint injection, aerosol inhalation, oral (tablet or pill form), topical, systemic, ocular, intraperitoneal and/or intrathecal delivery. More detailed descriptions of nucleic acid delivery and administration are provided in Sullivan et al., supra and Draper et al., supra which have been incorporated by reference herein.

Methods for the delivery of nucleic acid molecules is described in Akhtar et al., 1992, *Trends Cell Bio.*, 2, 139; and *Delivery Strategies for Antisense Oligonucleotide Therapeutics*, ed. Akhtar, 1995 which are both incorporated herein by reference. Sullivan et al., PCT WO 94/02595, further describes the general methods for delivery of enzymatic RNA molecules. These protocols can be utilized for the delivery of virtually any nucleic acid molecule. Nucleic acid molecules can be administered to cells by a variety of methods known to those familiar to the art, including, but not restricted to, encapsulation in liposomes, by iontophoresis, or by incorporation into other vehicles, such as hydrogels, cyclodextrins, biodegradable nanocapsules, and bioadhesive microspheres. For some indications, nucleic acid molecules can be directly delivered ex vivo to cells or tissues with or without the aforementioned vehicles. Alternatively, the nucleic acid/vehicle combination is locally delivered by direct injection or by use of a catheter, infusion pump or stent. Other routes of delivery include, but are not limited to, intravascular, intramuscular, subcutaneous or joint injection, aerosol inhalation, oral (tablet or pill form), topical, systemic, ocular, intraperitoneal and/or intrathecal delivery. More detailed descriptions of nucleic acid delivery and administration are provided in Sullivan et al., supra and Draper et al., PCT WO93/23569 which have been incorporated by reference herein.

The molecules of the instant invention can be used as pharmaceutical agents. Pharmaceutical agents prevent, inhibit the occurrence, or treat (alleviate a symptom to some extent, preferably all of the symptoms) of a disease state in a patient.

The negatively charged polynucleotides of the invention can be administered (e.g., RNA, DNA or protein) and introduced into a patient by any standard means, with or without stabilizers, buffers, and the like, to form a pharmaceutical composition. When it is desired to use a liposome delivery mechanism, standard protocols for formation of liposomes can be followed. The compositions of the present invention may also be formulated and used as tablets, capsules or elixirs for oral administration; suppositories for rectal administration; sterile solutions; suspensions for injectable administration; and the like.

The present invention also includes pharmaceutically acceptable formulations of the compounds described. These formulations include salts of the above compounds, e.g., acid addition salts, for example, salts of hydrochloric, hydrobromic, acetic acid, and benzene sulfonic acid.

A pharmacological composition or formulation refers to a composition or formulation in a form suitable for administration, e.g., systemic administration, into a cell or patient, preferably a human. Suitable forms, in part, depend upon the use or the route of entry, for example oral, transdermal, or by injection. Such forms should not prevent the composition or formulation to reach a target cell (i.e., a cell to which the negatively charged polymer is desired to be delivered to). For example, pharmacological compositions injected into the blood stream should be soluble. Other factors are known in the art, and include considerations such as toxicity and forms which prevent the composition or formulation from exerting its effect.

By "systemic administration" is meant in vivo systemic absorption or accumulation of drugs in the blood stream followed by distribution throughout the entire body. Administration routes which lead to systemic absorption include, without limitations: intravenous, subcutaneous, intraperitoneal, inhalation, oral, intrapulmonary and intramuscular. Each of these administration routes expose the desired negatively charged polymers, e.g., nucleic acids, to an accessible diseased tissue. The rate of entry of a drug into the circulation has been shown to be a function of molecular weight or size. The use of a liposome or other drug carrier comprising the compounds of the instant invention can potentially localize the drug, for example, in certain tissue types, such as the tissues of the reticular endothelial system (RES). A liposome formulation which can facilitate the association of drug with the surface of cells, such as, lymphocytes and macrophages is also useful. This approach may provide enhanced delivery of the drug to target cells by taking advantage of the specificity of macrophage and lymphocyte immune recognition of abnormal cells, such as the cancer cells.

The invention also features the use of a composition comprising surface-modified liposomes containing poly (ethylene glycol)lipids (PEG-modified, or long-circulating liposomes or stealth liposomes). These formulations offer a method for increasing the accumulation of drugs in target tissues. This class of drug carriers resists opsonization and elimination by the mononuclear phagocytic system (MPS or RES), thereby enabling longer blood circulation times and enhanced tissue exposure for the encapsulated drug (Lasic et al. *Chem. Rev.* 1995, 95, 2601–2627; Ishiwata et al., *Chem. Pharm. Bull.* 1995, 43, 1005–1011). Such liposomes have been shown to accumulate selectively in tumors, presumably by extravasation and capture in the neovascularized target tissues (Lasic et al., *Science* 1995, 267, 1275–1276; Oku et al., 1995, *Biochim. Biophys. Acta*, 1238, 86–90). Long-circulating liposomes enhance the pharmacokinetics and pharmacodynamics of DNA and RNA, particularly compared to conventional cationic liposomes which are known to accumulate in tissues of the MPS (Liu et al., *J. Biol. Chem.* 1995, 42, 24864–24870; Choi et al., International PCT Publication No. WO 96/10391; Ansell et al., International PCT Publication No. WO 96/10390; Holland et al., International PCT Publication No. WO 96/10392; all of these are incorporated by reference herein). Long-circulating liposomes are also likely to protect drugs from nuclease degradation to a greater extent compared to cationic liposomes, based on their ability to avoid accumulation in metabolically aggressive MPS tissues such as the liver and spleen. All of these references are incorporated by reference herein.

The present invention also includes compositions prepared for storage or administration which include a pharmaceutically effective amount of the desired compounds in a pharmaceutically acceptable carrier or diluent. Acceptable carriers or diluents for therapeutic use are well known in the pharmaceutical art, and are described, for example, in *Remington's Pharmaceutical Sciences*, Mack Publishing Co. (A. R. Gennaro edit. 1985) hereby incorporated by reference herein. For example, preservatives, stabilizers, dyes and flavoring agents may be provided. Id. at 1449. These include sodium benzoate, sorbic acid and esters of p-hydroxybenzoic acid. In addition, antioxidants and suspending agents can be used. Id.

A pharmaceutically effective dose is that dose required to prevent, inhibit the occurrence, or treat (alleviate a symptom to some extent, preferably all of the symptoms) of a disease state. The pharmaceutically effective dose depends on the type of disease, the composition used, the route of administration, the type of mammal being treated, the physical characteristics of the specific mammal under consideration, concurrent medication, and other factors which those skilled in the medical arts will recognize. Generally, an amount between 0.1 mg/kg and 100 mg/kg body weight/day of active ingredients is administered dependent upon potency of the negatively charged polymer.

The nucleic acid molecules of the invention and formulations thereof can be administered orally, topically, parenterally, by inhalation or spray or rectally in dosage unit formulations containing conventional non-toxic pharmaceutically acceptable carriers, adjuvants and vehicles. The term parenteral as used herein includes percutaneous, subcutaneous, intravascular (e.g., intravenous), intramuscular, or intrathecal injection or infusion techniques and the like. In addition, there is provided a pharmaceutical formulation comprising a nucleic acid molecule of the invention and a pharmaceutically acceptable carrier. One or more nucleic acid molecules of the invention can be present in association with one or more non-toxic pharmaceutically acceptable carriers and/or diluents and/or adjuvants, and if desired other active ingredients. The pharmaceutical compositions containing nucleic acid molecules of the invention can be in a form suitable for oral use, for example, as tablets, troches, lozenges, aqueous or oily suspensions, dispersible powders or granules, emulsion, hard or soft capsules, or syrups or elixirs.

Compositions intended for oral use can be prepared according to any method known to the art for the manufacture of pharmaceutical compositions and such compositions can contain one or more such sweetening agents, flavoring agents, coloring agents or preservative agents in order to provide pharmaceutically elegant and palatable preparations. Tablets contain the active ingredient in admixture with non-toxic pharmaceutically acceptable excipients that are suitable for the manufacture of tablets. These excipients can be for example, inert diluents, such as calcium carbonate, sodium carbonate, lactose, calcium phosphate or sodium phosphate; granulating and disintegrating agents, for example, corn starch, or alginic acid; binding agents, for example starch, gelatin or acacia, and lubricating agents, for example magnesium stearate, stearic acid or talc. The tablets can be uncoated or they can be coated by known techniques. In some cases such coatings can be prepared by known techniques to delay disintegration and absorption in the gastrointestinal tract and thereby provide a sustained action over a longer period. For example, a time delay material such as glyceryl monosterate or glyceryl distearate can be employed.

Formulations for oral use can also be presented as hard gelatin capsules wherein the active ingredient is mixed with an inert solid diluent, for example, calcium carbonate, calcium phosphate or kaolin, or as soft gelatin capsules wherein the active ingredient is mixed with water or an oil medium, for example peanut oil, liquid paraffin or olive oil.

Aqueous suspensions contain the active materials in admixture with excipients suitable for the manufacture of aqueous suspensions. Such excipients are suspending agents, for example sodium carboxymethylcellulose, methylcellulose, hydropropyl-methylcellulose, sodium alginate, polyvinylpyrrolidone, gum tragacanth and gum acacia; dispersing or wetting agents can be a naturally-occurring phosphatide, for example, lecithin, or condensation products of an alkylene oxide with fatty acids, for example polyoxyethylene stearate, or condensation products of ethylene oxide with long chain aliphatic alcohols, for example heptadecaethyleneoxycetanol, or condensation products of ethylene oxide with partial esters derived from fatty acids and a hexitol such as polyoxyethylene sorbitol monooleate, or condensation products of ethylene oxide with partial esters derived from fatty acids and hexitol anhydrides, for example polyethylene sorbitan monooleate. The aqueous suspensions can also contain one or more preservatives, for example ethyl, or n-propyl p-hydroxybenzoate, one or more coloring agents, one or more flavoring agents, and one or more sweetening agents, such as sucrose or saccharin.

Oily suspensions can be formulated by suspending the active ingredients in a vegetable oil, for example arachis oil, olive oil, sesame oil or coconut oil, or in a mineral oil such as liquid paraffin. The oily suspensions can contain a thickening agent, for example beeswax, hard paraffin or cetyl alcohol. Sweetening agents and flavoring agents can be added to provide palatable oral preparations. These compositions can be preserved by the addition of an anti-oxidant such as ascorbic acid.

Dispersible powders and granules suitable for preparation of an aqueous suspension by the addition of water provide the active ingredient in admixture with a dispersing or wetting agent, suspending agent and one or more preservatives. Suitable dispersing or wetting agents or suspending agents are exemplified by those already mentioned above. Additional excipients, for example sweetening, flavoring and coloring agents, can also be present.

Pharmaceutical compositions of the invention can also be in the form of oil-in-water emulsions. The oily phase can be a vegetable oil or a mineral oil or mixtures of these. Suitable emulsifying agents can be naturally-occurring gums, for example gum acacia or gum tragacanth, naturally-occurring phosphatides, for example soy bean, lecithin, and esters or partial esters derived from fatty acids and hexitol, anhydrides, for example sorbitan monooleate, and condensation products of the said partial esters with ethylene oxide, for example polyoxyethylene sorbitan monooleate. The emulsions can also contain sweetening and flavoring agents.

Syrups and elixirs can be formulated with sweetening agents, for example glycerol, propylene glycol, sorbitol, glucose or sucrose. Such formulations can also contain a demulcent, a preservative and flavoring and coloring agents. The pharmaceutical compositions can be in the form of a sterile injectable aqueous or oleaginous suspension. This suspension can be formulated according to the known art using those suitable dispersing or wetting agents and suspending agents that have been mentioned above. The sterile injectable preparation can also be a sterile injectable solution or suspension in a non-toxic parentally acceptable diluent or solvent, for example as a solution in 1,3-butanediol. Among the acceptable vehicles and solvents that can be employed are water, Ringer's solution and isotonic sodium chloride solution. In addition, sterile, fixed oils are conventionally employed as a solvent or suspending medium. For this purpose any bland fixed oil can be employed including synthetic mono- or diglycerides. In addition, fatty acids such as oleic acid find use in the preparation of injectables.

The nucleic acid molecules of the invention can also be administered in the form of suppositories, e.g., for rectal administration of the drug. These compositions can be prepared by mixing the drug with a suitable non-irritating excipient that is solid at ordinary temperatures but liquid at the rectal temperature and will therefore melt in the rectum to release the drug. Such materials include cocoa butter and polyethylene glycols.

Nucleic acid molecules of the invention can be administered parenterally in a sterile medium. The drug, depending on the vehicle and concentration used, can either be suspended or dissolved in the vehicle. Advantageously, adjuvants such as local anesthetics, preservatives and buffering agents can be dissolved in the vehicle.

Dosage levels of the order of from about 0.1 mg to about 140 mg per kilogram of body weight per day are useful in the treatment of the above-indicated conditions (about 0.5 mg to about 7 g per patient per day). The amount of active ingredient that can be combined with the carrier materials to produce a single dosage form varies depending upon the host treated and the particular mode of administration. Dosage unit forms generally contain between from about 1 mg to about 500 mg of an active ingredient.

It is understood that the specific dose level for any particular patient depends upon a variety of factors including the activity of the specific compound employed, the age, body weight, general health, sex, diet, time of administration, route of administration, and rate of excretion, drug combination and the severity of the particular disease undergoing therapy.

For administration to non-human animals, the composition can also be added to the animal feed or drinking water. It can be convenient to formulate the animal feed and drinking water compositions so that the animal takes in a therapeutically appropriate quantity of the composition along with its diet. It can also be convenient to present the composition as a premix for addition to the feed or drinking water.

The nucleic acid molecules of the present invention can also be administered to a patient in combination with other therapeutic compounds to increase the overall therapeutic effect. The use of multiple compounds to treat an indication can increase the beneficial effects while reducing the presence of side effects.

Another means of accumulating high concentrations of a nucleic acid molecule of the invention (e.g., ribozyme or antisense) within cells is to incorporate the nucleic acid-encoding sequences into a DNA or RNA expression vector. Transcription of the nucleic acid sequences are driven from a promoter for eukaryotic RNA polymerase I (pol I), RNA polymerase II (pol II), or RNA polymerase III (pol III). Transcripts from pol II or pol III promoters will be expressed at high levels in all cells; the levels of a given pol II promoter in a given cell type will depend on the nature of the gene regulatory sequences (enhancers, silencers, etc.) present nearby. Prokaryotic RNA polymerase promoters are also used, providing that the prokaryotic RNA polymerase enzyme is expressed in the appropriate cells (Elroy-Stein and Moss, 1990 *Proc. Natl. Acad. Sci. USA*, 87, 6743–7; Gao and Huang 1993 *Nucleic Acids Res.*, 21, 2867–72; Lieber et al., 1993 *Methods Enzymol.*, 217, 47–66; Zhou et al., 1990 *Mol. Cell. Biol.*, 10, 4529–37; Thompson et al., 1995 supra). Several investigators have demonstrated that enzymatic nucleic acid or antisese expressed from such promoters can function in mammalian cells (e.g. Izant and Weintraub, 1985 *Science* 229, 345; McGarry and Lindquist, 1986 *Proc. Natl. Acad. Sci. USA* 83, 399; Kashani-Sabet et al., 1992 *Antisense Res. Dev.*, 2, 3–15; Ojwang et al., 1992 *Proc. Natl. Acad. Sci. USA*, 89, 10802–6; Chen et al., 1992 *Nucleic Acids Res.*, 20, 4581–9; Yu et al., 1993 *Proc. Natl. Acad. Sci. USA*, 90, 6340–4; L'Huillier et al., 1992 *EMBO J.* 11, 4411–8; Lisziewicz et al., 1993 *Proc. Natl. Acad. Sci. U.S.A.*, 90, 8000–4; Thompson et al., 1995 *Nucleic Acids Res.* 23, 2259). The above nucleic acid transcription units can be incorporated into a variety of vectors for introduction into mammalian cells, including but not restricted to, plasmid DNA vectors, viral DNA vectors (such as adenovirus or adeno-associated virus vectors), or viral RNA vectors (such as retroviral or alphavirus vectors).

In one embodiment of the invention, a transcription unit expressing an enzymatic nucleic acid that cleaves RNAs that encode flt-1, KDR and/or flk-1 are inserted into a plasmid DNA vector or an adenovirus or adeno-associated virus DNA viral vector or a retroviral RNA vector. Viral vectors have been used to transfer genes and lead to either transient or long term gene expression (Zabner et al., 1993 *Cell* 75, 207; Carter, 1992 *Curr. Opi. Biotech.* 3, 533). The adenovirus, AAV or retroviral vector is delivered as recombinant viral particles. The DNA may be delivered alone or complexed with vehicles (as described for RNA above). The recombinant adenovirus or AAV or retroviral particles are locally administered to the site of treatment, e.g., through incubation or inhalation in vivo or by direct application to cells or tissues ex vivo. Retroviral vectors have also been used to express enzymatic nucleic acid in mammalian cells (Ojwang et al., 1992 supra; Thompson et al., 1995 supra).

Flt-1, KDR and/or flk-1 are attractive nucleic acid-based therapeutic targets by several criteria. The interaction between VEGF and VEGF-R is well-established. Efficacy can be tested in well-defined and predictive animal models. Finally, the disease conditions are serious and current therapies are inadequate. Whereas protein-based therapies would inhibit VEGF activity nucleic acid-based therapy provides a direct and elegant approach to directly modulate flt-1, KDR and/or flk-1 expression.

Because flt-1 and KDR mRNAs are highly homologous in certain regions, some enzymatic nucleic acid target sites are also homologous (see Table X). In this case, a single enzymatic nucleic acid cantarget both flt-1 and KDR mRNAs. At partially homologous sites, a single enzymatic nucleic acid can sometimes be designed to accommodate a site on both mRNAs by including G/U base pairing. For example, if there is a G present in an enzymatic nucleic acid target site in KDR mRNA at the same position there is an A in the flt-1 ribozyme target site, the enzymatic nucleic acid can be synthesized with a U at the complementary position and it will bind both to sites. The advantage of one enzymatic nucleic acid that targets both VEGF-R mRNAs is clear, especially in cases where both VEGF receptors may contribute to the progression of angiogenesis in the disease state.

"Angiogenesis" refers to formation of new blood vessels, which is an essential process in reproduction, development and wound repair. "Tumor angiogenesis" refers to the induction of the growth of blood vessels from surrounding tissue into a solid tumor. Tumor growth and tumor metastasis are dependent on angiogenesis (for a review see Folkman, 1985 supra; Folkman 1990 *J. Natl. Cancer Inst.*, 82, 4; Folkman and Shing, 1992 *J. Biol. Chem.* 267, 10931).

Angiogenesis plays an important role in other diseases such as arthritis wherein new blood vessels have been shown to invade the joints and degrade cartilage (Folkman and Shing, supra).

"Retinopathy" refers to inflammation of the retina and/or degenerative condition of the retina which may lead to occlusion of the retina and eventual blindness. In "diabetic retinopathy" angiogenesis causes the capillaries in the retina to invade the vitreous resulting in bleeding and blindness which is also seen in neonatal retinopathy (for a review see Folkman, 1985 supra; Folkman 1990 supra; Folkman and Shing, 1992 supra).

The following examples further illustrate the present invention but should not be construed to limit the present invention in any way.

EXAMPLE 1 flt-1, KDR and/or flk-1 Ribozymes

By engineering ribozyme motifs, Applicant has designed several ribozymes directed against flt-1, KDR and/or flk-1 encoded mRNA sequences. These ribozymes were synthesized with modifications that improve their nuclease resistance (Beigelman et al., 1995 *J Biol. Chem.* 270, 25702) and enhance their activity in cells. The ability of ribozymes to cleave target sequences in vitro was evaluated essentially as described in Thompson et al., PCT Publication No. WO 93/23057; Draper et al., PCT Publication No. WO 95/04818.

EXAMPLE 2

Effect of Ribozymes on the Binding of VEGF to flt-1, KDR and/or flk-1 Receptors Several common human cell lines are available that express endogenous flt-1, KDR and/or flk-1. flt-1, KDR and/or flk-1 which can be detected easily with monoclonal antibodies. Use of appropriate fluorescent reagents and fluorescence-activated cell-sorting (FACS) permit direct quantitation of surface flt-1, KDR and/or flk-1 on a cell-by-cell basis. Active ribozymes are expected to directly reduce flt-1, KDR and/or flk-1 expression and thereby reduce VEGF binding to the cells. In this example, human umbelical cord microvascular endothelial cells were used.

Cell Preparation:

Plates were coated with 1.5% gelatin and allowed to stand for one hour. Cells (e.g., microvascular endothelial cells derived from human umbilical cord vein) were plated at 20,000 cells/well (24 well plate) in 200 μl growth media and incubated overnight (~1 doubling) to yield ~40,000 cells (75–80% confluent).

Ribozyme Treatment:

Media was removed from cells and the cells were washed two times with 300 μl 1×PBS:$Ca^{2+}$:$Mg^{2+}$ mixture. A complex of 200–500 nM ribozyme and LipofectAMINE® (3:1 lipid:phosphate ratio) in 200 μl OptiMEM® (5% FBS) was added to the cells. The cells were incubated for 6 hr (equivalent to 2–3 VEGF-R turnovers).

$^{125}$I VEGF Binding Assay:

The assay was carried out on ice to inhibit internalization of VEGF during the experiment. The media containing the ribozyme was removed from the cells and the cells were washed twice with 300 μl 1×PBS:$Ca^{2+}$:$Mg^{2+}$ mixture containing 1% BSA. Appropriate $^{125}$I VEGF solution (100,000 cpm/well, +/−10× cold 1×PBS, 1% BSA) was applied to the cells. The cells were incubated on ice for 1 hour. $^{125}$I VEGF-containing solution was removed and the cells were washed three times with 300 μl 1×PBS:$Ca^{2+}$:$Mg^{2+}$ mixture containing 1% BSA. To each well 300 μl of 100 mM Tris-HCl, pH 8.0, 0.5% Triton X-100 was added and the mixture was incubated for 2 minutes. The $^{125}$I VEGF-binding was quantitated using standard scintillation counting techniques. Percent inhibition was calculated as follows:

$$\text{Percent Inhibition} = \frac{\text{cpm }^{125}I \text{ VEGF bound by the ribozyme-treated samples}}{\text{cpm }^{125}I \text{ VEGF bound by the Control sample}} \times 100$$

EXAMPLE 3

Effect of Hammerhead Ribozymes Targeted Against flt-1 Receptor on the Binding of VEGF Hammerhead ribozymes targeted to twenty sites within flt-1 RNA were synthesized as described above. The sequences of the ribozymes used are shown in Table II; the length of the stem II region is 3 bp. The hammerhead ribozymes were chemically modified such that the ribozyme consists of ribose residues at five positions; U4 and U7 positions contain 2'-$NH_2$ modifications, the remaining nucleotide positions contain 2'-O-methyl substitutions; four nucleotides at the 5' terminus contains phosphorothioate substitutions. Additionally, 3' end of the ribozyme contains a 3'-3' linked inverted abasic ribose.

Referring to FIG. 7, the effect of hammerhead ribozymes targeted against flt-1 receptor on the binding of VEGF to flt-1 on the surface of human microvascular endothelial cells is shown. The majority of the ribozymes tested were able to inhibit the expression of flt-1 and thereby were able to inhibit the binding of VEGF.

In order to determine the specificity of ribozymes targeted against flt-1 RNA, the effect of five anti-flt-1 ribozymes on the binding of VEGF, UPA (urokinase plasminogen activator) and FGF (fibroblast growth factor) to their corresponding receptors were assayed. As shown in FIG. 9, there was significant inhibition of VEGF binding to its receptors on cells treated with anti-flt-1 ribozymes. There was no specific inhibition of the binding of UPA and FGF to their corresponding receptors. These data strongly suggest that anti-flt-1 ribozymes specifically cleave flt-1 RNA and not RNAs encoding the receptors for UPA and FGF, resulting in the inhibition of flt-1 receptor expression on the surface of the cells. Thus the ribozymes are responsible for the inhibition of VEGF binding but not the binding of UPA and FGF.

EXAMPLE 4

Effect of Hammerhead Ribozymes Targeted Against KDR Receptor on the Binding of VEGF Hammerhead ribozymes targeted to twenty-one sites within KDR RNA were synthesized as described above. The sequences of the ribozymes used are shown in Table IV; the length of stem II region is 3 bp. The hammerhead ribozymes were chemically modified such that the ribozyme consists of ribose residues at five positions; U4 and U7 positions contain 2'-$NH_2$ modifications, the remaining nucleotide positions contain 2'-O-methyl substitutions; four nucleotides at the 5' terminus contains phosphorothioate substitutions. Additionally, the 3' end of the ribozyme contains a 3'-3' linked inverted abasic deoxyribose.

Referring to FIG. 8, the effect of hammerhead ribozymes targeted against KDR receptor on the binding of VEGF to KDR on the surface of human microvascular endothelial cells is shown. A majority of the ribozymes tested were able to inhibit the expression of KDR and thereby were able to inhibit the binding of VEGF. As a control, the cells were treated with a ribozyme that is not targeted towards KDR RNA (irrel. RZ); there was no specific inhibition of VEGF binding. The results from this control experiment strongly suggest that the inhibition of VEGF binding observed with anti-KDR ribozymes is a ribozyme-mediated inhibition.

EXAMPLE 5

Effect of Ribozymes Targeted Against VEGF Receptors on Cell Proliferation

Cell Preparation:

24-well plates were coated with 1.5% gelatin (porcine skin 300 bloom). After 1 hour, excess gelatin is washed off of the plate. Microvascular endothelial cells were plated at 5,000 cells/well (24 well plate) in 200 µl growth media. The cells were allowed to grow for ~18 hours (~1 doubling) to yield ~10,000 cells (25–30% confluent).

Ribozyme Treatment:

Media was removed from the cells, and the cells were washed two times with 300 µl 1×PBS:$Ca^{2+}$:$Mg^{2+}$ mixture.

For anti-flt-1HH ribozyme experiment (FIG. 12) a complex of 500 nM ribozyme; 15 µM LFA (3:1 lipid:phosphate ratio) in 200 µl OptiMEM (5% FCS) media was added to the cells. Incubation of cells was carried out for 6 hours (equivalent to 2–3 VEGF receptor turnovers).

For anti-KDR HH ribozyme experiment (FIG. 13) a complex of 200 nM ribozyme; 5.25 µM LFA (3:1 lipid:phosphate ratio) in 200 µl OptiMEM (5% FCS) media was added to the cells. Incubation of cells was carried out for 3 hours.

Proliferation:

After three or six hours, the media was removed from the cells and the cells were washed with 300 µl 1×PBS:$Ca^{2+}$:$Mg^{2+}$ mixture. Maintenance media (contains dialyzed 10% FBS) +/−VEGF or basic FGF at 10 ng/ml was added to the cells. The cells were incubated for 48 or 72 hours. The cells were trypsinized and counted (Coulter counter). Trypan blue was added on one well of each treatment as a control.

As shown in FIG. 12B, VEGF and basic FGF stimulate human microvascular endothelial cell proliferation. However, treatment of cells with 1358 HH or 4229 HH ribozymes, targeted against flt-1 mRNA, results in a significant decrease in the ability of VEGF to stimulate endothelial cell proliferation. These ribozymes do not inhibit the FGF-mediated stimulation of endothelial cell proliferation.

Human microvascular endothelial cells were also treated with hammerhead ribozymes targeted against sites 527, 730, 3702 or 3950 within the KDR mRNA. As shown in FIG. 13, all four ribozymes caused significant inhibition of VEGF-mediated induction of cell proliferation. No significant inhibition of cell proliferation was observed when the cells were treated with a hammerhead ribozyme targeted to an irrelevant RNA. Additionally, none of the ribozymes inhibited FGF-mediated stimulation of cell proliferation.

These results strongly suggest that hammerhead ribozymes targeted against either flt-1 or KDR mRNA specifically inhibit VEGF-mediated induction of endothelial cell proliferation.

EXAMPLE 6

Effect of Antisense Oligonucleotides Targeted Against VEGF Receptors on Cell Proliferation (Colorimetric Assay)

The following are some of the reagents used in the proliferation assay:

Cells: Human aortic endothelial cells (HAEC) from Clonetics®. Cells at early passage are preferably used.

Uptake Medium: EBM (from Clonetics®); 1% L-Glutamine; 20 mM Hepes; No serum; No antibiotics.

Growth Medium: EGM (from Clonetics®); FBS to 20%; 1% L-Glutamine; 20 mM Hepes.

Cell Plating: 96-well tissue culture plates were coated with 0.2% gelatin (50 µl/well). The gelatin was incubated in the wells at room temperature for 15–30 minutes. The gelatin was removed by aspiration and the wells were washed with PBS:$Ca^{2+}$:$Mg^{2+}$ mixture. PBS mixture was left in the wells until cells were ready to be added. HAEC cells were detached by trypsin treatment and resuspended at $1.25 \times 10^4$/ml in growth medium. PBS was removed from plates and 200 µl of cells (i.e. $2.5 \times 10^3$ cells/well) were added to each well. The cells were allowed to grow for 48 hours before the proliferation assay.

Assay: Growth medium was removed from the wells. The cells were washed twice with PBS:$Ca^{2+}$:$Mg^{2+}$ mixture without antibiotics. A formulation of lipid/antisense oligonucleotide (antisense oligonucleotide is used here as a non-limiting example) complex was added to each well (100 µl/well) in uptake medium. The cells were incubated for 2–3 hours at 37° C. in a $CO_2$ incubator. After uptake, 100 µl/well of growth medium was added (gives final FBS concentration of 10%). After approximately 72 hours, 40 µl MTS® stock solution (made as described by manufacturer) was added to each well and incubated at 37° C. for 1–3 hours, depending on the color development. (For this assay, 2 hours was sufficient). The intensity of color formation was determined on a plate reader at 490 nM.

Phosphorothioate-substituted antisense oligodeoxynucleotides were custom synthesized by The Midland Certified Reagent Company®, Midland, Tex. Following non-limiting antisense oligodeoxynucleotides targeted against KDR RNA were used in the proliferation assay:

KDR 21 AS:        5'-GCA GCA CCT TGC TCT    (SEQ ID NO: 20825)
                  CCA TCC-3'

SCRAMBLED CONTROL: 5'-CTG CCA ACT TCC CAT   (SEQ ID NO: 20826)
                   GCC TGC-3'

As shown in FIG. 10, proliferation of HAEC cells is specifically inhibited by increasing concentrations of the phosphorothioate anti-KDR-antisense oligodeoxynucleotide. The scrambled antisense oligonucleotide is not expected to bind the KDR RNA and therefore is not expected to inhibit KDR expression. As expected, there is no detectable inhibition of proliferation of HAEC cells treated with a phosphorothioate antisense oligonucleotide with scrambled sequence.

EXAMPLE 7

In vitro Cleavage of flt-1 RNA by Hammerhead Ribozymes

Referring to FIG. 11A, hammerhead ribozymes (HH) targeted against sites 1358 and 4229 within the flt-1 RNA were synthesized as described above.
RNA Cleavage Assay In Vitro:

Substrate RNA was 5' end-labeled using [γ-$^{32}$P] ATP and T4 polynucleotide kinase (US Biochemicals). Cleavage reactions were carried out under ribozyme "excess" conditions. Trace amount (≦1 nM) of 5' end-labeled substrate and 40 nM unlabeled ribozyme were denatured and renatured separately by heating to 90° C. for 2 minutes and snap-cooling on ice for 10-15 minutes. The ribozyme and substrate were incubated, separately, at 37° C. for 10 minutes in a buffer containing 50 mM Tris-HCl and 10 mM $MgCl_2$. The reaction was initiated by mixing the ribozyme and substrate solutions and incubating at 37° C. Aliquots of 5 μl were taken at regular intervals of time and the reaction was quenched by mixing with equal volume of 2× formamide stop mix. The samples were resolved on 20% denaturing polyacrylamide gels. The results were quantified and percentage of target RNA cleaved is plotted as a function of time.

Referring to FIGS. 11B and 11C, hammerhead ribozymes targeted against sites 1358 and 4229 within the flt-1 RNA are capable of cleaving target RNA efficiently in vitro.

EXAMPLE 8

In vitro Cleavage of KDR RNA by Hammerhead Ribozymes

In this non-limiting example, hammerhead ribozymes targeted against sites 726, 527, 3702 and 3950 within KDR RNA were synthesized as described above. RNA cleavage reactions were carried out in vitro essentially as described under Example 7.

Referring to FIGS. 14 and 15, all four ribozymes were able to cleave their cognate target RNA efficiently in a sequence-specific manner.

EXAMPLE 9

In vitro Cleavage of RNA by Hammerhead Ribozymes Targeted Against Cleavage Sites that are Homologous Between KDR and flt-1 mRNA Given that flt-1 and KDR mRNAs are highly homologous in certain regions, some ribozyme target sites are also homologous (see Table X). In this case, a single ribozyme will target both flt-1 and KDR mRNAs. Hammerhead ribozyme (FLT/KDR-1) targeted against one of the homologous sites between flt-1 and KDR (flt-1 site 3388 and KDR site 3151) was synthesized as described above. Ribozymes with either a 3 bp stem II or a 4 bp stem II were synthesized. RNA cleavage reactions were carried out in vitro essentially as described under Example 7.

Referring to FIG. 16, FLT/KDR-I ribozyme with either a 3 or a 4 bp stem II was able to cleave its target RNA efficiently in vitro.

EXAMPLE 10

Effect of Multiple Ribozymes Targeted Against Both flt-1 and KDR RNA on Cell Proliferation Since both flt-1 and KDR receptors of VEGF are involved in angiogenesis, the inhibition of the expression of both of these genes can be an effective approach to inhibit angiogenesis.

Human microvascular endothalial cells were treated with hammerhead ribozymes targeted against sites flt-1 4229 alone, KDR 527 alone, KDR 726 alone, KDR 3950 alone, flt-1 4229+KDR 527, flt-1 4229+KDR 726 or flt-1 4229+KDR 3950. As shown in FIG. 17, all the combinations of active ribozymes (A) caused significant inhibition of VEGF-mediated induction of cell proliferation. No significant inhibition of cell proliferation was observed when the cells were treated with a catalytically inactive (I) hammerhead ribozymes. Additionally, cells treated with ribozymes targeted against both flt-1 and KDR RNAs-flt-1 4229+KDR 527; flt-1 4229+KDR 726; flt-1 4229+KDR 3950, were able to cause a greater inhibition of VEGF-mediated induction of cell proliferation when compared with individual ribozymes targeted against either flt-1 or KDR RNA (see flt-1 4229 alone; KDR 527 alone; KDR 726 alone; KDR 3950 alone). This strongly suggests that treatment of cells with multiple ribozymes can be a more effective means of inhibition of gene expression.
Animal Models There are several animal models in which the anti-angiogenesis effect of nucleic acids of the present invention, such as enzymatic nucleic acids, directed against VEGF-R mRNAs can be tested. Typically a corneal model has been used to study angiogenesis in rat and rabbit since recruitment of vessels can easily be followed in this normally avascular tissue (Pandey et al., 1995 Science 268: 567–569). In these models, a small Teflon or Hydron disk pretreated with an angiogenesis factor (e.g. bFGF or VEGF) is inserted into a pocket surgically created in the cornea. Angiogenesis is monitored 3 to 5 days later. Enzymatic nucleic acids directed against VEGF-R mRNAs are delivered in the disk as well, or dropwise to the eye over the time course of the experiment. In another eye model, hypoxia has been shown to cause both increased expression of VEGF and neovascularization in the retina (Pierce et al., 1995 Proc. Natl. Acad. Sci. USA. 92: 905–909; Shweiki et al., 1992 J. Clin. Invest. 91: 2235–2243).

In human glioblastomas, it has been shown that VEGF is at least partially responsible for tumor angiogenesis (Plate et al., 1992 *Nature* 359, 845). Animal models have been developed in which glioblastoma cells are implanted subcutaneously into nude mice and the progress of tumor growth and angiogenesism is studied (Kim et al., 1993 supra; Millauer et al., 1994 supra).

Another animal model that addresses neovascularization involves Matrigel, an extract of basement membrane that becomes a solid gel when injected subcutaneously (Passaniti et al., 1992 *Lab. Invest.* 67: 519–528). When the Matrigel is supplemented with angiogenesis factors such as VEGF, vessels grow into the Matrigel over a period of 3 to 5 days and angiogenesis can be assessed. Again, nucleic acids directed against VEGF-R mRNAs are delivered in the Matrigel.

Several animal models exist for screening of anti-angiogenic agents. These include corneal vessel formation following corneal injury (Burger et al., 1985 *Cornea* 4: 35–41; Lepri, et al., 1994 *J. Ocular Pharmacol.* 10: 273–280; Ormerod et al., 1990 *Am. J. Pathol.* 137: 1243–1252) or intracorneal growth factor implant (Grant et al., 1993 *Diabetologia* 36: 282–291; Pandey et al. 1995 supra; Zieche et al., 1992 *Lab. Invest.* 67: 711–715), vessel growth into Matrigel matrix containing growth factors (Passaniti et al., 1992 supra), female reproductive organ neovascularization following hormonal manipulation (Shweiki et al., 1993 *Clin. Invest.* 91: 2235–2243), several models involving inhibition of tumor growth in highly vascularized solid tumors (O'Reilly et al., 1994 *Cell* 79: 315–328; Senger et al., 1993 *Cancer and Metas. Rev.* 12: 303–324; Takahasi et al., 1994 *Cancer Res.* 54: 4233–4237; Kim et al., 1993 supra), and transient hypoxia-induced neovascularization in the mouse retina (Pierce et al., 1995 *Proc. Natl. Acad. Sci. USA.* 92: 905–909).

The cornea model, described in Pandey et al. supra, is the most common and well characterized anti-angiogenic agent efficacy screening model. This model involves an avascular tissue into which vessels are recruited by a stimulating agent (growth factor, thermal or alkalai burn, endotoxin). The corneal model utilizes the intrastromal corneal implantation of a Teflon pellet soaked in a VEGF-Hydron solution to recruit blood vessels toward the pellet which can be quantitated using standard microscopic and image analysis techniques. To evaluate their anti-angiogenic efficacy, nucleic acids are applied topically to the eye or bound within Hydron on the Teflon pellet itself. This avascular cornea as well as the Matrigel (see below) provide for low background assays. While the corneal model has been performed extensively in the rabbit, studies in the rat have also been conducted.

The mouse model (Passaniti et al., supra) is a non-tissue model which utilizes Matrigel, an extract of basement membrane (Kleinman et al., 1986) or Millipore® filter disk, which can be impregnated with growth factors and anti-angiogenic agents in a liquid form prior to injection. Upon subcutaneous administration at body temperature, the Matrigel or Millipore® filter disk forms a solid implant. VEGF embedded in the Matrigel or Millipore® filter disk is used to recruit vessels within the matrix of the Matrigel or Millipore® filter disk which can be processed histologically for endothelial cell specific vWF (factor VIII antigen) immunohistochemistry, Trichrome-Masson stain, or hemoglobin content. Like the cornea, the Matrigel or Millipore® filter disk are avascular; however, it is not tissue. In the Matrigel or Millipore® filter disk model, nucleic acids are administered within the matrix of the Matrigel or Millipore® filter disk to test their anti-angiogenic efficacy. Thus, delivery issues in this model, as with delivery of nucleic acids by Hydron-coated Teflon pellets in the rat cornea model, may be less problematic due to the homogeneous presence of the nucleic acid within the respective matrix.

These models offer a distinct advantage over several other angiogenic models listed previously. The ability to use VEGF as a pro-angiogenic stimulus in both models is highly desirable since the instant nucleic acid molecules target only VEGFr mRNA. In other words, the involvement of other non-specific types of stimuli in the cornea and Matrigel models is not advantageous from the standpoint of understanding the pharmacologic mechanism by which the anti-VEGFr mRNA nucleic acid molecules produce their effects. In addition, the models allow for testing the specificity of the anti-VEGFr mRNA nucleic acids by using either a- or bFGF as a pro-angiogenic factor. Vessel recruitment using FGF should not be affected in either model by anti-VEGFr mRNA nucleic acid molecules. Other models of angiogenesis including vessel formation in the female reproductive system using hormonal manipulation (Shweiki et al., 1993 supra); a variety of vascular solid tumor models which involve indirect correltations with angiogenesis (O'Reilly et al., 1994 supra; Senger et al., 1993 supra; Takahasi et al., 1994 supra; Kim et al., 1993 supra); and retinal neovascularization following transient hypoxia (Pierce et al., 1995 supra) were not selected for efficacy screening due to their non-specific nature, although there is a correlation between VEGF and angiogenesis in these models.

Other model systems to study tumor angiogenesis is reviewed by Folkman, 1985 *Adv. Cancer. Res.* 43, 175.

Use of Murine Models

For a typical systemic study involving 10 mice (20 g each) per dose group, 5 doses (1, 3, 10, 30 and 100 mg/kg daily over 14 days continuous administration), approximately 400 mg of enzymatic nucleic acid, formulated in saline is used. A similar study in young adult rats (200 g) requires over 4 g. Parallel pharmacokinetic studies involve the use of similar quantities of enzymatic nucleic acid further justifying the use of murine models.

Enzymatic Nucleic Acids and Lewis Lung Carcinoma and B-16 Melanoma Murine Models Identifying a common animal model for systemic efficacy testing of enzymatic nucleic acid is an efficient way of screening enzymatic nucleic acid for systemic efficacy.

The Lewis lung carcinoma and B-16 murine melanoma models are well accepted models of primary and metastatic cancer and are used for initial screening of anti-cancer agents. These murine models are not dependent upon the use of immunodeficient mice, are relatively inexpensive, and minimize housing concerns. Both the Lewis lung and B-16 melanoma models involve subcutaneous implantation of approximately $10^6$ tumor cells from metastatically aggressive tumor cell lines (Lewis lung lines 3LL or D122, LLc-LN7; B-16-BL6 melanoma) in C57BL/6J mice. Alternatively, the Lewis lung model can be produced by the surgical implantation of tumor spheres (approximately 0.8 mm in diameter). Metastasis also can be modeled by injecting the tumor cells directly intravenously. In the Lewis lung model, microscopic metastases can be observed approximately 14 days following implantation with quantifiable macroscopic metastatic tumors developing within 21–25 days. The B-16 melanoma exhibits a similar time course with tumor neovascularization beginning 4 days following implantation. Since both primary and metastatic tumors exist in these models after 21–25 days in the same animal, multiple measurements can be taken as indices of efficacy. Primary tumor volume and growth latency as well as the number of micro- and macroscopic metastatic lung foci or number of animals exhibiting metastases can be quantitated. The percent increase in lifespan can also be measured. Thus, these models provide suitable primary efficacy assays for screening systemically administered enzymatic nucleic acids and enzymatic nucleic acid formulations.

In the Lewis lung and B-16 melanoma models, systemic pharmacotherapy with a wide variety of agents usually begins 1–7 days following tumor implantation/inoculation with either continuous or multiple administration regimens. Concurrent pharmacokinetic studies can be performed to determine whether sufficient tissue levels of ribozymes can be achieved for pharmacodynamic effect to be expected. Furthermore, primary tumors and secondary lung metastases can be removed and subjected to a variety of in vitro studies (i.e. target RNA reduction).

Flt-1, KDR and/or flk-1 protein levels can be measured clinically or experimentally by FACS analysis. Flt-1, KDR and/or flk-1 encoded mRNA levels are assessed by Northern analysis, RNase-protection, primer extension analysis and/or quantitative RT-PCR. Enzymatic nucleic acids that block flt-1, KDR and/or flk-1 protein encoding mRNAs and therefore result in decreased levels of flt-1, KDR and/or flk-1 activity by more than 20% in vitro can be identified.

Enzymatic nucleic acids and/or genes encoding them are delivered by either free delivery, liposome delivery, cationic lipid delivery, adeno-associated virus vector delivery, adenovirus vector delivery, retrovirus vector delivery or plasmid vector delivery in these animal model experiments (see above).

Patients can be treated by locally administering nucleic acids targeted against VEGF-R by direct injection. Routes of administration include, but are not limited to, intravascular, intramuscular, subcutaneous, intraarticular, aerosol inhalation, oral (tablet, capsule or pill form), topical, systemic, ocular, intraperitoneal and/or intrathecal delivery.

EXAMPLE 11

Ribozyme-mediated Inhibition of Angiogenesis In Vivo

The purpose of this study was to assess the anti-angiogenic activity of hammerhead ribozymes targeted against flt-1 4229 site in the rat cornea model of VEGF induced angiogenesis (see above). These ribozymes have either active or inactive catalytic core and either bind and cleave or just bind to VEGF-R mRNA of the flt-1 subtype. The active ribozymes, that are able to bind and cleave the target RNA, have been shown to inhibit ($^{125}$I-labeled) VEGF binding in cultured endothelial cells and produce a dose-dependent decrease in VEGF induced endothelial cell proliferation in these cells (see Examples 3–5 above). The catalytically inactive forms of these ribozymes, wherein the ribozymes can only bind to the RNA but cannot catalyze RNA cleavage, fail to show these characteristics. The ribozymes and VEGF were co-delivered using the filter disk method: Nitrocellulose filter disks (Millipore®) of 0.057 diameter were immersed in appropriate solutions and were surgically implanted in rat cornea as described by Pandey et al., supra. This delivery method has been shown to deliver rhodamine-labeled free ribozyme to scleral cells and, in all likelihood cells of the pericorneal vascular plexus. Since the active ribozymes show cell culture efficacy and can be delivered to the target site using the disk method, it is essential that these ribozymes be assessed for in vivo anti-angiogenic activity.

The stimulus for angiogenesis in this study was the treatment of the filter disk with 30 μM VEGF which is implanted within the cornea's stroma. This dose yields reproducible neovascularization stemming from the pericorneal vascular plexus growing toward the disk in a dose-response study 5 days following implant. Filter disks treated only with the vehicle for VEGF show no angiogenic response. The ribozymes were co-adminstered with VEGF on a disk in two different ribozyme concentrations. One concern with the simultaneous administration is that the ribozymes will not be able to inhibit angiogenesis since VEGF receptors can be stimulated. However, Applicant has observed that in low VEGF doses, the neovascular response reverts to normal suggesting that the VEGF stimulus is essential for maintaining the angiogenic response. Blocking the production of VEGF receptors using simultaneous administration of anti-VEGF-R mRNA ribozymes could attenuate the normal neovascularization induced by the filter disk treated with VEGF.

Materials and Methods:
1. Stock Hammerhead Ribozyme Solutions:
   a. flt-1 4229 (786 μM)—Active
   b. flt-1 4229 (736 μM)—Inactive
2. Experimental Solutions/Groups:

| Group 1 | Solution 1 | Control VEGF solution: 30 μM in 82 mM Tris base |
|---|---|---|
| Group 2 | Solution 2 | flt-1 4229 (1 μg/μL) in 30 μM VEGF/82 mM Tris base |
| Group 3 | Solution 3 | flt-1 4229 (10 μg/μL) in 30 μM VEGF/82 mM Tris base |
| Group 4 | Solution 4 | No VEGF, flt-1 4229 (10 μg/μL) in 82 mM Tris base |
| Group 5 | Solution 5 | No VEGF, No ribozyme in 82 mM Tris base |

10 eyes per group, 5 animals (Since they have similar molecular weights, the molar concentrations should be essentially similar).

Each solution (VEGF and RIBOZYMES) were prepared as a 2× solution for 1:1 mixing for final concentrations above, with the exception of solution 1 in which VEGF was 2× and diluted with ribozyme diluent (sterile water).

3. VEGF Solutions

The 2×VEGF solution (60 μM) was prepared from a stock of 0.82 μg/μL in 50 mM Tris base. 200 μL of VEGF stock was concentrated by speed vac to a final volume of 60.8 μL, for a final concentration of 2.7 μg/μL or 60 μM. Six 10 μL aliquots were prepared for daily mixing. 2× solutions for VEGF and Ribozyme was stored at 4° C. until the day of the surgery. Solutions were mixed for each day of surgery. Original 2× solutions were prepared on the day before the first day of the surgery.

4. Surgical Solutions:
Anesthesia:
   stock ketamine hydrochloride 100 mg/mL
   stock xylazine hydrochloride 20 mg/mL
   stock acepromazine 10 mg/mL
   Final anesthesia solution: 50 mg/mL ketamine, 10 mg/mL xylazine, and 0.5 mg/mL acepromazine
   5% povidone iodine for opthalmic surgical wash
   2% lidocaine (sterile) for opthalmic administration (2 drops per eye)
   sterile 0.9% NaCl for opthalmic irrigation 5. Surgical Methods:
   Standard surgical procedure was performed as described in Pandey et al., supra. Filter disks were incubated in 1 μL of each solution for approximately 30 minutes prior to implantation.

6. Experimental Protocol:
   The animal corneas were treated with the treatment groups as described above. Animals were allowed to recover for 5 days after treatment with daily observation (scoring 0–3). On the fifth day animals were euthanized and digital images of each eye was obtained for quantitaion using Image Pro Plus. Quantitated neovascular surface areas were analyzed by ANOVA followed by two post-hoc tests including Dunnets and Tukey-Kramer tests for significance at the 95% confidence level. Dunnets provide information on the significance between the differences within the means of treatments vs. controls while Tukey-Kramer provide information on the significance of differences within the means of each group.

Results are graphically represented in FIG. 18. As shown in FIG. 18, flt-1 4229 active hammerhead ribozyme at both concentrations was effective at inhibiting angiogenesis, while the inactive ribozyme did not show any significant reduction in angiogenesis. A statistically signifiant reduction in neovascular surface area was observed only with active ribozymes. This result clearly shows that the ribozymes are capable of significantly inhibiting angiogenesis in vivo. Specifically, the mechanism of inhibition appears to be by the binding and cleavage of target RNA by ribozymes.

EXAMPLE 12

Bioactivity of Anti-angiogenesis Ribozymes Targeting flt-1 and kdr RNA

Materials and Methods

Ribozymes: Hammerhead ribozymes and controls designed to have attenuated activity (attenuated controls) were synthesized and purified as previously described above. The attenuated ribozyme controls maintain the binding arm sequence of the parent ribozyme and thus are still capable of binding to the mRNA target. However, they have two nucleotide changes in the core sequence that substantially reduce their ability to carry out the cleavage reaction. Ribozymes were designed to target Flt-1 or KDR mRNA sites conserved in human, mouse, and rat. In general, ribozymes with binding arms of seven nucleotides were designed and tested. If, however, only six nucleotides surrounding the cleavage site were conserved in all three species, six nucleotide binding arms were used. A subset of ribozyme and attenuated control sequences and modifications are listed in Table XII. Data are presented herein for $2'$-$NH_2$ uridine modified ribozymes in cell proliferation studies and for $2'$-C-allyl uridine modified ribozymes in RNAse protection, in vitro cleavage and corneal studies.

In vitro ribozyme cleavage assays: In vitro RNA cleavage rates on a 15 nucleotide synthetic RNA substrate were measured as previously described above.

Cell culture: Human dermal microvascular endothelial cells (HMVEC-d, Clonetics Corp.) were maintained at 37° C. in flasks or plates coated with 1.5% porcine skin gelatin (300 bloom, Sigma) in Growth medium (Clonetics Corp.) supplemented with 10–20% fetal bovine serum (FBS, Hyclone). Cells were grown to confluency and used up to the seventh passage. Stimulation medium consisted of 50% Sigma 99 media and 50% RPMI 1640 with L-glutamine and additional supplementation with 10 µg/mL Insulin-Transferrin-Selenium (Gibco BRL) and 10% FBS. Cell growth was stimulated by incubation in Stimulation medium supplemented with 20 ng/mL of either $VEGF_{165}$ or bFGF. $VEGF_{165}$ (165 amino acids) was selected for cell culture and animal studies because it is the predominant form of the four native forms of VEGF generated by alternative mRNA splicing. Cell culture assays were carried out in triplicate.

Ribozyme and ribozyme/LIPOFECTAMINE™ formulations:

Cell culture: Ribozymes or attenuated controls (50–200 nM) were formulated for cell culture studies and used immediately. Formulations were carried out with LIPOFECTAMINE™ (Gibco BRL) at a 3:1 lipid to phosphate charge ratio in serum-free medium (OPTI-MEM™, Gibco BRL) by mixing for 20 minutes at room temperature. For example, a 3:1 lipid to phosphate charge ratio was established by complexing 200 nM ribozyme with 10.8 µg/µL LIPOFECTAMINE™ (13.5 µM DOSPA).

In vivo: For corneal studies, lyophilized ribozyme or attenuated controls were resuspended in sterile water at a final stock concentration of 170 µg/µL (highest dose). Lower doses (1.7–50 µg/µL) were prepared by serial dilution in sterile water.

Proliferation assay: HMVEC-d were seeded ($5\times10^3$ cells/well) in 48-well plates (Costar) and incubated 24–30 hours in Growth medium at 37° C. After removal of the Growth medium, cells were treated with 50–200 nM LIPOFECTAMINE™ complexes of ribozyme or attenuated controls for 2 hours in OPTI-MEM™. The ribozyme/control-containing medium was removed and the cells were washed extensively in 1×PBS. The medium was then replaced with Stimulation medium or Stimulation medium supplemented with 20 ng/mL $VEGF_{165}$ or bFGF. After 48 hours, the cell number was determined using a Coulter™ cell counter. Data are presented as cell number per well following 48 h of VEGF stimulation.

RNAse protection assay: HMVEC-d were seeded ($2\times10^5$ cells/well) in 6-well plates (Costar) and allowed to grow 32–36 hours in Growth medium at 37° C. Cells were treated with LIPOFECTAMINE™ complexes containing 200 nM ribozyme or attenuated control for 2 hours as described under "Proliferation Assay" and then incubated in Growth medium containing 20 ng/mL $VEGF_{165}$ for 24 hours. Cells were harvested and an RNAse protection assay was carried out using the Ambion Direct Protect kit and protocol with the exception that 50 mM EDTA was added to the lysis buffer to eliminate the possibility of ribozyme cleavage during sample preparation. Antisense RNA probes targeting portions of Flt-1 and KDR were prepared by transcription in the presence of $[^{32}P]$-UTP. Samples were analyzed on polyacrylamide gels and the level of protected RNA fragments was quantified using a Molecular Dynamics PhosphorImager. The levels of Flt-1 and KDR were normalized to the level of cyclophilin (human cyclophilin probe template, Ambion) in each sample. The coefficient of variation for cyclophilin levels was 11% [265940 cpm±29386 (SD)] for all conditions tested here (i.e. in the presence of either active ribozymes or attenuated controls). Thus, cyclophilin is useful as an internal standard in these studies.

Rat corneal pocket assay of VEGF-induced angiogenesis:

Animal guidelines and anesthesia. Animal housing and experimentation adhered to standards outlined in the 1996 Guide for the Care and Use of Laboratory Animals (National Research Council). Male Sprague Dawley rats (250–300 g) were anesthetized with ketamine (50 mg/kg), xylazine (10 mg/kg), and acepromazine (0.5 mg/kg) administered intramuscularly (im). The level of anesthesia was monitored every 2–3 min by applying hind limb paw pressure and examining for limb withdrawal. Atropine (0.4 mg/kg, im) was also administered to prevent potential corneal reflex-induced bradycardia.

Preparation of VEGF soaked disk. For corneal implantation, 0.57 mm diameter nitrocellulose disks, prepared from 0.45 µm pore diameter nitrocellulose filter membranes (Millipore Corporation), were soaked for 30 min in 1 µL of 30 µM $VEGF_{165}$ in 82 mM Tris HCl (pH 6.9) in covered petri dishes on ice.

Corneal surgery. The rat corneal model used in this study was a modified from Koch et al. Supra and Pandey et al., supra. Briefly, corneas were irrigated with 0.5% povidone iodine solution followed by normal saline and two drops of 2% lidocaine. Under a dissecting microscope (Leica MZ-6), a stromal pocket was created and a presoaked filter disk (see above) was inserted into the pocket such that its edge was 1 mm from the corneal limbus.

Intraconjunctival injection of test solutions. Immediately after disk insertion, the tip of a 40–50 µm OD injector (constructed in our laboratory) was inserted within the conjunctival tissue 1 mm away from the edge of the corneal limbus that was directly adjacent to the VEGF-soaked filter disk. Six hundred nanoliters of test solution (ribozyme, attenuated control or sterile water vehicle) were dispensed at a rate of 12 µL/min using a syringe pump (Kd Scientific). The injector was then removed, serially rinsed in 70% ethanol and sterile water and immersed in sterile water between each injection. Once the test solution was injected, closure of the eyelid was maintained using microaneurism clips until the animal began to recover gross motor activity. Following treatment, animals were warmed on a heating pad at 37° C.

Animal treatment groups/experimental protocol. Ribozymes targeting Flt-1 site 4229 and KDR mRNA site 726 were tested in the corneal model along with their attenuated controls. Five treatment groups were assigned to examine the effects of five doses of each test substance over a dose range of 1–100 µg on VEGF-stimulated angiogenesis. Negative (30 µM VEGF soaked filter disk and intraconjunctival injection of 600 nL sterile water) and no stimulus (Tris-soaked filter disk and intraconjunctival injection of sterile water) control groups were also included. Each group consisted of five animals (10 eyes) receiving the same treatment.

Quantitation of angiogenic response. Five days after disk implantation, animals were euthanized following im administration of 0.4 mg/kg atropine and corneas were digitally imaged. The neovascular surface area (NSA, expressed in pixels) was measured postmortem from blood-filled corneal vessels using computerized morphometry (Image Pro Plus, Media Cybernetics, v2.0). The individual mean NSA was determined in triplicate from three regions of identical size in the area of maximal neovascularization between the filter disk and the limbus. The number of pixels corresponding to the blood-filled corneal vessels in these regions was summated to produce an index of NSA. A group mean NSA was then calculated. Data from each treatment group were normalized to VEGF/ribozyme vehicle-treated control NSA and finally expressed as percent inhibition of VEGF-induced angiogenesis.

Statistics. After determining the normality of treatment group means, group mean percent inhibition of VEGF-induced angiogenesis was subjected to a one-way analysis of variance. This was followed by two post-hoc tests for significance including Dunnett's (comparison to VEGF control) and Tukey-Kramer (all other group mean comparisons) at alpha=0.05. Statistical analyses were performed using JMP v.3.1.6 (SAS Institute).

Results.

Ribozyme-mediated reduction of VEGF-induced cell proliferation: Ribozyme cleavage of Flt-1 or KDR mRNA should result in a decrease in the density of cell surface VEGF receptors. This decrease should limit VEGF binding and consequently interfere with the mitogenic signaling induced by VEGF. To determine if cell proliferation was impacted by anti-Flt-1 and/or anti-KDR ribozyme treatment, proliferation assays using cultured human microvascular cells were carried out. Ribozymes included in the proliferation assays were initially chosen by their ability to decrease the level of VEGF binding to treated cells (see FIG. 8). In these initial studies, ribozymes targeting 20 sites in the coding region of each mRNA were screened. The most effective ribozymes against two sites in each target (Table XII), Flt-1 sites 1358 and 4229 and KDR sites 726 and 3950, were included in the proliferation assays reported here (FIG. 19). In addition, attenuated analogs of each ribozyme were used as controls (Table XII). These attenuated controls are still capable of binding to the mRNA target since the binding arm sequence is maintained. However, these controls have two nucleotide changes in the core sequence that substantially reduce their ability to carry out the cleavage reaction.

The antiproliferative effect of active ribozymes targeting two lead sites on each VEGF receptor mRNA is shown in FIG. 19. The active ribozymes tested decreased the relative proliferation of HMVEC-d after VEGF stimulation, an effect that increased with ribozyme concentration. This concentration dependency was not observed following treatment with the attenuated controls designed for these sites. In fact, little or no change in cell growth was noted following treatment with the attenuated controls, even though these controls can still bind to the specific target sequences. At 200 nM, there was a distinct "window" between the anti-proliferative effects of each ribozyme and its attenuated control; a trend also observed at lower doses. This window of inhibition of proliferation (56–77% based on total cells/well) reflects the contribution of ribozyme-mediated activity. In comparison, no effect of anti-Flt-1 or anti-KDR ribozymes was noted on bFGF-stimulated cell proliferation (FIGS. 19C, 19F). Moreover, an irrelevant, but active, ribozyme whose binding sequence is not found in either Flt-1 or KDR mRNA had no effect in this assay (FIG. 19B). These data are consistent with the basic ribozyme mechanism in which binding and cleavage are necessary components. Although the relative surface distribution of Flt-1 and KDR receptors in this cell type is not known, the antiproliferative effects of these ribozymes indicate that, at least in cell culture, both receptors are functionally coupled to proliferation.

Specific reduction of Flt-1 or KDR mRNA by ribozyme treatment: To confirm that anti-Flt-1 and anti-KDR ribozymes reduce their respective mRNA targets, cellular levels of Flt-1 or KDR were quantified using an RNAse protection assay with specific Flt-1 or KDR probes. For each target, one ribozyme/attenuated control pair was chosen for continued study. Data from a representative experiment are shown in FIG. 20. Exposure of HMVEC-d to active ribozyme targeting Flt-1 site 4229 decreased Flt-1 mRNA, but not KDR mRNA. Likewise, treatment with the active ribozyme targeting KDR site 726 decreased KDR, but not Flt-1 mRNA. Both ribozymes decreased the level of their respective target RNA by greater than 50%. The degree of reduction associated with the corresponding attenuated controls was not greater than 13%.

In vitro activity of anti-Flt and anti-KDR ribozymes.

To confirm further the necessity of an active ribozyme core, in vitro cleavage activities were determined for the Flt-1 site 4229 ribozyme and the KDR site 726 ribozyme as well as their paired attenuated controls. The first order rate constants calculated from the time-course of short substrate cleavage for the anti-Flt-1 ribozyme and its attenuated control were $0.081 \pm 0.0007$ min$^{-1}$ and $0.001 \pm 6 \times 10^{-5}$ min$^{-1}$, respectively. For the anti-KDR ribozyme and its paired control, the first order rate constants were $0.434 \pm 0.024$ min$^{-1}$ and $0.002 \pm 1 \times 10^{-4}$ min$^{-1}$, respectively. Although the attenuated controls retain a very slight level of cleavage activity under these optimized conditions, the decrease in in vitro cleavage activity between each active ribozyme and its paired attenuated control is about two orders of magnitude. Thus, an active core is essential for cleavage activity in vitro and is also necessary for ribozyme activity in cell culture.

Ribozyme-mediated reduction of VEGF-induced angiogenesis in vivo. To assess whether ribozymes targeting VEGF receptor mRNA could impact the complex process of angiogenesis, prototypic anti-Flt-1 and KDR ribozymes that were identified in cell culture studies were screened in a rat corneal pocket assay of VEGF-induced angiogenesis. In this assay, corneas implanted with VEGF-containing filter disks exhibited a robust neovascular response in the corneal region between the disk and the corneal limbus (from which the new vessels emerge). Disks containing a vehicle solution elicited no angiogenic response. In separate studies, intraconjunctival injections of sterile water vehicle did not affect the magnitude of the VEGF-induced angiogenic response. In addition, ribozyme injections alone did not induce angiogenesis.

The dose-related effects of anti-Flt-1 or KDR ribozymes on the VEGF-induced angiogenic response were then examined. FIGS. 21 and 22 illustrate the quantified antiangiogenic effect of the anti-Flt-1 (site 4229) and KDR (site 726) ribozymes and their attenuated controls over a dose range from 1 to 100 µg, respectively. For both ribozymes, the maximal antiangiogenic response (48 and 36% for anti-Flt-1 and KDR ribozymes, respectively) was observed at a dose of 10 µg.

The anti-Flt-1 ribozyme produced a significantly greater antiangiogenic response than its attenuated control at 3 and 10 µg ($p<0.05$; FIG. 21). Its attenuated control exhibited a small but significant antiangiogenic response at doses above 10 µg compared to vehicle treated VEGF controls ($p<0.05$; FIG. 21). At its maximum, this response was not significantly greater than that observed with the lowest dose of active anti-Flt-1 ribozyme. The anti-KDR ribozyme significantly inhibited angiogenesis from 3 to 30 µg ($p<0.05$; FIG. 22). The anti-KDR attenuated control had no significant effect at any dose tested.

EXAMPLE 13

In Vivo Inhibition of Tumor Growth and Metastases by VEGF-R Ribozymes

A. Lewis Lung Carcinoma Mouse Model: Ribozymes were chemically synthesized as described above. The sequence of ANGIOZYME™ bound to its target RNA is shown in FIG. 26.

The tumors in this study were derived from a cell line (LLC-HM) which gives rise to reproducible numbers of spontaneous lung metastases when propagated in vivo. The LLC-HM line was obtained from Dr. Michael O'Reilly, Harvard University. Tumor neovascularization in Lewis lung carcinoma has been shown to be VEGF-dependent. Tumors from mice bearing LLC-HM (selected for the highly metastatic phenotype by serial propagation) were harvested 20 days post-inoculation. A tumor brei suspension was prepared from these tumors according to standard protocols. On day 0 of the study, $0.5 \times 10^6$ viable LLC-HM tumor cells were injected subcutaneously (sc) into the dorsum or flank of previously untreated mice (100 µL injectate). Tumors were allowed to grow for a period of 3 days prior to initiating continuous intravenous administration of saline or 30 mg/kg/d ANGIOZYME™ via Alzet mini-pumps. One set of animals was dosed from days 3 to 17, inclusive. Tumor length and width measurements and volumes were calculated according to the formula: Volume=$0.5$(length)(width)$^2$.

At post-inoculation day 25, animals were euthanized and lungs harvested. The number of lung macrometastatic nodules was counted. It should be noted that metastatic foci were quantified 8 days after the cessation of dosing. Ribozyme solutions were prepared to deliver to another set of animals 100, 10, 3, or 1 mg/kg/day of ANGIOZYME™ via Alzet mini-pumps. A total of 10 animals per dose or saline control group were surgically implanted on the left flank with osmotic mini-pumps pre-filled with the respective test solution three days following tumor inoculation. Pumps were attached to indwelling jugular vein catheters.

FIG. 27 shows the antitumor effects of ANGIOZYME™. There is a statistically significant inhibition ($p<0.05$) of primary LLC-HM tumor growth in tumors grown in the flank regions compared to saline control. ANGIOZYME™ significantly reduced ($p<0.05$) the number of lung metastatic foci in animals inoculated either in the flank regions. FIG. 28 illustrates the dose-dependent anti-metastatic effect of ANGIOZYME™ compared to saline control.

B. Mouse Colorectal Cancer Model. KM12L4a-16 is a human colorectal cancer cell line. On day 0 of the study, $0.5 \times 10^6$ KM12L4a-16 cells were implanted into the spleen of nude mice. Three days after tumor inoculation, Alzet minipumps were implanted and continuous subcutaneous delivery of either saline or 12, 36 or 100 mg/kg/day of ANGIOZYME™ was initiated. On day 5, the spleens containing the primary tumors were removed. On day 18, the Alzet minipumps were replaced with fresh pumps so that delivery of saline or ANGIOZYME™ was continuous over a 28 day period from day 3 to day 32. Animals were euthanized on day 41 and the liver tumor burden was evaluated.

Following treatment with 100 mg/kg/day of ANGIOZYME™, there was a significant reduction in the incidence and median number of liver metastasis (FIGS. 29 and 30). In saline-treated animals, the median number of metastases was 101. However, at the high dose of ANGIOZYME™ (100 mg/kg/day), the median number of metastases was zero.

EXAMPLE 14

Effect of ANGIOZYME™ Alone or in Combination with Chemotherapeutic Agents in the Mouse Lewis Lung Carcinoma Model Methods Tumor inoculations. Male C57/BL6 mice, age 6 to 8 weeks, were inoculated subcutaneously in the flank with $5 \times 10^5$ LLC-HM cells from brei preparations made from tumors grown in mice.

Ribozymes and controls. The ribozyme and controls tested in this study are given in Table XIII. RPI.4610, also known as ANGIOZYME™, is an anti-Flt-1 ribozyme that targets site 4229 in the human Flt-1 receptor mRNA (EMBL accession no. X51602). The controls tested include RPI.13141, an attenuated version of RPI.4610 in which four nucleotides in the catalytic core are changed so that the cleavage activity is dramatically decreased. RPI.13141, however, maintains the base composition and binding arms of RPI.4610 and so is still capable of binding to the target site. The second control (RPI.13030) also has changes to the catalytic core (three) to inhibit cleavage activity, but in addition the sequence of the binding arms has been scrambled so that it can no longer bind to the target sequence. One nucleotide in the arm of RPI.13030 is also changed to maintain the same base composition as RPI.4610.

Ribozyme administrations. Ribozymes and controls were resuspended in normal saline. Administration was initiated seven days following tumor inoculation. Animals either received a daily subcutaneous injection (30 mg/kg test substance) from day 7 to day 20 or were instrumented with an Alzet osmotic minipump (12 μL/day flow rate) containing a solution of ribozyme or control. Subcutaneous infusion pumps delivered the test substances (30 mg/kg/day) from day 7 to 20 (14-day pumps, 420 mg/kg total test substance) or days 7–34 (28-day pumps, 840 mg/kg total test substance). Where indicated, chemotherapeutic agents were given in combination with ribozyme treatment. Cyclophosphamide was given by ip administration on days 7, 9 and 11 (125 mg/kg). Gemcitabine was given by intraperitoneal administration on days 8, 11 and 14 (125 mg/kg). Untreated, uninstrumented animals were used as comparison. Five animals were included in each group.

Results

The antiangiogenic ribozyme, ANGIOZYME™, was tested in a model of Lewis lung carcinoma alone and in combination with two chemotherapeutic agents. Previously (see above), 30 mg/kg/day ANGIOZYME™ alone was determined to inhibit both primary tumor growth and lung metastases in a highly metastatic variant of Lewis lung (continuous 14-day intraveneous delivery via Alzet minipump).

In this study, 30 mg/kg/day ANGIOZYME™ delivered either as a daily subcutaneous bolus injection or as a continuous infusion from an Alzet minipump resulted in a delay in tumor growth (FIG. 23). On average, tumor growth to 500 mm$^3$ was delayed by approximately 7 days in animals being treated with ANGIOZYME™ compared to an untreated group. Growth of tumors in animals being treated with either of two attenuated controls was delayed by only approximately 2 days.

ANGIOZYME™ delivered by subcutaneous bolus was also tested in combination with either Gemcytabine or cyclophosphamide (FIG. 24). Tumor growth delay increased by about 3 days in the presence of combination therapy with ANGIOZYME™ and Gemcytabine over the effects of either treatment alone. The combination of ANGIOZYME™ and cyclophosphamide did not increase tumor growth delay over that of cyclophosphamide alone, however, suboptimal doses of cyclophosphamide were not included in this study. Neither of the attenuated controls increased the effect of the chemotherapeutic agents.

The effect of ANGIOZYME™ on metastases to the lung was also determined in the presence and absence of additional chemotherapeutic treatment. Macrometastases to the lungs were counted in two animals in each treatment group on day 20. Data for the daily subcutaneous administration of 30 mg/kg ANGIOZYME™ alone or with Gemcytabine or cyclophosphamide is given in FIG. 25. In the presence of ANGIOZYME™, with or without a chemotherapeutic agent, the lung metastases were reduced to zero. Treatment with either Gemcytabine or cyclophosphamide alone (mean number of metastases 4.5 and 4, respectively) were not as effective as ANGIOZYME™ alone or when used in combination with ANGIOZYME™. Neither of the attenuated controls increased the effect of the chemotherapeutic agents.

The effect on metastases to the lung was also determined following continuous treatment with ANGIOZYME™. At day 20, an average of approximately 8 macrometastases were noted in the treatment groups which had been instrumented with Alzet minipumps (either 14- or 28-day pumps). This is a decrease in metastases of approximately 50% from the untreated group. Since ANGIOZYME™ delivered by a daily subcutaneous bolus resulted in zero metastases (FIG. 4) in the two animals counted, it is possible that the additional burden of being instrumented with the minipump contributes to a slightly decreased response to ANGIOZYME™.

EXAMPLE 15

Phase I/II Study of Repetitive Dose ANGIOZYME™ Targeting the FLT-1 Receptor of VEGF A ribozyme therapeutic agent ANGIOZYME™, was assessed by daily subcutaneous administration in a phase I/II trial for 31 patients with refractory solid tumors. Demographic information relating to patients enrolled in the study are shown in Table XX. The primary study endpoint was to determine the safety and maximum tolerated dose of ANGIOZYME™. Secondary endpoints assessed ANGIOZYME™ pharmacokinetics and clinical response. Patients were treated in four cohorts of three patients at doses of 10, 30, 100, and 300 mg/m$^2$/day. Following the dose escalation phase, an additional 15 evaluable patients were entered in an expanded cohort at 100 mg/m2/day. Patients were dosed for a minimum of 29 consecutive days with 24-hour pharmacokinetic analyses on Day 1 and 29. Clinical response was assessed monthly.

Results The data from 20 patients indicated that ANGIOZYME™ was well tolerated, with no systemic adverse events. FIG. 31 shows the plasma concentration profile of ANGIOZYME™ after a single SC (subcutaneous) dose of 10, 30, 100, or 300 mg/m$^2$. The pharmacokinetic parameters of ANGIOZYME™ after SC bolus administration are outlined in Table XXI. An MTD (maximum tolerated dose) could not be established. One patient in the 300 mg/m$^2$/d group experienced a grade 3 injection site reaction. Patients in the other groups experienced intermittent grade 1 and grade 2 injection site reactions with erythema and induration. No systemic or laboratory toxicities were observed. Pharmacokinetic analyses demonstrated dose-dependent plasma concentrations with good bioavailability (70–90%), t1/2=209–384 min, and no accumulation after repeated doses. To date, 17/28 (61%) of evaluable patients have had stable disease for periods of one to six months and two patients (nasopharyngeal squamous cell carcinoma and melanoma) had minor clinical responses. The patient with nasopharyngeal carcinoma demonstrated central tumor necrosis as indicated by MRI. The longest period of treatment thus far has been 8 months for two patients at 100 mg/m$^2$/d (breast, peritoneal mesothelioma).

EXAMPLE 16

In Vivo Inhibition of Neovascularization in an Ocular Animal Model by VEGF-R Ribozymes Summary of the Mouse Model: A mouse model of proliferative retinopathy (Aiello et al., 1995, *Proc. Natl. Acad. Sci. USA* 92: 10457–10461; Robinson et al., 1996, *Proc. Natl. Acad. Sci. USA* 93: 4851–4856; Pierce et al., 1996, *Archives of Ophthalmology* 114: 1219–1228) in which neovascularization of the mouse retina is induced by exposure of 7-day old mice to 75% oxygen followed by a return to normal room air. The initial period in high oxygen causes an obliteration of developing blood vessels in the retina. Exposure to room air five days later is perceived as hypoxia by the now underperfused retina. The result is an immediate upregulation of VEGF mRNA and VEGF protein (between 6–12 hours) followed by an extensive retinal neovascularization that peaks in approximately 5 days. Although this model is more representative of retinopathy of prematurity than diabetic retinopathy, it is an accepted small animal model in which to study neovascular pathophysiology of the retina. In fact, intravitreal injection of certain antisense DNA constructs targeting VEGF mRNA have been found to be antiangiogenic in this model, as were soluble VEGF receptor chimeric proteins designed to bind VEGF in the vitreous humor (Aiello et al., 1995, *Proc. Natl. Acad. Sci. USA* 92: 10457–10461; Robinson et al., 1996, *Proc. Natl. Acad. Sci. USA* 93: 4851–4856; Pierce et al., 1996, *Archives of Ophthalmology* 114: 1219–1228).

Summary of experiment: The effect of an anti-KDR/Flk-1 ribozyme on the peak level of neovascularization was tested in the mouse model described above. As shown in FIG. 34A, P7 mice were removed from the hyperoxic chamber and the mice received two intraocular injections (P12 and P13) in the right eye of 10 μg RPI.4731, the anti-KDR/Flk-1 ribozyme. The left eye of each mouse was treated as a control and received intraocular injections of saline. Five days after being exposed to room air, neovascular nuclei in the retina of both eyes were counted. Data are presented in FIG. 34B. There was a significant decrease in retinal neovascularization (approximately 40%) compared to the control, saline-injected eyes.

RPI.4731 sequence and chemical composition:

5'-u$_s$a$_s$c$_s$ a$_s$au ucU GAu Gag gcg aaa gcc Gaa Aag aca aB-3' (SEQ ID NO: 13488)

where: uppercase G, A=ribonucleotides
lowercase=2'-OMe
U=2'-C-allyl uridine
B=inverted abasic nucleotide
S=phosphorothioate linkage Indications 1) Tumor angiogenesis: Angiogenesis has been shown to be necessary for tumors to grow into pathological size (Folkman, 1971, *PNAS* 76, 5217–5221; Wellstein & Czubayko, 1996, *Breast Cancer Res and Treatment* 38, 109–119). In addition, it allows tumor cells to travel through the circulatory system during metastasis. Increased levels of gene expression of a number of angiogenic factors such as vascular endothelial growth factor (VEGF) have been reported in vascularized and edema-associated brain tumors (Berkman et al., 1993 *J. Clini. Invest*. 91, 153). A more direct demonstration of the role of VEGF in tumor angiogenesis was demonstrated by Jim Kim et al., 1993 *Nature* 362, 841 wherein, monoclonal antibodies against VEGF were successfully used to inhibit the growth of rhabdomyosarcoma, glioblastoma multiforme cells in nude mice. Similarly, expression of a dominant negative mutated form of the flt-1 VEGF receptor inhibits vascularization induced by human glioblastoma cells in nude mice (Millauer et al., 1994, *Nature* 367, 576). Specific tumor/cancer types that can be targeted using the nucleic acid molecules of the invention include but are not limited to the tumor/cancer types described under Diagnosis in Table XX.

2) Ocular diseases: Neovascularization has been shown to cause or exacerbate ocular diseases including but not limited to, macular degeneration, neovascular glaucoma, diabetic retinopathy, myopic degeneration, and trachoma (Norrby, 1997, *APMIS* 105, 417–437). Aiello et al., 1994 *New Engl. J. Med*. 331, 1480, showed that the ocular fluid, of a majority of patients suffering from diabetic retinopathy and other retinal disorders, contains a high concentration of VEGF. Miller et al., 1994 *Am. J. Pathol*. 145, 574, reported elevated levels of VEGF mRNA in patients suffering from retinal ischemia. These observations support a direct role for VEGF in ocular diseases. Other factors, including those that stimulate VEGF synthesis, may also contribute to these indications.

3) Dermatological Disorders: Many indications have been identified which may be angiogenesis dependent including, but not limited to, psoriasis, verruca vulgaris, angiofibroma of tuberous sclerosis, pot-wine stains, Sturge Weber syndrome, Kippel-Trenaunay-Weber syndrome, and Osler-Weber-Rendu syndrome (Norrby, supra). Intradermal injection of the angiogenic factor b-FGF demonstrated angiogenesis in nude mice (Weckbecker et al., 1992, *Angiogenesis: Key principles-Science-Technology-Medicine*, ed R. Steiner) Detmar et al., 1994 *J. Exp. Med*. 180, 1141 reported that VEGF and its receptors were over-expressed in psoriatic skin and psoriatic dermal microvessels, suggesting that VEGF plays a significant role in psoriasis.

4) Rheumatoid arthritis: Immunohistochemistry and in situ hybridization studies on tissues from the joints of patients suffering from rheumatoid arthritis show an increased level of VEGF and its receptors (Fava et al., 1994 *J. Exp. Med*. 180, 341). Additionally, Koch et al., 1994 *J. Immunol*. 152, 4149, found that VEGF-specific antibodies were able to significantly reduce the mitogenic activity of synovial tissues from patients suffering from rheumatoid arthritis. These observations support a direct role for VEGF in rheumatoid arthritis. Other angiogenic factors including those of the present invention may also be involved in arthritis.

Combination Therapies

Gemcytabine and cyclophosphamide are non-limiting examples of chemotherapeutic agents that can be combined with or used in conjunction with the nucleic acid molecules (e.g. ribozymes and antisense molecules) of the instant invention. Those skilled in the art will recognize that other anti-angiogenic and/or anti-cancer compounds and therapies can be similarly be readily combined with the nucleic acid molecules of the instant invention (e.g. ribozymes and antisense molecules) and are hence within the scope of the instant invention. Such compounds and therapies are well known in the art (see for example *Cancer: Principles and Pranctice of Oncology*, Volumes 1 and 2, eds Devita, V. T., Hellman, S., and Rosenberg, S. A., J. B. Lippincott Company, Philadelphia, USA; incorporated herein by reference) and include, without limitations, folates, antifolates, pyrimidine analogs, fluoropyrimidines, purine analogs, adenosine analogs, topoisomerase I inhibitors, anthrapyrazoles, retinoids, antibiotics, anthacyclins, platinum analogs, alkylating agents, nitrosoureas, plant derived compounds such as vinca alkaloids, epipodophyllotoxins, tyrosine kinase inhibitors, taxols, radiation therapy, surgery, nutritional supplements, gene therapy, radiotherapy, for example 3D-CRT, immunotoxin therapy, for example ricin, and monoclonal antibodies. Specific examples of chemotherapeutic compounds that can be combined with or used in conjuction with the nucleic acid molecules of the invention include, but are not limited to, Paclitaxel; Docetaxel; Methotrexate; Doxorubin; Edatrexate; Vinorelbine; Tomaxifen; Leucovorin; 5-fluoro uridine (5-FU); Ionotecan; Cisplatin; Carboplatin; Amsacrine; Cytarabine; Bleomycin; Mitomycin C; Dactinomycin; Mithramycin; Hexamethylmelamine; Dacarbazine; L-asperginase; Nitrogen mustard; Melphalan, Chlorambucil; Busulfan; Ifosfamide; 4-hydroperoxycyclophosphamide, Thiotepa; Irinotecan (CAMPTOSAR®, CPT-11, Camptothecin-11, Campto) Tamoxifen, Herceptin; IMC C225; ABX-EGF: and combinations thereof.

Diagnostic Uses

The nucleic acid molecules of this invention (e.g., enzymatic nucleic acid) can be used as diagnostic tools to examine genetic drift and mutations within diseased cells or to detect the presence of flt-1, KDR and/or flk-1 RNA in a cell. The close relationship between enzymatic nucleic acid activity and the structure of the target RNA allows the detection of mutations in any region of the molecule which alters the base-pairing and three-dimensional structure of the target RNA. By using multiple enzymatic nucleic acids described in this invention, one can map nucleotide changes which are important to RNA structure and function in vitro, as well as in cells and tissues. Cleavage of target RNAs with enzymatic nucleic acid can be used to inhibit gene expression and define the role (essentially) of specified gene products in the progression of disease. In this manner, other genetic targets can be defined as important mediators of the disease. These experiments can lead to better treatment of the disease progression by affording the possibility of combinational therapies (e.g., multiple enzymatic nucleic acids targeted to different genes, enzymatic nucleic acids coupled with known small molecule inhibitors, or intermittent treatment with combinations of enzymatic nucleic acids and/or other chemical or biological molecules). Other in vitro uses of enzymatic nucleic acids of the invention are well known in the art, and include detection of the presence of mRNAs associated with flt-1, KDR and/or flk-1 related condition. Such RNA is detected by determining the presence of a cleavage product after treatment with a ribozyme using standard methodology.

In a specific example, enzymatic nucleic acids which can cleave only wild-type or mutant forms of the target RNA are used for the assay. The first enzymatic nucleic acid is used to identify wild-type RNA present in the sample and the second enzymatic nucleic acid is used to identify mutant RNA in the sample. As reaction controls, synthetic substrates of both wild-type and mutant RNA are cleaved by both enzymatic nucleic acids to demonstrate the relative enzymatic nucleic acid efficiencies in the reactions and the absence of cleavage of the "non-targeted" RNA species. The cleavage products from the synthetic substrates also serve to generate size markers for the analysis of wild-type and mutant RNAs in the sample population. Thus, each analysis requires two enzymatic nucleic acids, two substrates and one unknown sample which is combined into six reactions. The presence of cleavage products is determined using an RNAse protection assay so that full-length and cleavage fragments of each RNA can be analyzed in one lane of a polyacrylamide gel. It is not absolutely required to quantify the results to gain insight into the expression of mutant RNAs and putative risk of the desired phenotypic changes in target cells. The expression of mRNA whose protein product is implicated in the development of the phenotype (i.e., flt-1, KDR and/or flk-1) is adequate to establish risk. If probes of comparable specific activity are used for both transcripts, then a qualitative comparison of RNA levels is adequate and decreases the cost of the initial diagnosis. Higher mutant form to wild-type ratios is correlated with higher risk whether RNA levels are compared qualitatively or quantitatively. The use of enzymatic nucleic acid molecules in diagnostic applications contemplated by the instant invention is more fully described in George et al., U.S. Pat. Nos. 5,834,186 and 5,741,679, Shih et al., U.S. Pat. No. 5,589,332, Nathan et al., U.S. Pat. No. 5,871,914, Nathan and Ellington, International PCT publication No. WO 00/24931, Breaker et al., International PCT Publication Nos. WO 00/26226 and 98/27104, and Sullenger et al., International PCT publication No. WO 99/29842.

Additional Uses

Potential usefulness of sequence-specific enzymatic nucleic acid molecules of the instant invention have many of the same applications for the study of RNA that DNA restriction endonucleases have for the study of DNA (Nathans et al., 1975 Ann. Rev. Biochem. 44:273). For example, the pattern of restriction fragments can be used to establish sequence relationships between two related RNAs, and large RNAs can be specifically cleaved to fragments of a size more useful for study. The ability to engineer sequence specificity of the enzymatic nucleic acid molecule is ideal for cleavage of RNAs of unknown sequence. Applicant describes the use of nucleic acid molecules to down-regulate gene expression of target genes in bacterial, microbial, fungal, viral, and eukaryotic systems including plant, or mammalian cells.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications may be made to the invention disclosed herein without departing from the scope and spirit of the invention. Thus, such additional embodiments are within the scope of the present invention and the following claims.

The invention illustratively described herein suitably may be practiced in the absence of any element or elements, limitation or limitations which is not specifically disclosed herein. Thus, for example, in each instance herein any of the terms "comprising", "consisting essentially of" and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

Other embodiments are within the claims that follow.

TABLE I

Characteristics of Ribozymes

Group I Introns

Size: ~200 to >1000 nucleotides.
Requires a U in the target sequence immediately 5' of the cleavage site.
Binds 4–6 nucleotides at 5' side of cleavage site.
Over 75 known members of this class. Found in *Tetrahymena thermophila* rRNA, fungal mitochondria, chloroplasts, phage T4, blue-green algae, and others.
RNAseP RNA (M1 RNA)

Size: ~290 to 400 nucleotides.
RNA portion of a ribonucleoprotein enzyme. Cleaves tRNA precursors to form mature tRNA.
Roughly 10 known members of this group all are bacterial in origin.
Hammerhead Ribozyme Size: ~13 to 40 nucleotides.
Requires the target sequence UH immediately 5' of the cleavage site.
Binds a variable number of nucleotides on both sides of the cleavage site.
14 known members of this class. Found in a number of plant pathogens (virusoids) that use RNA as the infectious agent (FIGS. 1 and 2)

TABLE I-continued

Characteristics of Ribozymes

Hairpin Ribozyme

Size: ~50 nucleotides.
Requires the target sequence GUC immediately 3' of the cleavage site.
Binds 4–6 nucleotides at 5' side of the cleavage site and a variable number to the 3' side of the cleavage site.
Only 3 known member of this class. Found in three plant pathogen (satellite RNAs of the tobacco ringspot virus, arabis mosaic virus and chicory yellow mottle virus) which uses RNA as the infectious agent (FIG. 3).
Hepatitis Delta Virus (HDV) Ribozyme Size: 50–60 nucleotides (at present).
Sequence requirements not fully determined.
Binding sites and structural requirements not fully determined, although no sequences 5' of cleavage site are required.
Only 1 known member of this class. Found in human HDV (FIG. 4).
Neuraspora VS RNA Ribozyme Size: ~144 nucleotides (at present)
Cleavage of target RNAs recently demonstrated.
Sequence requirements not fully determined.
Binding sites and structural requirements not fully determined. Only 1 known member of this class. Found in Neurospora VS RNA (FIG. 5).

TABLE II

Human flt1 VEGF Receptor-Hammerhead Ribozyme and Substrate Sequence

| Pos | Substrate | Seq ID No | HH Ribozyme | Seq ID No |
|---|---|---|---|---|
| 10 | CGGACACUC CUCUCGGC | 1 | GCCGAGAG CUGAUGAGGCCGUUAGGCCGAA AGUGUCCG | 9420 |
| 13 | ACACUCCUC UCGGCUCC | 2 | GGAGCCGA CUGAUGAGGCCGUUAGGCCGAA AGGAGUGU | 9421 |
| 15 | ACUCCUCUC GGCUCCUC | 3 | GAGGAGCC CUGAUGAGGCCGUUAGGCCGAA AGAGGACU | 9422 |
| 20 | UCUCGGCUC CUCCCCGG | 4 | CCGGGGAG CUGAUGAGGCCGUUAGGCCGAA AGCCGAGA | 9423 |
| 23 | CGGCUCCUC CCCGGCAG | 5 | CUGCCGGG CUGAUGAGGCCGUUAGGCCGAA AGGAGCCG | 9424 |
| 43 | CGGCGGCUC GGAGCGGG | 6 | CCCGCUCC CUGAUGAGGCCGUUAGGCCGAA AGCCGCCG | 9425 |
| 54 | AGCGGGCUC CGGGGCUC | 7 | GAGCCCCG CUGAUGAGGCCGUUAGGCCGAA AGCCCGCU | 9426 |
| 62 | CCGGGGCUC GGGUGCAG | 8 | CUGCACCC CUGAUGAGGCCGUUAGGCCGAA AGCCCCGG | 9427 |
| 97 | GCGAGGAUU ACCCGGGG | 9 | CCCCGGGU CUGAUGAGGCCGUUAGGCCGAA AUCCUCGC | 9428 |
| 98 | CGAGGAUUA CCCGGGGA | 10 | UCCCCGGG CUGAUGAGGCCGUUAGGCCGAA AAUCCUCG | 9429 |
| 113 | GAAGUGGUU GUCUCCUG | 11 | CAGGAGAC CUGAUGAGGCCGUUAGGCCGAA ACCACUUC | 9430 |
| 116 | GUGGUUGUC UCCGGCU | 12 | AGCCAGGA CUGAUGAGGCCGUUAGGCCGAA ACAACCAC | 9431 |
| 118 | GGUUGUCUC CUGGCUGG | 13 | CCAGCCAG CUGAUGAGGCCGUUAGGCCGAA AGACAACC | 9432 |
| 145 | CGCGCGCUC AGGGCGCG | 14 | CGCGCCCU CUGAUGAGGCCGUUAGGCCGAA AGCGCCCG | 9433 |
| 185 | GACGGACUC UGGCGGCC | 15 | GGCCGCCA CUGAUGAGGCCGUUAGGCCGAA AGUCCGUC | 9434 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 198 | GGCCGGGUC GUUGGCCG | 16 | CGGCCAAC CUGAUGAGGCCGUUAGGCCGAA ACCCGGCC | 9435 |
| 201 | CGGGUCGUU GGCCGGGG | 17 | CCCCGGCC CUGAUGAGGCCGUUAGGCCGAA ACGACCCG | 9436 |
| 240 | GGCCGCGUC GCGCUCAC | 18 | GUGAGCGC CUGAUGAGGCCGUUAGGCCGAA ACGCGGCC | 9437 |
| 246 | GUCGCGCUC ACCAUGGU | 19 | ACCAUGGU CUGAUGAGGCCGUUAGGCCGAA AGCGCGAC | 9438 |
| 255 | ACCAUGGUC AGCUACUG | 20 | CAGUAGCU CUGAUGAGGCCGUUAGGCCGAA ACCAUGGU | 9439 |
| 260 | GGUCAGCUA CUGGGACA | 21 | UGUCCCAG CUGAUGAGGCCGUUAGGCCGAA AGCUGACC | 9440 |
| 276 | ACCGGGUC CUGCUGUG | 22 | CACAGCAG CUGAUGAGGCCGUUAGGCCGAA ACCCCGGU | 9441 |
| 294 | GCGCUGCUC AGCUGUCU | 23 | AGACAGCU CUGAUGAGGCCGUUAGGCCGAA AGCAGCGC | 9442 |
| 301 | UCAGCUGUC UGCUUCUC | 24 | GAGAAGCA CUGAUGAGGCCGUUAGGCCGAA ACAGCUGA | 9443 |
| 306 | UGUCUGCUU CUCACAGG | 25 | CCUGUGAG CUGAUGAGGCCGUUAGGCCGAA AGCAGACA | 9444 |
| 307 | GUCUGCUUC UCACAGGA | 26 | UCCUGUGA CUGAUGAGGCCGUUAGGCCGAA AAGCAGAC | 9445 |
| 309 | CUGCUUCUC ACAGGAUC | 27 | GAUCCUGU CUGAUGAGGCCGUUAGGCCGAA AGAAGCAG | 9446 |
| 317 | CACAGGAUC UAGUUCAG | 28 | CUGAACUA CUGAUGAGGCCGUUAGGCCGAA AUCCUGUG | 9447 |
| 319 | CAGGAUCUA GUUCAGGU | 29 | ACCUGAAC CUGAUGAGGCCGUUAGGCCGAA AGAUCCUG | 9448 |
| 322 | GAUCUAGUU CAGGUUCA | 30 | UGAACCUG CUGAUGAGGCCGUUAGGCCGAA ACUAGAUC | 9449 |
| 323 | AUCUAGUUC AGGUUCAA | 31 | UUGAACCU CUGAUGAGGCCGUUAGGCCGAA AACUAGAU | 9450 |
| 328 | GUUCAGGUU CAAAAUUA | 32 | UAAUUUUG CUGAUGAGGCCGUUAGGCCGAA ACCUGAAC | 9451 |
| 329 | UUCAGGUUC AAAAUUAA | 33 | UUAAUUUU CUGAUGAGGCCGUUAGGCCGAA AACCUGAA | 9452 |
| 335 | UUCAAAAUU AAAAGAUC | 34 | GAUCUUUU CUGAUGAGGCCGUUAGGCCGAA AUUUUGAA | 9453 |
| 336 | UCAAAAUUA AAAGAUCC | 35 | GGAUCUUU CUGAUGAGGCCGUUAGGCCGAA AAUUUUGA | 9454 |
| 343 | UAAAAGAUC CUGAACUG | 36 | CAGUUCAG CUGAUGAGGCCGUUAGGCCGAA AUCUUUUA | 9455 |
| 355 | AACUGAGUU UAAAAGGC | 37 | GCCUUUUA CUGAUGAGGCCGUUAGGCCGAA ACUCAGUU | 9456 |
| 356 | ACUGAGUUU AAAAGGCA | 38 | UGCCUUUU CUGAUGAGGCCGUUAGGCCGAA AACUCAGU | 9457 |
| 357 | CUGAGUUUA AAAGGCAC | 39 | GUGCCUUU CUGAUGAGGCCGUUAGGCCGAA AAACUCAG | 9458 |
| 375 | CAGCACAUC AUGCAAGC | 40 | GCUUGCAU CUGAUGAGGCCGUUAGGCCGAA AUGUGCUG | 9459 |
| 400 | CACUGCAUC UCCAAUGC | 41 | GCAUUGGA CUGAUGAGGCCGUUAGGCCGAA AUGCAGUG | 9460 |
| 402 | CUGCAUCUC CAAUGCAG | 42 | CUGCAUUG CUGAUGAGGCCGUUAGGCCGAA AGAUGCAG | 9461 |
| 427 | CAGCCCAUA AAUGGUCU | 43 | AGACCAUU CUGAUGAGGCCGUUAGGCCGAA AUGGGCUG | 9462 |
| 434 | UAAAUGGUC UUUGCCUG | 44 | CAGGCAAA CUGAUGAGGCCGUUAGGCCGAA ACCAUUUA | 9463 |
| 436 | AAUGGUCUU UGCCUGAA | 45 | UUCAGGCA CUGAUGAGGCCGUUAGGCCGAA AGACCAUU | 9464 |
| 437 | AUGGUCUUU GCCUGAAA | 46 | UUUCAGGC CUGAUGAGGCCGUUAGGCCGAA AAGACCAU | 9465 |
| 454 | UGGUGAGUA AGGAAAGC | 47 | GCUUUCCU CUGAUGAGGCCGUUAGGCCGAA ACUCACCA | 9466 |
| 477 | CUGAGCAUA ACUAAAUC | 48 | GAUUUAGU CUGAUGAGGCCGUUAGGCCGAA AUGCUCAG | 9467 |
| 481 | GCAUAACUA AAUCUGCC | 49 | GGCAGAUU CUGAUGAGGCCGUUAGGCCGAA AGUUAUGC | 9468 |
| 485 | AACUAAAUC UGCCUGUG | 50 | CACAGGCA CUGAUGAGGCCGUUAGGCCGAA AUUUAGUU | 9469 |
| 512 | CAAACAAUU CUGCAGUA | 51 | UACUGCAG CUGAUGAGGCCGUUAGGCCGAA AUUGUUUG | 9470 |
| 513 | AAACAAUUC UGCAGUAC | 52 | GUACUGCA CUGAUGAGGCCGUUAGGCCGAA AAUUGUUU | 9471 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 520 | UCUGCAGUA CUUUAACC | 53 | GGUUAAAG CUGAUGAGGCCGUUAGGCCGAA ACUGCAGA | 9472 |
| 523 | GCAGUACUU UAACCUUG | 54 | CAAGGUUA CUGAUGAGGCCGUUAGGCCGAA AGUACUGC | 9473 |
| 524 | CAGUACUUU AACCUUGA | 55 | UCAAGGUU CUGAUGAGGCCGUUAGGCCGAA AAGUACUG | 9474 |
| 525 | AGUACUUUA ACCUUGAA | 56 | UUCAAGGU CUGAUGAGGCCGUUAGGCCGAA AAAGUACU | 9475 |
| 530 | UUUAACCUU GAACACAG | 57 | CUGUGUUC CUGAUGAGGCCGUUAGGCCGAA AGGUUAAA | 9476 |
| 541 | ACACAGCUC AAGCAAAC | 58 | GUUUGCUU CUGAUGAGGCCGUUAGGCCGAA AGCUGUGU | 9477 |
| 560 | CACUGGCUU CUACAGCU | 59 | AGCUGUAG CUGAUGAGGCCGUUAGGCCGAA AGCCAGUG | 9478 |
| 561 | ACUGGCUUC UACAGCUG | 60 | CAGCUGUA CUGAUGAGGCCGUUAGGCCGAA AAGCCAGU | 9479 |
| 563 | UGGCUUCUA CAGCUGCA | 61 | UGCAGCUG CUGAUGAGGCCGUUAGGCCGAA AGAAGCCA | 9480 |
| 575 | CUGCAAAUA UCUAGCUG | 62 | CAGGUAGA CUGAUGAGGCCGUUAGGCCGAA AUUUGCAG | 9481 |
| 577 | GCAAAUAUC UAGCUGUA | 63 | UACAGCUA CUGAUGAGGCCGUUAGGCCGAA AUAUUUGC | 9482 |
| 579 | AAAUAUCUA GCUGUACC | 64 | GGUACAGC CUGAUGAGGCCGUUAGGCCGAA AGAUAUUU | 9483 |
| 585 | CUAGCUGUA CCUACUUC | 65 | GAAGUAGG CUGAUGAGGCCGUUAGGCCGAA ACAGCUAG | 9484 |
| 589 | CUGUACCUA CUUCAAAG | 66 | CUUUGAAG CUGAUGAGGCCGUUAGGCCGAA AGGUACAG | 9485 |
| 592 | UACCUACUU CAAAGAAG | 67 | CUUCUUUG CUGAUGAGGCCGUUAGGCCGAA AGUAGGUA | 9486 |
| 593 | ACCUACUUC AAAGAAGA | 68 | UCUUCUUU CUGAUGAGGCCGUUAGGCCGAA AAGUAGGU | 9487 |
| 614 | AACAGAAUC UGCAAUCU | 69 | AGAUUGCA CUGAUGAGGCCGUUAGGCCGAA AUUCUGUU | 9488 |
| 621 | UCUGCAAUC UAUAUAUU | 70 | AAUAUAUA CUGAUGAGGCCGUUAGGCCGAA AUUGCAGA | 9489 |
| 623 | UGCAAUCUA UAUAUUUA | 71 | UAAAUAUA CUGAUGAGGCCGUUAGGCCGAA AGAUUGCA | 9490 |
| 625 | CAAUCUAUA UAUUUAUU | 72 | AAUAAAUA CUGAUGAGGCCGUUAGGCCGAA AUAGAUUG | 9491 |
| 627 | AUCUAUAUA UUUAUUAG | 73 | CUAAUAAA CUGAUGAGGCCGUUAGGCCGAA AUAUAGAU | 9492 |
| 629 | CUAUAUAUU UAUUAGUG | 74 | CACUAAUA CUGAUGAGGCCGUUAGGCCGAA AUAUAUAG | 9493 |
| 630 | UAUAUAUUU AUUAGUGA | 75 | UCACUAAU CUGAUGAGGCCGUUAGGCCGAA AAUAUAUA | 9494 |
| 631 | AUAUAUUUA UUAGUGAU | 76 | AUCACUAA CUGAUGAGGCCGUUAGGCCGAA AAAUAUAU | 9495 |
| 633 | AUAUUUAUU AGUGAUAC | 77 | GUAUCACU CUGAUGAGGCCGUUAGGCCGAA AUAAAUAU | 9496 |
| 634 | UAUUUAUUA GUGAUACA | 78 | UGUAUCAC CUGAUGAGGCCGUUAGGCCGAA AAUAAAUA | 9497 |
| 640 | UUAGUGAUA CAGGUAGA | 79 | UCUACCUG CUGAUGAGGCCGUUAGGCCGAA AUCACUAA | 9498 |
| 646 | AUACAGGUA GACCUUUC | 80 | GAAAGGUC CUGAUGAGGCCGUUAGGCCGAA ACCUGUAU | 9499 |
| 652 | GUAGACCUU UCGUAGAG | 81 | CUCUACGA CUGAUGAGGCCGUUAGGCCGAA AGGUCUAC | 9500 |
| 653 | UAGACCUUU CGUAGAGA | 82 | UCUCUACG CUGAUGAGGCCGUUAGGCCGAA AAGGUCUA | 9501 |
| 654 | AGACCUUUC GUAGAGAU | 83 | AUCUCUAC CUGAUGAGGCCGUUAGGCCGAA AAAGGUCU | 9502 |
| 657 | CCUUUCGUA GAGAUGUA | 84 | UACAUCUC CUGAUGAGGCCGUUAGGCCGAA ACGAAAGG | 9503 |
| 665 | AGAGAUGUA CAGUGAAA | 85 | UUUCACUG CUGAUGAGGCCGUUAGGCCGAA ACAUCUCU | 9504 |
| 675 | AGUGAAAUC CCCGAAAU | 86 | AUUUCGGG CUGAUGAGGCCGUUAGGCCGAA AUUUCACU | 9505 |
| 684 | CCCGAAAUU AUACACAU | 87 | AUGUGUAU CUGAUGAGGCCGUUAGGCCGAA AUUUCGGG | 9506 |
| 685 | CCGAAAUUA UACACAUG | 88 | CAUGUGUA CUGAUGAGGCCGUUAGGCCGAA AAUUUCGG | 9507 |
| 687 | GAAAUUAUA CACAUGAC | 89 | GUCAUGUG CUGAUGAGGCCGUUAGGCCGAA AUAAUUUC | 9508 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 711 | AGGGAGCUC GUCAUUCC | 90 | GGAAUGAC CUGAUGAGGCCGUUAGGCCGAA AGCUCCCU | 9509 |
| 714 | GAGCUCGUC AUUCCUG | 91 | CAGGGAAU CUGAUGAGGCCGUUAGGCCGAA ACGAGCUC | 9510 |
| 717 | CUCGUCAUU CCCUGCCG | 92 | CGGCAGGG CUGAUGAGGCCGUUAGGCCGAA AUGACGAG | 9511 |
| 718 | UCGUCAUUC CCUGCCGG | 93 | CCGGCAGG CUGAUGAGGCCGUUAGGCCGAA AAUGACGA | 9512 |
| 729 | UGCCGGGUU ACGUCACC | 94 | GGUGACGU CUGAUGAGGCCGUUAGGCCGAA ACCCGGCA | 9513 |
| 730 | GCCGGGUUA CGUCACCU | 95 | AGGUGACG CUGAUGAGGCCGUUAGGCCGAA AACCCGGC | 9514 |
| 734 | GGUUACGUC ACCUAACA | 96 | UGUUAGGU CUGAUGAGGCCGUUAGGCCGAA ACGUAACC | 9515 |
| 739 | CGUCACCUA ACAUCACU | 97 | AGUGAUGU CUGAUGAGGCCGUUAGGCCGAA AGGUGACG | 9516 |
| 744 | CCUAACAUC ACUGUUAC | 98 | GUAACAGU CUGAUGAGGCCGUUAGGCCGAA AUGUUAGG | 9517 |
| 750 | AUCACUGUU ACUUUAAA | 99 | UUUAAAGU CUGAUGAGGCCGUUAGGCCGAA ACAGUGAU | 9518 |
| 751 | UCACUGUUA CUUUAAAA | 100 | UUUUAAAG CUGAUGAGGCCGUUAGGCCGAA AACAGUGA | 9519 |
| 754 | CUGUUACUU UAAAAAAG | 101 | CUUUUUUA CUGAUGAGGCCGUUAGGCCGAA AGUAACAG | 9520 |
| 755 | UGUUACUUU AAAAAGU | 102 | ACUUUUUU CUGAUGAGGCCGUUAGGCCGAA AAGUAACA | 9521 |
| 756 | GUUACUUUA AAAAGUU | 103 | AACUUUUU CUGAUGAGGCCGUUAGGCCGAA AAAGUAAC | 9522 |
| 764 | AAAAAGUU UCCACUUG | 104 | CAAGUGGA CUGAUGAGGCCGUUAGGCCGAA ACUUUUUU | 9523 |
| 765 | AAAAGUUU CCACUUGA | 105 | UCAAGUGG CUGAUGAGGCCGUUAGGCCGAA AACUUUUU | 9524 |
| 766 | AAAGUUUC CACUUGAC | 106 | GUCAAGUG CUGAUGAGGCCGUUAGGCCGAA AAACUUUU | 9525 |
| 771 | UUCCACUU GACACUUU | 107 | AAAGUGUC CUGAUGAGGCCGUUAGGCCGAA AGUGGAAA | 9526 |
| 778 | UUGACACUU UGAUCCCU | 108 | AGGGAUCA CUGAUGAGGCCGUUAGGCCGAA AGUGUCAA | 9527 |
| 779 | UGACACUUU GAUCCCUG | 109 | CAGGGAUC CUGAUGAGGCCGUUAGGCCGAA AAGUGUCA | 9528 |
| 783 | ACUUUGAUC CUGAUGG | 110 | CCAUCAGG CUGAUGAGGCCGUUAGGCCGAA AUCAAAGU | 9529 |
| 801 | AAACGCAUA AUCUGGGA | 111 | UCCCAGAU CUGAUGAGGCCGUUAGGCCGAA AUGCGUUU | 9530 |
| 804 | CGCAUAAUC UGGGACAG | 112 | CUGUCCCA CUGAUGAGGCCGUUAGGCCGAA AUUAUGCG | 9531 |
| 814 | GGGACAGUA GAAAGGGC | 113 | GCCCUUUC CUGAUGAGGCCGUUAGGCCGAA ACUGUCCC | 9532 |
| 824 | AAAGGGCUU CAUCAUAU | 114 | AUAUGAUG CUGAUGAGGCCGUUAGGCCGAA AGCCCUUU | 9533 |
| 825 | AAGGGCUUC AUCAUAUC | 115 | GAUAUGAU CUGAUGACGCCGUUAGGCCGAA AAGCCCUU | 9534 |
| 828 | GGCUUCAUC AUAUCAAA | 116 | UUUGAUAU CUGAUGAGGCCGUUAGGCCGAA AUGAAGCC | 9535 |
| 831 | UUCAUCAUA UCAAAUGC | 117 | GCAUUUGA CUGAUGAGGCCGUUAGGCCGAA AUGAUGAA | 9536 |
| 833 | CAUCAUAUC AAAUGCAA | 118 | UUGCAUUU CUGAUGAGGCCGUUAGGCCGAA AUAUGAUG | 9537 |
| 845 | UGCAACGUA CAAAGAAA | 119 | UUUCUUUG CUGAUGAGGCCGUUAGGCCGAA ACGUUGCA | 9538 |
| 855 | AAAGAAAUA GGGCUUCU | 120 | ACAAGCCC CUGAUGAGGCCGUUAGGCCGAA AUUUCUUU | 9539 |
| 861 | AUAGGGCUU CUGACCUG | 121 | CAGGUCAG CUGAUGAGGCCGUUAGGCCGAA AGCCCUAU | 9540 |
| 862 | UAGGGCUUC UGACCGUG | 122 | ACAGGUCA CUGAUGAGGCCGUUAGGCCGAA AAGCCCUA | 9541 |
| 882 | GCAACAGUC AAUGGGCA | 123 | UGCCCAUU CUGAUGAGGCCGUUAGGCCGAA ACUGUUGC | 9542 |
| 892 | AUGGGCAUU UGUAUAAG | 124 | CUUAUACA CUGAUGAGGCCGUUAGGCCGAA AUGCCCAU | 9543 |
| 893 | UGGGCAUUU GUAUAAGA | 125 | UCUUAUAC CUGAUGAGGCCGUUAGGCCGAA AAUGCCCA | 9544 |
| 896 | GCAUUUGUA UAAGACAA | 126 | UUGUCUUA CUCAUGAGGCCGUUAGGCCGAA ACAAAUGC | 9545 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 898 | AUUUGUAUA AGACAAAC | 127 | GUUUGUCU CUGAUGAGGCCGUUAGGCCGAA AUACAAAU | 9546 |
| 908 | GACAAACUA UCUCACAC | 128 | GUGUGAGA CUGAUGAGGCCGUUAGGCCGAA AGUUUGUC | 9547 |
| 910 | CAAACUAUC UCACACAU | 129 | AUGUGUGA CUGAUGAGGCCGUUAGGCCGAA AUAGUUUG | 9548 |
| 912 | AACUAUCUC ACACAUCG | 130 | CGAUGUGU CUGAUGAGGCCGUUAGGCCGAA AGAUAGUU | 9549 |
| 919 | UCACACAUC GACAAACC | 131 | GGUUUGUC CUGAUGAGGCCGUUAGGCCGAA AUGUGUGA | 9550 |
| 931 | AAACCAAUA CAAUCAUA | 132 | UAUGAUUG CUGAUGAGGCCGUUAGGCCGAA AUUGGUUU | 9551 |
| 936 | AAUACAAUC AUAGAUGU | 133 | ACAUCUAU CUGAUGAGGCCGUUAGGCCGAA AUUGUAUU | 9552 |
| 939 | ACAAUCAUA GAUGUCCA | 134 | UGGACAUC CUGAUGAGGCCGUUAGGCCGAA AUGAUUGU | 9553 |
| 945 | AUAGAUGUC CAAAUAAG | 135 | CUUAUUUG CUGAUGAGGCCGUUAGGCCGAA ACAUCUAU | 9554 |
| 951 | GUCCAAAUA AGCACACC | 136 | GGUGUGCU CUGAUGAGGCCGUUAGGCCGAA AUUUGGAC | 9555 |
| 969 | CGCCCAGUC AAAUUACU | 137 | AGUAAUUU CUGAUGAGGCCGUUAGGCCGAA ACUGGGCG | 9556 |
| 974 | AGUCAAAUU ACUUAGAG | 138 | CUCUAAGU CUGAUGAGGCCGUUAGGCCGAA AUUUGACU | 9557 |
| 975 | GUCAAAUUA CUUAGAGG | 139 | CCUCUAAG CUGAUGAGGCCGUUAGGCCGAA AAUVUGAC | 9558 |
| 978 | AAAUUACUU AGAGGCCA | 140 | UGGCCUCU CUGAUGAGGCCGUUAGGCCGAA AGUAAUUU | 9559 |
| 979 | AAUUACUUA GAGGCCAU | 141 | AUGGCCUC CUGAUGAGGCCGUUAGGCCGAA AAGUAAUU | 9560 |
| 988 | GAGGCCAUA CUCUUGUC | 142 | GACAAGAG CUGAUGAGGCCGUUAGGCCGAA AUGGCCUC | 9561 |
| 991 | GCCAUACUC UUGUCCUC | 143 | GAGGACAA CUGAUGAGGCCGUUAGGCCGAA AGUAUGGC | 9562 |
| 993 | CAUACUCUU GUCCUCAA | 144 | UUGAGGAC CUGAUGAGGCCGUUAGGCCGAA AGAGUAUG | 9563 |
| 996 | ACUCUUGUC CUCAAUUG | 145 | CAAUUGAG CUGAUGAGGCCGUUAGGCCGAA ACAAGAGU | 9564 |
| 999 | CUUGUCCUC AAUUGUAC | 146 | GUACAAUU CUGAUGAGGCCGUUAGGCCGAA AGGACAAG | 9565 |
| 1003 | UCCUCAAUU GUACUGCU | 147 | AGCAGUAC CUGAUGAGGCCGUUAGGCCGAA AUUGAGGA | 9566 |
| 1006 | UCAAUUGUA CUGCUACC | 148 | GGUAGCAG CUGAUGAGGCCGUUAGGCCGAA ACAAUUGA | 9567 |
| 1012 | GUACUGCUA CCACUCCC | 149 | GGGAGUGG CUGAUGAGGCCGUUAGGCCGAA AGCAGUAC | 9568 |
| 1018 | CUACCACUC CCUUGAAC | 150 | GUUCAAGG CUGAUGAGGCCGUUAGGCCGAA AGUGGUAG | 9569 |
| 1022 | CACUCCCUU GAACACGA | 151 | UCGUGUUC CUGAUGAGGCCGUUAGGCCGAA AGGGAGUG | 9570 |
| 1035 | ACGAGAGUU CAAAUGAC | 152 | GUCAUUUG CUGAUGAGGCCGUUAGGCCGAA ACUCUCGU | 9571 |
| 1036 | CGAGAGUUC AAAUGACC | 153 | GGUCAUUU CUGAUGAGGCCGUUAGGCCGAA AACUCUCG | 9572 |
| 1051 | CCUGGAGUU ACCCUGAU | 154 | AUCAGGGU CUGAUGAGGCCGUUAGGCCGAA ACUCCAGG | 9573 |
| 1052 | CUGGAGUUA CCCUGAUG | 155 | CAUCAGGG CUGAUGAGGCCGUUAGGCCGAA AACUCCAG | 9574 |
| 1069 | AAAAAAAUA AGAGAGCU | 156 | AGCUCUCU CUGAUGAGGCCGUUAGGCCGAA AUUUUUUU | 9575 |
| 1078 | AGAGAGCUU CCGUAAGG | 157 | CCUUACGG CUGAUGAGGCCGUUAGGCCGAA AGCUCUCU | 9576 |
| 1079 | GAGAGCUUC CGUAAGGC | 158 | GCCUUACG CUGAUGAGGCCGUUAGGCCGAA AAGCUCUC | 9577 |
| 1083 | GCUUCCGUA AGGCGACG | 159 | CGUCGCCU CUGAUGAGGCCGUUAGGCCGAA ACGGAAGC | 9578 |
| 1095 | CGACGAAUU GACCAAAG | 160 | CUUUGGUC CUGAUGAGGCCGUUAGGCCGAA AUUCGUCG | 9579 |
| 1108 | AAAGCAAUU CCCAUGCC | 161 | GGCAUGGG CUGAUGAGGCCGUUAGGCCGAA AUUGCUUU | 9580 |
| 1109 | AAGCAAUUC CCAUGCCA | 162 | UGGCAUGG CUGAUGAGGCCGUUAGGCCGAA AAUUGCUU | 9581 |
| 1122 | GCCAACAUA UUCUACAG | 163 | CUGUAGAA CUGAUGAGGCCGUUAGGCCGAA AUGUUGGC | 9582 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 1124 | CAACAUAUU CUACAGUG | 164 | CACUGUAG CUGAUGAGGCCGUUAGGCCGAA AUAUGUUG | 9583 |
| 1125 | AACAUAUUC UACAGUGU | 165 | ACACUGUA CUGAUGAGGCCGUUAGGCCGAA AAUAUGUU | 9584 |
| 1127 | CAUAUUCUA CAGUGUUC | 166 | GAACACUG CUGAUGAGGCCGUUAGGCCGAA AGAAUAUG | 9585 |
| 1134 | UACAGUGUU CUUACUAU | 167 | AUAGUAAG CUGAUGAGGCCGUUAGGCCGAA ACACUGUA | 9586 |
| 1135 | ACAGUGUUC UUACUAUU | 168 | AAUAGUAA CUGAUGAGGCCGUUAGGCCGAA AACACUGU | 9587 |
| 1137 | AGUGUUCUU ACUAUUGA | 169 | UCAAUAGU CUGAUGAGGCCGUUAGGCCGAA AGAACACU | 9588 |
| 1138 | GUGUUCUUA CUAUUGAC | 170 | GUCAAUAG CUGAUGAGGCCGUUAGGCCGAA AAGAACAC | 9589 |
| 1141 | UUCUUACUA UUGACAAA | 171 | UUUGUCAA CUGAUGAGGCCGUUAGGCCGAA AGUAAGAA | 9590 |
| 1143 | CUUACUAUU GACAAAAU | 172 | AUUUUGUC CUGAUGAGGCCGUUAGGCCGAA AUAGUAAG | 9591 |
| 1173 | AAAGGACUU UAUACUUG | 173 | CAAGUAUA CUGAUGAGGCCGUUAGGCCGAA AGUCCUUU | 9592 |
| 1174 | AAGGACUUU AUACUUGU | 174 | ACAAGUAU CUGAUGAGGCCGUUAGGCCGAA AAGUCCUU | 9593 |
| 1175 | AGGACUUUA UACUUGUC | 175 | GACAAGUA CUGAUGAGGCCGUUAGGCCGAA AAAGUCCU | 9594 |
| 1177 | GACUUUAUA CUUGUCGU | 176 | ACGACAAG CUGAUGAGGCCGUUAGGCCGAA AUAAAGUC | 9595 |
| 1180 | UUUAUACUU GUCGUGUA | 177 | UACACGAC CUGAUGAGGCCGUUAGGCCGAA AGUAUAAA | 9596 |
| 1183 | AUACUUGUC GUGUAAGG | 178 | CCUUACAC CUGAUGAGGCCGUUAGGCCGAA ACAAGUAU | 9597 |
| 1188 | UGUCGUGUA AGGAGUGG | 179 | CCACUCCU CUGAUGAGGCCGUUAGGCCGAA ACACGACA | 9598 |
| 1202 | UGGACCAUC AUUCAAAU | 180 | AUUUGAAU CUGAUGAGGCCGUUAGGCCGAA AUGGUCCA | 9599 |
| 1205 | ACCAUCAUU CAAAUCUG | 181 | CAGAUUUG CUGAUGAGGCCGUUAGGCCGAA AUGAUGGU | 9600 |
| 1206 | CCAUCAUUC AAAUCUGU | 182 | ACAGAUUU CUGAUGAGGCCGUUAGGCCGAA AAUGAUGG | 9601 |
| 1211 | AUUCAAAUC UGUUAACA | 183 | UGUUAACA CUGAUGAGGCCGUUAGGCCGAA AUUUGAAU | 9602 |
| 1215 | AAAUCUGUU AACACCUC | 184 | GAGGUGUU CUGAUGAGGCCGUUAGGCCGAA ACAGAUUU | 9603 |
| 1216 | AAUCUGUUA ACACCUCA | 185 | UGAGGUGU CUGAUGAGGCCGUUAGGCCGAA AACAGAUU | 9604 |
| 1223 | UAACACCUC AGUGCAUA | 186 | UAUGCACU CUGAUGAGGCCGUUAGGCCGAA AGGUGUUA | 9605 |
| 1231 | CAGUGCAUA UAUAUGAU | 187 | AUCAUAUA CUGAUGAGGCCGUUAGGCCGAA AUGCACUG | 9606 |
| 1233 | GUGCAUAUA UAUGAUAA | 188 | UUAUCAUA CUGAUGAGGCCGUUAGGCCGAA AUAUGCAC | 9607 |
| 1235 | GCAUAUAUA UGAUAAAG | 189 | CUUUAUCA CUGAUGAGGCCGUUAGGCCGAA AUAUAUGC | 9608 |
| 1240 | UAUAUGAUA AAGCAUUC | 190 | GAAUGCUU CUGAUGAGGCCGUUAGGCCGAA AUCAUAUA | 9609 |
| 1247 | UAAAGCAUU CAUCACUG | 191 | CAGUGAUG CUGAUGAGGCCGUUAGGCCGAA AUGCUUUA | 9610 |
| 1248 | AAAGCAUUC AUCACUGU | 192 | ACAGUGAU CUGAUGAGGCCGUUAGGCCGAA AAUGCUUU | 9611 |
| 1251 | GCAUUCAUC ACUGUGAA | 193 | UUCACAGU CUGAUGAGGCCGUUAGGCCGAA AUGAAUGC | 9612 |
| 1264 | UGAAACAUC GAAAACAG | 194 | CUGUUUUC CUGAUGAGGCCGUUAGGCCGAA AUGUUUCA | 9613 |
| 1281 | CAGGUGCUU GAAACCGU | 195 | ACGGUUUC CUGAUGAGGCCGUUAGGCCGAA AGCACCUG | 9614 |
| 1290 | GAAACCGUA GCUGGCAA | 196 | UUGCCAGC CUGAUGAGGCCGUUAGGCCGAA ACGGUUUC | 9615 |
| 1304 | CAAGCGGUC UUACCGGC | 197 | GCCGGUAA CUGAUGAGGCCGUUAGGCCGAA ACCGCUUG | 9616 |
| 1306 | AGCGGUCUU ACCGGCUC | 198 | GAGCCGGU CUGAUGAGGCCGUUAGGCCGAA AGACCGCU | 9617 |
| 1307 | GCGGUCUUA CCGGCUCU | 199 | AGAGCCGG CUGAUGAGGCCGUUAGGCCGAA AAGACCGC | 9618 |
| 1314 | UACCGGCUC UCUAUGAA | 200 | UUCAUAGA CUGAUGAGGCCGUUAGGCCGAA AGCCGGUA | 9619 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 1316 | CCGGCUCUC UAUGAAAG | 201 | CUUUCAUA CUGAUGAGGCCGUUAGGCCGAA AGAGCCGG | 9620 |
| 1318 | GCUCUCUA UGAAAGUG | 202 | CACUUUCA CUGAUGAGGCCGUUAGGCCGAA AGAGAGCC | 9621 |
| 1334 | GAAGGCAUU UCCCUCGC | 203 | GCGAGGGA CUGAUGAGGCCGUUAGGCCGAA AUGCCUUC | 9622 |
| 1335 | AAGGCAUUU CCCUCGCC | 204 | GGCGAGGG CUGAUGAGGCCGUUAGGCCGAA AAUGCCUU | 9623 |
| 1336 | AGGCAUUUC CUCGCCG | 205 | CGGCGAGG CUGAUGAGGCCGUUAGGCCGAA AAAUGCCU | 9624 |
| 1340 | AUUUCCCUC GCCGGAAG | 206 | CUUCCGGC CUGAUGAGGCCGUUAGGCCGAA AGGGAAAU | 9625 |
| 1350 | CCGGAAGUU GUAUGGUU | 207 | AACCAUAC CUGAUGAGGCCGUUAGGCCGAA ACUUCCGG | 9626 |
| 1353 | GAAGUUGUA UGGUUAAA | 208 | UUUAACCA CUGAUGAGGCCGUUAGGCCGAA ACAACUUC | 9627 |
| 1358 | UGUAUGGUU AAAGAUG | 209 | CAUCUUUU CUGAUGAGGCCGUUAGGCCGAA ACCAUACA | 9628 |
| 1359 | GUAUGGUUA AAGAUGG | 210 | CCAUCUUU CUGAUGAGGCCGUUAGGCCGAA AACCAUAC | 9629 |
| 1370 | AGAUGGGUU ACCGCGA | 211 | UCGCAGGU CUGAUGAGGCCGUUAGGCCGAA ACCCAUCU | 9630 |
| 1371 | GAUGGGUUA CCUGCGAC | 212 | GUCGCAGG CUGAUGAGGCCGUUAGGCCGAA AACCCAUC | 9631 |
| 1388 | UGAGAAAUC UGCUCGCU | 213 | AGCGAGCA CUGAUGAGGCCGUUAGGCCGAA AUUUCUCA | 9632 |
| 1393 | AAUCUGCUC GCUAUUUG | 214 | CAAAUAGC CUGAUGAGGCCGUUAGGCCGAA AGCAGAUU | 9633 |
| 1397 | UGCUCGCUA UUUGACUC | 215 | GAGUCAAA CUGAUGAGGCCGUUAGGCCGAA AGCGAGCA | 9634 |
| 1399 | CUCGCUAUU UGACUCGU | 216 | ACGAGUCA CUGAUGAGGCCGUUAGGCCGAA AUAGCGAG | 9635 |
| 1400 | UCGCUAUUU GACUCGUG | 217 | CACGAGUC CUGAUGAGGCCGUUAGGCCGAA AAUAGCGA | 9636 |
| 1405 | AUUUGACUC GUGGCUAC | 218 | GUAGCCAC CUGAUGAGGCCGUUAGGCCGAA AGUCAAAU | 9637 |
| 1412 | UCGUGGCUA CUCGUUAA | 219 | UUAACGAG CUGAUGAGGCCGUUAGGCCGAA AGCCACGA | 9638 |
| 1415 | UGGCUACUC GUUAAUUA | 220 | UAAUUAAC CUGAUGAGGCCGUUAGGCCGAA AGUAGCCA | 9639 |
| 1418 | CUACUCGUU AAUUAUCA | 221 | UGAUAAUU CUGAUGAGGCCGUUAGGCCGAA ACGAGUAG | 9640 |
| 1419 | UACUCGUUA AUUAUCAA | 222 | UUGAUAAU CUGAUGAGGCCGUUAGGCCGAA AACGAGUA | 9641 |
| 1422 | UCGUUAAUU AUCAAGGA | 223 | UCCUUGAU CUGAUGAGGCCGUUAGGCCGAA AUUAACGA | 9642 |
| 1423 | CGUUAAUUA UCAAGGAC | 224 | GUCCUUGA CUGAUGAGGCCGUUAGGCCGAA AAUUAACG | 9643 |
| 1425 | UUAAUUAUC AAGGACGU | 225 | ACGUCCUU CUGAUGAGGCCGUUAGGCCGAA AUAAUUAA | 9644 |
| 1434 | AAGGACGUA ACUGAAGA | 226 | UCUUCAGU CUGAUGAGGCCGUUAGGCCGAA ACGUCCUU | 9645 |
| 1456 | CAGGGAAUU AUACAAUC | 227 | GAUUGUAU CUGAUGAGGCCGUUAGGCCGAA AUUCCCUG | 9646 |
| 1457 | AGGGAAUUA UACAAUCU | 228 | AGAUUGUA CUGAUGAGGCCGUUAGGCCGAA AAUUCCCU | 9647 |
| 1459 | GGAAUUAUA CAAUCUUG | 229 | CAAGAUUG CUGAUGAGGCCGUUAGGCCGAA AUAAUUCC | 9648 |
| 1464 | UAUACAAUC UUGCUGAG | 230 | CUCAGCAA CUGAUGAGGCCGUUAGGCCGAA AUUGUAUA | 9649 |
| 1466 | UACAAUCUU GCUGAGCA | 231 | UGCUCAGC CUGAUGAGGCCGUUAGGCCGAA AGAUUGUA | 9650 |
| 1476 | CUGAGCAUA AACAGUC | 232 | GACUGUUU CUGAUGAGGCCGUUAGGCCGAA AUGCUCAG | 9651 |
| 1484 | AAACAGUC AAAUGUGU | 233 | ACACAUUU CUGAUGAGGCCGUUAGGCCGAA ACUGUUUU | 9652 |
| 1493 | AAAUGUGUU UAAAAACC | 234 | GGUUUUUA CUGAUGAGGCCGUUAGGCCGAA ACACAUUU | 9653 |
| 1494 | AAUGUGUUU AAAACCU | 235 | AGGUUUUU CUGAUGAGGCCGUUAGGCCGAA AACACAUU | 9654 |
| 1495 | AUGUGUUUA AAACCUC | 236 | GAGGUUUU CUGAUGAGGCCGUUAGGCCGAA AAACACAU | 9655 |
| 1503 | AAAAACCUC ACUGCCAC | 237 | GUGGCAGU CUGAUGAGGCCGUUAGGCCGAA AGGUUUUU | 9656 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 1513 | CUGCCACUC UAAUUGUC | 238 | GACAAUUA CUGAUGAGGCCGUUAGGCCGAA AGUGGCAG | 9657 |
| 1515 | GCCACUCUA AUUGUCAA | 239 | UUGACAAU CUGAUGAGGCCGUUAGGCCGAA AGAGUGGC | 9658 |
| 1518 | ACUCUAAUU GUCAAUGU | 240 | ACAUUGAC CUGAUGAGGCCGUUAGGCCGAA AUUAGAGU | 9659 |
| 1521 | CUAAUUGUC AAUGUGAA | 241 | UUCACAUU CUGAUGAGGCCGUUAGGCCGAA ACAAUUAG | 9660 |
| 1539 | CCCCAGAUU UACGAAAA | 242 | UUUUCGUA CUGAUGAGGCCGUUAGGCCGAA AUCUGGGG | 9661 |
| 1540 | CCCAGAUUU ACGAAAAG | 243 | CUUUUCGU CUGAUGAGGCCGUUAGGCCGAA AAUCUGGG | 9662 |
| 1541 | CCAGAUUUA CGAAAAGG | 244 | CCUUUUCG CUGAUGAGGCCGUUAGGCCGAA AAAUCUGG | 9663 |
| 1556 | GGCCGUGUC AUCGUUUC | 245 | GAAACGAU CUGAUGAGGCCGUUAGGCCGAA ACACGGCC | 9664 |
| 1559 | CGUGUCAUC GUUUCCAG | 246 | CUGGAAAC CUGAUGAGGCCGUUAGGCCGAA AUGACACG | 9665 |
| 1562 | GUCAUCGUU UCCAGACC | 247 | GGUCUGGA CUGAUGAGGCCGUUAGGCCGAA ACGAUGAC | 9666 |
| 1563 | UCAUCGUUU CCAGACCC | 248 | GGGUCUGG CUGAUGAGGCCGUUAGGCCGAA AACGAUGA | 9667 |
| 1564 | CAUCGUUUC CAGACCCG | 249 | CGGGUCUG CUGAUGAGGCCGUUAGGCCGAA AAACGAUG | 9668 |
| 1576 | ACCCGGCUC UCUACCCA | 250 | UGGGUAGA CUGAUGAGGCCGUUAGGCCGAA AGCCGGGU | 9669 |
| 1578 | CCGGCUCUC UACCCACU | 251 | AGUGGGUA CUGAUGAGGCCGUUAGGCCGAA AGAGCCGG | 9670 |
| 1580 | GGCUCUCUA CCCACUGG | 252 | CCAGUGGG CUGAUGAGGCCGUUAGGCCGAA AGAGAGCC | 9671 |
| 1602 | AGACAAAUC UGACUUG | 253 | CAAGUCAG CUGAUGAGGCCGUUAGGCCGAA AUUUGUCU | 9672 |
| 1609 | UCCUGACUU GUACCGCA | 254 | UGCGGUAC CUGAUGAGGCCGUUAGGCCGAA AGUCAGGA | 9673 |
| 1612 | UGACUUGUA CCGCAUAU | 255 | AUAUGCGG CUGAUGAGGCCGUUAGGCCGAA ACAAGUCA | 9674 |
| 1619 | UACCGCAUA UGGUAUCC | 256 | GGAUACCA CUGAUGAGGCCGUUAGGCCGAA AUGCGGUA | 9675 |
| 1624 | CAUAUGGUA UCCCUCAA | 257 | UUGAGGGA CUGAUGAGGCCGUUAGGCCGAA ACCAUAUG | 9676 |
| 1626 | UAUGGUAUC CCUCAACC | 258 | GGUUGAGG CUGAUGAGGCCGUUAGGCCGAA AUACCAUA | 9677 |
| 1630 | GUAUCCCUC AACCUACA | 259 | UGUAGGUU CUGAUGAGGCCGUUAGGCCGAA AGGGAUAC | 9678 |
| 1636 | CUCAACCUA CAAUCAAG | 260 | CUUGAUUG CUGAUGAGGCCGUUAGGCCGAA AGGUUGAG | 9679 |
| 1641 | CCUACAAUC AAGUGGUU | 261 | AACCACUU CUGAUGAGGCCGUUAGGCCGAA AUUGUAGG | 9680 |
| 1649 | CAAGUGGUU CUGGCACC | 262 | GGUGCCAG CUGAUGAGGCCGUUAGGCCGAA ACCACUUG | 9681 |
| 1650 | AAGUGGUUC UGGCACCC | 263 | GGGUGCCA CUGAUGAGGCCGUUAGGCCGAA AACCACUU | 9682 |
| 1663 | ACCCCUGUA ACC5AUAAU | 264 | AUUAUGGU CUGAUGAGGCCGUUAGGCCGAA ACAGGGGU | 9683 |
| 1669 | GUAACCAUA AUCAUUCC | 265 | GGAAUGAU CUGAUGAGGCCGUUAGGCCGAA AUGGUUAC | 9684 |
| 1672 | ACCAUAAUC AUUCCGAA | 266 | UUCGGAAU CUGAUGAGGCCGUUAGGCCGAA AUUAUGGU | 9685 |
| 1675 | AUAAUCAUU CCGAAGCA | 267 | UGCUUCGG CUGAUGAGGCCGUUAGGCCGAA AUGAUUAU | 9686 |
| 1676 | UAAUCAUUC CGAAGCAA | 268 | UUGCUUCG CUGAUGAGGCCGUUAGGCCGAA AAUGAUUA | 9687 |
| 1694 | GUGUGACUU UGUUCCA | 269 | UGGAACAA CUGAUGAGGCCGUUAGGCCGAA AGUCACAC | 9688 |
| 1695 | UGUGACUUU GUUCCAA | 270 | UUGGAACA CUGAUGAGGCCGUUAGGCCGAA AAGUCACA | 9689 |
| 1696 | GUGACUUUU GUUCCAAU | 271 | AUUGGAAC CUGAUGAGGCCGUUAGGCCGAA AAAGUCAC | 9690 |
| 1699 | ACUUUGUU CCAUAAU | 272 | AUUAUGG CUGAUGAGGCCGUUAGGCCGAA ACAAAGU | 9691 |
| 1700 | CUUUUGUUC CAAUAAUG | 273 | CAUUAUUG CUGAUGAGGCCGUUAGGCCGAA AACAAAAG | 9692 |
| 1705 | GUUCCAAUA AUGAAGAG | 274 | CUCUUCAU CUGAUGAGGCCGUUAGGCCGAA AUUGGAAC | 9693 |

TABLE II-continued

Human flt1 VEGF Receptor-Hammerhead Ribozyme and Substrate Sequence

| Pos | Substrate | Seq ID No | HH Ribozyme | Seq ID No |
|-----|-----------|-----------|-------------|-----------|
| 1715 | UGAAGAGUC CUUUAUCC | 275 | GGAUAAAG CUGAUGAGGCCGUUAGGCCGAA ACUCUUCA | 9694 |
| 1718 | AGAGUCCUU UAUCCUGG | 276 | CCAGGAUA CUGAUGAGGCCGUUAGGCCGAA AGGACUCU | 9695 |
| 1719 | GAGUCCUUU AUCCUGGA | 277 | UCCAGGAU CUGAUGAGGCCGUUAGGCCGAA AAGGACUC | 9696 |
| 1720 | AGUCCUUUA UCCUGGAU | 278 | AUCCAGGA CUGAUGAGGCCGUUAGGCCGAA AAAGGACU | 9697 |
| 1722 | UCCUUUAUC CUGGAUGC | 279 | GCAUCCAG CUGAUGAGGCCGUUAGGCCGAA AUAAAGGA | 9698 |
| 1755 | AACAGAAUU GAGAGCAU | 280 | AUGCUCUC CUGAUGAGGCCGUUAGGCCGAA AUUCUGUU | 9699 |
| 1764 | GAGAGCAUC ACUCAGCG | 281 | CGCUGAGU CUGAUGAGGCCGUUAGGCCGAA AUGCUCUC | 9700 |
| 1768 | GCAUCACUC AGCGCAUG | 282 | CAUGCGCU CUGAUGAGGCCGUUAGGCCGAA AGUGAUGC | 9701 |
| 1782 | AUGGCAAUA AUAGAAGG | 283 | CCUUCUAU CUGAUGAGGCCGUUAGGCCGAA AUUGCCAU | 9702 |
| 1785 | GCAAUAAUA GAAGGAAA | 284 | UUUCCUUC CUGAUGAGGCCGUUAGGCCGAA AUUAUUGC | 9703 |
| 1798 | GAAAGAAUA AGAUGGCU | 285 | AGCCAUCU CUGAUGAGGCCGUUAGGCCGAA AUUCUUUC | 9704 |
| 1807 | AGAUGGCUA GCACCUUG | 286 | CAAGGUGC CUGAUGAGGCCGUUAGGCCGAA AGCCAUCU | 9705 |
| 1814 | UAGCACCUU GGUUGUGG | 287 | CCACAACC CUGAUGAGGCCGUUAGGCCGAA AGGUGCUA | 9706 |
| 1818 | ACCUUGGUU GUGGCUGA | 288 | UCAGCCAC CUGAUGAGGCCGUUAGGCCGAA ACCAAGGU | 9707 |
| 1829 | GGCUGACUC UAGAAUUU | 289 | AAAUUCUA CUGAUGAGGCCGUUAGGCCGAA AGUCAGCC | 9708 |
| 1831 | CUGACUCUA GAAUUUCU | 290 | AGAAAUUC CUGAUGAGGCCGUUAGGCCGAA AGAGUCAG | 9709 |
| 1836 | UCUAGAAUU UCUGGAAU | 291 | AUUCCAGA CUGAUGAGGCCGUUAGGCCGAA AUUCUAGA | 9710 |
| 1837 | CUAGAAUUU CUGGAAUC | 292 | GAUUCCAG CUGAUGAGGCCGUUAGGCCGAA AAUUCUAG | 9711 |
| 1838 | UAGAAUUUC UGGAAUCU | 293 | AGAUUCCA CUGAUGAGGCCGUUAGGCCGAA AAAUUCUA | 9712 |
| 1845 | UCUGGAAUC UACAUUUG | 294 | CAAAUGUA CUGAUGAGGCCGUUAGGCCGAA AUUCCAGA | 9713 |
| 1847 | UGGAAUCUA CAUUUGCA | 295 | UGCAAAUG CUGAUGAGGCCGUUAGGCCGAA AGAUUCCA | 9714 |
| 1851 | AUCUACAUU UGCAUAGC | 296 | GCUAUGCA CUGAUGAGGCCGUUAGGCCGAA AUGUAGAU | 9715 |
| 1852 | UCUACAUUU GCAUAGCU | 297 | AGCUAUGC CUGAUGAGGCCGUUAGGCCGAA AAUGUAGA | 9716 |
| 1857 | AUUUGCAUA GCUUCCAA | 298 | UUGGAAGC CUGAUGAGGCCGUUAGGCCGAA AUGCAAAU | 9717 |
| 1861 | GCAUAGCUU CCAAUAAA | 299 | UUUAUUGG CUGAUGAGGCCGUUAGGCCGAA AGCUAUGC | 9718 |
| 1862 | CAUAGCUUC CAAUAAAG | 300 | CUUUAUUG CUGAUGAGGCCGUUAGGCCGAA AAGCUAUG | 9719 |
| 1867 | CUUCCAAUA AGUUGGG | 301 | CCCAACUU CUGAUGAGGCCGUUAGGCCGAA AUUGGAAG | 9720 |
| 1872 | AAUAAGUU GGGACUGU | 302 | ACAGUCCC CUGAUGAGGCCGUUAGGCCGAA ACUUUAUU | 9721 |
| 1893 | AGAAACAUA AGCUUUUA | 303 | UAAAAGCU CUGAUGAGGCCGUUAGGCCGAA AUGUUUCU | 9722 |
| 1898 | CAUAAGCUU UUAUAUCA | 304 | UGAUAUAA CUGAUGAGGCCGUUAGGCCGAA AGCUUAUG | 9723 |
| 1899 | AUAAGCUUU UAUAUCAC | 305 | GUGAUAUA CUGAUGAGGCCGUUAGGCCGAA AAGCUUAU | 9724 |
| 1900 | UAAGCUUUU AUAUCACA | 306 | UGUGAUAU CUGAUGAGGCCGUUAGGCCGAA AAAGCUUA | 9725 |
| 1901 | AAGCUUUUA UAUCACAG | 307 | CUGUGAUA CUGAUGAGGCCGUUAGGCCGAA AAAAGCUU | 9726 |
| 1903 | GCUUUUAUA UCACAGAU | 308 | AUCUGUGA CUGAUGAGGCCGUUAGGCCGAA AUAAAAGC | 9727 |
| 1905 | UUUUAUAUC ACAGAUGU | 309 | ACAUCUGU CUGAUGAGGCCGUUAGGCCGAA AUAUAAAA | 9728 |
| 1925 | AAAUGGGUU UCAUGUUA | 310 | UAACAUGA CUGAUGAGGCCGUUAGGCCGAA ACCCAUUU | 9729 |
| 1926 | AAUGGGUUU CAUGUUAA | 311 | UUAACAUG CUGAUGAGGCCGUUAGGCCGAA AACCCAUU | 9730 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 1927 | AUGGGUUUC AUGUUAAC | 312 | GUUAACAU CUGAUGAGGCCGUUAGGCCGAA AAACCCAU | 9731 |
| 1932 | UUUCAUGUU AACUUGGA | 313 | UCCAAGUU CUGAUGAGGCCGUUAGGCCGAA ACAUGAAA | 9732 |
| 1933 | UUCAUGUUA ACUUGGAA | 314 | UUCCAAGU CUGAUGAGGCCGUUAGGCCGAA AACAUGAA | 9733 |
| 1937 | UGUUAACUU GGAAAAAA | 315 | UUUUUUCC CUGAUGAGGCCGUUAGGCCGAA AGUUAACA | 9734 |
| 1976 | GAAACUGUC UUGCACAG | 316 | CUGUGCAA CUGAUGAGGCCGUUAGGCCGAA ACAGUUUC | 9735 |
| 1978 | AACUGUCUU GCACAGUU | 317 | AACUGUGC CUGAUGAGGCCGUUAGGCCGAA AGACAGUU | 9736 |
| 1986 | UGCACAGUU AACAAGUU | 318 | AACUUGUU CUGAUGAGGCCGUUAGGCCGAA ACUGUGCA | 9737 |
| 1987 | GCACAGUUA ACAAGUUC | 319 | GAACUUGU CUGAUGAGGCCGUUAGGCCGAA AACUGUGC | 9738 |
| 1994 | UAACAAGUU CUUAUACA | 320 | UGUAUAAG CUGAUGAGGCCGUUAGGCCGAA ACUUGUUA | 9739 |
| 1995 | AACAAGUUC UUAUACAG | 321 | CUGUAUAA CUGAUGAGGCCGUUAGGCCGAA AACUUGUU | 9740 |
| 1997 | CAAGUUCUU AUACAGAG | 322 | CUCUGUAU CUGAUGAGGCCGUUAGGCCGAA AGAACUUG | 9741 |
| 1998 | AAGUUCUUA UACAGAGA | 323 | UCUCUGUA CUGAUGAGGCCGUUAGGCCGAA AAGAACUU | 9742 |
| 2000 | GUUCUUAUA CAGAGACG | 324 | CGUCUCUG CUGAUGAGGCCGUUAGGCCGAA AUAAGAAC | 9743 |
| 2010 | AGAGACGUU ACUUGGAU | 325 | AUCCAAGU CUGAUGAGGCCGUUAGGCCGAA ACGUCUCU | 9744 |
| 2011 | GAGACGUUA CUUGGAUU | 326 | AAUCCAAG CUGAUGAGGCCGUUAGGCCGAA AACGUCUC | 9745 |
| 2014 | ACGUUACUU GGAUUUUA | 327 | UAAAAUCC CUGAUGAGGCCGUUAGGCCGAA AGUAACGU | 9746 |
| 2019 | ACUUGGAUU UUACUGCG | 328 | CGCAGUAA CUGAUGAGGCCGUUAGGCCGAA AUCCAAGU | 9747 |
| 2020 | CUUGGAUUU UACUGCGG | 329 | CCGCAGUA CUGAUGAGGCCGUUAGGCCGAA AAUCCAAG | 9748 |
| 2021 | UUGGAUUUU ACUGCGGA | 330 | UCCGCAGU CUGAUGAGGCCGUUAGGCCGAA AAAUCCAA | 9749 |
| 2022 | UGGAUUUUA CUGCGGAC | 331 | GUCCGCAG CUGAUGAGGCCGUUAGGCCGAA AAAAUCCA | 9750 |
| 2034 | CGGACAGUU AAUAACAG | 332 | CUGUUAUU CUGAUGAGGCCGUUAGGCCGAA ACUGUCCG | 9751 |
| 2035 | GGACAGUUA AUAACAGA | 333 | UCUGUUAU CUGAUGAGGCCGUUAGGCCGAA AACUGUCC | 9752 |
| 2038 | CAGUUAAUA ACAGAACA | 334 | UGUUCUGU CUGAUGAGGCCGUUAGGCCGAA AUUAACUG | 9753 |
| 2054 | AAUGCACUA CAGUAUUA | 335 | UAAUACUG CUGAUGAGGCCGUUAGGCCGAA AGUGCAUU | 9754 |
| 2059 | ACUACAGUA UUAGCAAG | 336 | CUUGCUAA CUGAUGAGGCCGUUAGGCCGAA ACUGUAGU | 9755 |
| 2061 | UACAGUAUU AGCAAGCA | 337 | UGCUUGCU CUGAUGAGGCCGUUAGGCCGAA AUACUGUA | 9756 |
| 2062 | ACAGUAUUA GCAAGCAA | 338 | UUGCUUGC CUGAUGAGGCCGUUAGGCCGAA AAUACUGU | 9757 |
| 2082 | AUGGCCAUC ACUAAGGA | 339 | UCCUUAGU CUGAUGAGGCCGUUAGGCCGAA AUGGCCAU | 9758 |
| 2086 | CCAUCACUA AGGAGCAC | 340 | GUGCUCCU CUGAUGAGGCCGUUAGGCCGAA AGUGAUGG | 9759 |
| 2096 | GGAGCACUC CAUCACUC | 341 | GAGUGAUG CUGAUGAGGCCGUUAGGCCGAA AGUGCUCC | 9760 |
| 2100 | CACUCCAUC ACUCUUAA | 342 | UUAAGAGU CUGAUGAGGCCGUUAGGCCGAA AUGGAGUG | 9761 |
| 2104 | CCAUCACUC UUAAUCUU | 343 | AAGAUUAA CUGAUGAGGCCGUUAGGCCGAA AGUGAUGG | 9762 |
| 2106 | AUCACUCUU AAUCUUAC | 344 | GUAAGAUU CUGAUGAGGCCGUUAGGCCGAA AGAGUGAU | 9763 |
| 2107 | UCACUCUUA AUCUUACC | 345 | GGUAAGAU CUGAUGAGGCCGUUAGGCCGAA AAGAGUGA | 9764 |
| 2110 | CUCUUAAUC UUACCAUC | 346 | GAUGGUAA CUGAUGAGGCCGUUAGGCCGAA AUUAAGAG | 9765 |
| 2112 | CUUAAUCUU ACCAUCAU | 347 | AUGAUGGU CUGAUGAGGCCGUUAGGCCGAA AGAUUAAG | 9766 |
| 2113 | UUAAUCUUA CCAUCAUG | 348 | CAUGAUGG CUGAUGAGGCCGUUAGGCCGAA AAGAUUAA | 9767 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 2118 | CUUACCAUC AUGAAUGU | 349 | ACAUUCAU CUGAUGAGGCCGUUAGGCCGAA AUGGUAAG | 9768 |
| 2127 | AUGAAUGUU UCCCUGCA | 350 | UGCAGGGA CUGAUGAGGCCGUUAGGCCGAA ACAUUCAU | 9769 |
| 2128 | UGAAUGUUU CCCUGCAA | 351 | UUGCAGGG CUGAUGAGGCCGUUAGGCCGAA AACAUUCA | 9770 |
| 2129 | GAAUGUUUC CCUGCAAG | 352 | CUUGCAGG CUGAUGAGGCCGUUAGGCCGAA AAACAUUC | 9771 |
| 2140 | UGCAAGAUU CAGGCACC | 353 | GGUGCCUG CUGAUGAGGCCGUUAGGCCGAA AUCUUGCA | 9772 |
| 2141 | GCAAGAUUC AGGCACCU | 354 | AGGUGCCU CUGAUGAGGCCGUUAGGCCGAA AAUCUUGC | 9773 |
| 2150 | AGGCACCUA UGCCUGCA | 355 | UGCAGGCA CUGAUGAGGCCGUUAGGCCGAA AGGUGCCU | 9774 |
| 2172 | AGGAAUGUA UACACAGG | 356 | CCUGUGUA CUGAUGAGGCCGUUAGGCCGAA ACAUUCCU | 9775 |
| 2174 | GAAUGUAUA CACAGGGG | 357 | CCCCUGUG CUGAUGAGGCCGUUAGGCCGAA AUACAUUC | 9776 |
| 2190 | GAAGAAAUC UCCAGAA | 358 | UUCUGGAG CUGAUGAGGCCGUUAGGCCGAA AUUUCUUC | 9777 |
| 2193 | GAAAUCCUC CAGAAGAA | 359 | UUCUUCUG CUGAUGAGGCCGUUAGGCCGAA AGGAUUUC | 9778 |
| 2208 | AAAGAAAUU ACAAUCAG | 360 | CUGAUUGU CUGAUGAGGCCGUUAGGCCGAA AUUUCUUU | 9779 |
| 2209 | AAGAAAUUA CAAUCAGA | 361 | UCUGAUUG CUGAUGAGGCCGUUAGGCCGAA AAUUUCUU | 9780 |
| 2214 | AUUACAAUC AGAGAUCA | 362 | UGAUCUCU CUGAUGAGGCCGUUAGGCCGAA AUUGUAAU | 9781 |
| 2221 | UCAGAGAUC AGGAAGCA | 363 | UGCUUCCU CUGAUGAGGCCGUUAGGCCGAA AUCUCUGA | 9782 |
| 2234 | AGCACCAUA CCUCCUGC | 364 | GCAGGAGG CUGAUGAGGCCGUUAGGCCGAA AUGGUGCU | 9783 |
| 2238 | CCAUACCUC UGCGAAA | 365 | UUUCGCAG CUGAUGAGGCCGUUAGGCCGAA AGGUAUGG | 9784 |
| 2250 | CGAAACCUC AGUGAUCA | 366 | UGAUCACU CUGAUGAGGCCGUUAGGCCGAA AGGUUUCG | 9785 |
| 2257 | UCAGUGAUC ACACAGUG | 367 | CACUGUGU CUGAUGAGGCCGUUAGGCCGAA AUCACUGA | 9786 |
| 2271 | GUGGCCAUC AGCAGUUC | 368 | GAACUGCU CUGAUGAGGCCGUUAGGCCGAA AUGGCCAC | 9787 |
| 2278 | UCAGCAGUU CCACCACU | 369 | AGUGGUGG CUGAUGAGGCCGUUAGGCCGAA ACUGCUGA | 9788 |
| 2279 | CAGCAGUUC CACCACUU | 370 | AAGUGGUG CUGAUGAGGCCGUUAGGCCGAA AACUGCUG | 9789 |
| 2287 | CCACCACUU UAGACUGU | 371 | ACAGUCUA CUGAUGAGGCCGUUAGGCCGAA AGUGGUGG | 9790 |
| 2288 | CACCACUUU AGACUGUC | 372 | GACAGUCU CUGAUGAGGCCGUUAGGCCGAA AAGUGGUG | 9791 |
| 2289 | ACCACUUUA GACUGUCA | 373 | UGACAGUC CUGAUGAGGCCGUUAGGCCGAA AAAGUGGU | 9792 |
| 2296 | UAGACUGUC AUGCUAAU | 374 | AUUAGCAU CUGAUGAGGCCGUUAGGCCGAA ACAGUCUA | 9793 |
| 2302 | GUCAUGCUA AUGGUGUC | 375 | GACACCAU CUGAUGAGGCCGUUAGGCCGAA AGCAUGAC | 9794 |
| 2310 | AAUGGUGUC CCCGAGCC | 376 | GGCUCGGG CUGAUGAGGCCGUUAGGCCGAA ACACCAUU | 9795 |
| 2320 | CCGAGCCUC AGAUCACU | 377 | AGUGAUCU CUGAUGAGGCCGUUAGGCCGAA AGGCUCGG | 9796 |
| 2325 | CCUCAGAUC ACUUGGUU | 378 | AACCAAGU CUGAUGAGGCCGUUAGGCCGAA AUCUGAGG | 9797 |
| 2329 | AGAUCACUU GGUUUAAA | 379 | UUUAAACC CUGAUGAGGCCGUUAGGCCGAA AGUGAUCU | 9798 |
| 2333 | CACUUGGUU UAAAACA | 380 | UGUUUUUA CUGAUGAGGCCGUUAGGCCGAA ACCAAGUG | 9799 |
| 2334 | ACUUGGUUU AAAACAA | 381 | UUGUUUUU CUGAUGAGGCCGUUAGGCCGAA AACCAAGU | 9800 |
| 2335 | CUUGGUUUA AAACAAC | 382 | GUUGUUUU CUGAUGAGGCCGUUAGGCCGAA AAACCAAG | 9801 |
| 2352 | CACAAAAUA CAACAAGA | 383 | UCUUGUUG CUGAUGAGGCCGUUAGGCCGAA AUUUUGUG | 9802 |
| 2370 | CCUGGAAUU AUUUUAGG | 384 | CCUAAAAU CUGAUGAGGCCGUUAGGCCGAA AUUCCAGG | 9803 |
| 2371 | CUGGAAUUA UUUUAGGA | 385 | UCCUAAAA CUGAUGAGGCCGUUAGGCCGAA AAUUCCAG | 9804 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 2373 | GGAAUUAUU UUAGGACC | 386 | GGUCCUAA CUGAUGAGGCCGUUAGGCCGAA AUAAUUCC | 9805 |
| 2374 | GAAUUAUUU UAGGACCA | 387 | UGGUCCUA CUGAUGAGGCCGUUAGGCCGAA AAUAAUUC | 9806 |
| 2375 | AAUUAUUUU AGGACCAG | 388 | CUGGUCCU CUGAUGAGGCCGUUAGGCCGAA AAAUAAUU | 9807 |
| 2376 | AUUAUUUUA GGACCAGG | 389 | CCUGGUCC CUGAUGAGGCCGUUAGGCCGAA AAAAUAAU | 9808 |
| 2399 | CACGCUGUU UAUUGAAA | 390 | UUUCAAUA CUGAUGAGGCCGUUAGGCCGAA ACAGCGUG | 9809 |
| 2400 | ACGCUGUUU AUUGAAAG | 391 | CUUUCAAU CUGAUGAGGCCGUUAGGCCGAA AACAGCGU | 9810 |
| 2401 | CGCUGUUUA UUGAAAGA | 392 | UCUUUCAA CUGAUGAGGCCGUUAGGCCGAA AAACAGCG | 9811 |
| 2403 | CUGUUUAUU GAAAGAGU | 393 | ACUCUUUC CUGAUGAGGCCGUUAGGCCGAA AUAAACAG | 9812 |
| 2412 | GAAAGAGUC ACAGAAGA | 394 | UCUUCUGU CUGAUGAGGCCGUUAGGCCGAA ACUCUUUC | 9813 |
| 2433 | GAAGGUGUC UAUCACUG | 395 | CAGUGAUA CUGAUGAGGCCGUUAGGCCGAA ACACCUUC | 9814 |
| 2435 | AGGUGUCUA UCACUGCA | 396 | UGCAGUGA CUGAUGAGGCCGUUAGGCCGAA AGACACCU | 9815 |
| 2437 | GUGUCUAUC ACUGCAAA | 397 | UUUGCAGU CUGAUGAGGCCGUUAGGCCGAA AUAGACAC | 9816 |
| 2465 | GAAGGGCUC UGUGGAAA | 398 | UUUCCACA CUGAUGAGGCCGUUAGGCCGAA AGCCCUUC | 9817 |
| 2476 | UGGAAAGUU CAGCAUAC | 399 | GUAUGCUG CUGAUGAGGCCGUUAGGCCGAA ACUUUCCA | 9818 |
| 2477 | GGAAAGUUC AGCAUACC | 400 | GGUAUGCU CUGAUGAGGCCGUUAGGCCGAA AACUUUCC | 9819 |
| 2483 | UUCAGCAUA CCUCACUG | 401 | CAGUGAGG CUGAUGAGGCCGUUAGGCCGAA AUGCUGAA | 9820 |
| 2487 | GCAUACCUC ACUGUUCA | 402 | UGAACAGU CUGAUGAGGCCGUUAGGCCGAA AGGUAUGC | 9821 |
| 2493 | CUCACUGUU CAAGGAAC | 403 | GUUCCUUG CUGAUGAGGCCGUUAGGCCGAA ACAGUGAG | 9822 |
| 2494 | UCACUGUUC AAGGAACC | 404 | GGUUCCUU CUGAUGAGGCCGUUAGGCCGAA AACAGUGA | 9823 |
| 2504 | AGGAACCUC GGACAAGU | 405 | ACUUGUCC CUGAUGAGGCCGUUAGGCCGAA AGGUUCCU | 9824 |
| 2513 | GGACAAGUC UAAUCUGG | 406 | CCAGAUUA CUGAUGAGGCCGUUAGGCCGAA ACUUGUCC | 9825 |
| 2515 | ACAAGUCUA AUCUGGAG | 407 | CUCCAGAU CUGAUGAGGCCGUUAGGCCGAA AGACUUGU | 9826 |
| 2518 | AGUCUAAUC UGGAGCUG | 408 | CAGCUCCA CUGAUGAGGCCGUUAGGCCGAA AUUAGACU | 9827 |
| 2529 | GAGCUGAUC ACUCUAAC | 409 | GUUAGAGU CUGAUGAGGCCGUUAGGCCGAA AUCAGCUC | 9828 |
| 2533 | UGAUCACUC UAACAUGC | 410 | GCAUGUUA CUGAUGAGGCCGUUAGGCCGAA AGUGAUCA | 9829 |
| 2535 | AUCACUCUA ACAUGCAC | 411 | GUGCAUGU CUGAUGAGGCCGUUAGGCCGAA AGAGUGAU | 9830 |
| 2560 | CUGCGACUC UCUUCUGG | 412 | CCAGAAGA CUGAUGAGGCCGUUAGGCCGAA AGUCGCAG | 9831 |
| 2562 | GCGACUCUC UUCUGGCU | 413 | AGCCAGAA CUGAUGAGGCCGUUAGGCCGAA AGAGUCGC | 9832 |
| 2564 | GACUCUCUU CUGGCUCC | 414 | GGAGCCAG CUGAUGAGGCCGUUAGGCCGAA AGAGAGUC | 9833 |
| 2565 | ACUCUCUUC UGGCUCCU | 415 | AGGAGCCA CUGAUGAGGCCGUUAGGCCGAA AAGAGAGU | 9834 |
| 2571 | UUCUGGCUC CUAUUAAC | 416 | GUUAAUAG CUGAUGAGGCCGUUAGGCCGAA AGCCAGAA | 9835 |
| 2574 | UGGCUCCUA UUAACCCU | 417 | AGGGUUAA CUGAUGAGGCCGUUAGGCCGAA AGGAGCCA | 9836 |
| 2576 | GCUCCUAUU AACCCUCC | 418 | GGAGGGUU CUGAUGAGGCCGUUAGGCCGAA AUAGGAGC | 9837 |
| 2577 | CUCCUAUUA ACCCUCCU | 419 | AGGAGGGU CUGAUGAGGCCGUUAGGCCGAA AAUAGGAG | 9838 |
| 2583 | UUAACCCUC CUAUCCG | 420 | CGGAUAAG CUGAUGAGGCCGUUAGGCCGAA AGGGUUAA | 9839 |
| 2586 | ACCCUCCUU AUCCGAAA | 421 | UUUCGGAU CUGAUGAGGCCGUUAGGCCGAA AGGAGGGU | 9840 |
| 2587 | CCCUCCUUA UCCGAAAA | 422 | UUUUCGGA CUGAUGAGGCCGUUAGGCCGAA AAGGAGGG | 9841 |

TABLE II-continued

Human flt1 VEGF Receptor-Hammerhead Ribozyme and Substrate Sequence

| Pos | Substrate | Seq ID No | HH Ribozyme | Seq ID No |
|-----|-----------|-----------|-------------|-----------|
| 2589 | CUCCUUAUC CGAAAAAU | 423 | AUUUUUCG CUGAUGAGGCCGUUAGGCCGAA AUAAGGAG | 9842 |
| 2606 | GAAAAGGUC UUCUUCUG | 424 | CAGAAGAA CUGAUGAGGCCGUUAGGCCGAA ACCUUUUC | 9843 |
| 2608 | AAAGGUCUU CUUCUGAA | 425 | UUCAGAAG CUGAUGAGGCCGUUAGGCCGAA AGACCUUU | 9844 |
| 2809 | AAGGUCUUC UUCUGAAA | 426 | UUUCAGAA CUGAUGAGGCCGUUAGGCCGAA AAGACCUU | 9845 |
| 2611 | GGUCUUCUU CUGAAAUA | 427 | UAUUUCAG CUGAUGAGGCCGUUAGGCCGAA AGAAGACC | 9846 |
| 2612 | GUCUUCUUC UGAAAUAA | 428 | UUAUUUCA CUGAUGAGGCCGUUAGGCCGAA AAGAAGAC | 9847 |
| 2619 | UCUGAAAUA AAGACUGA | 429 | UCAGUCUU CUGAUGAGGCCGUUAGGCCGAA AUUUCAGA | 9848 |
| 2630 | GACUGACUA CCUAUCAA | 430 | UUGAUAGG CUGAUGAGGCCGUUAGGCCGAA AGUCAGUC | 9849 |
| 2634 | GACUACCUA UCAAUUAU | 431 | AUAAUUGA CUGAUGAGGCCGUUAGGCCGAA AGGUAGUC | 9850 |
| 2636 | CUACCUAUC AAUUAUAA | 432 | UUAUAAUU CUGAUGAGGCCGUUAGGCCGAA AUAGGUAG | 9851 |
| 2640 | CUAUCAAUU AUAAUGGA | 433 | UCCAUUAU CUGAUGAGGCCGUUAGGCCGAA AUUGAUAG | 9852 |
| 2641 | UAUCAAUUA UAAUGGAC | 434 | GUCCAUUA CUGAUGAGGCCGUUAGGCCGAA AAUUGAUA | 9853 |
| 2643 | UCAAUUAUA AUGGACCC | 435 | GGGUCCAU CUGAUGAGGCCGUUAGGCCGAA AUAAUUGA | 9854 |
| 2661 | GAUGAAGUU CCUUUGGA | 436 | UCCAAAGG CUGAUGAGGCCGUUAGGCCGAA ACUUCAUC | 9855 |
| 2662 | AUGAAGUUC CUUUGGAU | 437 | AUCCAAAG CUGAUGAGGCCGUUAGGCCGAA AACUUCAU | 9856 |
| 2665 | AAGUUCCUU UGGAUGAG | 438 | CUCAUCCA CUGAUGAGGCCGUUAGGCCGAA AGGAACUU | 9857 |
| 2666 | AGUUCCUUU GGAUGAGC | 439 | GCUCAUCC CUGAUGAGGCCGUUAGGCCGAA AAGGAACU | 9858 |
| 2688 | GAGCGGCUC CCUUAUGA | 440 | UCAUAAGG CUGAUGAGGCCGUUAGGCCGAA AGCCGCUC | 9859 |
| 2692 | GGCUCCCUU AUGAUGCC | 441 | GGCAUCAU CUGAUGAGGCCGUUAGGCCGAA AGGGAGCC | 9860 |
| 2693 | GCUCCCUUA UGAUGCCA | 442 | UGGCAUCA CUGAUGAGGCCGUUAGGCCGAA AAGGGAGC | 9861 |
| 2714 | GUGGGAGUU UGCCCGGG | 443 | CCCGGGCA CUGAUGAGGCCGUUAGGCCGAA ACUCCCAC | 9862 |
| 2715 | UGGGAGUUU GCCCGGGA | 444 | UCCCGGGC CUGAUGAGGCCGUUAGGCCGAA AACUCCCA | 9863 |
| 2730 | GAGAGACUU AAACUGGG | 445 | CCCAGUUU CUGAUGAGGCCGUUAGGCCGAA AGUCUCUC | 9864 |
| 2731 | AGAGACUUA AACUGGGC | 446 | GCCCAGUU CUGAUGAGGCCGUUAGGCCGAA AAGUCUCU | 9865 |
| 2744 | GGGCAAAUC ACUUGGAA | 447 | UUCCAAGU CUGAUGAGGCCGUUAGGCCGAA AUUUGCCC | 9866 |
| 2748 | AAAUCACUU GGAAGAGG | 448 | CCUCUUCC CUGAUGAGGCCGUUAGGCCGAA AGUGAUUU | 9867 |
| 2761 | GAGGGGCUU UUGGAAAA | 449 | UUUUCCAA CUGAUGAGGCCGUUAGGCCGAA AGCCCCUC | 9868 |
| 2762 | AGGGGCUUU UGGAAAAG | 450 | CUUUUCCA CUGAUGAGGCCGUUAGGCCGAA AAGCCCCU | 9869 |
| 2763 | GGGGCUUUU GGAAAAGU | 451 | ACUUUUCC CUGAUGAGGCCGUUAGGCCGAA AAAGCCCC | 9870 |
| 2775 | AAAGUGGUU CAAGCAUC | 452 | GAUGCUUG CUGAUGAGGCCGUUAGGCCGAA ACCACUUU | 9871 |
| 2776 | AGUGGUUC AAGCAUCA | 453 | UGAUGCUU CUGAUGAGGCCGUUAGGCCGAA AACCACUU | 9872 |
| 2783 | UCAAGCAUC AGCAUUUG | 454 | CAAAUGCU CUGAUGAGGCCGUUAGGCCGAA AUGCUUGA | 9873 |
| 2789 | AUCAGCAUU UGGCAUUA | 455 | UAAUGCCA CUGAUGAGGCCGUUAGGCCGAA AUGCUGAU | 9874 |
| 2790 | UCAGCAUUU GGCAUUAA | 456 | UUAAUGCC CUGAUGAGGCCGUUAGGCCGAA AAUGCUGA | 9875 |
| 2796 | UUUGGCAUU AAGAAAUC | 457 | GAUUUCUU CUGAUGAGGCCGUUAGGCCGAA AUGCCAAA | 9876 |
| 2797 | UUGGCAUUA AGAAAUCA | 458 | UGAUUUCU CUGAUGAGGCCGUUAGGCCGAA AAUGCCAA | 9877 |
| 2804 | UAAGAAAUC ACCUACGU | 459 | ACGUAGGU CUGAUGAGGCCGUUAGGCCGAA AUUUCUUA | 9878 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 2809 | AAUCACCUA CGUGCCGG | 460 | CCGGCACG CUGAUGAGGCCGUUAGGCCGAA AGGUCAUU | 9879 |
| 2864 | CAGCGAGUA CAAAGCUC | 461 | GAGCUUUG CUGAUGAGGCCGUUAGGCCGAA ACUCGCUG | 9880 |
| 2872 | ACAAAGCUC UGAUGACU | 462 | AGUCAUCA CUGAUGAGGCCGUUAGGCCGAA AGCUUUGU | 9881 |
| 2886 | ACUGAGCUA AAAAUCUU | 463 | AAGAUUUU CUGAUGAGGCCGUUAGGCCGAA AGCUCAGU | 9882 |
| 2892 | CUAAAAAUC UUGACCCA | 464 | UGGGUCAA CUGAUGAGGCCGUUAGGCCGAA AUUUUUAG | 9883 |
| 2894 | AAAAAUCUU GACCCACA | 465 | UGUGGGUC CUGAUGAGGCCGUUAGGCCGAA AGAUUUUU | 9884 |
| 2904 | ACCCACAUU GGCCACCA | 466 | UGGUGGCC CUGAUGAGGCCGUUAGGCCGAA AUGUGGGU | 9885 |
| 2914 | GCCACCAUC UGAACGUG | 467 | CACGUUCA CUGAUGAGGCCGUUAGGCCGAA AUGGUGGC | 9886 |
| 2925 | AACGUGGUU AACCUGCU | 468 | AGCAGGUU CUGAUGAGGCCGUUAGGCCGAA ACCACGUU | 9887 |
| 2926 | ACGUGGUUA ACCUGCUG | 469 | CAGCAGGU CUGAUGAGGCCGUUAGGCCGAA AACCACGU | 9888 |
| 2962 | GAGGGCCUC UGAUGGUG | 470 | CACCAUCA CUGAUGAGGCCGUUAGGCCGAA AGGCCCUC | 9889 |
| 2973 | AUGGUGAUU GUUGAAUA | 471 | UAUUCAAC CUGAUGAGGCCGUUAGGCCGAA AUCACCAU | 9890 |
| 2976 | GUGAUUGUU GAAUACUG | 472 | CAGUAUUC CUGAUGAGGCCGUUAGGCCGAA ACAAUCAC | 9891 |
| 2981 | UGUUGAAUA CUGCAAAU | 473 | AUUUGCAG CUGAUGAGGCCGUUAGGCCGAA AUUCAACA | 9892 |
| 2990 | CUGCAAAUA UGGAAAUC | 474 | GAUUUCCA CUGAUGAGGCCGUUAGGCCGAA AUUUGCAG | 9893 |
| 2998 | AUGGAAAUC UCUCCAAC | 475 | GUUGGAGA CUGAUGAGGCCGUUAGGCCGAA AUUUCCAU | 9894 |
| 3000 | GGAAAUCUC UCCAACUA | 476 | UAGUUGGA CUGAUGAGGCCGUUAGGCCGAA AGAUUUCC | 9895 |
| 3002 | AAAUCUCUC CAACUACC | 477 | GGUAGUUG CUGAUGAGGCCGUUAGGCCGAA AGAGAUUU | 9896 |
| 3008 | CUCCAACUA CCUCAAGA | 478 | UCUUGAGG CUGAUGAGGCCGUUAGGCCGAA AGUUGGAG | 9897 |
| 3012 | AACUACCUC AAGAGCAA | 479 | UUGCUCUU CUGAUGAGGCCGUUAGGCCGAA AGGUAGUU | 9898 |
| 3029 | ACGUGACUU AUUUUUUC | 480 | GAAAAAAU CUGAUGAGGCCGUUAGGCCGAA AGUCACGU | 9899 |
| 3030 | CGUGACUUA UUUUUUCU | 481 | AGAAAAAA CUGAUGAGGCCGUUAGGCCGAA AAGUCACG | 9900 |
| 3032 | UGACUUAUU UUUUCUCA | 482 | UGAGAAAA CUGAUGAGGCCGUUAGGCCGAA AUAAGUCA | 9901 |
| 3033 | GACUUAUUU UUUCUCAA | 483 | UUGAGAAA CUGAUGAGGCCGUUAGGCCGAA AAUAAGUC | 9902 |
| 3034 | ACUUAUUUU UUCUCAAC | 484 | GUUGAGAA CUGAUGAGGCCGUUAGGCCGAA AAAUAAGU | 9903 |
| 3035 | CUUAUUUUU UCUCAACA | 485 | UGUUGAGA CUGAUGAGGCCGUUAGGCCGAA AAAAUAAG | 9904 |
| 3036 | UUAUUUUUU CUCAACAA | 486 | UUGUUGAG CUGAUGAGGCCGUUAGGCCGAA AAAAAUAA | 9905 |
| 3037 | UAUUUUUUC UCAACAAG | 487 | CUUGUUGA CUGAUGAGGCCGUUAGGCCGAA AAAAAAUA | 9906 |
| 3039 | UUUUUUCUC AACAAGGA | 488 | UCCUUGUU CUGAUGAGGCCGUUAGGCCGAA AGAAAAAA | 9907 |
| 3057 | GCAGCACUA CACAUGGA | 489 | UCCAUGUG CUGAUGAGGCCGUUAGGCCGAA AGUGCUGC | 9908 |
| 3070 | UGGAGCCUA AGAAAGAA | 490 | UUCUUUCU CUGAUGAGGCCGUUAGGCCGAA AGGCUCCA | 9909 |
| 3120 | CCAAGACUA GAUAGCGU | 491 | ACGCUAUC CUGAUGAGGCCGUUAGGCCGAA AGUCUUGG | 9910 |
| 3124 | GACUAGAUA GCGUCACC | 492 | GGUGACGC CUGAUGAGGCCGUUAGGCCGAA AUCUAGUC | 9911 |
| 3129 | GAUAGCGUC ACCAGCAG | 493 | CUGCUGGU CUGAUGAGGCCGUUAGGCCGAA ACGCUAUC | 9912 |
| 3146 | CGAAAGCUU UGCGAGCU | 494 | AGCUCGCA CUGAUGAGGCCGUUAGGCCGAA AGCUUUCG | 9913 |
| 3147 | GAAAGCUUU GCGAGCUC | 495 | GAGCUCGC CUGAUGAGGCCGUUAGGCCGAA AAGCUUUC | 9914 |
| 3155 | UGCGAGCUC CGGCUUUC | 496 | GAAAGCCG CUGAUGAGGCCGUUAGGCCGAA AGCUCGCA | 9915 |

TABLE II-continued

Human flt1 VEGF Receptor—Hammerhead Ribozyme and Substrate Sequence

| Pos | Substrate | Seq ID No | HH Ribozyme | Seq ID No |
|---|---|---|---|---|
| 3161 | CUCCGGCUU UCAGGAAG | 497 | CUUCCUGA CUGAUGAGGCCGUUAGGCCGAA AGCCGGAG | 9916 |
| 3162 | UCCGGCUUU CAGGAAGA | 498 | UCUUCCUG CUGAUGAGGCCGUUAGGCCGAA AAGCCGGA | 9917 |
| 3163 | CCGGCUUUC AGGAAGAU | 499 | AUCUUCCU CUGAUGAGGCCGUUAGGCCGAA AAAGCCGG | 9918 |
| 3172 | AGGAAGAUA AAAGUCUG | 500 | CAGACUUU CUGAUGAGGCCGUUAGGCCGAA AUCUUCCU | 9919 |
| 3178 | AUAAAAGUC UGAGUGAG | 501 | AUCACUCA CUGAUGAGGCCGUUAGGCCGAA ACUUUUAU | 9920 |
| 3189 | AGUGAUGUU GAGGAAGA | 502 | UCUUCCUC CUGAUGAGGCCGUUAGGCCGAA ACAUCACU | 9921 |
| 3205 | AGGAGGAUU CUGACGGU | 503 | ACCGUCAG CUGAUGAGGCCGUUAGGCCGAA AUCCUCCU | 9922 |
| 3206 | GGAGGAUUC UGACGGUU | 504 | AACCGUCA CUGAUGAGGCCGUUAGGCCGAA AAUCCUCC | 9923 |
| 3214 | CUGACGGUU UCUACAAG | 505 | CUUGUAGA CUGAUGAGGCCGUUAGGCCGAA ACCGUCAG | 9924 |
| 3215 | UGACGGUUU CUACAAGG | 506 | CCUUGUAG CUGAUGAGGCCGUUAGGCCGAA AACCGUCA | 9925 |
| 3216 | GACGGUUUC UACAAGGA | 507 | UCCUGGUA CUGAUGAGGCCGUUAGGCCGAA AAACCGUC | 9926 |
| 3218 | CGGUUUCUA CAAGGAGC | 508 | GCUCCUUG CUGAUGAGGCCGUUAGGCCGAA AGAAACCG | 9927 |
| 3231 | GAGCCCAUC ACUAUGGA | 509 | UCCAUAGU CUGAUGAGGCCGUUAGGCCGAA AUGGGCUC | 9928 |
| 3235 | CCAUCACUA UGGAAGAU | 510 | AUCUUCCA CUGAUGAGGCCGUUAGGCCGAA AGUGAUGG | 9929 |
| 3244 | UGGAAGAUC UGAUUUCU | 511 | AGAAAUCA CUGAUGAGGCCGUUAGGCCGAA AUCUUCCA | 9930 |
| 3249 | GAUCUGAUU UCUUACAG | 512 | CUGUAAGA CUGAUGAGGCCGUUAGGCCGAA AUCAGAUC | 9931 |
| 3250 | AUCUGAUUU CUUACAGU | 513 | ACUGUAAG CUGAUGAGGCCGUUAGGCCGAA AAUCAGAU | 9932 |
| 3251 | UCUGAUUUC UUACAGUU | 514 | AACUGUAA CUGAUGAGGCCGUUAGGCCGAA AAAUCAGA | 9933 |
| 3253 | UGAUUUCUU ACAGUUUU | 515 | AAAACUGU CUGAUGAGGCCGUUAGGCCGAA AGAAAUCA | 9934 |
| 3254 | GAUUUCUUA CAGUUUUC | 516 | GAAAACUG CUGAUGAGGCCGUUAGGCCGAA AAGAAAUC | 9935 |
| 3259 | CUUACAGUU UUCAAGUG | 517 | CACUUGAA CUGAUGAGGCCGUUAGGCCGAA ACUGUAAG | 9936 |
| 3260 | UUACAGUUU UCAAGUGG | 518 | CCACUUGA CUGAUGAGGCCGUUAGGCCGAA AACUGUAA | 9937 |
| 3261 | UACAGUUUU CAAGUGGC | 519 | GCCACUUG CUGAUGAGGCCGUUAGGCCGAA AAACUGUA | 9938 |
| 3262 | ACAGUUUUC AAGUGGCC | 520 | GGCCACUU CUGAUGAGGCCGUUAGGCCGAA AAAACUGU | 9939 |
| 3284 | CAUGGAGUU CCUGUCUU | 521 | AAGACAGG CUGAUGAGGCCGUUAGGCCGAA ACUCCAUG | 9940 |
| 3285 | AUGGAGUUC CUGUCUUC | 522 | GAAGACAG CUGAUGAGGCCGUUAGGCCGAA AACUCCAU | 9941 |
| 3290 | GUUCCUGUC UUCCAGAA | 523 | UUCUGGAA CUGAUGAGGCCGUUAGGCCGAA ACAGGAAC | 9942 |
| 3292 | UCCUGUCUU CCAGAAAG | 524 | CUUUCUGG CUGAUGAGGCCGUUAGGCCGAA AGACAGGA | 9943 |
| 3293 | CCUGUCUUC CAGAAAGU | 525 | ACUUUCUG CUGAUGAGGCCGUUAGGCCGAA AAGACAGG | 9944 |
| 3306 | AAGUGCAUU CAUCGGGA | 526 | UCCCGAUG CUGAUGAGGCCGUUAGGCCGAA AUGCACUU | 9945 |
| 3307 | AGUGCAUUC AUCGGGAC | 527 | GUCCCGAU CUGAUGAGGCCGUUAGGCCGAA AAUGCACU | 9946 |
| 3310 | GCAUUCAUC GGGACCUG | 528 | CAGGUCCC CUGAUGAGGCCGUUAGGCCGAA AUGAAUGC | 9947 |
| 3333 | AGAAACAUU CUUUUAUC | 529 | GAUAAAAG CUGAUGAGGCCGUUAGGCCGAA AUGUUUCU | 9948 |
| 3334 | GAAACAUUC UUUUAUCU | 530 | AGAUAAAA CUGAUGAGGCCGUUAGGCCGAA AAUGUUUC | 9949 |
| 3336 | AACAUUCUU UUAUCUGA | 531 | UCAGAUAA CUGAUGAGGCCGUUAGGCCGAA AGAAUGUU | 9950 |
| 3337 | ACAUUCUUU UAUCUGAG | 532 | CUCAGAUA CUGAUGAGGCCGUUAGGCCGAA AAGAAUGU | 9951 |
| 3338 | CAUUCUUUU AUCUGAGA | 533 | UCUCAGAU CUGAUGAGGCCGUUAGGCCGAA AAAGAAUG | 9952 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 3339 | AUUCUUUUA UCUGAGAA | 534 | UUCUCAGA CUGAUGAGGCCGUUAGGCCGAA AAAAGAAU | 9953 |
| 3341 | UCUUUUAUC UGAGAACA | 535 | UGUUCUCA CUGAUGAGGCCGUUAGGCCGAA AUAAAAGA | 9954 |
| 3363 | GUGAAGAUU UGUGAUUU | 536 | AAAUCACA CUGAUGAGGCCGUUAGGCCGAA AUCUUCAC | 9955 |
| 3364 | UGAAGAUUU GUGAUUUU | 537 | AAAAUCAC CUGAUGAGGCCGUUAGGCCGAA AAUCUUCA | 9956 |
| 3370 | UUUGUGAUU UUGGCCUU | 538 | AAGGCCAA CUGAUGAGGCCGUGAGGCCGAA AUCACAAA | 9957 |
| 3371 | UUGUGAUUU UGGCCUUG | 539 | CAAGGCCA CUGAUGAGGCCGUUAGGCCGAA AAUCACAA | 9958 |
| 3372 | UGUGAUUUU GGCCUUGC | 540 | GCAAGGCC CUGAUGAGGCCGUUAGGCCGAA AAAUCACA | 9959 |
| 3378 | UUUGGCCUU GCCCGGGA | 541 | UCCCGGGC CUGAUGAGGCCGUUAGGCCGAA AGGCCAAA | 9960 |
| 3388 | CCCGGGAUA UUUAUAAG | 542 | CUUAUAAA CUGAUGAGGCCGUUAGGCCGAA AUCCCGGG | 9961 |
| 3390 | CGGGAUAUU UAUAAGAA | 543 | UUCUUAUA CUGAUGAGGCCGUUAGGCCGAA AUAUCCCG | 9962 |
| 3391 | GGGAUAUUU AUAAGAAC | 544 | GUUCUUAU CUGAUGAGGCCGUUAGGCCGAA AAUAUCCC | 9963 |
| 3392 | GGAUAUUUA UAAGAACC | 545 | GGUUCUUA CUGAUGAGGCCGUUAGGCCGAA AAAUAUCC | 9964 |
| 3394 | AUAUUUAUA AGAACCCC | 546 | GGGGUUCU CUGAUGAGGCCGUUAGGCCGAA AUAAAUAU | 9965 |
| 3406 | ACCCCGAUU AUGUGAGA | 547 | UCUCACAU CUGAUGAGGCCGUUAGGCCGAA AUCGGGGU | 9966 |
| 3407 | CCCCGAUUA UGUGAGAA | 548 | UUCUCACA CUGAUGAGGCCGUUAGGCCGAA AAUCGGGG | 9967 |
| 3424 | AAGGAGAUA CUCGACUU | 549 | AAGUCGAG CUGAUGAGGCCGUUAGGCCGAA AUCUCCUU | 9968 |
| 3427 | GAGAUACUC GACUUCCU | 550 | AGGAAGUC CUGAUGAGGCCGUUAGGCCGAA AGUAUCUC | 9969 |
| 3432 | ACUCGACUU CCUCUGAA | 551 | UUCAGAGG CUGAUGAGGCCGUUAGGCCGAA AGUCGAGU | 9970 |
| 3433 | CUCGACUUC CUCUGAAA | 552 | UUUCAGAG CUGAUGAGGCCGUUAGGCCGAA AAGUCGAG | 9971 |
| 3436 | GACUUCCUC UGAAAUGG | 553 | CCAUUUCA CUGAUGAGGCCGUUAGGCCGAA AGGAAGUC | 9972 |
| 3451 | GGAUGGCUC CCGAAUCU | 554 | AGAUUCGG CUGAUGAGGCCGUUAGGCCGAA AGCCAUCC | 9973 |
| 3458 | UCCCGAAUC UAUCUUUG | 555 | CAAAGAUA CUGAUGAGGCCGUUAGGCCGAA AUUCGGGA | 9974 |
| 3460 | CCGAAUCUA UCUUUGAC | 556 | GUCAAAGA CUGAUGAGGCCGUUAGGCCGAA AGAUUCGG | 9975 |
| 3462 | GAAUCUAUC UUUGACAA | 557 | UUGUCAAA CUGAUGAGGCCGUUAGGCCGAA AUAGAUUC | 9976 |
| 3464 | AUCUAUCUU UGACAAAA | 558 | UUUUGUCA CUGAUGAGGCCGUUAGGCCGAA AGAUAGAU | 9977 |
| 3465 | UCUAUCUUU GACAAAAU | 559 | AUUUUGUC CUGAUGAGGCCGUUAGGCCGAA AAGAUAGA | 9978 |
| 3474 | GACAAAAUC UACAGCAC | 560 | GUGCUGUA CUGAUGAGGCCGUUAGGCCGAA AUUUUGUC | 9979 |
| 3476 | CAAAAUCUA CAGCACCA | 561 | UGGUGCUG CUGAUGAGGCCGUUAGGCCGAA AGAUUUUG | 9980 |
| 3500 | CGUGGGUC UUACGGAG | 562 | CUCCGUAA CUGAUGAGGCCGUUAGGCCGAA ACCACACG | 9981 |
| 3502 | UGUGGUCUU ACGGAGUA | 563 | UACUCCGU CUGAUGAGGCCGUUAGGCCGAA AGACCACA | 9982 |
| 3503 | GUGGUCUUA CGGAGUAU | 564 | AUACUCCG CUGAUGAGGCCGUUAGGCCGAA AAGACCAC | 9983 |
| 3510 | UACGGAGUA UUGCUGUG | 565 | CACAGCAA CUGAUGAGGCCGUUAGGCCGAA ACUCCGUA | 9984 |
| 3512 | CGGAGUAUU GCUGUGGG | 566 | CCCACAGC CUGAUGAGGCCGUUAGGCCGAA AUACUCCG | 9985 |
| 3525 | UGGGAAAUC UUCUCCUU | 567 | AAGGAGAA CUGAUGAGGCCGUUAGGCCGAA AUUUCCCA | 9986 |
| 3527 | GGAAAUCUU CUCCUUAG | 568 | CUAAGGAG CUGAUGAGGCCGUUAGGCCGAA AGAUUUCC | 9987 |
| 3528 | GAAAUCUUC UCCUUAGG | 569 | CCUAAGGA CUGAUGAGGCCGUUAGGCCGAA AAGAUUUC | 9988 |
| 3530 | AAUCUUCUC CUUAGGUG | 570 | CACCUAAG CUGAUGAGGCCGUUAGGCCGAA AGAAGAUU | 9989 |

TABLE II-continued

Human flt1 VEGF Receptor—Hammerhead Ribozyme and Substrate Sequence

| Pos | Substrate | Seq ID No | HH Ribozyme | Seq ID No |
|---|---|---|---|---|
| 3533 | CUUCUCCUU AGGUGGGU | 571 | ACCCACCU CUGAUGAGGCCGUUAGGCCGAA AGGAGAAG | 9990 |
| 3534 | UUCUCCUUA GGUGGGUC | 572 | GACCCACC CUGAUGAGGCCGUUAGGCCGAA AAGGAGAA | 9991 |
| 3542 | AGGUGGGUC UCCAUACC | 573 | GGUAUGGA CUGAUGAGGCCGUUAGGCCGAA ACCCACCU | 9992 |
| 3544 | GUGGGUCUC CAUACCCA | 574 | UGGGUAUG CUGAUGAGGCCGUUAGGCCGAA AGACCCAC | 9993 |
| 3548 | GUCUCCAUA CCCAGGAG | 575 | CUCCUGGG CUGAUGAGGCCGUUAGGCCGAA AUGGAGAC | 9994 |
| 3558 | CCAGGAGUA CAAAUGGA | 576 | UCCAUUUG CUGAUGAGGCCGUUAGGCCGAA ACUCCUGG | 9995 |
| 3575 | UGAGGACUU UUGCAGUC | 577 | GACUGCAA CUGAUGAGGCCGUUAGGCCGAA AGUCCUCA | 9996 |
| 3576 | GAGGACUUU UGCAGUCG | 578 | CGACUGCA CUGAUGAGGCCGUUAGGCCGAA AAGUCCUC | 9997 |
| 3577 | AGGACUUUU GCAGUCGC | 579 | GCGACUGC CUGAUGAGGCCGUUAGGCCGAA AAAGUCCU | 9998 |
| 3583 | UUUGCAGUC GCCUGAGG | 580 | CCUCAGGC CUGAUGAGGCCGUUAGGCCGAA ACUGCAAA | 9999 |
| 3613 | UGAGAGCUC CUGAGUAC | 581 | GUACUCAG CUGAUGAGGCCGUUAGGCCGAA AGCUCUCA | 10000 |
| 3620 | UCCUGAGUA CUCUACUC | 582 | GAGUAGAG CUGAUGAGGCCGUUAGGCCGAA ACUCAGGA | 10001 |
| 3623 | UGAGUACUC UACUCCUG | 583 | CAGGAGUA CUGAUGAGGCCGUUAGGCCGAA AGUACUCA | 10002 |
| 3625 | AGUACUCUA CUCCUGAA | 584 | UUCAGGAG CUGAUGAGGCCGUUAGGCCGAA AGAGUACU | 10003 |
| 3628 | ACUCUACUC CUGAAAUC | 585 | GAUUUCAG CUGAUGAGGCCGUUAGGCCGAA AGUAGAGU | 10004 |
| 3636 | CCUGAAAUC UAUCAGAU | 586 | AUCUGAUA CUGAUGAGGCCGUUAGGCCGAA AUUUCAGG | 10005 |
| 3638 | UGAAAUCUA UCAGAUCA | 587 | UGAUCUGA CUGAUGAGGCCGUUAGGCCGAA AGAUUUCA | 10006 |
| 3640 | AAAUCUAUC AGAUCAUG | 588 | CAUGAUCU CUGAUGAGGCCGUUAGGCCGAA AUAGAUUU | 10007 |
| 3645 | UAUCAGAUC AUGCUGGA | 589 | UCCAGCAU CUGAUGAGGCCGUUAGGCCGAA AUCUGAUA | 10008 |
| 3689 | GCCAAGAUU UGCAGAAC | 590 | GUUCUGCA CUGAUGAGGCCGUUAGGCCGAA AUCUUGGC | 10009 |
| 3690 | CCAAGAUUU GCAGAACU | 591 | AGUUCUGC CUGAUGAGGCCGUUAGGCCGAA AAUCUUGG | 10010 |
| 3699 | GCAGAACUU GUGGAAAA | 592 | UUUUCCAC CUGAUGAGGCCGUUAGGCCGAA AGUUCUGC | 10011 |
| 3711 | GAAAAACUA GGUGAUUU | 593 | AAAUCACC CUGAUGAGGCCGUUAGGCCGAA AGUUUUUC | 10012 |
| 3718 | UAGGUGAUU UGCUUCAA | 594 | UUGAAGCA CUGAUGAGGCCGUUAGGCCGAA AUCACCUA | 10013 |
| 3719 | AGGUGAUUU GCUUCAAG | 595 | CUUGAAGC CUGAUGAGGCCGUUAGGCCGAA AAUCACCU | 10014 |
| 3723 | GAUUUGCUU CAAGCAAA | 596 | UUUGCUUG CUGAUGAGGCCGUUAGGCCGAA AGCAAAUC | 10015 |
| 3724 | AUUUGCUUC AAGCAAAU | 597 | AUUUGCUU CUGAUGAGGCCGUUAGGCCGAA AAGCAAAU | 10016 |
| 3735 | GCAAAUGUA CAACAGGA | 598 | UCCUGUUG CUGAUGAGGCCGUUAGGCCGAA ACAUUUGC | 10017 |
| 3748 | AGGAUGGUA AAGACUAC | 599 | GUAGUCUU CUGAUGAGGCCGUUAGGCCGAA ACCAUCCU | 10018 |
| 3755 | UAAAGACUA CAUCCCAA | 600 | UUGGGAUG CUGAUGAGGCCGUUAGGCCGAA AGUCUUUA | 10019 |
| 3759 | GACUACAUC CCAAUCAA | 601 | UUGAUUGG CUGAUGAGGCCGUUAGGCCGAA AUGUAGUC | 10020 |
| 3765 | AUCCCAAUC AAUGCCAU | 602 | AUGGCAUU CUGAUGAGGCCGUUAGGCCGAA AUUGGGAU | 10021 |
| 3774 | AAUGCCAUA CUGACAGG | 603 | CCUGUCAG CUGAUGAGGCCGUUAGGCCGAA AUGGCAUU | 10022 |
| 3787 | CAGGAAAUA GUGGGUUU | 604 | AAACCCAC CUGAUGAGGCCGUUAGGCCGAA AUUUCCUG | 10023 |
| 3794 | UAGUGGGUU UACAUACU | 605 | AGUAUGUA CUGAUGAGGCCGUUAGGCCGAA ACCCACUA | 10024 |
| 3795 | AGUGGGUUU ACAUACUC | 606 | GAGUAUGU CUGAUGAGGCCGUUAGGCCGAA AACCCACU | 10025 |
| 3796 | GUGGGUUUA CAUACUCA | 607 | UGAGUAUG CUGAUGAGGCCGUUAGGCCGAA AAACCCAC | 10026 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 3800 | GUUUACAUA CUCAACUC | 608 | GAGUUGAG CUGAUGAGGCCGUUAGGCCGAA AUGUAAAC | 10027 |
| 3803 | UACAUACUC AACUCCUG | 609 | CAGGAGUU CUGAUGAGGCCGUUAGGCCGAA AGUAUGUA | 10028 |
| 3808 | ACUCAACUC CUGCCUUC | 610 | GAAGGCAG CUGAUGAGGCCGUUAGGCCGAA AGUUCAGU | 10029 |
| 3815 | UCCUGCCUU CUCUGAGG | 611 | CCUCAGAG CUGAUGAGGCCGUUAGGCCGAA AGGCAGGA | 10030 |
| 3816 | CCUGCCUUC UCUGAGGA | 612 | UCCUCAGA CUGAUGAGGCCGUUAGGCCGAA AAGGCAGG | 10031 |
| 3818 | UGCCUUCUC UGAGGACU | 613 | AGUCCUCA CUGAUGAGGCCGUUAGGCCGAA AGAAGGCA | 10032 |
| 3827 | UGAGGACUU CUUCAAGG | 614 | CCUUGAAG CUGAUGAGGCCGUUAGGCCGAA AGUCCUCA | 10033 |
| 3828 | GAGGACUUC UUCAAGGA | 615 | UCCUUGAA CUGAUGAGGCCGUUAGGCCGAA AAGUCCUC | 10034 |
| 3830 | GGACUUCUU CAAGGAAA | 616 | UUUCCUUG CUGAUGAGGCCGUUAGGCCGAA AGAAGUCC | 10035 |
| 3831 | GACUUCUUC AAGGAAAG | 617 | CUUUCCUU CUGAUGAGGCCGUUAGGCCGAA AAGAAGUC | 10036 |
| 3841 | AGGAAAGUA UUUCAGCU | 618 | AGCUGAAA CUGAUGAGGCCGUUAGGCCGAA ACUUUCCU | 10037 |
| 3843 | GAAAGUAUU UCAGCUCC | 619 | GGAGCUGA CUGAUGAGGCCGUUAGGCCGAA AUACUUUC | 10038 |
| 3844 | AAAGUAUUU CAGCUCCG | 620 | CGGAGCUG CUGAUGAGGCCGUUAGGCCGAA AAUACUUU | 10039 |
| 3845 | AAGUAUUUC AGCUCCGA | 621 | UCGGAGCU CUGAUGAGGCCGUUAGGCCGAA AAAUACUU | 10040 |
| 3850 | UUUCAGCUC CGAAGUUU | 622 | AAACUUCG CUGAUGAGGCCGUUAGGCCGAA AGCUGAAA | 10041 |
| 3857 | UCCGAAGUU UAAUUCAG | 623 | CUGAAUUA CUGAUGAGGCCGUUAGGCCGAA ACUUCGGA | 10042 |
| 3858 | CCGAAGUUU AAUUCAGG | 624 | CCUGAAUU CUGAUGAGGCCGUUAGGCCGAA AACUUCGG | 10043 |
| 3859 | CGAAGUUUA AUUCAGGA | 625 | UCCUGAAU CUGAUGAGGCCGUUAGGCCGAA AAACUUCG | 10044 |
| 3862 | AGUUUAAUU CAGGAAGC | 626 | GCUUCCUG CUGAUGAGGCCGUUAGGCCGAA AUUAAACU | 10045 |
| 3863 | GUUUAAUUC AGGAAGCU | 627 | AGCUUCCU CUGAUGAGGCCGUUAGGCCGAA AAUUAAAC | 10046 |
| 3872 | AGGAAGCUC UGAUGAUG | 628 | CAUCAUCA CUGAUGAGGCCGUUAGGCCGAA AGCUUCCU | 10047 |
| 3882 | GAUGAUGUC AGAUAUGU | 629 | ACAUAUCU CUGAUGAGGCCGUUAGGCCGAA ACAUCAUC | 10048 |
| 3887 | UGUCAGAUA UGUAAAUG | 630 | CAUUUACA CUGAUGAGGCCGUUAGGCCGAA AUCUGACA | 10049 |
| 3891 | AGAUAUGUA AAUGCUUU | 631 | AAAGCAUU CUGAUGAGGCCGUUAGGCCGAA ACAUAUCU | 10050 |
| 3898 | UAAAUGCUU UCAAGUUC | 632 | GAACUUGA CUGAUGAGGCCGUUAGGCCGAA AGCAUUUA | 10051 |
| 3899 | AAAUGCUUU CAAGUUCA | 633 | UGAACUUG CUGAUGAGGCCGUUAGGCCGAA AAGCAUUU | 10052 |
| 3900 | AAUGCUUUC AAGUUCAU | 634 | AUGAACUU CUGAUGAGGCCGUUAGGCCGAA AAAGCAUU | 10053 |
| 3905 | UUUCAAGUU CAUGAGCC | 635 | GGCUCAUG CUGAUGAGGCCGUUAGGCCGAA ACUUGAAA | 10054 |
| 3906 | UUCAAGUUC AUGAGCCU | 636 | AGGCUCAU CUGAUGAGGCCGUUAGGCCGAA AACUUGAA | 10055 |
| 3924 | GAAAGAAUC AAAACCUU | 637 | AAGGUUUU CUGAUGAGGCCGUUAGGCCGAA AUUCUUUC | 10056 |
| 3932 | CAAAACCUU GAAGAAC | 638 | GUUCUUCA CUGAUGAGGCCGUUAGGCCGAA AGGUUUUG | 10057 |
| 3933 | AAAACCUUU GAAGAACU | 639 | AGUUCUUC CUGAUGAGGCCGUUAGGCCGAA AAGGUUUU | 10058 |
| 3942 | GAAGAACUU UUACCGAA | 640 | UUCGGUAA CUGAUGAGGCCGUUAGGCCGAA AGUUCUUC | 10059 |
| 3943 | AAGAACUUU UACCGAAU | 641 | AUUCGGUA CUGAUGAGGCCGUUAGGCCGAA AAGUUCUU | 10060 |
| 3944 | AGAACUUUU ACCGAAUG | 642 | CAUUCGGU CUGAUGAGGCCGUUAGGCCGAA AAAGUUCU | 10061 |
| 3945 | GAACUUUUA CCGAAUGC | 643 | GCAUUCGG CUGAUGAGGCCGUUAGGCCGAA AAAAGUUC | 10062 |
| 3959 | UGCCACCUC CAUGUUUG | 644 | CAAACAUG CUGAUGAGGCCGUUAGGCCGAA AGGUGGCA | 10063 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 3965 | CUCCAUGUU UGAUGACU | 645 | AGUCAUCA CUGAUGAG<u>GCCGUUAGGC</u>CGAA ACAUGGAG | 10064 |
| 3966 | UCCAUGUUU GAUGACUA | 646 | UAGUCAUC CUGAUGAG<u>GCCGUUAGGC</u>CGAA AACAUGGA | 10065 |
| 3974 | UGAUGACUA CCAGGGCG | 647 | CGCCCUGG CUGAUGAG<u>GCCGUUAGGC</u>CGAA AGUCAUCA | 10066 |
| 3994 | GCAGCACUC UGUUGGCC | 648 | GGCCAACA CUGAUGAG<u>GCCGUUAGGC</u>CGAA AGUGCUGC | 10067 |
| 3998 | CACUCUGUU GGCCUCUC | 649 | GAGAGGCC CUGAUGAG<u>GCCGUUAGGC</u>CGAA ACAGAGUG | 10068 |
| 4004 | GUUGGCCUC UCCCAUGC | 650 | GCAUGGGA CUGAUGAG<u>GCCGUUAGGC</u>CGAA AGGCCAAC | 10069 |
| 4006 | UGGCCUCUC CCAUGCUG | 651 | CAGCAUGG CUGAUGAG<u>GCCGUUAGGC</u>CGAA AGAGGCCA | 10070 |
| 4022 | GAAGCGCUU CACCUGGA | 652 | UCCAGGUG CUGAUGAG<u>GCCGUUAGGC</u>CGAA AGCGCUUC | 10071 |
| 4023 | AAGCGCUUC ACCUGGAC | 653 | GUCCAGGU CUGAUGAG<u>GCCGUUAGGC</u>CGAA AAGCGCUU | 10072 |
| 4052 | CAAGGCCUC GCUCAAGA | 654 | UCUUGAGC CUGAUGAG<u>GCCGUUAGGC</u>CGAA AGGCCUUG | 10073 |
| 4056 | GCCUCGCUC AAGAUUGA | 655 | UCAAUCUU CUGAUGAG<u>GCCGUUAGGC</u>CGAA AGCGAGGC | 10074 |
| 4062 | CUCAAGAUU GACUUGAG | 656 | CUCAAGUC CUGAUGAG<u>GCCGUUAGGC</u>CGAA AUCUUGAG | 10075 |
| 4067 | GAUUGACUU GAGAGUAA | 657 | UUACUCUC CUGAUGAG<u>GCCGUUAGGC</u>CGAA AGUCAAUC | 10076 |
| 4074 | UUGAGAGUA ACCAGUAA | 658 | UUACUGGU CUGAUGAG<u>GCCGUUAGGC</u>CGAA ACUCUCAA | 10077 |
| 4081 | UAACCAGUA AAAGUAAG | 659 | CUUACUUU CUGAUGAG<u>GCCGUUAGGC</u>CGAA ACUGGUUA | 10078 |
| 4087 | GUAAAAGUA AGGAGUCG | 660 | CGACUCCU CUGAUGAG<u>GCCGUUAGGC</u>CGAA ACUUUUAC | 10079 |
| 4094 | UAAGGAGUC GGGGCUGU | 661 | ACAGCCCC CUGAUGAG<u>GCCGUUAGGC</u>CGAA ACUCCUUA | 10080 |
| 4103 | GGGGCUGUC UGAUGUCA | 662 | UGACAUCA CUGAUGAG<u>GCCGUUAGGC</u>CGAA ACAGCCCC | 10081 |
| 4110 | UCUGAUGUC AGCAGGCC | 663 | GGCCUGCU CUGAUGAG<u>GCCGUUAGGC</u>CGAA ACAUCAGA | 10082 |
| 4123 | GGCCCAGUU UCUGCCAU | 664 | AUGGCAGA CUGAUGAG<u>GCCGUUAGGC</u>CGAA ACUGGGCC | 10083 |
| 4124 | GCCCAGUUU CUGCCAUU | 665 | AAUGGCAG CUGAUGAG<u>GCCGUUAGGC</u>CGAA AACUGGGC | 10084 |
| 4125 | CCCAGUUUC UGCCAUUC | 666 | GAAUGGCA CUGAUGAG<u>GCCGUUAGGC</u>CGAA AAACUGGG | 10085 |
| 4132 | UCUGCCAUU CCAGCUGU | 667 | ACAGCUGG CUGAUGAG<u>GCCGUUAGGC</u>CGAA AUGGCAGA | 10086 |
| 4133 | CUGCCAUUC CAGCUGUG | 668 | CACAGCUG CUGAUGAG<u>GCCGUUAGGC</u>CGAA AAUGGCAG | 10087 |
| 4149 | GGGCACGUC AGCGAAGG | 669 | CCUUCGCU CUGAUGAG<u>GCCGUUAGGC</u>CGAA ACGUGCCC | 10088 |
| 4169 | GCGCAGGUU CACCUACG | 670 | CGUAGGUG CUGAUGAG<u>GCCGUUAGGC</u>CGAA ACCUGCGC | 10089 |
| 4170 | CGCAGGUUC ACCUACGA | 671 | UCGUAGGU CUGAUGAG<u>GCCGUUAGGC</u>CGAA AACCUGCG | 10090 |
| 4175 | GUUCACCUA CGACCACG | 672 | CGUGGUCG CUGAUGAG<u>GCCGUUAGGC</u>CGAA AGGUGAAC | 10091 |
| 4203 | AGGAAAAUC GCGUGCUG | 673 | CAGCACGC CUGAUGAG<u>GCCGUUAGGC</u>CGAA AUUUUCCU | 10092 |
| 4214 | GUGCUGCUC CCCGCCCC | 674 | GGGGCGGG CUGAUGAG<u>GCCGUUAGGC</u>CGAA AGCAGCAC | 10093 |
| 4229 | CCCAGACUA CAACUCGG | 675 | CCGAGUUG CUGAUGAG<u>GCCGUUAGGC</u>CGAA AGUCUGGG | 10094 |
| 4235 | CUACAACUC GGUGGUCC | 676 | GGACCACC CUGAUGAG<u>GCCGUUAGGC</u>CGAA AGUUGUAG | 10095 |
| 4242 | UCGGUGGUC CUGUACUC | 677 | GAGUACAG CUGAUGAG<u>GCCGUUAGGC</u>CGAA ACCACCGA | 10096 |
| 4247 | GGUCCUGUA CUCCACCC | 678 | GGGUGGAG CUGAUGAG<u>GCCGUUAGGC</u>CGAA ACAGGACC | 10097 |
| 4250 | CCUGUACUC CACCCCAC | 679 | GUGGGGUG CUGAUGAG<u>GCCGUUAGGC</u>CGAA AGUACAGG | 10098 |
| 4263 | CCACCCAUC UAGAGUUU | 680 | AAACUCUA CUGAUGAG<u>GCCGUUAGGC</u>CGAA AUGGGUGG | 10099 |
| 4265 | ACCCAUCUA GAGUUUGA | 681 | UCAAACUC CUGAUGAG<u>GCCGUUAGGC</u>CGAA AGAUGGGU | 10100 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 4270 | UCUAGAGUU UGACACGA | 682 | UCGUGUCA CUGAUGAGGCCGUUAGGCCGAA ACUCUAGA | 10101 |
| 4271 | CUAGAGUUU GACACGAA | 683 | UUCGUGUC CUGAUGAGGCCGUUAGGCCGAA AACUCUAG | 10102 |
| 4284 | CGAAGCCUU AUUUCUAG | 684 | CUAGAAAU CUGAUGAGGCCGUUAGGCCGAA AGGCUUCG | 10103 |
| 4285 | GAAGCCUUA UUUCUAGA | 685 | UCUAGAAA CUGAUGAGGCCGUUAGGCCGAA AAGGCUUC | 10104 |
| 4287 | AGCCUUAUU UCUAGAAG | 686 | CUUCUAGA CUGAUGAGGCCGUUAGGCCGAA AUAAGGCU | 10105 |
| 4288 | GCCUUAUUU CUAGAAGC | 687 | GCUUCUAG CUGAUGAGGCCGUUAGGCCGAA AAUAAGGC | 10106 |
| 4289 | CCUUAUUUC UAGAAGCA | 688 | UGCUUCUA CUGAUGAGGCCGUUAGGCCGAA AAAUAAGG | 10107 |
| 4291 | UUAUUUCUA GAAGCACA | 689 | UGUGCUUC CUGAUGAGGCCGUUAGGCCGAA AGAAAUAA | 10108 |
| 4305 | ACAUGUGUA UUUUAUACC | 690 | GGUAUAAA CUGAUGAGGCCGUUAGGCCGAA ACACAUGU | 10109 |
| 4307 | AUGUGUAUU UAUACCCC | 691 | GGGGUAUA CUGAUGAGGCCGUUAGGCCGAA AUACACAU | 10110 |
| 4308 | UGUGUAUUU AUACCCCC | 692 | GGGGGUAU CUGAUGAGGCCGUUAGGCCGAA AAUACACA | 10111 |
| 4309 | GUGUAUUUA UACCCCCA | 693 | UGGGGGUA CUGAUGAGGCCGUUAGGCCGAA AAAUACAC | 10112 |
| 4311 | GUAUUUAUA CCCCCAGG | 694 | CCUGGGGG CUGAUGAGGCCGUUAGGCCGAA AUAAAUAC | 10113 |
| 4325 | AGGAAACUA GCUUUUGC | 695 | GCAAAAGC CUGAUGAGGCCGUUAGGCCGAA AGUUUCCU | 10114 |
| 4329 | AACUAGCUU UUGCCAGU | 696 | ACUGGCAA CUGAUGAGGCCGUUAGGCCGAA AGCUAGUU | 10115 |
| 4330 | ACUAGCUUU UGCCAGUA | 697 | UACUGGCA CUGAUGAGGCCGUUAGGCCGAA AAGCUAGU | 10116 |
| 4331 | CUAGCUUUU GCCAGUAU | 698 | AUACUGGC CUGAUGAGGCCGUUAGGCCGAA AAAGCUAG | 10117 |
| 4338 | UUGCCAGUA UUAUGCAU | 699 | AUGCAUAA CUGAUGAGGCCGUUAGGCCGAA ACUGGCAA | 10118 |
| 4340 | GCCAGUAUU AUGCAUAU | 700 | AUAUGCAU CUGAUGAGGCCGUUAGGCCGAA AAUACGGC | 10119 |
| 4341 | CCAGUAUUA UGCAUAUA | 701 | UAUAUGCA CUGAUGAGGCCGUUAGGCCGAA AAUACUGG | 10120 |
| 4347 | UUAUGCAUA UAUAAGUU | 702 | AACUUAUA CUGAUGAGGCCGUUAGGCCGAA AUGCAUAA | 10121 |
| 4349 | AUGCAUAUA UAAGUUUA | 703 | UAAACUUA CUGAUGAGGCCGUUAGGCCGAA AUAUGCAU | 10122 |
| 4351 | GCAUAUAUA AGUUUACA | 704 | UGUAAACU CUGAUGAGGCCGUUAGGCCGAA AUAUAUGC | 10123 |
| 4355 | AUAUAAGUU UACACCUU | 705 | AAGGUGUA CUGAUGAGGCCGUUAGGCCGAA ACUUAUAU | 10124 |
| 4356 | UAUAAGUUU ACACCUUU | 706 | AAAGGUGU CUGAUGAGGCCGUUAGGCCGAA AACUUAUA | 10125 |
| 4357 | AUAAGUUUA CACCUUUA | 707 | UAAAGGUG CUGAUGAGGCCGUUAGGCCGAA AAACUUAU | 10126 |
| 4363 | UUACACCUU UAUCUUUC | 708 | GAAAGAUA CUGAUGAGGCCGUUAGGCCGAA AGGUGUAA | 10127 |
| 4364 | UACACCUUU AUCUUUCC | 709 | GGAAAGAU CUGAUGAGGCCGUUAGGCCGAA AAGGUGUA | 10128 |
| 4365 | ACACCUUUA UCUUUCCA | 710 | UGGAAAGA CUGAUGAGGCCGUUAGGCCGAA AAAGGUGU | 10129 |
| 4367 | ACCUUUAUC UUUCCAUG | 711 | CAUGGAAA CUGAUGAGGCCGUUAGGCCGAA AUAAAGGU | 10130 |
| 4369 | CUUUAUCUU UCCAUGGG | 712 | CCCAUGGA CUGAUGAGGCCGUUAGGCCGAA AGAUAAAG | 10131 |
| 4370 | UUUAUCUUU CCAUGGGA | 713 | UCCCAUGG CUGAUGAGGCCGUUAGGCCGAA AAGAUAAA | 10132 |
| 4371 | UUAUCUUUC CAUGGGAG | 714 | CUCCCAUG CUGAUGAGGCCGUUAGGCCGAA AAAGAUAA | 10133 |
| 4389 | CAGCUGCUU UUGUGAU | 715 | AUCACAAA CUGAUGAGGCCGUUAGGCCGAA AGCAGCUG | 10134 |
| 4390 | AGCUGCUUU UGUGAUU | 716 | AAUCACAA CUGAUGAGGCCGUUAGGCCGAA AAGCAGCU | 10135 |
| 4391 | GCUGCUUUU GUGAUUU | 717 | AAAUCACA CUGAUGAGGCCGUUAGGCCGAA AAAGCAGC | 10136 |
| 4392 | CUGCUUUUU GUGAUUUU | 718 | AAAAUCAC CUGAUGAGGCCGUUAGGCCGAA AAAAGCAG | 10137 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 4398 | UUUGUGAUU UUUUUAAU | 719 | AUUAAAAA CUGAUGAGGCCGUUAGGCCGAA AUCACAAA | 10138 |
| 4399 | UUGUGAUUU UUUUAAUA | 720 | UAUUAAAA CUGAUGAGGCCGUUAGGCCGAA AAUCACAA | 10139 |
| 4400 | UGUGAUUUU UUUAAUAG | 721 | CUAUUAAA CUGAUGAGGCCGUUAGGCCGAA AAAUCACA | 10140 |
| 4401 | GUGAUUUUU UUAAUAGU | 722 | ACUAUUAA CUGAUGAGGCCGUUAGGCCGAA AAAAUCAC | 10141 |
| 4402 | UGAUUUUUU UAAUAGUG | 723 | CACUAUUA CUGAUGAGGCCGUUAGGCCGAA AAAAAUCA | 10142 |
| 4403 | GAUUUUUUU AAUAGUGC | 724 | GCACUAUU CUGAUGAGGCCGUUAGGCCGAA AAAAAAUC | 10143 |
| 4404 | AUUUUUUUA AUAGUGCU | 725 | AGCACUAU CUGAUGAGGCCGUUAGGCCGAA AAAAAAAU | 10144 |
| 4407 | UUUUUAAUA GUGCUUUU | 726 | AAAAGCAC CUGAUGAGGCCGUUAGGCCGAA AUUAAAAA | 10145 |
| 4413 | AUAGUGCUU UUUUUUUU | 727 | AAAAAAAA CUGAUGAGGCCGUUAGGCCGAA AGCACUAU | 10146 |
| 4414 | UAGUGCUUU UUUUUUUU | 728 | AAAAAAAA CUGAUGAGGCCGUUAGGCCGAA AAGCACUA | 10147 |
| 4415 | AGUGCUUUU UUUUUUUG | 729 | CAAAAAAA CUGAUGAGGCCGUUAGGCCGAA AAAGCACU | 10148 |
| 4416 | GUGCUUUUU UUUUUUGA | 730 | UCAAAAAA CUGAUGAGGCCGUUAGGCCGAA AAAAGCAC | 10149 |
| 4417 | UGCUUUUUU UUUUUGAC | 731 | GUCAAAAA CUGAUGAGGCCGUUAGGCCGAA AAAAAGCA | 10150 |
| 4418 | GCUUUUUUU UUUUGACU | 732 | AGUCAAAA CUGAUGAGGCCGUUAGGCCGAA AAAAAAGC | 10151 |
| 4419 | CUUUUUUUU UUUGACUA | 733 | UAGUCAAA CUGAUGAGGCCGUUAGGCCGAA AAAAAAAG | 10152 |
| 4420 | UUUUUUUUU UUGACUAA | 734 | UUAGUCAA CUGAUGAGGCCGUUAGGCCGAA AAAAAAAA | 10153 |
| 4421 | UUUUUUUUU UGACUAAC | 735 | GUUAGUCA CUGAUGAGGCCGUUAGGCCGAA AAAAAAAA | 10154 |
| 4422 | UUUUUUUUU GACUAACA | 736 | UGUUAGUC CUGAUGAGGCCGUUAGGCCGAA AAAAAAAA | 10155 |
| 4427 | UUUUGACUA ACAAGAAU | 737 | AUUCUUGU CUGAUGAGGCCGUUAGGCCGAA AGUCAAAA | 10156 |
| 4438 | AAGAAUGUA ACUCCAGA | 738 | UCUGGAGU CUGAUGAGGCCGUUAGGCCGAA ACAUUCUU | 10157 |
| 4442 | AUGUAACUC CAGAUAGA | 739 | UCUAUCUG CUGAUGAGGCCGUUAGGCCGAA AGUUACAU | 10158 |
| 4448 | CUCCAGAUA GAGAAAUA | 740 | UAUUUCUC CUGAUGAGGCCGUUAGGCCGAA AUCUGGAG | 10159 |
| 4456 | AGAGAAAUA GUGACAAG | 741 | CUUGUCAC CUGAUGAGGCCGUUAGGCCGAA AUUUCUCU | 10160 |
| 4476 | AGAACACUA CUGCUAAA | 742 | UUUAGCAG CUGAUGAGGCCGUUAGGCCGAA AGUGUUCU | 10161 |
| 4482 | CUACUGCUA AAUCCUCA | 743 | UGAGGAUU CUGAUGAGGCCGUUAGGCCGAA AGCAGUAG | 10162 |
| 4486 | UGCUAAAUC CUCAUGUU | 744 | AACAUGAG CUGAUGAGGCCGUUAGGCCGAA AUUUAGCA | 10163 |
| 4489 | UAAAUCCUC AUGUUACU | 745 | AGUAACAU CUGAUGAGGCCGUUAGGCCGAA AGGAUUUA | 10164 |
| 4494 | CCUCAUGUU ACUCAGUG | 746 | CACUGAGU CUGAUGAGGCCGUUAGGCCGAA ACAUGAGG | 10165 |
| 4495 | CUCAUGUUA CUCAGUGU | 747 | ACACUGAG CUGAUGAGGCCGUUAGGCCGAA AACAUGAG | 10166 |
| 4498 | AUGUUACUC AGUGUUAG | 748 | CUAACACU CUGAUGAGGCCGUUAGGCCGAA AGUAACAU | 10167 |
| 4504 | CUCAGUGUU AGAGAAAU | 749 | AUUUCUCU CUGAUGAGGCCGUUAGGCCGAA ACACUGAG | 10168 |
| 4505 | UCAGUGUUA GAGAAAUC | 750 | GAUUUCUC CUGAUGAGGCCGUUAGGCCGAA AACACUGA | 10169 |
| 4513 | AGAGAAAUC CUUCCUAA | 751 | UUAGGAAG CUGAUGAGGCCGUUAGGCCGAA AUUUCUCU | 10170 |
| 4516 | GAAAUCCUU CCUAAACC | 752 | GGUUUAGG CUGAUGAGGCCGUUAGGCCGAA AGGAUUUC | 10171 |
| 4517 | AAAUCCUUC CUAAACCC | 753 | GGGUUUAG CUGAUGAGGCCGUUAGGCCGAA AAGGAUUU | 10172 |
| 4520 | UCCUUCCUA AACCCAAU | 754 | AUUGGGUU CUGAUGAGGCCGUUAGGCCGAA AGGAAGGA | 10173 |
| 4533 | CAAUGACUU CCCUGCUC | 755 | GAGCAGGG CUGAUGAGGCCGUUAGGCCGAA AGUCAUUG | 10174 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 4534 | AAUGACUUC CCUGCUCC | 756 | GGAGCAGG CUGAUGAGGCCGUUAGGCCGAA AAGUCAUU | 10175 |
| 4541 | UCCCUGCUC CAACCCCC | 757 | GGGGGUUG CUGAUGAGGCCGUUAGGCCGAA AGCAGGGA | 10176 |
| 4557 | CGCCACCUC AGGGCACG | 758 | CGUGCCCU CUGAUGAGGCCGUUAGGCCGAA AGGUGGCG | 10177 |
| 4576 | GGACCAGUU UGAUUGAG | 759 | CUCAAUCA CUGAUGAGGCCGUUAGGCCGAA ACUGGUCC | 10178 |
| 4577 | GACCAGUUU GAUUGAGG | 760 | CCUCAAUC CUGAUGAGGCCGUUAGGCCGAA AACUGGUC | 10179 |
| 4581 | AGUUUGAUU GAGGAGCU | 761 | AGCUCCUC CUGAUGAGGCCGUUAGGCCGAA AUCAAACU | 10180 |
| 4598 | GCACUGAUC ACCCAAUG | 762 | CAUUGGGU CUGAUGAGGCCGUUAGGCCGAA AUCAGUGC | 10181 |
| 4610 | CAAUGCAUC ACGUACCC | 763 | GGGUACGU CUGAUGAGGCCGUUAGGCCGAA AUGCAUUG | 10182 |
| 4615 | CAUCACGUA CCCCACUG | 764 | CAGUGGGG CUGAUGAGGCCGUUAGGCCGAA ACGUGAUG | 10183 |
| 4664 | AAGCCCGUU AGCCCCAG | 765 | CUGGGGCU CUGAUGAGGCCGUUAGGCCGAA ACGGGCUU | 10184 |
| 4665 | AGCCCGUUA GCCCCAGG | 766 | CCUGGGGC CUGAUGAGGCCGUUAGGCCGAA AACGGGCU | 10185 |
| 4678 | CAGGGGAUC ACUGGCUG | 767 | CAGCCAGU CUGAUGAGGCCGUUAGGCCGAA AUCCCCUG | 10186 |
| 4700 | AGCAACAUC UCGGGAGU | 768 | ACUCCCGA CUGAUGAGGCCGUUAGGCCGAA AUGUUGCU | 10187 |
| 4702 | CAACAUCUC GGGAGUCC | 769 | GGACUCCC CUGAUGAGGCCGUUAGGCCGAA AGAUGUUG | 10188 |
| 4709 | UCGGGAGUC UCUAGCA | 770 | UGCUAGAG CUGAUGAGGCCGUUAGGCCGAA ACUCCCGA | 10189 |
| 4712 | GGAGUCCUC UAGCAGGC | 771 | GCCUGCUA CUGAUGAGGCCGUUAGGCCGAA AGGACUCC | 10190 |
| 4714 | AGUCCUCUA GCAGGCCU | 772 | AGGCCUGC CUGAUGAGGCCGUUAGGCCGAA AGAGGACU | 10191 |
| 4723 | GCAGGCCUA AGACAUGU | 773 | ACAUGUCU CUGAUGAGGCCGUUAGGCCGAA AGGCCUGC | 10192 |
| 4802 | GAAAGAAUU UGAGACGC | 774 | GCGUCUCA CUGAUGAGGCCGUUAGGCCGAA AUUCUUUC | 10193 |
| 4803 | AAAGAAUUU GAGACGCA | 775 | UGCGUCUC CUGAUGAGGCCGUUAGGCCGAA AAUUCUUU | 10194 |
| 4840 | ACGGGCUC AGCAAUGC | 776 | GCAUUGCU CUGAUGAGGCCGUUAGGCCGAA AGCCCCGU | 10195 |
| 4852 | AAUGCCAUU UCAGUGGC | 777 | GCCACUGA CUGAUGAGGCCGUUAGGCCGAA AUGGCAUU | 10196 |
| 4853 | AUGCCAUUU CAGUGGCU | 778 | AGCCACUG CUGAUGAGGCCGUUAGGCCGAA AAUGGCAU | 10197 |
| 4854 | UGCCAUUUC AGUGGCUU | 779 | AAGCCACU CUGAUGAGGCCGUUAGGCCGAA AAAUGGCA | 10198 |
| 4862 | CAGUGGCUU CCCAGCUC | 780 | GAGCUGGG CUGAUGAGGCCGUUAGGCCGAA AGCCACUG | 10199 |
| 4863 | AGUGGCUUC CCAGCUCU | 781 | AGAGCUGG CUGAUGAGGCCGUUAGGCCGAA AAGCCACU | 10200 |
| 4870 | UCCCAGCUC UGACCCUU | 782 | AAGGGUCA CUGAUGAGGCCGUUAGGCCGAA AGCUGGGA | 10201 |
| 4878 | CUGACCCUU CUACAUUU | 783 | AAAUGUAG CUGAUGAGGCCGUUAGGCCGAA AGGGUCAG | 10202 |
| 4879 | UGACCCUUC UACAUUUG | 784 | CAAAUGUA CUGAUGAGGCCGUUAGGCCGAA AAGGGUCA | 10203 |
| 4881 | ACCCUUCUA CAUUUGAG | 785 | CUCAAAUG CUGAUGAGGCCGUUAGGCCGAA AGAAGGGU | 10204 |
| 4885 | UUCUACAUU UGAGGGCC | 786 | GGCCCUCA CUGAUGAGGCCGUUAGGCCGAA AUGUAGAA | 10205 |
| 4886 | UCUACAUUU GAGGGCCC | 787 | GGGCCCUC CUGAUGAGGCCGUUAGGCCGAA AAUGUAGA | 10206 |
| 4929 | GGGGACAUU UUCUGGAU | 788 | AUCCAGAA CUGAUGAGGCCGUUAGGCCGAA AUGUCCCC | 10207 |
| 4930 | GGGACAUUU UCUGGAUU | 789 | AAUCCAGA CUGAUGAGGCCGUUAGGCCGAA AAUGUCCC | 10208 |
| 4931 | GGACAUUUU CUGGAUUC | 790 | GAAUCCAG CUGAUGAGGCCGUUAGGCCGAA AAAUGUCC | 10209 |
| 4932 | GACAUUUUC UGGAUUCU | 791 | AGAAUCCA CUGAUGAGGCCGUUAGGCCGAA AAAAUGUC | 10210 |
| 4938 | UUCUGGAUU CUGGGAGG | 792 | CCUCCCAG CUGAUGAGGCCGUUAGGCCGAA AUCCAGAA | 10211 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 4939 | UCUGGAUUC UGGGAGGC | 793 | GCCUCCCA CUGAUGAGGCCGUUAGGCCGAA AAUCCAGA | 10212 |
| 4963 | GGACAAAUA UCUUUUUU | 794 | AAAAAAGA CUGAUGAGGCCGUUAGGCCGAA AUUUGUCC | 10213 |
| 4965 | ACAAAUAUC UUUUUUGG | 795 | CCAAAAAA CUGAUGAGGCCGUUAGGCCGAA AUAUUUGU | 10214 |
| 4967 | AAAUAUCUU UUUUGGAA | 796 | UUCCAAAA CUGAUGAGGCCGUUAGGCCGAA AGAUAUUU | 10215 |
| 4968 | AAUAUCUUU UUUGGAAC | 797 | GUUCCAAA CUGAUGAGGCCGUUAGGCCGAA AAGAUAUU | 10216 |
| 4969 | AUAUCUUUU UUGGAACU | 798 | AGUUCCAA CUGAUGAGGCCGUUAGGCCGAA AAAGAUAU | 10217 |
| 4970 | UAUCUUUUU UGGAACUA | 799 | UAGUUCCA CUGAUGAGGCCGUUAGGCCGAA AAAAGAUA | 10218 |
| 4971 | AUCUUUUUU GGAACUAA | 800 | UUAGUUCC CUGAUGAGGCCGUUAGGCCGAA AAAAAGAU | 10219 |
| 4978 | UUGGAACUA AAGCAAAU | 801 | AUUUGCUU CUGAUGAGGCCGUUAGGCCGAA AGUUCCAA | 10220 |
| 4987 | AAGCAAAUU UUAGACCU | 802 | AGGUCUAA CUGAUGAGGCCGUUAGGCCGAA AUUUGCUU | 10221 |
| 4988 | AGCAAAUUU UAGACCUU | 803 | AAGGUCUA CUGAUGAGGCCGUUAGGCCGAA AAUUUGCU | 10222 |
| 4989 | GCAAAUUUU AGACCUUU | 804 | AAAGGUCU CUGAUGAGGCCGUUAGGCCGAA AAAUUUGC | 10223 |
| 4990 | CAAAUUUUA GACCUUUA | 805 | UAAAGGUC CUGAUGAGGCCGUUAGGCCGAA AAAAUUUG | 10224 |
| 4996 | UUAGACCUU UACCUAUG | 806 | CAUAGGUA CUGAUGAGGCCGUUAGGCCGAA AGGUCUAA | 10225 |
| 4997 | UAGACCUUU ACCUAUGG | 807 | CCAUAGGU CUGAUGAGGCCGUUAGGCCGAA AAGGUCUA | 10226 |
| 4998 | AGACCUUUA CCUAUGGA | 808 | UCCAUAGG CUGAUGAGGCCGUUAGGCCGAA AAAGGUCU | 10227 |
| 5002 | CUUUACCUA UGGAAGUG | 809 | CACUUCCA CUGAUGAGGCCGUUAGGCCGAA AGGUAAAG | 10228 |
| 5013 | GAAGUGGUU CUAUGUCC | 810 | GGACAUAG CUGAUGAGGCCGUUAGGCCGAA ACCACUUC | 10229 |
| 5014 | AAGUGGUUC UAUGUCCA | 811 | UGGACAUA CUGAUGAGGCCGUUAGGCCGAA AACCACUU | 10230 |
| 5016 | GUGGUUCUA UGUCCAUU | 812 | AAUGGACA CUGAUGAGGCCGUUAGGCCGAA AGAACCAC | 10231 |
| 5020 | UUCUAUGUC CAUUCUCA | 813 | UGAGAAUG CUGAUGAGGCCGUUAGGCCGAA ACAUAGAA | 10232 |
| 5024 | AUGUCCAUU CUCAUUCG | 814 | CGAAUGAG CUGAUGAGGCCGUUAGGCCGAA AUGGACAU | 10233 |
| 5025 | UGUCCAUUC UCAUUCGU | 815 | ACGAAUGA CUGAUGAGGCCGUUAGGCCGAA AAUGGACA | 10234 |
| 5027 | UCCAUUCUC AUUCGUGG | 816 | CCACGAAU CUGAUGAGGCCGUUAGGCCGAA AGAAUGGA | 10235 |
| 5030 | AUUCUCAUU CGUGGCAU | 817 | AUGCCACG CUGAUGAGGCCGUUAGGCCGAA AUGAGAAU | 10236 |
| 5031 | UUCUCAUUC GUGGCAUG | 818 | CAUGCCAC CUGAUGAGGCCGUUAGGCCGAA AAUGAGAA | 10237 |
| 5041 | UGGCAUGUU UUGAUUUG | 819 | CAAAUCAA CUGAUGAGGCCGUUAGGCCGAA ACAUGCCA | 10238 |
| 5042 | GGCAUGUUU UGAUUUGU | 820 | ACAAAUCA CUGAUGAGGCCGUUAGGCCGAA AACAUGCC | 10239 |
| 5043 | GCAUGUUUU GAUUUGUA | 821 | UACAAAUC CUGAUGAGGCCGUUAGGCCGAA AAACAUGC | 10240 |
| 5047 | GUUUUGAUU UGUAGCAC | 822 | GUGCUACA CUGAUGAGGCCGUUAGGCCGAA AUCAAAAC | 10241 |
| 5048 | UUUUGAUUU GUAGCACU | 823 | AGUGCUAC CUGAUGAGGCCGUUAGGCCGAA AAUCAAAA | 10242 |
| 5051 | UGAUUUGUA GCACUGAG | 824 | CUCAGUGC CUGAUGAGGCCGUUAGGCCGAA ACAAAUCA | 10243 |
| 5069 | GUGGCACUC AACUCUGA | 825 | UCAGAGUU CUGAUGAGGCCGUUAGGCCGAA AGUGCCAC | 10244 |
| 5074 | ACUCAACUC UGAGCCCA | 826 | UGGGCUCA CUGAUGAGGCCGUUAGGCCGAA AGUUGAGU | 10245 |
| 5084 | GAGCCCAUA CUUUUGGC | 827 | GCCAAAAG CUGAUGAGGCCGUUAGGCCGAA AUGGGCUC | 10246 |
| 5087 | CCCAUACUU UUGGCUCC | 828 | GGAGCCAA CUGAUGAGGCCGUUAGGCCGAA AGUAUGGG | 10247 |
| 5088 | CCAUACUUU UGGCUCCU | 829 | AGGAGCCA CUGAUGAGGCCGUUAGGCCGAA AAGUAUGG | 10248 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 5089 | CAUACUUUU GGCUCCUC | 830 | GAGGAGCC CUGAUGAGGCCGUUAGGCCGAA AAAGUAUG | 10249 |
| 5094 | UUUUGGCUC CUCUAGUA | 831 | UACUAGAG CUGAUGAGGCCGUUAGGCCGAA AGCCAAAA | 10250 |
| 5097 | UGGCUCCUC UAGUAAGA | 832 | UCUUACUA CUGAUGAGGCCGUUAGGCCGAA AGGAGCCA | 10251 |
| 5099 | GCUCCUCUA GUAAGAUG | 833 | CAUCUUAC CUGAUGAGGCCGUUAGGCCGAA AGAGGAGC | 10252 |
| 5102 | CCUCUAGUA AGAUGCAC | 834 | GUGCAUCU CUGAUGAGGCCGUUAGGCCGAA ACUAGAGG | 10253 |
| 5119 | UGAAAACUU AGCCAGAG | 835 | CUCUGGCU CUGAUGAGGCCGUUAGGCCGAA AGUUUUCA | 10254 |
| 5120 | GAAAACUUA GCCAGAGU | 836 | ACUCUGGC CUGAUGAGGCCGUUAGGCCGAA AAGUUUUC | 10255 |
| 5129 | GCCAGAGUU AGGUUGUC | 837 | GACAACCU CUGAUGAGGCCGUUAGGCCGAA ACUCUGGC | 10256 |
| 5130 | CCAGAGUUA GGUUGUCU | 838 | AGACAACC CUGAUGAGGCCGUUAGGCCGAA AACUCUGG | 10257 |
| 5134 | AGUUAGGUU GUCUCCAG | 839 | CUGGAGAC CUGAUGAGGCCGUUAGGCCGAA ACCUAACU | 10258 |
| 5137 | UAGGUUGUC UCCAGGCC | 840 | GGCCUGGA CUGAUGAGGCCGUUAGGCCGAA ACAACCUA | 10259 |
| 5139 | GGUUGUCUC CAGGCCAU | 841 | AUGGCCUG CUGAUGAGGCCGUUAGGCCGAA AGACAACC | 10260 |
| 5156 | GAUGGCCUU ACACUGAA | 842 | UUCAGUGU CUGAUGAGGCCGUUAGGCCGAA AGGCCAUC | 10261 |
| 5157 | AUGGCCUUA CACUGAAA | 843 | UUUCAGUG CUGAUGAGGCCGUUAGGCCGAA AAGGCCAU | 10262 |
| 5170 | GAAAAUGUC ACAUUCUA | 844 | UAGAAUGU CUGAUGAGGCCGUUAGGCCGAA ACAUUUUC | 10263 |
| 5175 | UGUCACAUU CUAUUUUG | 845 | CAAAAUAG CUGAUGAGGCCGUUAGGCCGAA AUGUGACA | 10264 |
| 5176 | GUCACAUUC UAUUUUGG | 846 | CCAAAAUA CUGAUGAGGCCGUUAGGCCGAA AAUGUGAC | 10265 |
| 5178 | CACAUUCUA UUUUGGGU | 847 | ACCCAAAA CUGAUGAGGCCGUUAGGCCGAA AGAAUGUG | 10266 |
| 5180 | CAUUCUAUU UUGGGUAU | 848 | AUACCCAA CUGAUGAGGCCGUUAGGCCGAA AUAGAAUG | 10267 |
| 5181 | AUUCUAUUU UGGGUAUU | 849 | AAUACCCA CUGAUGAGGCCGUUAGGCCGAA AAUAGAAU | 10268 |
| 5182 | UUCUAUUUU GGGUAUUA | 850 | UAAUACCC CUGAUGAGGCCGUUAGGCCGAA AAAUAGAA | 10269 |
| 5187 | UUUUGGGUA UUAAUAUA | 851 | UAUAUUAA CUGAUGAGGCCGUUAGGCCGAA ACCCAAAA | 10270 |
| 5189 | UUGGGUAUU AAUAUAUA | 852 | UAUAUAUU CUGAUGAGGCCGUUAGGCCGAA AUACCCAA | 10271 |
| 5190 | UGGGUAUUA AUAUAUAG | 853 | CUAUAUAU CUGAUGAGGCCGUUAGGCCGAA AAUACCCA | 10272 |
| 5193 | GUAUUAAUA UAUAGUCC | 854 | GGACUAUA CUGAUGAGGCCGUUAGGCCGAA AUUAAUAC | 10273 |
| 5195 | AUUAAUAUA UAGUCCAG | 855 | CUGGACUA CUGAUGAGGCCGUUAGGCCGAA AUAUUAAU | 10274 |
| 5197 | UAAUAUAUA GUCCAGAC | 856 | GUCUGGAC CUGAUGAGGCCGUUAGGCCGAA AUAUAUUA | 10275 |
| 5200 | UAUAUAGUC CAGACACU | 857 | AGUCUGG CUGAUGAGGCCGUUAGGCCGAA ACUAUAUA | 10276 |
| 5209 | CAGACACUU AACUCAAU | 858 | AUUGAGUU CUGAUGAGGCCGUUAGGCCGAA AGUGUCUG | 10277 |
| 5210 | AGACACUUA ACUCAAUU | 859 | AAUUGAGU CUGAUGAGGCCGUUAGGCCGAA AAGUGUCU | 10278 |
| 5214 | ACUUAACUC AAUUUCUU | 860 | AAGAAAUU CUGAUGAGGCCGUUAGGCCGAA AGUUAAGU | 10279 |
| 5218 | AACUCAAUU UCUUGGUA | 861 | UACCAAGA CUGAUGAGGCCGUUAGGCCGAA AUUGAGUU | 10280 |
| 5219 | ACUCAAUUU CUUGGUAU | 862 | AUACCAAG CUGAUGAGGCCGUUAGGCCGAA AAUUGAGU | 10281 |
| 5220 | CUCAAUUUC UUGGUAUU | 863 | AAUACCAA CUGAUGAGGCCGUUAGGCCGAA AAAUUGAG | 10282 |
| 5222 | CAAUUUCUU GGUAUUAU | 864 | AUAAUACC CUGAUGAGGCCGUUAGGCCGAA AGAAAUUG | 10283 |
| 5226 | UUCUUGGUA UUAUUCUG | 865 | CAGAAUAA CUGAUGAGGCCGUUAGGCCGAA ACCAAGAA | 10284 |
| 5228 | CUUGGUAUU AUUCUGUU | 866 | AACAGAAU CUGAUGAGGCCGUUAGGCCGAA AUACCAAG | 10285 |

TABLE II-continued

Human flt1 VEGF Receptor—Hammerhead Ribozyme and Substrate Sequence

| Pos | Substrate | Seq ID No | HH Ribozyme | Seq ID No |
|---|---|---|---|---|
| 5229 | UUGGUAUUA UUCUGUUU | 867 | AAACAGAA CUGAUGAGGCCGUUAGGCCGAA AAUACCAA | 10286 |
| 5231 | GGUAUUAUU CUGUUUUG | 868 | CAAAACAG CUGAUGAGGCCGUUAGGCCGAA AUAAUACC | 10287 |
| 5232 | GUAUUAUUC UGUUUUGC | 869 | GCAAAACA CUGAUGAGGCCGUUAGGCCGAA AAUAAUAC | 10288 |
| 5236 | UAUUCUGUU UUGCACAG | 870 | CUGUGCAA CUGAUGAGGCCGUUAGGCCGAA ACAGAAUA | 10289 |
| 5237 | AUUCUGUUU UGCACAGU | 871 | ACUGUGCA CUGAUGAGGCCGUUAGGCCGAA AACAGAAU | 10290 |
| 5238 | UUCUGUUUU GCACAGUU | 872 | AACUGUGC CUGAUGAGGCCGUUAGGCCGAA AAACAGAA | 10291 |
| 5246 | UGCACAGUU AGUUGUGA | 873 | UCACAACU CUGAUGAGGCCGUUAGGCCGAA ACUGUGCA | 10292 |
| 5247 | GCACAGUUA GUUGUGAA | 874 | UUCACAAC CUGAUGAGGCCGUUAGGCCGAA AACUGUGC | 10293 |
| 5250 | CAGUUAGUU GUGAAAGA | 875 | UCUUUCAC CUGAUGAGGCCGUUAGGCCGAA ACUAACUG | 10294 |
| 5284 | AAUGCAGUC CUGAGGAG | 876 | CUCCUCAG CUGAUGAGGCCGUUAGGCCGAA ACUGCAUU | 10295 |
| 5296 | AGGAGAGUU UUCUCCAU | 877 | AUGGAGAA CUGAUGAGGCCGUUAGGCCGAA ACUCUCCU | 10296 |
| 5297 | GGAGAGUUU UCUCCAUA | 878 | UAUGGAGA CUGAUGAGGCCGUUAGGCCGAA AACUCUCC | 10297 |
| 5298 | GAGAGUUUU CUCCAUAU | 879 | AUAUGGAG CUGAUGAGGCCGUUAGGCCGAA AAACUCUC | 10298 |
| 5299 | AGAGUUUUC UCCAUAUC | 880 | GAUAUGGA CUGAUGAGGCCGUUAGGCCGAA AAAACUCU | 10299 |
| 5301 | AGUUUUCUC CAUAUCAA | 881 | UUGAUAUG CUGAUGAGGCCGUUAGGCCGAA AGAAAACU | 10300 |
| 5305 | UUCUCCAUA UCAAAACG | 882 | CGUUUUGA CUGAUGAGGCCGUUAGGCCGAA AUGGAGAA | 10301 |
| 5307 | CUCCAUAUC AAAACGAG | 883 | CUCGUUUU CUGAUGAGGCCGUUAGGCCGAA AUAUGGAG | 10302 |
| 5336 | AAAAAGGUC AAUAAGGU | 884 | ACCUUAUU CUGAUGAGGCCGUUAGGCCGAA ACCUUUUU | 10303 |
| 5340 | AGGUCAAUA AGGUCAAG | 885 | CUUGACCU CUGAUGAGGCCGUUAGGCCGAA AUUGACCU | 10304 |
| 5345 | AAUAAGGUC AAGGGAAG | 886 | CUUCCCUU CUGAUGAGGCCGUUAGGCCGAA ACCUUAUU | 10305 |
| 5361 | GACCCCGUC UCUAUACC | 887 | GGUAUAGA CUGAUGAGGCCGUUAGGCCGAA ACGGGGUC | 10306 |
| 5363 | CCCCGUCUC UAUACCAA | 888 | UUGGUAUA CUGAUGAGGCCGUUAGGCCGAA AGACGGGG | 10307 |
| 5365 | CCGUCUCUA UACCAACC | 889 | GGUUGGUA CUGAUGAGGCCGUUAGGCCGAA AGAGACGG | 10308 |
| 5367 | GUCUCUAUA CCAACCAA | 890 | UUGGUUGG CUGAUGAGGCCGUUAGGCCGAA AUAGAGAC | 10309 |
| 5382 | AAACCAAUU CACCAACA | 891 | UGUUGGUG CUGAUGAGGCCGUUAGGCCGAA AUUGGUUU | 10310 |
| 5383 | AACCAAUUC ACCAACAC | 892 | GUGUUGGU CUGAUGAGGCCGUUAGGCCGAA AAUUGGUU | 10311 |
| 5395 | AACACAGUU GGGACCCA | 893 | UGGGUCCC CUGAUGAGGCCGUUAGGCCGAA ACUGUGUU | 10312 |
| 5417 | CAGGAAGUC AGUCACGU | 894 | ACGUGACU CUGAUGAGGCCGUUAGGCCGAA ACUUCCUG | 10313 |
| 5421 | AAGUCAGUC ACGUUUCC | 895 | GGAAACGU CUGAUGAGGCCGUUAGGCCGAA ACUGACUU | 10314 |
| 5426 | AGUCACGUU UCCUUUUC | 896 | GAAAAGGA CUGAUGAGGCCGUUAGGCCGAA ACGUGACU | 10315 |
| 5427 | GUCACGUUU CCUUUUCA | 897 | UGAAAAGG CUGAUGAGGCCGUUAGGCCGAA AACGUGAC | 10316 |
| 5428 | UCACGUUUC CUUUUCAU | 898 | AUGAAAAG CUGAUGAGGCCGUUAGGCCGAA AAACGUGA | 10317 |
| 5431 | CGUUCCUU UUCAUUUA | 899 | UAAAUGAA CUGAUGAGGCCGUUAGGCCGAA AGGAAACG | 10318 |
| 5432 | GUUCCUUU UCAUUUAA | 900 | UUAAAUGA CUGAUGAGGCCGUUAGGCCGAA AAGGAAAC | 10319 |
| 5433 | UUCCUUUU CAUUUAAU | 901 | AUUAAAUG CUGAUGAGGCCGUUAGGCCGAA AAAGGAAA | 10320 |
| 5434 | UUCCUUUUC AUUUAAUG | 902 | CAUUAAAU CUGAUGAGGCCGUUAGGCCGAA AAAAGGAA | 10321 |
| 5437 | CUUUUCAUU UAAUGGGG | 903 | CCCCAUUA CUGAUGAGGCCGUUAGGCCGAA AUGAAAAG | 10322 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 5438 | UUUUCAUUU AAUGGGGA | 904 | UCCCCAUU CUGAUGAGGCCGUUAGGCCGAA AAUGAAAA | 10323 |
| 5439 | UUUCAUUUA AUGGGGAU | 905 | AUCCCCAU CUGAUGAGGCCGUUAGGCCGAA AAAUGAAA | 10324 |
| 5448 | AUGGGGAUU CCACUAUC | 906 | GAUAGUGG CUGAUGAGGCCGUUAGGCCGAA AUCCCCAU | 10325 |
| 5449 | UGGGGAUUC CACUAUCU | 907 | AGAUAGUG CUGAUGAGGCCGUUAGGCCGAA AAUCCCCA | 10326 |
| 5454 | AUUCCACUA UCUCACAC | 908 | GUGUGAGA CUGAUGAGGCCGUUAGGCCGAA AGUGGAAU | 10327 |
| 5456 | UCCACUAUC UCACACUA | 909 | UAGUGUGA CUGAUGAGGCCGUUAGGCCGAA AUAGUGGA | 10328 |
| 5458 | CACUAUCUC ACACUAAU | 910 | AUUAGUGU CUGAUGAGGCCGUUAGGCCGAA AGAUAGUG | 10329 |
| 5464 | CUCACACUA AUCUGAAA | 911 | UUUCAGAU CUGAUGAGGCCGUUAGGCCGAA AGUGUGAG | 10330 |
| 5467 | ACACUAAUC UGAAAGGA | 912 | UCCUUUCA CUGAUGAGGCCGUUAGGCCGAA AUUAGUGU | 10331 |
| 5489 | AAGAGCAUU AGCUGGCG | 913 | CGCCAGCU CUGAUGAGGCCGUUAGGCCGAA AUGCUCUU | 10332 |
| 5490 | AGAGCAUUA GCUGGCGC | 914 | GCGCCAGC CUGAUGAGGCCGUUAGGCCGAA AAUGCUCU | 10333 |
| 5501 | UGGCGCAUA UUAAGCAC | 915 | GUGCUUAA CUGAUGAGGCCGUUAGGCCGAA AUGCGCCA | 10334 |
| 5503 | GCGCAUAUU AAGCACUU | 916 | AAGUGCUU CUGAUGAGGCCGUUAGGCCGAA AUAUGCGC | 10335 |
| 5504 | CGCAUAUUA AGCACUUU | 917 | AAAGUGCU CUGAUGAGGCCGUUAGGCCGAA AAUAUGCG | 10336 |
| 5511 | UAAGCACUU UAAGCUCC | 918 | GGAGCUUA CUGAUGAGGCCGUUAGGCCGAA AGUGCUUA | 10337 |
| 5512 | AAGCACUUU AAGCUCCU | 919 | AGGAGCUU CUGAUGAGGCCGUUAGGCCGAA AAGUGCUU | 10338 |
| 5513 | AGCACUUUA AGCUCCUU | 920 | AAGGAGCU CUGAUGAGGCCGUUAGGCCGAA AAAGUGCU | 10339 |
| 5518 | UUUAAGCUC CUUGAGUA | 921 | UACUCAAG CUGAUGAGGCCGUUAGGCCGAA AGCUUAAA | 10340 |
| 5521 | AAGCUCCUU GAGUAAAA | 922 | UUUUACUC CUGAUGAGGCCGUUAGGCCGAA AGGAGCUU | 10341 |
| 5526 | CCUUGAGUA AAAGGUG | 923 | CACCUUUU CUGAUGAGGCCGUUAGGCCGAA ACUCAAGG | 10342 |
| 5537 | AAGGUGGUA UGUAAUUU | 924 | AAAUUACA CUGAUGAGGCCGUUAGGCCGAA ACCACCUU | 10343 |
| 5541 | UGGUAUGUA AUUUAUGC | 925 | GCAUAAAU CUGAUGAGGCCGUUAGGCCGAA ACAUACCA | 10344 |
| 5544 | UAUGUAAUU UAUGCAAG | 926 | CUUGCAUA CUGAUGAGGCCGUUAGGCCGAA AUUACAUA | 10345 |
| 5545 | AUGUAAUUU AUGCAAGG | 927 | CCUUGCAU CUGAUGAGGCCGUUAGGCCGAA AAUUACAU | 10346 |
| 5546 | UGUAAUUUA UGCAAGGU | 928 | ACCUUGCA CUGAUGAGGCCGUUAGGCCGAA AAAUUACA | 10347 |
| 5555 | UGCAAGGUA UUUCUCCA | 929 | UGGAGAAA CUGAUGAGGCCGUUAGGCCGAA ACCUUGCA | 10348 |
| 5557 | CAAGGUAUU UCUCCAGU | 930 | ACUGGAGA CUGAUGAGGCCGUUAGGCCGAA AUACCUUG | 10349 |
| 5558 | AAGGUAUUU CUCCAGUU | 931 | AACUGGAG CUGAUGAGGCCGUUAGGCCGAA AAUACCUU | 10350 |
| 5559 | AGGUAUUUC UCCAGUUG | 932 | CAACUGGA CUGAUGAGGCCGUUAGGCCGAA AAAUACCU | 10351 |
| 5561 | GUAUUUCUC CAGUUGGG | 933 | CCCAACUG CUGAUGAGGCCGUUAGGCCGAA AGAAAUAC | 10352 |
| 5566 | UCUCCAGUU GGGACUCA | 934 | UGAGUCCC CUGAUGAGGCCGUUAGGCCGAA ACUGGAGA | 10353 |
| 5573 | UUGGGACUC AGGAUAUU | 935 | AAUAUCCU CUGAUGAGGCCGUUAGGCCGAA AGUCCCAA | 10354 |
| 5579 | CUCAGGAUA UUAGUUAA | 936 | UUAACUAA CUGAUGAGGCCGUUAGGCCGAA AUCCUGAG | 10355 |
| 5581 | CAGGAUAUU AGUUAAUG | 937 | CAUUAACU CUGAUGAGGCCGUUAGGCCGAA AUAUCCUG | 10356 |
| 5582 | AGGAUAUUA GUUAAUGA | 938 | UCAUUAAC CUGAUGAGGCCGUUAGGCCGAA AAUAUCCU | 10357 |
| 5585 | AUAUUAGUU AAUGAGCC | 939 | GGCUCAUU CUGAUGAGGCCGUUAGGCCGAA ACUAAUAU | 10358 |
| 5586 | UAUUAGUUA AUGAGCCA | 940 | UGGCUCAU CUGAUGAGGCCGUUAGGCCGAA AACUAAUA | 10359 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 5596 | UGAGCCAUC ACUAGAAG | 941 | CUUCUAGU CUGAUGAGGCCGUUAGGCCGAA AUGGCUCA | 10360 |
| 5600 | CCAUCACUA GAAGAAAA | 942 | UUUUCUUC CUGAUGAGGCCGUUAGGCCGAA AGUGAUGG | 10361 |
| 5615 | AAGCCCAUU UUCAACUG | 943 | CAGUUGAA CUGAUGAGGCCGUUAGGCCGAA AUGGGCUU | 10362 |
| 5616 | AGCCCAUUU UCAACUGC | 944 | GCAGUUGA CUGAUGAGGCCGUUAGGCCGAA AAUGGGCU | 10363 |
| 5617 | GCCCAUUUU CAACUGCU | 945 | AGCACUUG CUGAUGAGGCCGUUAGGCCGAA AAAUGGGC | 10364 |
| 5618 | CCCAUUUUC AACUGCUU | 946 | AAGCAGUU CUGAUGAGGCCGUUAGGCCGAA AAAAUGGG | 10365 |
| 5626 | CAACUGCUU UGAAACUU | 947 | AAGUUUCA CUGAUGAGGCCGUUAGGCCGAA AGCAGUUG | 10366 |
| 5627 | AACUGCUUU GAAACUUG | 948 | CAAGUUUC CUGAUGAGGCCGUUAGGCCGAA AAGCAGUU | 10367 |
| 5634 | UUGAAACUU GCCUGGGG | 949 | CCCCAGGC CUGAUGAGGCCGUUAGGCCGAA AGUUUCAA | 10368 |
| 5644 | CCUGGGGUC UGAGCAUG | 950 | CAUGCUCA CUGAUGAGGCCGUUAGGCCGAA ACCCCAGG | 10369 |
| 5661 | AUGGGAAUA GGGAGACA | 951 | UGUCUCCC CUGAUGAGGCCGUUAGGCCGAA AUUCCCAU | 10370 |
| 5674 | GACAGGGUA GGAAAGGG | 952 | CCCUUUCC CUGAUGAGGCCGUUAGGCCGAA ACCCUGUC | 10371 |
| 5688 | GGGCGCCUA CUCUUCAG | 953 | CUGAAGAG CUGAUGAGGCCGUUAGGCCGAA AGGCGCCC | 10372 |
| 5691 | CGCCUACUC UUCAGGGU | 954 | ACCCUGAA CUGAUGAGGCCGUUAGGCCGAA AGUAGGCG | 10373 |
| 5693 | CCUACUCUU CAGGGUCU | 955 | AGACCCUG CUGAUGAGGCCGUUAGGCCGAA AGAGUAGG | 10374 |
| 5694 | CUACUCUUC AGGGUCUA | 956 | UAGACCCU CUGAUGAGGCCGUUAGGCCGAA AAGAGUAG | 10375 |
| 5700 | UUCAGGGUC UAAAGAUC | 957 | GAUCUUUA CUGAUGAGGCCGUUAGGCCGAA ACCCUGAA | 10376 |
| 5702 | CAGGGUCUA AAGAUCAA | 958 | UUGAUCUU CUGAUGAGGCCGUUAGGCCGAA AGACCCUG | 10377 |
| 5708 | CUAAAGAUC AAGUGGGC | 959 | GCCCACUU CUGAUGAGGCCGUUAGGCCGAA AUCUUUAG | 10378 |
| 5719 | GUGGGCCUU GGAUCGCU | 960 | AGCGAUCC CUGAUGAGGCCGUUAGGCCGAA AGGCCCAC | 10379 |
| 5724 | CCUUGGAUC GCUAAGCU | 961 | AGCUUAGC CUGAUGAGGCCGUUAGGCCGAA AUCCAAGG | 10380 |
| 5728 | GGAUCGCUA AGCUGGCU | 962 | AGCCAGCU CUGAUGAGGCCGUUAGGCCGAA AGCGAUCC | 10381 |
| 5737 | AGCUGGCUC UGUUUGAU | 963 | AUCAAACA CUGAUGAGGCCGUUAGGCCGAA AGCCAGCU | 10382 |
| 5741 | GGCUCUGUU UGAUGCUA | 964 | UAGCAUCA CUGAUGAGGCCGUUAGGCCGAA ACAGAGCC | 10383 |
| 5742 | GCUCUGUUU GAUGCUAU | 965 | AUAGCAUC CUGAUGAGGCCGUUAGGCCGAA AACAGAGC | 10384 |
| 5749 | UUGAUGCUA UUUAUGCA | 966 | UGCAUAAA CUGAUGAGGCCGUUAGGCCGAA AGCAUCAA | 10385 |
| 5751 | GAUGCUAUU UAUGCAAG | 967 | CUUGCAUA CUGAUGAGGCCGUUAGGCCGAA AUAGCAUC | 10386 |
| 5752 | AUGCUAUUU AUGCAAGU | 968 | ACUUGCAU CUGAUGAGGCCGUUAGGCCGAA AAUAGCAU | 10387 |
| 5753 | UGCUAUUUA UGCAAGUU | 969 | AACUUGCA CUGAUGAGGCCGUUAGGCCGAA AAAUAQCA | 10388 |
| 5761 | AUGCAAGUU AGGGUCUA | 970 | UAGACCCU CUGAUGAGGCCGUUAGGCCGAA ACUUGCAU | 10389 |
| 5762 | UGCAAGUUA GGGUCUAU | 971 | AUAGACCC CUGAUGAGGCCGUUAGGCCGAA AACUUGCA | 10390 |
| 5767 | GUUAGGGUC UAUGUAUU | 972 | AAUACAUA CUGAUGAGGCCGUUAGGCCGAA ACCCUAAC | 10391 |
| 5769 | UAGGGUCUA UGUAUUUA | 973 | UAAAUACA CUGAUGAGGCCGUUAGGCCGAA AGACCCUA | 10392 |
| 5773 | GUCUAUGUA UUUAGGAU | 974 | AUCCUAAA CUGAUGAGGCCGUUAGGCCGAA ACAUAGAC | 10393 |
| 5775 | CUAUGUAUU UAGGAUGC | 975 | GCAUCCUA CUGAUGAGGCCGUUAGGCCGAA AUACAUAG | 10394 |
| 5776 | UAUGUAUUU AGGAUGCG | 976 | CGCAUCCU CUGAUGAGGCCGUUAGGCCGAA AAUACAUA | 10395 |
| 5777 | AUGUAUUUA GGAUGCGC | 977 | GCGCAUCC CUGAUGAGGCCGUUAGGCCGAA AAAUACAU | 10396 |

TABLE II-continued

Human flt1 VEGF Receptor—Hammerhead Ribozyme and Substrate Sequence

| Pos | Substrate | Seq ID No | HH Ribozyme | Seq ID No |
|---|---|---|---|---|
| 5788 | AUGCGCCUA CUCUUCAG | 978 | CUGAAGAG CUGAUGAGGCCGUUAGGCCGAA AGGCGCAU | 10397 |
| 5791 | CGCCUACUC UUCAGGGU | 954 | ACCCUGAA CUGAUGAGGCCGUUAGGCCGAA AGUAGGCG | 10373 |
| 5793 | CCUACUCUU CAGGGUCU | 955 | AGACCCUG CUGAUGAGGCCGUUAGGCCGAA AGAGUAGG | 10374 |
| 5794 | CUACUCUUC AGGGUCUA | 956 | UAGACCOU CUGAUGAGGCCGUUAGGCCGAA AAGAGUAG | 10375 |
| 5800 | UUCAGGGUC UAAAGAUC | 957 | GAUCUUUA CUGAUGAGGCCGUUAGGCCGAA ACCCUGAA | 10376 |
| 5802 | CAGGGUCUA AAGAUCAA | 958 | UUGAUCUU CUGAUGAGGCCGUUAGGCCGAA AGACCCUG | 10377 |
| 5808 | CUAAAGAUC AAGUGGGC | 959 | GCCCACUU CUGAUGAGGCCGUUAGGCCGAA AUCUUUAG | 10378 |
| 5819 | GUGGGCCUU GGAUCGCU | 960 | AGCGAUCC CUGAUGAGGCCGUUAGGCCGAA AGGCCCAC | 10379 |
| 5824 | CCUUGGAUC GCUAAGCU | 961 | AGCUUAGC CUGAUGAGGCCGUUAGGCCGAA AUCCAAGG | 10380 |
| 5828 | GGAUCGCUA AGCUGGCU | 962 | AGCCAGCU CUGAUGAGGCCGUUAGGCCGAA AGCGAUCC | 10381 |
| 5837 | AGCUGGCUC UGUUUGAU | 963 | AUCAAACA CUGAUGAGGCCGUUAGGCCGAA AGCCAGCU | 10382 |
| 5841 | GGCUCUGUU UGAUGCUA | 964 | UAGCAUCA CUGAUGAGGCCGUUAGGCCGAA ACAGAGCC | 10383 |
| 5842 | GCUCUGUUU GAUGCUAU | 965 | AUAGCAUC CUGAUGAGGCCGUUAGGCCGAA AACAGAGC | 10384 |
| 5849 | UUGAUGCUA UUUAUGCA | 966 | UGCAUAAA CUGAUGAGGCCGUUAGGCCGAA AGCAUCAA | 10385 |
| 5851 | GAUGCUAUU UAUGCAAG | 967 | CUUGCAUA CUGAUGAGGCCGUUAGGCCGAA AUAGCAUC | 10386 |
| 5852 | AUGCUAUUU AUGCAAGU | 968 | ACUUCCAU CUGAUGAGGCCGUUAGGCCGAA AAUAGCAU | 10387 |
| 5853 | UGCUAUUUA UGCAAGUU | 969 | AACUUGCA CUGAUGAGGCCGUUAGGCCGAA AAAUAGCA | 10388 |
| 5861 | AUGCAAGUU AGGGUCUA | 970 | UAGACCCU CUGAUGAGGCCGUUAGGCCGAA ACUUGCAU | 10389 |
| 5862 | UGCAAGUUA GGGUCUAU | 971 | AUAGACCC CUGAUGAGGCCGUUAGGCCGAA AACUUGCA | 10390 |
| 5867 | GUUAGGGUC UAUGUAUU | 972 | AAUACAUA CUGAUGAGGCCGUUAGGCCGAA ACCCUAAC | 10391 |
| 5869 | UAGGGUCUA UGUAUUUA | 973 | UAAAUACA CUGAUGAGGCCGUUAGGCCGAA AGACCCUA | 10392 |
| 5873 | GUCUAUGUA UUUAGGAU | 974 | AUCCUAAA CUGAUGAGGCCGUUAGGCCGAA ACAUAGAC | 10393 |
| 5875 | CUAUGUAUU UAGGAUGU | 979 | ACAUCCUA CUGAUGAGGCCGUUAGGCCGAA AUACAUAG | 10398 |
| 5876 | UAUGUAUUU AGGAUGUC | 980 | GACAUCCU CUGAUGAGGCCGUUAGGCCGAA AAUACAUA | 10399 |
| 5877 | AUGUAUUUA GGAUGUCU | 981 | AGACAUCC CUGAUGAGGCCGUUAGGCCGAA AAAUACAU | 10400 |
| 5884 | UAGGAUGUC UGCACCUU | 982 | AAGGUGCA CUGAUGAGGCCGUUAGGCCGAA ACAUCCUA | 10401 |
| 5892 | CUGCACCUU CUGCAGCC | 983 | GGCUGCAG CUGAUGAGGCCGUUAGGCCGAA AGGUGCAG | 10402 |
| 5893 | UGCACCUUC UGCAGCCA | 984 | UGGCUGCA CUGAUGAGGCCGUUAGGCCGAA AAGGUGCA | 10403 |
| 5904 | CAGCCAGUC AGAAGCUG | 985 | CAGCUUCU CUGAUGAGGCCGUUAGGCCGAA ACUGGCUG | 10404 |
| 5930 | CAGUGGAUU GCUGCUUC | 986 | GAAGCAGC CUGAUGAGGCCGUUAGGCCGAA AUCCACUG | 10405 |
| 5937 | UUGCUGCUU CUUGGGGA | 987 | UCCCCAAG CUGAUGAGGCCGUUAGGCCGAA AGCAGCAA | 10406 |
| 5938 | UGCUGCUUC UUGGGGAG | 988 | CUCCCCAA CUGAUGAGGCCGUUAGGCCGAA AAGCAGCA | 10407 |
| 5940 | CUGCUUCUU GGGGAGAA | 989 | UUCUCCCC CUGAUGAGGCCGUUAGGCCGAA AGAAGCAG | 10408 |
| 5953 | AGAAGAGUA UGCUUCCU | 990 | AGGAAGCA CUGAUGAGGCCGUUAGGCCGAA ACUCUUCU | 10409 |
| 5958 | AGUAUGCUU CCUUUUAU | 991 | AUAAAAGG CUGAUGAGGCCGUUAGGCCGAA AGCAUACU | 10410 |
| 5959 | GUAUGCUUC CUUUUAUC | 992 | GAUAAAAG CUGAUGAGGCCGUUAGGCCGAA AAGCAUAC | 10411 |
| 5962 | UGCUUCCUU UUAUCCAU | 993 | AUGGAUAA CUGAUGAGGCCGUUAGGCCGAA AGGAAGCA | 10412 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 5963 | GCUUCCUUU UAUCCAUG | 994 | CAUGGAUA CUGAUGAGGCCGUUAGGCCGAA AAGGAAGC | 10413 |
| 5964 | CUUCCUUUU AUCCAUGU | 995 | ACAUGGAU CUGAUGAGGCCGUUAGGCCGAA AAAGGAAG | 10414 |
| 5965 | UUCCUUUUA UCCAUGUA | 996 | UACAUGGA CUGAUGAGGCCGUUAGGCCGAA AAAAGGAA | 10415 |
| 5967 | CCUUUUAUC CAUGUAAU | 997 | AUUACAUG CUGAUGAGGCCGUUAGGCCGAA AUAAAAGG | 10416 |
| 5973 | AUCCAUGUA AUUUAACU | 998 | AGUUAAAU CUGAUGAGGCCGUUAGGCCGAA ACAUGGAU | 10417 |
| 5976 | CAUGUAAUU UAACUGUA | 999 | UACAGUUA CUGAUGAGGCCGUUAGGCCGAA AUUACAUG | 10418 |
| 5977 | AUGUAAUUU AACUGUAG | 1000 | CUACAGUU CUGAUGAGGCCGUUAGGCCGAA AAUUACAU | 10419 |
| 5978 | UGUAAUUUA ACUGUAGA | 1001 | UCUACAGU CUGAUGAGGCCGUUAGGCCGAA AAAUUACA | 10420 |
| 5984 | UUAACUGUA GAACCUGA | 1002 | UCAGGUUC CUGAUGAGGCCGUUAGGCCGAA ACAGUUAA | 10421 |
| 5996 | CCUGAGCUC UAAGUAAC | 1003 | GUUACUUA CUGAUGAGGCCGUUAGGCCGAA AGCUCAGG | 10422 |
| 5998 | UGAGCUCUA AGUAACCG | 1004 | CGGUUACU CUGAUGAGGCCGUUAGGCCGAA AGAGCUCA | 10423 |
| 6002 | CUCUAAGUA ACCGAAGA | 1005 | UCUUCGGU CUGAUGAGGCCGUUAGGCCGAA ACUUAGAG | 10424 |
| 6015 | AAGAAUGUA UGCCUCUG | 1006 | CAGAGGCA CUGAUGAGGCCGUUAGGCCGAA ACAUUCUU | 10425 |
| 6021 | GUAUGCCUC UGUUCUUA | 1007 | UAAGAACA CUGAUGAGGCCGUUAGGCCGAA AGGCAUAC | 10426 |
| 6025 | GCCUCUGUU CUUAUGUG | 1008 | CACAUAAG CUGAUGAGGCCGUUAGGCCGAA ACAGAGGC | 10427 |
| 6026 | CCUCUGUUC UUAUGUGC | 1009 | GCACAUAA CUGAUGAGGCCGUUAGGCCGAA AACAGAGG | 10428 |
| 6028 | UCUGUUCUU AUGUGCCA | 1010 | UGGCACAU CUGAUGAGGCCGUUAGGCCGAA AGAACAGA | 10429 |
| 6029 | CUGUUCUUA UGUGCCAC | 1011 | GUGGCACA CUGAUGAGGCCGUUAGGCCGAA AAGAACAG | 10430 |
| 6040 | UGCCACAUC CUUGUUUA | 1012 | UAAACAAG CUGAUGAGGCCGUUAGGCCGAA AUGUGGCA | 10431 |
| 6043 | CACAUCCUU GUUUAAAG | 1013 | CUUUAAAC CUGAUGAGGCCGUUAGGCCGAA AGGAUGUG | 10432 |
| 6046 | AUCCUUGUU UAAAGGCU | 1014 | AGCCUUUA CUGAUGAGGCCGUUAGGCCGAA ACAAGGAU | 10433 |
| 6047 | UCCUUGUUU AAAGGCUC | 1015 | GAGCCUUU CUGAUGAGGCCGUUAGGCCGAA AACAAGGA | 10434 |
| 6048 | CCUUGUUUA AAGGCUCU | 1016 | AGAGCCUU CUGAUGAGGCCGUUAGGCCGAA AAACAAGG | 10435 |
| 6055 | UAAAGGCUC UCUGUAUG | 1017 | CAUACAGA CUGAUGAGGCCGUUAGGCCGAA AGCCUUUA | 10436 |
| 6057 | AAGGCUCUC UGUAUGAA | 1018 | UUCAUACA CUGAUGAGGCCGUUAGGCCGAA AGAGCCUU | 10437 |
| 6061 | CUCUCUGUA UGAAGAGA | 1019 | UCUCUUCA CUGAUGAGGCCGUUAGGCCGAA ACAGAGAG | 10438 |
| 6079 | GGGACCGUC AUCAGCAC | 1020 | GUGCUGAU CUGAUGAGGCCGUUAGGCCGAA ACGGUCCC | 10439 |
| 6082 | ACCGUCAUC AGCACAUU | 1021 | AAUGUGCU CUGAUGAGGCCGUUAGGCCGAA AUGACGGU | 10440 |
| 6090 | CAGCACAUU CCCUAGUG | 1022 | CACUAGGG CUGAUGAGGCCGUUAGGCCGAA AUGUGCUG | 10441 |
| 6091 | AGCACAUUC CCUAGUGA | 1023 | UCACUAGG CUGAUGAGGCCGUUAGGCCGAA AAUGUGCU | 10442 |
| 6095 | CAUUCCCUA GUGAGCCU | 1024 | AGGCUCAC CUGAUGAGGCCGUUAGGCCGAA AGGGAAUG | 10443 |
| 6104 | GUGAGCCUA CUGGCUCC | 1025 | GGAGCCAG CUGAUGAGGCCGUUAGGCCGAA AGGCUCAC | 10444 |
| 6111 | UACUGGCUC CUGGCAGC | 1026 | GCUGCCAG CUGAUGAGGCCGUUAGGCCGAA AGCCAGUA | 10445 |
| 6124 | CAGCGGCUU UUGUGGAA | 1027 | UUCCACAA CUGAUGAGGCCGUUAGGCCGAA AGCCGCUG | 10446 |
| 6125 | AGCGGCUUU UGUGGAAG | 1028 | CUUCCACA CUGAUGAGGCCGUUAGGCCGAA AAGCCGCU | 10447 |
| 6126 | GCGGCUUUU GUGGAAGA | 1029 | UCUUCCAC CUGAUGAGGCCGUUAGGCCGAA AAAGCCGC | 10448 |
| 6137 | GGAAGACUC ACUAGCCA | 1030 | UGGCUAGU CUGAUCAGGCCGUUAGGCCGAA AGUCUUCC | 10449 |

TABLE II-continued

Human flt1 VEGF Receptor—Hammerhead Ribozyme and Substrate Sequence

| Pos | Substrate | Seq ID No | HH Ribozyme | Seq ID No |
|---|---|---|---|---|
| 6141 | GACUCACUA GCCAGAAG | 1031 | CUUCUGGC CUGAUGAGGCCGUUAGGCCGAA AGUGAGUC | 10450 |
| 6166 | GGGACAGUC CUCUCCAC | 1032 | GUGGAGAG CUGAUGAGGCCGUUAGGCCGAA ACUGUCCC | 10451 |
| 6169 | ACAGUCCUC UCCACCAA | 1033 | UUGGUGGA CUGAUGAGGCCGUUAGGCCGAA AGGACUGU | 10452 |
| 6171 | AGUCCUCUC CACCAAGA | 1034 | UCUUCGUG CUGAUGAGGCCGUUAGGCCGAA AGAGGACU | 10453 |
| 6181 | ACCAAGAUC UAAAUCCA | 1035 | UGGAUUUA CUGAUGAGGCCGUUAGGCCGAA AUCUUGGU | 10454 |
| 6183 | CAAGAUCUA AAUCCAAA | 1036 | UUUGGAUU CUGAUGAGGCCGUUAGGCCGAA AGAUCUUG | 10455 |
| 6187 | AUCUAAAUC CAAACAAA | 1037 | UUUGUUUG CUGAUGAGGCCGUUAGGCCGAA AUUUAGAU | 10456 |
| 6204 | AGCAGGCUA GAGCCAGA | 1038 | UCUGGCUC CUGAUGAGGCCGUUAGGCCGAA AGCCUGCU | 10457 |
| 6226 | GGACAAAUC UUUGUUGU | 1039 | ACAACAAA CUGAUGAGGCCGUUAGGCCGAA AUUUGUCC | 10458 |
| 6228 | ACAAAUCUU UGUUGUUC | 1040 | GAACAACA CUGAUGAGGCCGUUAGGCCGAA AGAUUUGU | 10459 |
| 6229 | CAAAUCUUU GUUGUUCC | 1041 | GGAACAAC CUGAUGAGGCCGUUAGGCCGAA AAGAUUUG | 10460 |
| 6232 | AUCUUUGUU GUUCCUCU | 1042 | AGAGGAAC CUGAUGAGGCCGUUAGGCCGAA ACAAAGAU | 10461 |
| 6235 | UUUGUUGUU CCUCUUCU | 1043 | AGAAGAGG CUGAUGAGGCCGUUAGGCCGAA ACAACAAA | 10462 |
| 6236 | UUGUUGUUC CUCUUCUU | 1044 | AAGAAGAG CUGAUGAGGCCGUUAGGCCGAA AACAACAA | 10463 |
| 6239 | UUGUUCCUC UUCUUUAC | 1045 | GUAAAGAA CUGAUGAGGCCGUUAGGCCGAA AGGAACAA | 10464 |
| 6241 | GUUCCUCUU CUUUACAC | 1046 | GUGUAAAG CUGAUGAGGCCGUUAGGCCGAA AGAGGAAC | 10465 |
| 6242 | UUCCUCUUC UUUACACA | 1047 | UGUGUAAA CUGAUGAGGCCGUUAGGCCGAA AAGAGGAA | 10466 |
| 6244 | CCUCUUCUU UACACAUA | 1048 | UAUGUGUA CUGAUGAGGCCGUUAGGCCGAA AGAAGAGG | 10467 |
| 6245 | CUCUUCUUU ACACAUAC | 1049 | GUAUGUGU CUGAUGAGGCCGUUAGGCCGAA AAGAAGAG | 10468 |
| 6246 | UCUUCUUUA CACAUACG | 1050 | CGUAUGUG CUGAUGAGGCCGUUAGGCCGAA AAAGAAGA | 10469 |
| 6252 | UUACACAUA CGCAAACC | 1051 | GGUUUGCG CUGAUGAGGCCGUUAGGCCGAA AUGUGUAA | 10470 |
| 6280 | CUGGCAAUU UUAUAAAU | 1052 | AUUUAUAA CUGAUGAGGCCGUUAGGCCGAA AUUGCCAG | 10471 |
| 6281 | UGGCAAUUU UAUAAAUC | 1053 | GAUUUAUA CUGAUGAGGCCGUUAGGCCGAA AAUUGCCA | 10472 |
| 6282 | GGCAAUUUU AUAAAUCA | 1054 | UGAUUUAU CUGAUGAGGCCGUUAGGCCGAA AAAUUGCC | 10473 |
| 6283 | GCAAUUUUA UAAAUCAG | 1055 | CUGAUUUA CUGAUGAGGCCGUUAGGCCGAA AAAAUUGC | 10474 |
| 6285 | AAUUUUAUA AAUCAGGU | 1056 | ACCUGAUU CUGAUGAGGCCGUUAGGCCGAA AUAAAAUU | 10475 |
| 6289 | UUAUAAAUC AGGUAACU | 1057 | AGUUACCU CUGAUGAGGCCGUUAGGCCGAA AUUUAUAA | 10476 |
| 6294 | AAUCAGGUA ACUGGAAG | 1058 | CUUCCAGU CUGAUGAGGCCGUUAGGCCGAA ACCUGAUU | 10477 |
| 6308 | AAGGAGGUU AAACUCAG | 1059 | CUGAGUUU CUGAUGAGGCCGUUAGGCCGAA ACCUCCUU | 10478 |
| 6309 | AGGAGGUUA AACUCAGA | 1060 | UCUGAGUU CUGAUGAGGCCGUUAGGCCGAA AACCUCCU | 10479 |
| 6314 | GUUAAACUC AGAAAAAA | 1061 | UUUUUUCU CUGAUGAGGCCGUUAGGCCGAA AGUUUAAC | 10480 |
| 6331 | GAAGACCUC AGUCAAUU | 1062 | AAUUGACU CUGAUGAGGCCGUUAGGCCGAA AGGUCUUC | 10481 |
| 6335 | ACCUCAGUC AAUUCUCU | 1063 | AGAGAAUU CUGAUGAGGCCGUUAGGCCGAA ACUGAGGU | 10482 |
| 6339 | CAGUCAAUU CUCUACUU | 1064 | AAGUAGAG CUGAUGAGGCCGUUAGGCCGAA AUUGACUG | 10483 |
| 6340 | AGUCAAUUC UCUACUUU | 1065 | AAAGUAGA CUGAUGAGGCCGUUAGGCCGAA AAUUGACU | 10484 |
| 6342 | UCAAUUCUC UACUUUUU | 1066 | AAAAAGUA CUGAUGAGGCCGUUAGGCCGAA AGAAUUGA | 10485 |
| 6344 | AAUUCUCUA CUUUUUUU | 1067 | AAAAAAAG CUGAUGAGGCCGUUAGGCCGAA AGAGAAUU | 10486 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 6347 | UCUCUACUU UUUUUUUU | 1068 | AAAAAAAA CUGAUGAGGCCGUUAGGCCGAA AGUAGAGA | 10487 |
| 6348 | CUCUACUUU UUUUUUUU | 1069 | AAAAAAAA CUGAUGAGGCCGUUAGGCCGAA AAGUAGAG | 10488 |
| 6349 | UCUACUUUU UUUUUUUU | 1070 | AAAAAAAA CUGAUGAGGCCGUUAGGCCGAA AAAGUAGA | 10489 |
| 6350 | CUACUUUUU UUUUUUUU | 1071 | AAAAAAAA CUGAUGAGGCCGUUAGGCCGAA AAAAGUAG | 10490 |
| 6351 | UACUUUUUU UUUUUUUU | 1072 | AAAAAAAA CUGAUGAGGCCGUUAGGCCGAA AAAAAGUA | 10491 |
| 6352 | ACUUUUUUU UUUUUUUU | 1073 | AAAAAAAA CUGAUGAGGCCGUUAGGCCGAA AAAAAAGU | 10492 |
| 6353 | CUUUUUUUU UUUUUUUU | 1074 | AAAAAAAA CUGAUGAGGCCGUUAGGCCGAA AAAAAAAG | 10493 |
| 6354 | UUUUUUUUU UUUUUUUC | 1075 | GAAAAAAA CUGAUGAGGCCGUUAGGCCGAA AAAAAAAA | 10494 |
| 6355 | UUUUUUUUU UUUUUUCC | 1076 | GGAAAAAA CUGAUGAGGCCGUUAGGCCGAA AAAAAAAA | 10495 |
| 6356 | UUUUUUUUU UUUUUCCA | 1077 | UGGAAAAA CUGAUGAGGCCGUUAGGCCGAA AAAAAAAA | 10496 |
| 6357 | UUUUUUUUU UUUUCCAA | 1078 | UUGGAAAA CUGAUGAGGCCGUUAGGCCGAA AAAAAAAA | 10497 |
| 6358 | UUUUUUUUU UUUCCAAA | 1079 | UUUGGAAA CUGAUGAGGCCGUUAGGCCGAA AAAAAAAA | 10498 |
| 6359 | UUUUUUUUU UUCCAAAU | 1080 | AUUUGGAA CUGAUGAGGCCGUUAGGCCGAA AAAAAAAA | 10499 |
| 6360 | UUUUUUUUU UCCAAAUC | 1081 | GAUUUGGA CUGAUGAGGCCGUUAGGCCGAA AAAAAAAA | 10500 |
| 6361 | UUUUUUUUU CCAAAUCA | 1082 | UGAUUUGG CUGAUGAGGCCGUUAGGCCGAA AAAAAAAA | 10501 |
| 6362 | UUUUUUUUC CAAAUCAG | 1083 | CUGAUUUG CUGAUGAGGCCGUUAGGCCGAA AAAAAAAA | 10502 |
| 6368 | UUCCAAAUC AGAUAAUA | 1084 | UAUUAUCU CUGAUGAGGCCGUUAGGCCGAA AUUUGGAA | 10503 |
| 6373 | AAUCAGAUA AUAGCCCA | 1085 | UGGGCUAU CUGAUGAGGCCGUUAGGCCGAA AUCUGAUU | 10504 |
| 6376 | CAGAUAAUA GCCCAGCA | 1086 | UGCUGGGC CUGAUGAGGCCGUUAGGCCGAA AUUAUCUG | 10505 |
| 6388 | CAGCAAAUA GUGAUAAC | 1087 | GUUAUCAC CUGAUGAGGCCGUUAGGCCGAA AUUUGCUG | 10506 |
| 6394 | AUAGUGAUA ACAAAUAA | 1088 | UUAUUUGU CUGAUGAGGCCGUUAGGCCGAA AUCACUAU | 10507 |
| 6401 | UAACAAAUA AAACCUUA | 1089 | UAAGGUUU CUGAUGAGGCCGUUAGGCCGAA AUUUGUUA | 10508 |
| 6408 | UAAAACCUU AGCUGUUC | 1090 | GAACAGCU CUGAUGAGGCCGUUAGGCCGAA AGGUUUUA | 10509 |
| 6409 | AAAACCUUA GCUGUUCA | 1091 | UGAACAGC CUGAUGAGGCCGUUAGGCCGAA AAGGUUUU | 10510 |
| 6415 | UUAGCUGUU CAUGUCUU | 1092 | AAGACAUG CUGAUGAGGCCGUUAGGCCGAA ACAGCUAA | 10511 |
| 6416 | UAGCUGUUC AUGUCUUG | 1093 | CAAGACAU CUGAUGAGGCCGUUAGGCCGAA AACAGCUA | 10512 |
| 6421 | GUUCAUGUC UUGAUUUC | 1094 | GAAAUCAA CUGAUGAGGCCGUUAGGCCGAA ACAUGAAC | 10513 |
| 6423 | UCAUGUCUU GAUUUCAA | 1095 | UUGAAAUC CUGAUGAGGCCGUUAGGCCGAA AGACAUGA | 10514 |
| 6427 | GUCUUGAUU UCAAUAAU | 1096 | AUUAUUGA CUGAUGAGGCCGUUAGGCCGAA AUCAAGAC | 10515 |
| 6428 | UUCUGAUUU CAAUAAUU | 1097 | AAUUAUUG CUGAUGAGGCCGUUAGGCCGAA AAUCAAGA | 10516 |
| 6429 | CUUGAUUUC AAUAAUUA | 1098 | UAAUUAUU CUGAUGAGGCCGUUAGGCCGAA AAAUCAAG | 10517 |
| 6433 | AUUUCAAUA AUUAAUUC | 1099 | GAAUUAAU CUGAUGAGGCCGUUAGGCCGAA AUUGAAAU | 10518 |
| 6436 | UCAAUAAUU AAUUCUUA | 1100 | UAAGAAUU CUGAUGAGGCCGUUAGGCCGAA AUUAUUGA | 10519 |
| 6437 | CAAUAAUUA AUUCUUAA | 1101 | UUAAGAAU CUGAUGAGGCCGUUAGGCCGAA AAUUAUUG | 10520 |
| 6440 | UAAUUAAUU CUUAAUCA | 1102 | UGAUUAAG CUGAUGAGGCCGUUAGGCCGAA AUUAAUUA | 10521 |
| 6441 | AAUUAAUUC UUAAUCAU | 1103 | AUGAUUAA CUGAUGAGGCCGUUAGGCCGAA AAUUAAUU | 10522 |
| 6443 | UUAAUUCUU AAUCAUUA | 1104 | UAAUGAUU CUGAUGAGGCCGUUAGGCCGAA AGAAUUAA | 10523 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 6444 | UAAUUCUUA AUCAUUAA | 1105 | UUAAUGAU CUGAUGAGGCCGUUAGGCCGAA AAGAAUUA | 10524 |
| 6447 | UUCUUAAUC AUUAAGAG | 1106 | CUCUUAAU CUGAUGAGGCCGUUAGGCCGAA AUUAAGAA | 10525 |
| 6450 | UUAAUCAUU AAGAGACC | 1107 | GGUCUCUU CUGAUGAGGCCGUUAGGCCGAA AUGAUUAA | 10526 |
| 6451 | UAAUCAUUA AGAGACCA | 1108 | UGGUCUCU CUGAUGAGGCCGUUAGGCCGAA AAUGAUUA | 10527 |
| 6461 | GAGACCAUA AUAAAUAC | 1109 | GUAUUUAU CUGAUGAGGCCGUUAGGCCGAA AUGGUCUC | 10528 |
| 6464 | ACCAUAAUA AAUACUCC | 1110 | GGAGUAUU CUGAUGAGGCCGUUAGGCCGAA AUUAUGGU | 10529 |
| 6468 | UAAUAAAUA CUCCUUUU | 1111 | AAAAGGAG CUGAUGAGGCCGUUAGGCCGAA AUUUAUUA | 10530 |
| 6471 | UAAAUACUC CUUUUCAA | 1112 | UUGAAAAG CUGAUGAGGCCGUUAGGCCGAA AGUAUUUA | 10531 |
| 6474 | AUACUCCUU UUCAAGAG | 1113 | CUCUUGAA CUGAUGAGGCCGUUAGGCCGAA AGGAGUAU | 10532 |
| 6475 | UACUCCUUU UCAAGAGA | 1114 | UCUCUUGA CUGAUGAGGCCGUUAGGCCGAA AAGGAGUA | 10533 |
| 6476 | ACUCCUUUU CAAGAGAA | 1115 | UUCUCUUG CUGAUGAGGCCGUUAGGCCGAA AAAGGAGU | 10534 |
| 6477 | CUCCUUUUC AAGAGAAA | 1116 | UUUCUCUU CUGAUGAGGCCGUUAGGCCGAA AAAAGGAG | 10535 |
| 6497 | AAAACCAUU AGAAUUGU | 1117 | ACAAUUCU CUGAUGAGGCCGUUAGGCCGAA AUGGUUUU | 10536 |
| 6498 | AAACCAUUA GAAUUGUU | 1118 | AACAAUUC CUGAUGAGGCCGUUAGGCCGAA AAUGGUUU | 10537 |
| 6503 | AUUAGAAUU GUUACUCA | 1119 | UGAGUAAC CUGAUGAGGCCGUUAGGCCGAA AUUCUAAU | 10538 |
| 6506 | AGAAUUGUU ACUCAGCU | 1120 | AGCUGAGU CUGAUGAGGCCGUUAGGCCGAA ACAAUUCU | 10539 |
| 6507 | GAAUUGUUA CUCAGCUC | 1121 | GACCUGAG CUGAUGAGGCCGUUAGGCCGAA AACAAUUC | 10540 |
| 6510 | UUGUUACUC AGCUCCUU | 1122 | AAGGAGCU CUGAUGAGGCCGUUAGGCCGAA AGUAACAA | 10541 |
| 6515 | ACUCAGCUC CUUCAAAC | 1123 | GUUUGAAG CUGAUGAGGCCGUUAGGCCGAA AGCUGAGU | 10542 |
| 6518 | CAGCUCCUU CAAACUCA | 1124 | UGAGUUUG CUGAUGAGGCCGUUAGGCCGAA AGGAGCUG | 10543 |
| 6519 | AGCUCCUUC AAACUCAG | 1125 | CUGAGUUU CUGAUGAGGCCGUUAGGCCGAA AAGGAGCU | 10544 |
| 6525 | UUCAAACUC AGGUUUGU | 1126 | ACAAACCU CUGAUGAGGCCGUUAGGCCGAA AGUUUGAA | 10545 |
| 6530 | ACUCAGGUU UGUAGCAU | 1127 | AUGCUACA CUGAUGAGGCCGUUAGGCCGAA ACCUGAGU | 10546 |
| 6531 | CUCAGGUUU GUAGCAUA | 1128 | UAUGCUAC CUGAUGAGGCCGUUAGGCCGAA AACCUGAG | 10547 |
| 6534 | AGGUUUGUA GCAUACAU | 1129 | AUGUAUGC CUGAUGAGGCCGUUAGGCCGAA ACAAACCU | 10548 |
| 6539 | UUGUAGCAUA CAUGAGUC | 1130 | GACUCAUG CUGAUGAGGCCGUUAGGCCGAA AUGCUACA | 10549 |
| 6547 | ACAUGAGUC CAUCCAUC | 1131 | GAUGGAUG CUGAUGAGGCCGUUAGGCCGAA ACUCAUGU | 10550 |
| 6551 | GAGUCCAUC CAUCAGUC | 1132 | GACUGAUG CUGAUGAGGCCGUUAGGCCGAA AUGGACUC | 10551 |
| 6555 | CCAUCCAUC AGUCAAAG | 1133 | CUUUGACU CUGAUGAGGCCGUUAGGCCGAA AUGGAUGG | 10552 |
| 6559 | CCAUCAGUC AAAGAAUG | 1134 | CAUUCUUU CUGAUGAGGCCGUUAGGCCGAA ACUGAUGG | 10553 |
| 6570 | AGAAUGGUU CCAUCUGG | 1135 | CCAGAUGG CUGAUGAGGCCGUUAGGCCGAA ACCAUUCU | 10554 |
| 6571 | GAAUGGUUC CAUCUGGA | 1136 | UCCAGAUG CUGAUGAGGCCGUUAGGCCGAA AACCAUUC | 10555 |
| 6575 | GGUUCCAUC UGGAGUCU | 1137 | AGACUCCA CUGAUGAGGCCGUUAGGCCGAA AUGGAACC | 10556 |
| 6582 | UCUGCAGUC UUAAUGUA | 1138 | UACAUUAA CUGAUGAGGCCGUUAGGCCGAA ACUCCAGA | 10557 |
| 6584 | UGGAGUCUU AAUGUAGA | 1139 | UCUACAUU CUGAUGAGGCCGUUAGGCCGAA AGACUCCA | 10558 |
| 6585 | GGAGUCUUA AUGUAGAA | 1140 | UUCUACAU CUGAUGAGGCCGUUAGGCCGAA AAGACUCC | 10559 |
| 6590 | CUUAAUGUA GAAAGAAA | 1141 | UUUCUUUC CUGAUGAGGCCGUUAGGCCGAA ACAUUAAG | 10560 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 6609 | UGGAGACUU GUAAUAAU | 1142 | AUUAUUAC CUGAUGAG<u>GCCGUUAGGCC</u>GAA AGUCUCCA | 10561 |
| 6612 | AGACUUGUA AUAAUGAG | 1143 | CUCAUUAU CUGAUGAG<u>GCCGUUAGGCC</u>GAA ACAAGUCU | 10562 |
| 6615 | CUUGUAAUA AUGAGCUA | 1144 | UAGCUCAU CUGAUGAG<u>GCCGUUAGGCC</u>GAA AUUACAAG | 10563 |
| 6623 | AAUGAGCUA GUUACAAA | 1145 | UUUGUAAC CUGAUGAG<u>GCCGUUAGGCC</u>GAA AGCUCAUU | 10564 |
| 6626 | GAGCUAGUU ACAAAGUG | 1146 | CACUUUGU CUGAUGAG<u>GCCGUUAGGCC</u>GAA ACUAGCUC | 10565 |
| 6627 | AGCUAGUUA CAAAGUGC | 1147 | GCACUUUG CUGAUGAG<u>GCCGUUAGGCC</u>GAA AACUAGCU | 10566 |
| 6637 | AAAGUGCUU GUUCAUUA | 1148 | UAAUGAAC CUGAUGAG<u>GCCGUUAGGCC</u>GAA AGCACUUU | 10567 |
| 6640 | GUGCUUGUU CAUUAAAA | 1149 | UUUUAAUG CUGAUGAG<u>GCCGUUAGGCC</u>GAA ACAAGCAC | 10568 |
| 6641 | UGCUUGUUC AUUAAAAU | 1150 | AUUUUAAU CUGAUGAG<u>GCCGUUAGGCC</u>GAA AACAAGCA | 10569 |
| 6644 | UUGUUCAUU AAAAUAGC | 1151 | GCUAUUUU CUGAUGAG<u>GCCGUUAGGCC</u>GAA AUGAACAA | 10570 |
| 6645 | UGUUCAUUA AAAUAGCA | 1152 | UGCUAUUU CUGAUGAG<u>GCCGUUAGGCC</u>GAA AAUGAACA | 10571 |
| 6650 | AUUAAAAUA GCACUGAA | 1153 | UUCAGUGC CUGAUGAG<u>GCCGUUAGGCC</u>GAA AUUUUAAU | 10572 |
| 6662 | CUGAAAAUU GAAACAUG | 1154 | CAUGUUUC CUGAUGAG<u>GCCGUUAGGCC</u>GAA AUUUUCAG | 10573 |
| 6674 | ACAUGAAUU AACUGAUA | 1155 | UAUCAGUU CUGAUGAG<u>GCCGUUAGGCC</u>GAA AUUCAUGU | 10574 |
| 6675 | CAUGAAUUA ACUGAUAA | 1156 | UUAUCAGU CUGAUGAG<u>GCCGUUAGGCC</u>GAA AAUUCAUG | 10575 |
| 6682 | UAACUGAUA AUAUUCCA | 1157 | UGGAAUAU CUGAUGAG<u>GCCGUUAGGCC</u>GAA AUCAGUUA | 10576 |
| 6685 | CUGAUAAUA UUCCAAUC | 1158 | GAUUGGAA CUGAUGAG<u>GCCGUUAGGCC</u>GAA AUUAUCAG | 10577 |
| 6687 | GAUAAUAUU CCAAUCAU | 1159 | AUGAUUGG CUGAUGAG<u>GCCGUUAGGCC</u>GAA AUAUUAUC | 10578 |
| 6688 | AUAAUAUUC CAAUCAUU | 1160 | AAUGAUUG CUGAUGAG<u>GCCGUUAGGCC</u>GAA AAUAUUAU | 10579 |
| 6693 | AUUCCAAUC AUUUGCCA | 1161 | UGGCAAAU CUGAUGAG<u>GCCGUUAGGCC</u>GAA AUUGGAAU | 10580 |
| 6696 | CCAAUCAUU UGCCAUUU | 1162 | AAAUGGCA CUGAUGAG<u>GCCGUUAGGCC</u>GAA AUGAUUGG | 10581 |
| 6697 | CAAUCAUUU GCCAUUUA | 1163 | UAAAUGGC CUGAUGAG<u>GCCGUUAGGCC</u>GAA AAUGAUUG | 10582 |
| 6703 | UUUGCCAUU UAUGACAA | 1164 | UUGUCAUA CUGAUGAG<u>GCCGUUAGGCC</u>GAA AUGGCAAA | 10583 |
| 6704 | UUGCCAUUU AUGACAAA | 1165 | UUUGUCAU CUGAUGAG<u>GCCGUUAGGCC</u>GAA AAUGGCAA | 10584 |
| 6705 | UGCCAUUUA UGACAAAA | 1166 | UUUUGUCA CUGAUGAG<u>GCCGUUAGGCC</u>GAA AAAUGGCA | 10585 |
| 6719 | AAAAUGGUU GGCACUAA | 1167 | UUAGUGCC CUGAUGAG<u>GCCGUUAGGCC</u>GAA ACCAUUUU | 10586 |
| 6726 | UUGGCACUA ACAAAGAA | 1168 | UUCUUUGU CUGAUGAG<u>GCCGUUAGGCC</u>GAA AGUGCCAA | 10587 |
| 6743 | CGAGCACUU CCUUUCAG | 1169 | CUGAAAGG CUGAUGAG<u>GCCGUUAGGCC</u>GAA AGUGCUCG | 10588 |
| 6744 | GAGCACUUC CUUUCAGA | 1170 | UCUGAAAG CUGAUGAG<u>GCCGUUAGGCC</u>GAA AAGUGCUC | 10589 |
| 6747 | CACUUCCUU UCAGAGUU | 1171 | AACUCUGA CUGAUGAG<u>GCCGUUAGGCC</u>GAA AGGAAGUG | 10590 |
| 6748 | ACUUCCUUU CAGAGUUU | 1172 | AAACUCUG CUGAUGAG<u>GCCGUUAGGCC</u>GAA AAGGAAGU | 10591 |
| 6749 | CUUCCUUUC AGAGUUUC | 1173 | GAAACUCU CUGAUGAG<u>GCCGUUAGGCC</u>GAA AAAGGAAG | 10592 |
| 6755 | UUCAGAGUU UCUGAGAU | 1174 | AUCUCAGA CUGAUGAG<u>GCCGUUAGGCC</u>GAA ACUCUGAA | 10593 |
| 6756 | UCAGAGUUU CUGAGAUA | 1175 | CAUCUCAG CUGAUGAG<u>GCCGUUAGGCC</u>GAA AACUCUGA | 10594 |
| 6757 | CAGAGUUUC UGAGAUAA | 1176 | UUAUCUCA CUGAUGAG<u>GCCGUUAGGCC</u>GAA AAACUCUG | 10595 |
| 6764 | UCUGAGAUA AUGUACGU | 1177 | ACGUACAU CUGAUGAG<u>GCCGUUAGGCC</u>GAA AUCUCAGA | 10596 |
| 6769 | GAUAAUGUA CGUGGAAC | 1178 | GUUCCACG CUGAUGAG<u>GCCGUUAGGCC</u>GAA ACAUUAUC | 10597 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 6781 | GGAACAGUC UGGGUGGA | 1179 | UCCACCCA CUGAUGAGGCCGUUAGGCCGAA ACUGUUCC | 10598 |
| 6814 | GUGCAAGUC UGUGUCUU | 1180 | AAGACACA CUGAUGAGGCCGUUAGGCCGAA ACUUGCAC | 10599 |
| 6820 | GUCUGUGUC UUGUCAGU | 1181 | ACUGACAA CUGAUGAGGCCGUUAGGCCGAA ACACAGAC | 10600 |
| 6822 | CUGUGUCUU GUCAGUCC | 1182 | GGACUGAC CUGAUGAGGCCGUUAGGCCGAA AGACACAG | 10601 |
| 6825 | UGUCCUGUC AGUCCAAG | 1183 | CUUGGACU CUGAUGAGGCCGUUAGGCCGAA ACAAGACA | 10602 |
| 6829 | UUGUCAGUC CAAGAAGU | 1184 | ACUUCUUG CUGAUGAGGCCGUUAGGCCGAA ACUGACAA | 10603 |
| 6851 | CGAGAUGUU AAUUUUAG | 1185 | CUAAAAUU CUGAUGAGGCCGUUAGGCCGAA ACAUCUCG | 10604 |
| 6852 | GAGAUGUUA AUUUUAGG | 1186 | CCUAAAAU CUGAUGAGGCCGUUAGGCCGAA AACAUCUC | 10605 |
| 6855 | AUGUUAAUU UUAGGGAC | 1187 | GUCCCUAA CUGAUGAGGCCGUUAGGCCGAA AUUAACAU | 10606 |
| 6856 | UGUUAAUUU UAGGGACC | 1188 | GGUCCCUA CUGAUGAGGCCGUUAGGCCGAA AAUUAACA | 10607 |
| 6857 | GUUAAUUUU AGGGACCC | 1189 | GGGUCCCU CUGAUGAGGCCGUUAGGCCGAA AAAUUAAC | 10608 |
| 6858 | UUAAUUUUA GGGACCCG | 1190 | CGGGUCCC CUGAUGAGGCCGUUAGGCCGAA AAAAUUAA | 10609 |
| 6872 | CCGUGCCUU GUUUCCUA | 1191 | UAGGAAAC CUGAUGAGGCCGUUAGGCCGAA AGGCACGG | 10610 |
| 6875 | UGCCUUGUU UCCUAGCC | 1192 | GGCUAGGA CUGAUGAGGCCGUUAGGCCGAA ACAAGGCA | 10611 |
| 6876 | GCCUUGUUU CCUAGCCC | 1193 | GGGCUAGG CUGAUGAGGCCGUUAGGCCGAA AACAAGGC | 10612 |
| 6877 | CCUUGUUUC CUAGCCCA | 1194 | UGGGCUAG CUGAUGAGGCCGUUAGGCCGAA AAACAAGG | 10613 |
| 6880 | UGUUUCCUA GCCCACAA | 1195 | UUGUGGGC CUGAUGAGGCCGUUAGGCCGAA AGGAAACA | 10614 |
| 6901 | GCAAACAUC AAACAGAU | 1196 | AUCUGUUU CUGAUGAGGCCGUUAGGCCGAA AUGUUUGC | 10615 |
| 6910 | AAACAGAUA CUCGCUAG | 1197 | CUAGCGAG CUGAUGAGGCCGUUAGGCCGAA AUCUGUUU | 10616 |
| 6913 | CAGAUACUC GCUAGCCU | 1198 | AGGCUAGC CUGAUGAGGCCGUUAGGCCGAA AGUAUCUG | 10617 |
| 6917 | UACUCGCUA GCCUCAUU | 1199 | AAUGAGGC CUGAUGAGGCCGUUAGGCCGAA AGCGAGUA | 10618 |
| 6922 | GCUAGCCUC AUUUAAAU | 1200 | AUUUAAAU CUGAUGAGGCCGUUAGGCCGAA AGGCUAGC | 10619 |
| 6925 | AGCCUCAUU UAAAUUGA | 1201 | UCAAUUUA CUGAUGAGGCCGUUAGGCCGAA AUGAGGCU | 10620 |
| 6926 | GCCUCAUUU AAAUUGAU | 1202 | AUCAAUUU CUGAUGAGGCCGUUAGGCCGAA AAUGAGGC | 10621 |
| 6927 | CCUCAUUUA AAUUGAUU | 1203 | AAUCAAUU CUGAUGAGGCCGUUAGGCCGAA AAAUGAGG | 10622 |
| 6931 | AUUUAAAUU GAUUAAAG | 1204 | CUUUAAUC CUGAUGAGGCCGUUAGGCCGAA AUUUAAAU | 10623 |
| 6935 | AAAUUGAUU AAAGGAGG | 1205 | CCUCCUUU CUGAUGAGGCCGUUAGGCCGAA AUCAAUUU | 10624 |
| 6936 | AAUUGAUUA AAGGAGGA | 1206 | UCCUCCUU CUGAUGAGGCCGUUAGGCCGAA AAUCAAUU | 10625 |
| 6951 | GAGUGCAUC UUUGGCCG | 1207 | CGGCCAAA CUGAUGAGGCCGUUAGGCCGAA AUGCACUC | 10626 |
| 6953 | GUGCAUCUU UGGCCGAC | 1208 | GUCGGCCA CUGAUGAGGCCGUUAGGCCGAA AGAUGCAC | 10627 |
| 6954 | UGCAUCUUU GGCCGACA | 1209 | UGUCGGCC CUGAUGAGGCCGUUAGGCCGAA AAGAUGCA | 10628 |
| 6970 | AGUGGUGUA ACUGUGUG | 1210 | CACACAGU CUGAUGAGGCCGUUAGGCCGAA ACACCACU | 10629 |
| 7026 | GUGGGUGUA UGUGUGUU | 1211 | AACACACA CUGAUGAGGCCGUUAGGCCGAA ACACCCAC | 10630 |
| 7034 | AUGUGUGUU UUGUGCAU | 1212 | AUGCACAA CUGAUGAGGCCGUUAGGCCGAA ACACACAU | 10631 |
| 7035 | UGUGUGUUU UGUGCAUA | 1213 | UAUGCACA CUGAUGAGGCCGUUAGGCCGAA AACACACA | 10632 |
| 7036 | GUGUGUUUU GUGCAUAA | 1214 | UUAUGCAC CUGAUGAGGCCGUUAGGCCGAA AAACACAC | 10633 |
| 7043 | UUGUGCAUA ACUAUUUA | 1215 | UAAAUAGU CUGAUGAGGCCGUUAGGCCGAA AUGCACAA | 10634 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 7047 | GCAUAACUA UUUAAGGA | 1216 | UCCUUAAA CUGAUGAGGCCGUUAGGCCGAA AGUUAUGC | 10635 |
| 7049 | AUAACUAUU UAAGGAAA | 1217 | UUUCCUUA CUGAUGAGGCCGUUAGGCCGAA AUAGUUAU | 10636 |
| 7050 | UAACUAUUU AAGGAAAC | 1218 | GUUUCCUU CUGAUGAGGCCGUUAGGCCGAA AAUAGUUA | 10637 |
| 7051 | AACUAUUUA AGGAAACU | 1219 | AGUUUCCU CUGAUGAGGCCGUUAGGCCGAA AAAUAGUU | 10638 |
| 7065 | ACUGGAAUU UUAAAGUU | 1220 | AACUUUAA CUGAUGAGGCCGUUAGGCCGAA AUUCCAGU | 10639 |
| 7066 | CUGGAAUUU UAAAGUUA | 1221 | UAACUUUA CUGAUGAGGCCGUUAGGCCGAA AAUUCCAG | 10640 |
| 7067 | UGGAAUUUU AAAGUUAC | 1222 | GUAACUUU CUGAUGAGGCCGUUAGGCCGAA AAAUUCCA | 10641 |
| 7068 | GGAAUUUUA AAGUUACU | 1223 | AGUAACUU CUGAUGAGGCCGUUAGGCCGAA AAAAUUCC | 10642 |
| 7073 | UUUAAAGUU ACUUUUAU | 1224 | AUAAAAGU CUGAUGAGGCCGUUAGGCCGAA ACUUUAAA | 10643 |
| 7074 | UUAAAGUUA CUUUUAUA | 1225 | UAUAAAAG CUGAUGAGGCCGUUAGGCCGAA AACUUUAA | 10644 |
| 7077 | AAGUUACUU UUAUACAA | 1226 | UUGUAUAA CUGAUGAGGCCGUUAGGCCGAA AGUAACUU | 10645 |
| 7078 | AGUUACUUU UAUACAAA | 1227 | UUUGUAUA CUCAUGAGGCCGUUAGGCCGAA AAGUAACU | 10646 |
| 7079 | GUUACUUUU AUACAAAC | 1228 | GUUUGUAU CUGAUGAGGCCGUUAGGCCGAA AAAGUAAC | 10647 |
| 7080 | UUACUUUUA UACAAACC | 1229 | GGUUUGUA CUGAUGAGGCCGUUAGGCCGAA AAAAGUAA | 10648 |
| 7082 | ACUUUUAUA CAAACCAA | 1230 | UUGGUUUG CUGAUGAGGCCGUUAGGCCGAA AUAAAAGU | 10649 |
| 7095 | CCAAGAAUA UAUGCUAC | 1231 | GUAGCAUA CUGAUGAGGCCGUUAGGCCGAA AUUCUUGG | 10650 |
| 7097 | AAGAAUAUA UGCUACAG | 1232 | CUGUAGCA CUGAUGAGGCCGUUAGGCCGAA AUAUUCUU | 10651 |
| 7102 | UAUAUGCUA CAGAUAUA | 1233 | UAUAUCUG CUGAUGAGGCCGUUAGGCCGAA AGCAUAUA | 10652 |
| 7108 | CUACAGAUA UAAGACAG | 1234 | CUGUCUUA CUGAUGAGGCCGUUAGGCCGAA AUCUGUAG | 10653 |
| 7110 | ACAGAUAUA AGACAGAC | 1235 | GUCUGUCU CUGAUGAGGCCGUUAGGCCGAA AUAUCUGU | 10654 |
| 7124 | GACAUGGUU UGGUCCUA | 1236 | UAGGACCA CUGAUGAGGCCGUUAGGCCGAA ACCAUGUC | 10655 |
| 7125 | ACAUGGUUU GGUCCUAU | 1237 | AUAGGACC CUGAUGAGGCCGUUAGGCCGAA AACCAUGU | 10656 |
| 7129 | GGUUUGGUC UAUAUUU | 1238 | AAAUAUAG CUGAUGAGGCCGUUAGGCCGAA ACCAAACC | 10657 |
| 7132 | UUGGUCCUA UAUUUCUA | 1239 | UAGAAAUA CUGAUGAGGCCGUUAGGCCGAA AGGACCAA | 10658 |
| 7134 | UGUCCUAUA UUUCUAGU | 1240 | ACUAGAAA CUGAUGAGGCCGUUAGGCCGAA AUAGGACC | 10659 |
| 7136 | UCCUAUAUU UCUAGUCA | 1241 | UGACUAGA CUGAUGAGGCCGUUAGGCCGAA AUAUAGGA | 10660 |
| 7137 | CCUAUAUUU CUAGUCAU | 1242 | AUGACUAG CUGAUGAGGCCGUUAGGCCGAA AAUAUAGG | 10661 |
| 7138 | CUAUAUUUC UAGUCAUG | 1243 | CAUGACUA CUGAUGAGGCCGUUAGGCCGAA AAAUAUAG | 10662 |
| 7140 | AUAUUUCUA GUCAUGAU | 1244 | AUCAUGAC CUGAUGAGGCCGUUAGGCCGAA AGAAAUAU | 10663 |
| 7143 | UUUCUAGUC AUGAUGAA | 1245 | UUCAUCAU CUGAUGAGGCCGUUAGGCCGAA ACUAGAAA | 10664 |
| 7155 | AUGAAUGUA UUUUGUAU | 1246 | AUACAAAA CUGAUGAGGCCGUUAGGCCGAA ACAUUCAU | 10665 |
| 7157 | GAAUGUAUU UUGUAUAC | 1247 | GUAUACAA CUGAUGAGGCCGUUAGGCCGAA AUACAUUC | 10666 |
| 7158 | AAUGUAUUU UGUAUACC | 1248 | GGUAUACA CUGAUGAGGCCGUUAGGCCGAA AAUACAUU | 10667 |
| 7159 | AUGUAUUUU GUAUACCA | 1249 | UGGUAUAC CUGAUGAGGCCGUUAGGCCGAA AAAUACAU | 10668 |
| 7162 | UAUUUUGUA UACCAUCU | 1250 | AGAUGGUA CUGAUGAGGCCGUUAGGCCGAA ACAAAAUA | 10669 |
| 7164 | UUUUGUAUA CCAUCUUC | 1251 | GAAGAUGG CUGAUGAGGCCGUUAGGCCGAA AUACAAAA | 10670 |
| 7169 | UAUACCAUC UUCAUAUA | 1252 | UAUAUGAA CUGAUGAGGCCGUUAGGCCGAA AUGGUAUA | 10671 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 7171 | UACCAUCUU CAUAUAAU | 1253 | AUUAUAUG CUGAUGAGGCCGUUAGGCCGAA AGAUGGUA | 10672 |
| 7172 | ACCAUCUUC AUAUAAUA | 1254 | UAUUAUAU CUGAUGAGGCCGUUAGGCCGAA AAGAUGGU | 10673 |
| 7175 | AUCUUCAUA UAAUAUAC | 1255 | GUAUAUUA CUGAUGAGGCCGUUAGGCCGAA AUGAAGAU | 10674 |
| 7177 | CUUCAUAUA AUAUACUU | 1256 | AAGUAUAU CUGAUGAGGCCGUUAGGCCGAA AUAUGAAG | 10675 |
| 7180 | CAUAUAAUA UACUUAAA | 1257 | UUUAAGUA CUGAUGAGGCCGUUAGGCCGAA AUUAUAUG | 10676 |
| 7182 | UAUAAUAUA CUUAAAAA | 1258 | UUUUUAAG CUGAUGAGGCCGUUAGGCCGAA AUAUUAUA | 10677 |
| 7185 | AAUAUACUU AAAAAUAU | 1259 | AUAUUUUU CUGAUGAGGCCGUUAGGCCGAA AGUAUAUU | 10678 |
| 7186 | AUAUACUUA AAAAUAUU | 1260 | AAUAUUUU CUGAUGAGGCCGUUAGGCCGAA AAGUAUAU | 10679 |
| 7192 | UUAAAAAUA UUUCUUAA | 1261 | UUAAGAAA CUGAUGAGGCCGUUAGGCCGAA AUUUUUAA | 10680 |
| 7194 | AAAAAUAUU UCUUAAUU | 1262 | AAUUAAGA CUGAUGAGGCCGUUAGGCCGAA AUAUUUUU | 10681 |
| 7195 | AAAAUAUUU CUUAAUUG | 1263 | CAAUUAAG CUGAUGAGGCCGUUAGGCCGAA AAUAUUUU | 10682 |
| 7196 | AAAUAUUUC UUAAUUGG | 1264 | CCAAUUAA CUGAUGAGGCCGUUAGGCCGAA AAAUAUUU | 10683 |
| 7198 | AUAUUUCUU AAUUGGGA | 1265 | UCCCAAUU CUGAUGAGGCCGUUAGGCCGAA AGAAAUAU | 10684 |
| 7199 | UAUUUCUUA AUGGGAU | 1266 | AUCCCAAU CUGAUGAGGCCGUUAGGCCGAA AAGAAAUA | 10685 |
| 7202 | UUCUUAAUU GGGAUUUG | 1267 | CAAAUCCC CUGAUGAGGCCGUUAGGCCGAA AUUAAGAA | 10686 |
| 7208 | AUUGGGAUU UGUAAUCG | 1268 | CGAUUACA CUGAUGAGGCCGUUAGGCCGAA AUCCCAAU | 10687 |
| 7209 | UUGGGAUUU GUAAUCGU | 1269 | ACGAUUAC CUGAUGAGGCCGUUAGGCCGAA AAUCCCAA | 10688 |
| 7212 | GGAUUUGUA AUCGUACC | 1270 | GGUACGAU CUGAUGAGGCCGUUAGGCCGAA ACAAAUCC | 10689 |
| 7215 | UUUGUAAUC GUACCAAC | 1271 | GUUGGUAC CUGAUGAGGCCGUUAGGCCGAA AUUACAAA | 10690 |
| 7218 | GUAAUCGUA CCAACUUA | 1272 | UAAGUUGG CUGAUGAGGCCGUUAGGCCGAA ACGAUUAC | 10691 |
| 7225 | UACCAACUU AAUUGAUA | 1273 | UAUCAAUU CUGAUGAGGCCGUUAGGCCGAA AGUUGGUA | 10692 |
| 7226 | ACCAACUUA AUUGAUAA | 1274 | UUAUCAAU CUGAUGAGGCCGUUAGGCCGAA AAGUUGGU | 10693 |
| 7229 | AACUUAAUU GAUAAACU | 1275 | AGUUUAUC CUGAUGAGGCCGUUAGGCCGAA AUUAAGUU | 10694 |
| 7233 | UAAUUGAUA AACUUGGC | 1276 | GCCAAGUU CUGAUGAGGCCGUUAGGCCGAA AUCAAUUA | 10695 |
| 7238 | GAUAAACUU GGCAACUG | 1277 | CAGUUGCC CUGAUGAGGCCGUUAGGCCGAA AGUUUAUC | 10696 |
| 7249 | CAACUGCUU UUAUGUUC | 1278 | GAACAUAA CUGAUGAGGCCGUUAGGCCGAA AGCAGUUG | 10697 |
| 7250 | AACUGCUUU UAUGUUCU | 1279 | AGAACAUA CUGAUGAGGCCGUUAGGCCGAA AAGCAGUU | 10698 |
| 7251 | ACUGCUUUU AUGUUCUG | 1280 | CAGAACAU CUGAUGAGGCCGUUAGGCCGAA AAAGCAGU | 10699 |
| 7252 | CUGCUUUUA UGUUCUGU | 1281 | ACAGAACA CUGAUGAGGCCGUUAGGCCGAA AAAAGCAG | 10700 |
| 7256 | UUUUAUGUU CUGUCUCC | 1282 | GGAGACAG CUGAUGAGGCCGUUAGGCCGAA ACAUAAAA | 10701 |
| 7257 | UUUAUGUUC UGUCUCCU | 1283 | AGGAGACA CUGAUGAGGCCGUUAGGCCGAA AACAUAAA | 10702 |
| 7261 | UGUUCUGUC UCCUUCCA | 1284 | UGGAAGGA CUGAUGAGGCCGUUAGGCCGAA ACAGAACA | 10703 |
| 7263 | UUCUGUCUC CUUCCAUA | 1285 | UAUGGAAG CUGAUGAGGCCGUUAGGCCGAA AGACAGAA | 10704 |
| 7266 | UGUCCCUU CCAUAAAU | 1286 | AUUUAUGG CUGAUGAGGCCGUUAGGCCGAA AGGAGACA | 10705 |
| 7267 | GUCUCCUUC CAUAAAUU | 1287 | AAUUUAUG CUGAUGAGGCCGUUAGGCCGAA AAGGAGAC | 10706 |
| 7271 | CCUUCCAUA AAUUUUUC | 1288 | GAAAAAUU CUGAUGAGGCCGUUAGGCCGAA AUGGAAGG | 10707 |
| 7275 | CCAUAAAUU UUUCAAAA | 1289 | UUUUGAAA CUGAUGAGGCCGUUAGGCCGAA AUUUAUGG | 10708 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 7276 | CAUAAAUUU UUCAAAAU | 1290 | AUUUUGAA CUGAUGAGGCCGUUAGGCCGAA AAUUUAUG | 10709 |
| 7277 | AUAAAUUUU UCAAAAUA | 1291 | UAUUUUGA CUGAUGAGGCCGUUAGGCCGAA AAAUUUAU | 10710 |
| 7278 | UAAAUUUUU CAAAAUAC | 1292 | GUAUUUUG CUGAUGAGGCCGUUAGGCCGAA AAAAUUUA | 10711 |
| 7279 | AAAUUUUUC AAAAUACU | 1293 | AGUAUUUU CUGAUGAGGCCGUUAGGCCGAA AAAAAUUU | 10712 |
| 7285 | UUCAAAAUA CUAAUUCA | 1294 | UGAAUUAG CUGAUGAGGCCGUUAGGCCGAA AUUUUGAA | 10713 |
| 7288 | AAAAUACUA AUUCAACA | 1295 | UGUUGAAU CUGAUGAGGCCGUUAGGCCGAA AGUAUUUU | 10714 |
| 7291 | AUACUAAUU CAACAAAG | 1296 | CUUUGUUG CUGAUGAGGCCGUUAGGCCGAA AUUAGUAU | 10715 |
| 7292 | UACUAAUUC AACAAAGA | 1297 | UCUUUGUU CUGAUGAGGCCGUUAGGCCGAA AAUUAGUA | 10716 |
| 7308 | AAAAAGCUC UUUUUUUU | 1298 | AAAAAAAA CUGAUGAGGCCGUUAGGCCGAA AGCUUUUU | 10717 |
| 7310 | AAAGCUCUU UUUUUUCC | 1299 | GGAAAAAA CUGAUGAGGCCGUUAGGCCGAA AGAGCUUU | 10718 |
| 7311 | AAGCUCUUU UUUUUCCU | 1300 | AGGAAAAA CUGAUGAGGCCGUUAGGCCGAA AAGAGCUU | 10719 |
| 7312 | AGCUCUUUU UUUUCCUA | 1301 | UAGGAAAA CUGAUGAGGCCGUUAGGCCGAA AAAGAGCU | 10720 |
| 7313 | GCUCUUUUU UUUCCUAA | 1302 | UUAGGAAA CUGAUGAGGCCGUUAGGCCGAA AAAAGAGC | 10721 |
| 7314 | CUCUUUUUU UUCCUAAA | 1303 | UUUAGGAA CUGAUGAGGCCGUUAGGCCGAA AAAAAGAG | 10722 |
| 7315 | UCUUUUUUU UCCUAAAA | 1304 | UUUUAGGA CUGAUGAGGCCGUUAGGCCGAA AAAAAAGA | 10723 |
| 7316 | CUUUUUUUU CCUAAAAU | 1305 | AUUUUAGG CUGAUGAGGCCGUUAGGCCGAA AAAAAAAG | 10724 |
| 7317 | UUUUUUUUC CUAAAAUA | 1306 | UAUUUUAG CUGAUGAGGCCGUUAGGCCGAA AAAAAAAA | 10725 |
| 7320 | UUUUUCCUA AAAUAAAC | 1307 | GUUUAUUU CUGAUGAGGCCGUUAGGCCGAA AGGAAAAA | 10726 |
| 7325 | CCUAAAAUA AACUCAAA | 1308 | UUUGAGUU CUGAUGAGGCCGUUAGGCCGAA AUUUUAGG | 10727 |
| 7330 | AAUAAACUC AAAUUUAU | 1309 | AUAAAUUU CUGAUGAGGCCGUUAGGCCGAA AGUUUAUU | 10728 |
| 7335 | ACUCAAAUU UAUCCUUG | 1310 | CAAGGAUA CUGAUGAGGCCGUUAGGCCGAA AUUUGAGU | 10729 |
| 7336 | CUCAAAUUU AUCCUUGU | 1311 | ACAAGGAU CUGAUGAGGCCGUUAGGCCGAA AAUUUGAG | 10730 |
| 7337 | UCAAAUUUA UCCUUGUU | 1312 | AACAAGGA CUGAUGAGGCCGUUAGGCCGAA AAAUUUGA | 10731 |
| 7339 | AAAUUUAUC CUUGUUUA | 1313 | UAAACAAG CUGAUGAGGCCGUUAGGCCGAA AUAAAUUU | 10732 |
| 7342 | UUUAUCCUU GUUUAGAG | 1314 | CUCUAAAC CUGAUGAGGCCGUUAGGCCGAA AGGAUAAA | 10733 |
| 7345 | AUCCUUGUU UAGAGCAG | 1315 | CUGCUCUA CUGAUGAGGCCGUUAGGCCGAA ACAAGGAU | 10734 |
| 7346 | UCCUUGUUU AGAGCAGA | 1316 | UCUGCUCU CUGAUGAGGCCGUUAGGCCGAA AACAAGGA | 10735 |
| 7347 | CCUUGUUUA GAGCAGAG | 1317 | CUCUGCUC CUGAUGAGGCCGUUAGGCCGAA AAACAAGG | 10736 |
| 7362 | AGAAAAAUU AAGAAAAA | 1318 | UUUUUCUU CUGAUGAGGCCGUUAGGCCGAA AUUUUUCU | 10737 |
| 7363 | GAAAAAUUA AGAAAAAC | 1319 | GUUUUUCU CUGAUGAGGCCGUUAGGCCGAA AAUUUUUC | 10738 |
| 7373 | GAAAACUU UGAAAUGG | 1320 | CCAUUUCA CUGAUGAGGCCGUUAGGCCGAA AGUUUUUC | 10739 |
| 7374 | AAAAACUUU GAAAUGGU | 1321 | ACCAUUUC CUGAUGAGGCCGUUAGGCCGAA AAGUUUUU | 10740 |
| 7383 | GAAAUGGUC UCAAAAAA | 1322 | UUUUUUGA CUGAUGAGGCCGUUAGGCCGAA ACCAUUUC | 10741 |
| 7385 | AAUGGUCUC AAAAAAUU | 1323 | AAUUUUUU CUGAUGAGGCCGUUAGGCCGAA AGACCAUU | 10742 |
| 7393 | CAAAAAAUU GCUAAAUA | 1324 | UAUUUAGC CUGAUGAGGCCGUUAGGCCGAA AUUUUUUG | 10743 |
| 7397 | AAAUGCUA AAUAUUUU | 1325 | AAAAUAUU CUGAUGAGGCCGUUAGGCCGAA AGCAAUUU | 10744 |
| 7401 | UGCUAAAUA UUUUCAAU | 1326 | AUUGAAAA CUGAUGAGGCCGUUAGGCCGAA AUUUAGCA | 10745 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 7403 | CUAAAUAUU UUCAAUGG | 1327 | CCAUUGAA CUGAUGAGGCCGUUAGGCCGAA AUAUUUAG | 10746 |
| 7404 | UAAAUAUUU UCAAUGGA | 1328 | UCCAUUGA CUGAUGAGGCCGUUAGGCCGAA AAUAUUUA | 10747 |
| 7405 | AAAUAUUUU CAAUGGAA | 1329 | UUCCAUUG CUGAUGAGGCCGUUAGGCCGAA AAAUAUUU | 10748 |
| 7406 | AAUAUUUUC AAUGGAAA | 1330 | UUUCCAUU CUGAUGAGGCCGUUAGGCCGAA AAAAUAUU | 10749 |
| 7418 | GGAAAACUA AAUGUUAG | 1331 | CUAACAUU CUGAUGAGGCCGUUAGGCCGAA AGUUUUCC | 10750 |
| 7424 | CUAAAUGUU AGUUUAGC | 1332 | GCUAAACU CUGAUGAGGCCGUUAGGCCGAA ACAUUUAG | 10751 |
| 7425 | UAAAUGUUA GUUUAGCU | 1333 | AGCUAAAC CUGAUGAGGCCGUUAGGCCGAA AACAUUUA | 10752 |
| 7428 | AUGUUAGUU UAGCUGAU | 1334 | AUCAGCUA CUGAUGAGGCCGUUAGGCCGAA ACUAACAU | 10753 |
| 7429 | UGUUAGUUU AGCUGAUU | 1335 | AAUCAGCU CUGAUGAGGCCGUUAGGCCGAA AACUAACA | 10754 |
| 7430 | GUUAGUUUA GCUGAUUG | 1336 | CAAUCAGC CUGAUGAGGCCGUUAGGCCGAA AAACUAAC | 10755 |
| 7437 | UAGCUGAUU GUAUGGGG | 1337 | CCCCAUAC CUGAUGAGGCCGUUAGGCCGAA AUCAGCUA | 10756 |
| 7440 | CUGAUUGUA UGGGGUUU | 1338 | AAACCCCA CUGAUGAGGCCGUUAGGCCGAA ACAAUCAG | 10757 |
| 7447 | UAUGGGGUU UUCGAACC | 1339 | GGUUCGAA CUGAUGAGGCCGUUAGGCCGAA ACCCCAUA | 10758 |
| 7448 | AUGGGGUUU UCGAACCU | 1340 | AGGUUCGA CUGAUGAGGCCGUUAGGCCGAA AACCCCAU | 10759 |
| 7449 | UGGGGUUUU CGAACCUU | 1341 | AAGGUUCG CUGAUGAGGCCGUUAGGCCGAA AAACCCCA | 10760 |
| 7450 | GGGGUUUUC GAACCUUU | 1342 | AAAGGUUC CUGAUGAGGCCGUUAGGCCGAA AAAACCCC | 10761 |
| 7457 | UCGAACCUU UCACUUUU | 1343 | AAAAGUGA CUGAUGAGGCCGUUAGGCCGAA AGGUUCGA | 10762 |
| 7458 | CGAACCUUU CACUUUUU | 1344 | AAAAAGUG CUGAUGAGGCCGUUAGGCCGAA AAGGUUCG | 10763 |
| 7459 | GAACCUUUC ACUUUUUG | 1345 | CAAAAAGU CUGAUGAGGCCGUUAGGCCGAA AAAGGUUC | 10764 |
| 7463 | CUUUCACUU UUUGUUUG | 1346 | CAAACAAA CUGAUGAGGCCGUUAGGCCGAA AGUGAAAG | 10765 |
| 7464 | UUUCACUUU UUGUUUGU | 1347 | ACAAACAA CUGAUGAGGCCGUUAGGCCGAA AAGUGAAA | 10766 |
| 7465 | UUCACUUUU UGUUUGUU | 1348 | AACAAACA CUGAUGAGGCCGUUAGGCCGAA AAAGUGAA | 10767 |
| 7466 | UCACUUUUU GUUUGUUU | 1349 | AAACAAAC CUGAUGAGGCCGUUAGGCCGAA AAAAGUGA | 10768 |
| 7469 | CUUUUUGUU UGUUUUAC | 1350 | GUAAAACA CUGAUGAGGCCGUUAGGCCGAA ACAAAAAG | 10769 |
| 7470 | UUUUUGUUU GUUUUACC | 1351 | GGUAAAAC CUGAUGAGGCCGUUAGGCCGAA AACAAAAA | 10770 |
| 7473 | UUGUUUGUU UUACCUAU | 1352 | AUAGGUAA CUGAUGAGGCCGUUAGGCCGAA ACAAACAA | 10771 |
| 7474 | UGUUUGUUU UACCUAUU | 1353 | AAUAGGUA CUGAUGAGGCCGUUAGGCCGAA AACAAACA | 10772 |
| 7475 | GUUUGUUUU ACCUAUUU | 1354 | AAAUAGGU CUGAUGAGGCCGUUAGGCCGAA AAACAAAC | 10773 |
| 7476 | UUUGUUUUA CCUAUUUC | 1355 | GAAAUAGG CUGAUGAGGCCGUUAGGCCGAA AAAACAAA | 10774 |
| 7480 | UUUUACCUA UUUCACAA | 1356 | UUGUGAAA CUGAUGAGGCCGUUAGGCCGAA AGGUAAAA | 10775 |
| 7482 | UUACCUAUU UCACAACU | 1357 | AGUUGUGA CUGAUGAGGCCGUUAGGCCGAA AUAGGUAA | 10776 |
| 7483 | UACCUAUUU CACAACUG | 1358 | CAGUUGUG CUGAUGAGGCCGUUAGGCCGAA AAUAGGUA | 10777 |
| 7484 | ACCUAUUUC ACAACUGU | 1359 | ACAGUUGU CUGAUGAGGCCGUUAGGCCGAA AAAUAGGU | 10778 |
| 7495 | AACUGUGUA AAUUGCCA | 1360 | UGGCAAUU CUGAUGAGGCCGUUAGGCCGAA ACACAGUU | 10779 |
| 7499 | GUGUAAAUU GCCAAUAA | 1361 | UUAUUGGC CUGAUGAGGCCGUUAGGCCGAA AUUUACAC | 10780 |
| 7506 | UUGCCAAUA AUUCCUGU | 1362 | ACAGGAAU CUGAUGAGGCCGUUAGGCCGAA AUUGGCAA | 10781 |
| 7509 | CCAAUAUUU CCUGUCCA | 1363 | UGGACAGG CUGAUGAGGCCGUUAGGCCGAA AUUAUUGG | 10782 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 7510 | CAAUAAUUC CUGUCCAU | 1364 | AUGGACAG CUGAUGAGGCCGUUAGGCCGAA AAUUAUUG | 10783 |
| 7515 | AUUCCUGUC CAUGAAAA | 1365 | UUUUCAUG CUGAUGAGGCCGUUAGGCCGAA ACAGGAAU | 10784 |
| 7531 | AUGCAAAUU AUCCAGUG | 1366 | CACUGGAU CUGAUGAGGCCGUUAGGCCGAA AUUUGCAU | 10785 |
| 7532 | UGCAAAUUA UCCAGUGU | 1367 | ACACUGGA CUGAUGAGGCCGUUAGGCCGAA AAUUUGCA | 10786 |
| 7534 | CAAAUUAUC CAGUGUAG | 1368 | CUACACUG CUGAUGAGGCCGUUAGGCCGAA AUAAUUUG | 10787 |
| 7541 | UCCAGUGUA GAUAUAUU | 1369 | AAUAUAUC CUGAUGAGGCCGUUAGGCCGAA ACACUGGA | 10788 |
| 7545 | GUGUAGAUA UAUUUGAC | 1370 | GUCAAAUA CUGAUGAGGCCGUUAGGCCGAA AUCUACAC | 10789 |
| 7547 | GUAGAUAUA UUUGACCA | 1371 | UGGUCAAA CUGAUGAGGCCGUUAGGCCGAA AUAUCUAC | 10790 |
| 7549 | AGAUAUAUU UGACCAUC | 1372 | GAUGGUCA CUGAUGAGGCCGUUAGGCCGAA AUAUAUCU | 10791 |
| 7550 | GAUAUAUUU GACCAUCA | 1373 | UGAUGGUC CUGAUGAGGCCGUUAGGCCGAA AAUAUAUC | 10792 |
| 7557 | UUGACCAUC ACCCUAUG | 1374 | CAUAGGGU CUGAUGAGGCCGUUAGGCCGAA AUGGUCAA | 10793 |
| 7563 | AUCACCCUA UGGAUAUU | 1375 | AAUAUCCA CUGAUGAGGCCGUUAGGCCGAA AGGGUGAU | 10794 |
| 7569 | CUAUGGAUA UUGGCUAG | 1376 | CUAGCCAA CUGAUGAGGCCGUUAGGCCGAA AUCCAUAG | 10795 |
| 7571 | AUGGAUAUU GGCUAGUU | 1377 | AACUAGCC CUGAUGAGGCCGUUAGGCCGAA AUAUCCAU | 10796 |
| 7576 | UAUUGGCUA GUUUUGCC | 1378 | GGCAAAAC CUGAUGAGGCCGUUAGGCCGAA AGCCAAUA | 10797 |
| 7579 | UGGCUAGUU UUGCCUUU | 1379 | AAAGGCAA CUGAUGAGGCCGUUAGGCCGAA ACUAGCCA | 10798 |
| 7580 | GGCUAGUUU UGCCUUUA | 1380 | UAAAGGCA CUGAUGAGGCCGUUAGGCCGAA AACUAGCC | 10799 |
| 7581 | GCUAGUUUU GCCUUUAU | 1381 | AUAAAGGC CUGAUGAGGCCGUUAGGCCGAA AAACUAGC | 10800 |
| 7586 | UUUUGCCUU UAUUAAGC | 1382 | GCUUAAUA CUGAUGAGGCCGUUAGGCCGAA AGGCAAAA | 10801 |
| 7587 | UUUGCCUUU AUUAAGCA | 1383 | UGCUUAAU CUGAUGAGGCCGUUAGGCCGAA AAGGCAAA | 10802 |
| 7588 | UUGCCUUUA UUAAGCAA | 1384 | UUGCUUAA CUGAUGAGGCCGUUAGGCCGAA AAAGGCAA | 10803 |
| 7590 | GCCUUUAUU AAGCAAAU | 1385 | AUUUGCUU CUGAUGAGGCCGUUAGGCCGAA AUAAAGGC | 10804 |
| 7591 | CCUUUAUUA AGCAAAUU | 1386 | AAUUUGCU CUGAUGAGGCCGUUAGGCCGAA AAUAAAGG | 10805 |
| 7599 | AAGCAAAUU CAUUUCAG | 1387 | CUGAAAUG CUGAUGAGGCCGUUAGGCCGAA AUUUGCUU | 10806 |
| 7600 | AGCAAAUUC AUUUCAGC | 1388 | GCUGAAAU CUGAUGAGGCCGUUAGGCCGAA AAUUUGCU | 10807 |
| 7603 | AAAUUCAUU UCAGCCUG | 1389 | CAGGCUGA CUGAUGAGGCCGUUAGGCCGAA AUGAAUUU | 10808 |
| 7604 | AAUUCAUUU CAGCCUGA | 1390 | UCAGGCUG CUGAUGAGGCCGUUAGGCCGAA AAUGAAUU | 10809 |
| 7605 | AUUCAUUUC AGCCUGAA | 1391 | UUCAGGCU CUGAUGAGGCCGUUAGGCCGAA AAAUGAAU | 10810 |
| 7617 | CUGAAUGUC UGCCUAUA | 1392 | UAUAGGCA CUGAUGAGGCCGUUAGGCCGAA ACAUUCAG | 10811 |
| 7623 | GUCUGCCUA UAUAUUCU | 1393 | AGAAUAUA CUGAUGAGGCCGUUAGGCCGAA AGGCAGAC | 10812 |
| 7625 | CUGCCUAUA UAUUCUCU | 1394 | AGAGAAUA CUGAUGAGGCCGUUAGGCCGAA AUAGGCAG | 10813 |
| 7627 | GCCUAUAUA UUCUCUGC | 1395 | GCAGAGAA CUGAUGAGGCCGUUAGGCCGAA AUAUAGGC | 10814 |
| 7629 | CUAUAUAUU CUCUGCUC | 1396 | GAGCAGAG CUGAUGAGGCCGUUAGGCCGAA AUAUAUAG | 10815 |
| 7630 | UAUAUAUUC UCUGCUCU | 1397 | AGAGCAGA CUGAUGAGGCCGUUAGGCCGAA AAUAUAUA | 10816 |
| 7632 | UAUAUUCUC UGCUCUUU | 1398 | AAAGAGCA CUGAUGAGGCCGUUAGGCCGAA AGAAUAUA | 10817 |
| 7637 | UCUCUGCUC UUUGUAUU | 1399 | AAUACAAA CUGAUGAGGCCGUUAGGCCGAA AGCAGAGA | 10818 |
| 7639 | UCUGCUCUU UGUAUUCU | 1400 | AGAAUACA CUGAUGAGGCCGUUAGGCCGAA AGAGCAGA | 10819 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 7640 | CUGCUCUUU GUAUUCUC | 1401 | GAGAAUAC CUGAUGAG<u>GCCGUUAGGCC</u>GAA AAGAGCAG | 10820 |
| 7643 | CUCUUUGUA UUCUCCUU | 1402 | AAGGAGAA CUGAUGAG<u>GCCGUUAGGCC</u>GAA ACAAAGAG | 10821 |
| 7645 | CUUUGUAUU CUCCUUUG | 1403 | CAAAGGAG CUGAUGAG<u>GCCGUUAGGCC</u>GAA AUACAAAG | 10822 |
| 7646 | UUUGUAUUC UCCUUUGA | 1404 | UCAAAGGA CUGAUGAG<u>GCCGUUAGGCC</u>GAA AAUACAAA | 10823 |
| 7648 | UGUAUUCUC CUUUGAAC | 1405 | GUUCAAAG CUGAUGAG<u>GCCGUUAGGCC</u>GAA AGAAUACA | 10824 |
| 7651 | AUUCUCCUU UGAACCCG | 1406 | CGGGUUCA CUGAUGAG<u>GCCGUUAGGCC</u>GAA AGGAGAAU | 10825 |
| 7652 | UUCUCCUUU GAACCCGU | 1407 | ACGGGUUC CUGAUGAG<u>GCCGUUAGGCC</u>GAA AAGGAGAA | 10826 |
| 7661 | GAACCCGUU AAAACAUC | 1408 | GAUGUUUU CUGAUGAG<u>GCCGUUAGGCC</u>GAA ACGGGUUC | 10827 |
| 7662 | AACCCGUUA AAACAUCC | 1409 | GGAUGUUU CUGAUGAG<u>GCCGUUAGGCC</u>GAA AACGGGUU | 10828 |
| 7669 | UAAAACAUC CUGUGGCA | 1410 | UGCCACAG CUGAUGAG<u>GCCGUUAGGCC</u>GAA AUGUUUUA | 10829 |

Where "X" represents stem II region of a HH ribozyme (Hertel et al., 1992 Nucleic Acids Res. 20 3252). The length of stem II may be 2 base-pairs.
Underlined region can be any X sequence or linker, as described herein.

TABLE III

Human flt1 VEGF Receptor-Hairpin Ribozyme and Substrate sequence

| Pos | Substrate | Seq ID No | HP Ribozyme Sequence | Seq ID No |
|---|---|---|---|---|
| 16 | CCUCUCG GCU CCUCCCCG | 1411 | CGGGGAGG AGAA GAGAGG ACCAGAGAAACACACGUUGUGGUACAUUACCUGGUA | 10830 |
| 39 | GGCGGCG GCU CGGAGCGC | 1412 | CCGCUCCG AGAA GCCGCC ACCAGAGAAACACACGUUGUGGUACAUUACCUGGUA | 10831 |
| 180 | GACGACG GAC UCUGGCGG | 1413 | CCCCCAGA AGAA GUCCUC ACCAGAGAAACACACGUUGUGGUACAUUACCUGGUA | 10832 |
| 190 | UCUGGCG GCC GGGUCGUU | 1414 | AACGACCC AGAA GCCAGA ACCAGAGAAACACACGUUGUGGUACAUUACCUGGUA | 10833 |
| 278 | GGGUCCU GCU GUGCGCGC | 1415 | GCGCGCAC AGAA GGACCC ACCAGAGAAACACACGUUGUGGUACAUUACCUGGUA | 10834 |
| 290 | GCGCGCU GCU CAGCUGUC | 1416 | GACAUCUG AGAA GCGCGC ACCAGAGAAACACACGUUGUGGUACAUUACCUGGUA | 10835 |
| 295 | CUCCUCA GCU GUCUGCUU | 1417 | AAGCAGAC AGAA GAGCAG ACCAGAGAAACACACGUUGUGGUACAUUACCUGGUA | 10836 |
| 298 | CUCAGCU GUC UGCUUCUC | 1418 | GAGAAGCA AGAA GCUGAG ACCAGAGAAACACACGUUGUGGUACAUUACCUGGUA | 10837 |
| 302 | GCUGUCU GCU UCUCACAG | 1419 | CUGUGAGA AGAA GACAGC ACCAGAGAAACACACGUUGUGGUACAUUACCUGGUA | 10838 |
| 420 | GGAAGCA GCC CAUAAAUG | 1420 | CAUUUAUG AGAA GCUUCC ACCAGAGAAACACACGUUGUGGUACAUUACCUGGUA | 10839 |
| 486 | UAAAUCU GCC UGUGGAAG | 1421 | CUUCCACA AGAA GAUUUA ACCAGAGAAACACACGUUGUGGUACAUUACCUGGUA | 10840 |
| 537 | GAACACA GCU CAAGCAAA | 1422 | UUUGCUUG AGAA GUGUUC ACCAGAGAAACACACGUUGUGGUACAUUACCUGGUA | 10841 |
| 565 | UUCUACA GCU GCAAAUAU | 1423 | AUAUUUGC AGAA GUAGAA ACCAGAGAAACACACGUUGUGGUACAUUACCUGGUA | 10842 |
| 721 | AUUCCCU CCC GGGUUACG | 1424 | CGUAACCC AGAA GGGAAU ACCAGAGAAACACACGUUGUGGUACAUUACCUGGUA | 10843 |
| 786 | GAUCCCU GAU GGAAAACG | 1425 | CGUUUUCC AGAA GGGAUC ACCAGAGAAACACACGUUGUGGUACAUUACCUGGUA | 10844 |
| 863 | GGCUUCU GAC CUGUGAAG | 1426 | CUUCACAG AGAA GAAGCC ACCAGAGAAACACACGUUGUGGUACAUUACCUGGUA | 10845 |
| 1056 | UUACCCU GAU GAAAAAAA | 1427 | UUUUUUUC AGAA GGGUAA ACCAGAGAAACACACGUUGUGGUACAUUACCUGGUA | 10846 |
| 1301 | GCAAGCG GUC UUACCGGC | 1428 | GCCGGUAA AGAA GCUUGC ACCAGAGAAACACACGUUGUGGUACAUUACCUGGUA | 10847 |
| 1310 | CUUACCG GCU CUCUAUGA | 1429 | UCAUAGAG AGAA GGUAAG ACCAGAGAAACACACGUUGUGGUACAUUACCUGGUA | 10848 |
| 1389 | GAAAUCU GCU CGCUAUUU | 1430 | AAAUAGCG AGAA GAUUUC ACCAGAGAAACACACGUUGUGGUACAUUACCUGGUA | 10849 |

TABLE III-continued

Human flt1 VEGF Receptor-Hairpin Ribozyme and Substrate sequence

| Pos | Substrate | Seq ID No | HP Ribozyme Sequence | Seq ID No |
|---|---|---|---|---|
| 1535 | AACCCCA GAU UUACGAAA | 1431 | UUUCGUAA AGAA GGGGUU ACCAGAGAAACACACGUUGUGGUACAUUACCUGGUA | 10850 |
| 1566 | GUUUCCA GAC CCGGCUCU | 1432 | AGAGCCGG AGAA GGAAAC ACCAGAGAAACACACGUUGUGGUACAUUACCUGGUA | 10851 |
| 1572 | AGACCCG GCU CUCUACCC | 1433 | GGGUAGAG AGAA GGGUCU ACCAGAGAAACACACGUUGUGGUACAUUACCUGGUA | 10852 |
| 1604 | AAAUCCU GAC UUGUACCG | 1434 | CGGUACAA AGAA GGAUUU ACCAGAGAAACACACGUUGUGGUACAUUACCUGGUA | 10853 |
| 1824 | UGUGGCU GAC UCUAGAAU | 1435 | AUUCUAGA AGAA GCCACA ACCAGAGAAACACACGUUGUGGUACAUUACCUGGUA | 10854 |
| 1908 | UAUCACA GAU GUGCCAAA | 1436 | UUUGGCAC AGAA GUGAUA ACCAGAGAAACACACGUUGUGGUACAUUACCUGGUA | 10855 |
| 1949 | AAAUGCC GAC GGAAGGAG | 1437 | CUCCUUCC AGAA GCAUUU ACCAGAGAAACACACGUUGUGGUACAUUACCUGGUA | 10856 |
| 1973 | UGAAACU GUC UUGCACAG | 1438 | CUGUGCAA AGAA GUUUCA ACCAGAGAAACACACGUUGUGGUACAUUACCUGGUA | 10857 |
| 2275 | AUCACCA GUU CCACCACU | 1439 | AGUGGUGG AGAA GCUGAU ACCAGAGAAACACACGUUGUGGUACAUUACCUGGUA | 10858 |
| 2321 | AGCCUCA GAU CACUUGGU | 1440 | ACCAAGUG AGAA GAGGCU ACCAGAGAAACACACGUUGUGGUACAUUACCUGGUA | 10859 |
| 2396 | GCACGCU GUU UAUUGAAA | 1441 | UUUCAAUA AGAA GCGUGC ACCAGAGAAACACACGUUGUGGUACAUUACCUGGUA | 10860 |
| 2490 | CCUCACU GUU CAAGGAAC | 1442 | GUUCCUUG AGAA GUGAGG ACCAGAGAAACACACGUUGUGGUACAUUACCUGGUA | 10861 |
| 2525 | UGGAGCU GAU CACUCUAA | 1443 | UUAGAGUG AGAA GCUCCA ACCAGAGAAACACACGUUGUGGUACAUUACCUGGUA | 10862 |
| 2625 | AAAGACU GAC UACCUAUC | 1444 | GAUAGGUA AGAA GUCUUU ACCAGAGAAACACACGUUGUGGUACAUUACCUGGUA | 10863 |
| 2652 | GGACCCA GAU GAAGUUCC | 1445 | GGAACUUC AGAA GGGUCC ACCAGAGAAACACACGUUGUGGUACAUUACCUGGUA | 10864 |
| 2684 | GUGAGCG GCU CCCUUAUG | 1446 | CAUAAGGG AGAA GCUCAC ACCAGAGAAACACACGUUGUGGUACAUUACCUGGUA | 10865 |
| 2816 | CGUGCCG GAC UGUGGCUG | 1447 | CAGCCACA AGAA GGCACG ACCAGAGAAACACACGUUGUGGUACAUUACCUGGUA | 10866 |
| 2873 | AAGCUCU GAU GACUGAGC | 1448 | GCUCAGUC AGAA GAGCUU ACCAGAGAAACACACGUUGUGGUACAUUACCUGGUA | 10867 |
| 2930 | UUAACCU GCU GGGAGCCU | 1449 | AGGCUCCC AGAA GGUUAA ACCAGAGAAACACACGUUGUGGUACAUUACCUGGUA | 10868 |
| 2963 | GGCCUCU GAU GGUGAUUG | 1450 | CAAUCACC AGAA GAGGCC ACCAGAGAAACACACGUUGUGGUACAUUACCUGGUA | 10869 |
| 3157 | AGCUCCG GCU UUCAGGAA | 1451 | UUCCUGAA AGAA GGAGCU ACCAGAGAAACACACGUUGUGGUACAUUACCUGGUA | 10870 |
| 3207 | GGAUUCU GAC GGUUUCUA | 1452 | UAGAAACC AGAA GAAUCC ACCAGAGAAACACACGUUGUGGUACAUUACCUGGUA | 10871 |
| 3211 | UCUGACG GUU UCUACAAG | 1453 | CUUGUAGA AGAA GUCAGA ACCAGAGAAACACACGUUGUGGUACAUUACCUGGUA | 10872 |
| 3245 | AAGAUCU GAU UUCUUACA | 1454 | UGUAAGAA AGAA GAUCUG ACCAGAGAAACACACGUUGUGGUACAUUACCUGGUA | 10873 |
| 3256 | UCUUACA GUU UUCAAGUG | 1455 | CACUUGAA AGAA GUAAGA ACCAGAGAAACACACGUUGUGGUACAUUACCUGGUA | 10874 |
| 3287 | AGUUCCU GUC UUCCAGAA | 1456 | UUCUGGAA AGAA GGAACU ACCAGAGAAACACACGUUGUGGUACAUUACCUGGUA | 10875 |
| 3402 | GAACCCC GAU UAUGUGAG | 1457 | CUCACAUA AGAA GGGUUC ACCAGAGAAACACACGUUGUGGUACAUUACCUGGUA | 10876 |
| 3580 | UUUUGCA GUC GCCUGAGG | 1458 | CCUCAGGC AGAA GCAAAA ACCAGAGAAACACACGUUGUGGUACAUUACCUGGUA | 10877 |
| 3641 | UCUAUCA GAU CAUGCUGG | 1459 | CCAGCAUG AGAA GAUAGA ACCAGAGAAACACACGUUGUGGUACAUUACCUGGUA | 10878 |
| 3655 | CUGGACU GCU GGCACAGA | 1460 | UCUGUGCC AGAA GUCCAG ACCAGAGAAACACACGUUGUGGUACAUUACCUGGUA | 10879 |
| 3810 | AACUCCU GCC UUCUCUGA | 1461 | UCAGAGAA AGAA GGAGUU ACCAGAGAAACACACGUUGUGGUACAUUACCUGGUA | 10880 |
| 3846 | UAUUUCA GCU CCGAAGUU | 1462 | AACUUCGG AGAA GAAAUA ACCAGAGAAACACACGUUGUGGUACAUUACCUGGUA | 10881 |
| 3873 | AAGCUCU GAU GAUGUCAG | 1463 | CUGACAUC AGAA GAGCUU ACCAGAGAAACACACGUUGUGGUACAUUACCUGGUA | 10882 |
| 3995 | GCACUCU GUU GGCCUCUC | 1464 | GAGAGGCC AGAA GAGUGC ACCAGAGAAACACACGUUGUGGUACAUUACCUGGUA | 10883 |
| 4100 | CGGGGCU GUC UGAUGUCA | 1465 | UGACAUCA AGAA GCCCCG ACCAGAGAAACACACGUUGUGGUACAUUACCUGGUA | 10884 |
| 4104 | GCUGUCU GAU GUCAGCAG | 1466 | CUGCUGAC AGAA GACAGC ACCAGAGAAACACACGUUGUGGUACAUUACCUGGUA | 10885 |

TABLE III-continued

Human flt1 VEGF Receptor-Hairpin Ribozyme and Substrate sequence

| Pos | Substrate | Seq ID No | HP Ribozyme Sequence | Seq ID No |
|-----|-----------|-----------|----------------------|-----------|
| 4120 | AGGCCCA GUU UCUGCCAU | 1467 | AUGGCAGA AGAA GGGCCU ACCAGAGAAACACACGUUGUGGUACAUUACCUGGUA | 10886 |
| 4135 | CAUUCCA GCU GUGGGCAC | 1468 | GUGCCCAC AGAA GGAAUG ACCAGAGAAACACACGUUGUGGUACAUUACCUGGUA | 10887 |
| 4210 | GCGUGCU GCU CCCCGCCC | 1469 | GGGCGGGG AGAA GCACGC ACCAGAGAAACACACGUUGUGGUACAUUACCUGGUA | 10888 |
| 4217 | GCUCCCC GCC CCCAGACU | 1470 | AGUCUGG AGAA GGGAGC ACCAGAGAAACACACGUUGUGGUACAUUACCUGGUA | 10889 |
| 4224 | GCCCCCA GAC UACAACUC | 1471 | GAGUUGUA AGAA GGGGGC ACCAGAGAAACACACGUUGUGGUACAUUACCUGGUA | 10890 |
| 4382 | GGAGCCA GCU GCUUUUUG | 1472 | CAAAAAGC AGAA GGCUCC ACCAGAGAAACACACGUUGUGGUACAUUACCUGGUA | 10891 |
| 4385 | GCCAGCU GCU UUUUGUGA | 1473 | UCACAAAA AGAA GCUGGC ACCAGAGAAACACACGUUGUGGUACAUUACCUGGUA | 10892 |
| 4537 | CUUCCCU GCU CCAACCCC | 1474 | GGGGUUGG AGAA GGGAAG ACCAGAGAAACACACGUUGUGGUACAUUACCUGGUA | 10893 |
| 4573 | AGGACCA GUU UGAUUGAG | 1475 | CUCAAUCA AGAA GGUCCU ACCAGAGAAACACACGUUGUGGUACAUUACCUGGUA | 10894 |
| 4594 | CUGCACU GAU CACCCAAU | 1476 | AUUGGGUG AGAA GUGCAG ACCAGAGAAACACACGUUGUGGUACAUUACCUGGUA | 10895 |
| 4628 | UGGGCCA CCC CUGCAGCC | 1477 | GGCUGCAG AGAA GGCCCA ACCAGAGAAACACACGUUGUGGUACAUUACCUGGUA | 10896 |
| 4636 | CCCUGCA GCC CAAAACCC | 1478 | GGGUUUUG ACAA GCAGGG ACCAGACAAACACACGUUGUGGUACAUUACCUGGUA | 10897 |
| 4866 | CUUCCCA GCU CUGACCCU | 1479 | ACGGUCAG AGAA GGGAAG ACCACAGAAACACACQUUGUGGUACAUUACCUGGUA | 10898 |
| 4871 | CACCUCU CAC CCUUCUAC | 1480 | GUACAAGG AGAA GAGCUG ACCAGAGAAACACACGUUGUGGUACAUUACCUGGUA | 10899 |
| 4905 | AGGACCA GAU GGACAGCG | 1481 | CGCUGUCC AGAA GCUCCU ACCAGAGAAACACACGUUGUGGUACAUUACCUGGUA | 10900 |
| 5233 | UUAUUCU GUU UUCCACAG | 1482 | CUGUGCAA AGAA GAAUAA ACCAGAGAAACACACGUUGUGGUACAUUACCUGGUA | 10901 |
| 5281 | AAAUGCA GUC CUGAGGAG | 1483 | CUCCUCAG AGAA GCAUUU ACCAGAGAAACACACGUUGUGGUACAUUACCUGGUA | 10902 |
| 5319 | GAGGGCU GAU GGAGGAAA | 1484 | UUUCCUCC AGAA GCCCUC ACCAGAGAAACACACGUUGUGGUACAUUACCUGGUA | 10903 |
| 5358 | AGACCCC GUC UCUAUACC | 1485 | GGUAUAGA AGAA GGGUCU ACCAGAGAAACACACGUUGUGGUACAUUACCUGGUA | 10904 |
| 5392 | CAACACA GUU GGGACCCA | 1486 | UGGGUCCC AGAA GUGUUG ACCAGAGAAACACACGUUGUGGUACAUUACCUGGUA | 10905 |
| 5563 | UUCUCCA GUU GGGACUCA | 1487 | UGAGUCCC AGAA GGAGAA ACCAGAGAAACACACGUUGUGGUACAUUACCUGGUA | 10906 |
| 5622 | UUCAACU GCU UUGAAACU | 1488 | AGUUUCAA AGAA GUUGAA ACCAGAGAAACACACGUUGUGGUACAUUACCUGGUA | 10907 |
| 5738 | UGGCUCU GUU UGAUGCUA | 1489 | UAGCAUCA AGAA GAGCCA ACCAGAGAAACACACGUUGUGGUACAUUACCUGGUA | 10908 |
| 5838 | UGGCUCU GUU UGAUGCUA | 1489 | UAGCAUCA AGAA GAGCCA ACCAGAGAAACACACGUUGUGGUACAUUACCUGGUA | 10908 |
| 5933 | GAUUGCU GCU UCUGGGG | 1490 | CCCCAAGA AGAA GCAAUC ACCAGAGAAACACACGUUGUGGUACAUUACCUGGUA | 10909 |
| 6022 | UGCCUCU GUU CUUAUGUG | 1491 | CACAUAAG AGAA GAGGCA ACCAGAGAAACACACGUUGUGGUACAUUACCUGGUA | 10910 |
| 6120 | GGCAGCG GCU UCUGUGGA | 1492 | UCCACAAA AGAA GCUGCC ACCAGAGAAACACACGUUGUGGUACAUUACCUGGUA | 10911 |
| 6163 | UGGGACA GUC CUCUCCAC | 1493 | GUGGAGAG AGAA GUCCCA ACCAGAGAAACACACGUUGUGGUACAUUACCUGGUA | 10912 |
| 6270 | UGUGACA GCU GGCAAUUU | 1494 | AAAUUGCC AGAA GUCACA ACCAGAGAAACACACGUUGUGGUACAUUACCUGGUA | 10913 |
| 6412 | CUUAGCU GUU CAUGUCUU | 1495 | AAGACAUG AGAA GCUAAG ACCAGAGAAACACACGUUGUGGUACAUUACCUGGUA | 10914 |
| 6511 | UUACUCA GCU CCUUCAAA | 1496 | UUUGAAGG AGAA GAGUAA ACCAGAGAAACACACGUUGUGGUACAUUACCUGGUA | 10915 |
| 6778 | UGGAACA GUC UGGGUGGA | 1497 | UCCACCCA AGAA GUUCCA ACCAGAGAAACACACGUUGUGGUACAUUACCUGGUA | 10916 |
| 6826 | CUUGUCA GUC CAAGAAGU | 1498 | ACUUCUUG AGAA GACAAG ACCAGAGAAACACACGUUGUGGUACAUUACCUGGUA | 10917 |
| 7245 | GGCAACU GCU UUUAUGUU | 1499 | AACAUAAA AGAA GUUGCC ACCAGAGAAACACACGUUGUGGUACAUUACCUGGUA | 10918 |
| 7258 | AUGUUCU GUC UCCUUCCA | 1500 | UGGAAGGA AGAA GAACAU ACCAGAGAAACACACGUUGUGGUACAUUACCUGGUA | 10919 |
| 7433 | UUUAGCU GAU UGUAUGGG | 1501 | CCCAUACA AGAA GCUAAA ACCAGAGAAACACACGUUGUGGUACAUUACCUGGUA | 10920 |
| 7512 | AAUUCCU GUC CAUGAAAA | 1502 | UUUUCAUG AGAA GGAAUU ACCAGAGAAACACACGUUGUGGUACAUUACCUGGUA | 10921 |

TABLE III-continued

Human flt1 VEGF Receptor-Hairpin Ribozyme and Substrate sequence

| Pos | Substrate | Seq ID No | HP Ribozyme Sequence | Seq ID No |
|---|---|---|---|---|
| 7606 | CAUUUCA CCC UGAAUGUC | 1503 | GACAUUCA AGAA GAAAUG ACCAGAGAAACACACGUUGUGGUACAUUACCUGGUA | 10922 |
| 7618 | AAUGUCU CCC UAUAUAUU | 1504 | AAUAUAUA AGAA GACAUU ACCAGAGAAACACACGUUGUGGUACAUUACCUGGUA | 10923 |
| 7633 | AUUCUCU GCU CUUUGUAU | 1505 | AUACAAAG AGAA GAGAAU ACCAGAGAAACACACGUUGUGGUACAUUACCUGGUA | 10924 |

TABLE IV

Human KDR VEGF Receptor-Hammerhead Ribozyme and Substrate Sequence

| Pos | Substrate | Seq ID No | HH Ribozyme Sequence | Seq ID No |
|---|---|---|---|---|
| 21 | CUGGCCGUC GCCCUGUG | 1506 | CACAGGGC CUGAUGAGGCCGUUAGGCCGAA ACGGCCAG | 10925 |
| 33 | CUGUGGCUC UGCGUGGA | 1507 | UCCACGCA CUGAUGAGGCCGUUAGGCCGAA AGCCACAG | 10926 |
| 56 | GGCCGCCUC UGUGGGUU | 1508 | AACCCACA CUGAUGAGGCCGUUAGGCCGAA AGGCGGCC | 10927 |
| 64 | CUGUGGGUU UGCCUAGU | 1509 | ACUAGGCA CUGAUGAGGCCGUUAGGCCGAA ACCCACAG | 10928 |
| 65 | UGUGGGUUU GCCUAGUG | 1510 | CACUAGGC CUGAUGAGGCCGUUAGGCCGAA AACCCACA | 10929 |
| 70 | GUUUGCCUA GUGUUUCU | 1511 | AGAAACAC CUGAUGAGGCCGUUAGGCCGAA AGGCAAAC | 10930 |
| 75 | CCUAGUGUU UCUCUUGA | 1512 | UCAAGAGA CUGAUGAGGCCGUUAGGCCGAA ACACUAGG | 10931 |
| 76 | CUAGUGUUU CUCUUGAU | 1513 | AUCAAGAG CUGAUGAGGCCGUUAGGCCGAA AACACUAG | 10932 |
| 77 | UAGUGUUUC UCUUGAUC | 1514 | GAUCAAGA CUGAUGAGGCCGUUAGGCCGAA AAACACUA | 10933 |
| 79 | GUGUUUCUC UUGAUCUG | 1515 | CAGAUCAA CUGAUGAGGCCGUUAGGCCGAA AGAAACAC | 10934 |
| 81 | GUUUCUCUU GAUCUGCC | 1516 | GGCAGAUC CUGAUGAGGCCGUUAGGCCGAA AGAGAAAC | 10935 |
| 85 | CUCUUGAUC UGCCCAGG | 1517 | CCUGGGCA CUGAUGAGGCCGUUAGGCCGAA AUCAAGAG | 10936 |
| 96 | CCCAGGCUC AGCAUACA | 1518 | UGUAUGCU CUGAUGAGGCCGUUAGGCCGAA AGCCUGGG | 10937 |
| 102 | CUCAGCAUA CAAAAGA | 1519 | UCUUUUG CUGAUGAGGCCGUUAGGCCGAA AUGCUGAG | 10938 |
| 114 | AAAGACAUA CUUACAAU | 1520 | AUUGUAAG CUGAUGAGGCCGUUAGGCCGAA AUGUCUUU | 10939 |
| 117 | GACAUACUU ACAAUUAA | 1521 | UUAAUUGU CUGAUGAGGCCGUUAGGCCGAA AGUAUGUC | 10940 |
| 118 | ACAUACUUA CAAUUAAG | 1522 | CUUAAUUG CUGAUGAGGCCGUUAGGCCGAA AAGUAUGU | 10941 |
| 123 | CUUACAAUU AAGGCUAA | 1523 | UUAGCCUU CUGAUGAGGCCGUUAGGCCGAA AUUGUAAG | 10942 |
| 124 | UUACAAUUA AGGCUAAU | 1524 | AUUAGCCU CUGAUGAGGCCGUUAGGCCGAA AAUUGUAA | 10943 |
| 130 | UUAAGGCUA AUACAACU | 1525 | AGUUGUAU CUGAUGAGGCCGUUAGGCCGAA AGCCUUAA | 10944 |
| 133 | AGGCUAAUA CAACUCUU | 1526 | AAGAGUUG CUGAUGAGGCCGUUAGGCCGAA AUUAGCCU | 10945 |
| 139 | AUACAACUC UUCAAAUU | 1527 | AAUUUGAA CUGAUGAGGCCGUUAGGCCGAA AGUUGUAU | 10946 |
| 141 | ACAACUCUU CAAAUUAC | 1528 | GUAAUUUG CUGAUGAGGCCGUUAGGCCGAA AGAGUUGU | 10947 |
| 142 | CAACUCUUC AAAUUACU | 1529 | AGUAAUUU CUGAUGAGGCCGUUAGGCCGAA AAGAGUUG | 10948 |
| 147 | CUUCAAAUU ACUUGCAG | 1530 | CUGCAAGU CUGAUGAGGCCGUUAGGCCGAA AUUUGAAG | 10949 |
| 148 | UUCAAAUUA CUUGCAGG | 1531 | CCUGCAAG CUGAUGAGGCCGUUAGGCCGAA AAUUUGAA | 10950 |
| 151 | AAAUUACUU GCAGGGA | 1532 | UCCCCGC CUGAUGAGGCCGUUAGGCCGAA AGUAAUUU | 10951 |
| 170 | GAGGGACUU GGACUGGC | 1533 | GCCAGUCC CUGAUGAGGCCGUUAGGCCGAA AGUCCCUC | 10952 |

TABLE IV-continued

Human KDR VEGF Receptor-Hammerhead Ribozyme and Substrate Sequence

| Pos | Substrate | Seq ID No | HH Ribozyme Sequence | Seq ID No |
|-----|-----------|-----------|----------------------|-----------|
| 180 | GACUGGCUU UGGCCCAA | 1534 | UUGGGCCA CUGAUGAGGCCGUUAGGCCGAA AGCCAGUC | 10953 |
| 181 | ACUGGCUUU GGCCCAAU | 1535 | AUUGGGCC CUGAUGAGGCCGUUAGGCCGAA AAGCCAGU | 10954 |
| 190 | GGCCCAAUA AUCAGAGU | 1536 | ACUCUGAU CUGAUGAGGCCGUUAGGCCGAA AUUGGGCC | 10955 |
| 193 | CCAAUAAUC AGAGUGGC | 1537 | GCCACUCU CUGAUGAGGCCGUUAGGCCGAA AUUAUUGG | 10956 |
| 243 | GAUGGCCUC UUCUGUAA | 1538 | UUACAGAA CUGAUGAGGCCGUUAGGCCGAA AGGCCAUC | 10957 |
| 245 | UGGCCUCUU CUGUAAGA | 1539 | UCUUACAG CUGAUGAGGCCGUUAGGCCGAA AGAGGCCA | 10958 |
| 246 | GGCCUCUUC UGUAAGAC | 1540 | GUCUUACA CUGAUGAGGCCGUUAGGCCGAA AAGAGGCC | 10959 |
| 250 | UCUUCUGUA AGACACUC | 1541 | GAGUGUCU CUGAUGAGGCCGUUAGGCCGAA ACAGAAGA | 10960 |
| 258 | AAGACACUC ACAAUUCC | 1542 | GGAAUUGU CUGAUGAGGCCGUUAGGCCGAA AGUGUCUU | 10961 |
| 264 | CUCACAAUU CCAAAAGU | 1543 | ACUUUUGG CUGAUGAGGCCGUUAGGCCGAA AUUGUGAG | 10962 |
| 265 | UCACAAUUC CAAAAGUG | 1544 | CACUUUUG CUGAUGAGGCCGUUAGGCCGAA AAUUGUGA | 10963 |
| 276 | AAAGUGAUC GGAAAUGA | 1545 | UCAUUUCC CUGAUGAGGCCGUUAGGCCGAA AUCACUUG | 10964 |
| 296 | UGGAGCCUA CAAGUGCU | 1546 | AGCACUUG CUGAUGAGGCCGUUAGGCCGAA AGGCUCCA | 10965 |
| 305 | CAAGUGCUU CUACCGGG | 1547 | CCCGGUAG CUGAUGAGGCCGUUAGGCCGAA AGCACUUG | 10966 |
| 306 | AAGUGCUUC UACCGGGA | 1548 | UCCCGGUA CUGAUGAGGCCGUUAGGCCGAA AAGCACUU | 10967 |
| 308 | GUGCUUCUA CCGGGAAA | 1549 | UUUCCCGG CUGAUGAGGCCGUUAGGCCGAA AGAAGCAC | 10968 |
| 323 | AACUGACUU GGCCUCGG | 1550 | CCGAGGCC CUGAUGAGGCCGUUAGGCCGAA AGUCAGUU | 10969 |
| 329 | CUUGGCCUC GGUCAUUU | 1551 | AAAUGACC CUGAUGAGGCCGUUAGGCCGAA AGGCCAAG | 10970 |
| 333 | GCCUCGGUC AUUUAUGU | 1552 | ACAUAAAU CUGAUGAGGCCGUUAGGCCGAA ACCGAGGC | 10971 |
| 336 | UCGGUCAUU UAUGUCUA | 1553 | UAGACAUA CUGAUGAGGCCGUUAGGCCGAA AUGACCGA | 10972 |
| 337 | CGGUCAUUU AUGUCUAU | 1554 | AUAGACAU CUGAUGAGGCCGUUAGGCCGAA AAUGACCG | 10973 |
| 338 | GGUCAUUUA UGUCUAUG | 1555 | CAUAGACA CUGAUGAGGCCGUUAGGCCGAA AAAUGACC | 10974 |
| 342 | AUUUAUGUC UAUGUUCA | 1556 | UGAACAUA CUGAUGAGGCCGUUAGGCCGAA ACAUAAAU | 10975 |
| 344 | UUAUGUCUA UGUUCAAG | 1557 | CUUGAACA CUGAUGAGGCCGUUAGGCCGAA AGACAUAA | 10976 |
| 348 | GUCUAUGUU CAAGAUUA | 1558 | UAAUCUUG CUGAUGAGGCCGUUAGGCCGAA ACAUAGAC | 10977 |
| 349 | UCUAUGUUC AAGAUUAC | 1559 | GUAAUCUU CUGAUGAGGCCGUUAGGCCGAA AACAUAGA | 10978 |
| 355 | UUCAAGAUU ACAGAUCU | 1560 | AGAUCUGU CUGAUGAGGCCGUUAGGCCGAA AUCUUGAA | 10979 |
| 356 | UCAAGAUUA CAGAUCUC | 1561 | GAGAUCUG CUGAUGAGGCCGUUAGGCCGAA AAUCUUGA | 10980 |
| 362 | UUACAGAUC UCCAUUUA | 1562 | UAAAUGGA CUGAUGAGGCCGUUAGGCCGAA AUCUGUAA | 10981 |
| 364 | ACAGAUCUC CAUUUAUU | 1563 | AAUAAAUG CUGAUGAGGCCGUUAGGCCGAA AGAUCUGU | 10982 |
| 368 | AUCUCCAUU UAUUGCUU | 1564 | AAGCAAUA CUGAUGAGGCCGUUAGGCCGAA AUGGAGAU | 10983 |
| 369 | UCUCCAUUU AUUGCUUC | 1565 | GAAGCAAU CUGAUGAGGCCGUUAGGCCGAA AAUGGAGA | 10984 |
| 370 | CUCCAUUUA UUGCUUCU | 1566 | AGAAGCAA CUGAUGAGGCCGUUAGGCCGAA AAAUGGAG | 10985 |
| 372 | CCAUUUAUU GCUUCUGU | 1567 | ACAGAAGC CUGAUGAGGCCGUUAGGCCGAA AUAAAUGG | 10986 |
| 376 | UUAUUGCUU CUGUUAGU | 1568 | ACUAACAG CUGAUGAGGCCGUUAGGCCGAA AGCAAUAA | 10987 |
| 377 | UAUUGCUUC UGUUAGUG | 1569 | CACUAACA CUGAUGAGGCCGUUAGGCCGAA AAGCAAUA | 10988 |
| 381 | GCUUCUGUU AGUGACCA | 1570 | UGGUCACU CUGAUGAGGCCGUUAGGCCGAA ACAGAAGC | 10989 |

TABLE IV-continued

Human KDR VEGF Receptor-Hammerhead Ribozyme and Substrate Sequence

| Pos | Substrate | Seq ID No | HH Ribozyme Sequence | Seq ID No |
|-----|-----------|-----------|----------------------|-----------|
| 382 | CUUCUGUUA GUGACCAA | 1571 | UUGGUCAC CUGAUGAGGCCGUUAGGCCGAA AACAGAAG | 10990 |
| 399 | CAUGGAGUC GUGUACAU | 1572 | AUGUACAC CUGAUGAGGCCGUUAGGCCGAA ACUCCAUG | 10991 |
| 404 | AGUCGUGUA CAUUACUG | 1573 | CAGUAAUG CUGAUGAGGCCGUUAGGCCGAA ACACGACU | 10992 |
| 408 | GUGUACAUU ACUGAGAA | 1574 | UUCUCAGU CUGAUGAGGCCGUUAGGCCGAA AUGUACAC | 10993 |
| 409 | UGUACAUUA CUGAGAAC | 1575 | GUUCUCAG CUGAUGAGGCCGUUAGGCCGAA AAUGUACA | 10994 |
| 438 | GUGGUGAUU CCAUGUCU | 1576 | AGACAUGG CUGAUGAGGCCGUUAGGCCGAA AUCACCAC | 10995 |
| 439 | UGGUGAUUC CAUGUCUC | 1577 | GAGACAUG CUGAUGAGGCCGUUAGGCCGAA AAUCACCA | 10996 |
| 445 | UUCCAUGUC UCGGGUCC | 1578 | GGACCCGA CUGAUGAGGCCGUUAGGCCGAA ACAUGGAA | 10997 |
| 447 | CCAUGUCUC GGGUCCAU | 1579 | AUGGACCC CUGAUGAGGCCGUUAGGCCGAA AGACAUGG | 10998 |
| 452 | UCUCGGGUC CAUUUCAA | 1580 | UUGAAAUG CUGAUGAGGCCGUUAGGCCGAA ACCCGAGA | 10999 |
| 456 | GGGUCCAUU UCAAAUCU | 1581 | AGAUUUGA CUGAUGAGGCCGUUAGGCCGAA AUGGACCC | 11000 |
| 457 | GGUCCAUUU CAAAUCUC | 1582 | GAGAUUUG CUGAUGAGGCCGUUAGGCCGAA AAUGGACC | 11001 |
| 458 | GUCCAUUUC AAAUCUCA | 1583 | UGAGAUUU CUGAUGAGGCCGUUAGGCCGAA AAAUGGAC | 11002 |
| 463 | UUUCAAAUC UCAACGUG | 1584 | CACGUUGA CUGAUGAGGCCGUUAGGCCGAA AUUUGAAA | 11003 |
| 465 | UCAAAUCUC AACGUGUC | 1585 | GACACGUU CUGAUGAGGCCGUUAGGCCGAA AGAUUUGA | 11004 |
| 473 | CAACGUGUC ACUUUGUG | 1586 | CACAAAGU CUGAUGAGGCCGUUAGGCCGAA ACACGUUG | 11005 |
| 477 | GUGUCACUU UGUGCAAG | 1587 | CUUGCACA CUGAUGAGGCCGUUAGGCCGAA AGUGACAC | 11006 |
| 478 | UGUCACUUU GUGCAAGA | 1588 | UCUUGCAC CUGAUGAGGCCGUUAGGCCGAA AAGUGACA | 11007 |
| 488 | UGCAAGAUA CCCAGAAA | 1589 | UUUCUGGG CUGAUGAGGCCGUUAGGCCGAA AUCUUGCA | 11008 |
| 503 | AAAGAGAUU GUUCCUG | 1590 | CAGGAACA CUGAUGAGGCCGUUAGGCCGAA AUCUCUUU | 11009 |
| 504 | AAGAGAUUU GUUCCUGA | 1591 | UCAGGAAC CUGAUGAGGCCGUUAGGCCGAA AAUCUCUU | 11010 |
| 507 | AGAUUUGUU CCUGAUGG | 1592 | CCAUCAGG CUGAUGAGGCCGUUAGGCCGAA ACAAAUCU | 11011 |
| 508 | GAUUUGUUC CUGAUGGU | 1593 | ACCAUCAG CUGAUGAGGCCGUUAGGCCGAA AACAAAUC | 11012 |
| 517 | CUGAUGGUA ACAGAAUU | 1594 | AAUUCUGU CUGAUGAGGCCGUUAGGCCGAA ACCAUCAG | 11013 |
| 525 | AACAGAAUU UCCUGGGA | 1595 | UCCCAGGA CUGAUGAGGCCGUUAGGCCGAA AUUCUGUU | 11014 |
| 526 | ACAGAAUUU CCUGGGAC | 1596 | GUCCCAGG CUGAUGAGGCCGUUAGGCCGAA AAUUCUGU | 11015 |
| 527 | CAGAAUUUC CUGGGACA | 1597 | UGUCCCAG CUGAUGAGGCCGUUAGGCCGAA AAAUUCUG | 11016 |
| 548 | GAAGGGCUU UACUAUUC | 1598 | GAAUAGUA CUGAUGAGGCCGUUAGGCCGAA AGCCCUUC | 11017 |
| 549 | AAGGGCUUU ACUAUUCC | 1599 | GGAAUAGU CUGAUGAGGCCGUUAGGCCGAA AAGCCCUU | 11018 |
| 550 | AGGGCUUUA CUAUUCCC | 1600 | GGGAAUAG CUGAUGAGGCCGUUAGGCCGAA AAAGCCCU | 11019 |
| 553 | GCUUUACUA UUCCCAGC | 1601 | GCUGGGAA CUGAUGAGGCCGUUAGGCCGAA AGUAAAGC | 11020 |
| 555 | UUUACUAUU CCCAGCUA | 1602 | UAGCUGGG CUGAUGAGGCCGUUAGGCCGAA AUAGUAAA | 11021 |
| 556 | UUACUAUUC CCAGCUAC | 1603 | GUAGCUGG CUGAUGAGGCCGUUAGGCCGAA AAUAGUAA | 11022 |
| 563 | UCCCAGCUA CAUGAUCA | 1604 | UGAUCAUG CUGAUGAGGCCGUUAGGCCGAA AGCUGGGA | 11023 |
| 570 | UACAUGAUC AGCUAUGC | 1605 | GCAUAGCU CUGAUGAGGCCGUUAGGCCGAA AUCAUGUA | 11024 |
| 575 | GAUCAGCUA UGCUGGCA | 1606 | UGCCAGCA CUGAUGAGGCCGUUAGGCCGAA AGCUGAUC | 11025 |
| 588 | GGCAUGGUC UUCUGUGA | 1607 | UCACAGAA CUGAUGAGGCCGUUAGGCCGAA ACCAUGCC | 11026 |

TABLE IV-continued

Human KDR VEGF Receptor-Hammerhead Ribozyme and Substrate Sequence

| Pos | Substrate | Seq ID No | HH Ribozyme Sequence | Seq ID No |
|-----|-----------|-----------|----------------------|-----------|
| 590 | CAUGGUCUU CUGUGAAG | 1608 | CUUCACAG CUGAUGAGGCCGUUAGGCCGAA AGACCAUG | 11027 |
| 591 | AUGGUCUUC UGUGAAGC | 1609 | GCUUCACA CUGAUGAGGCCGUUAGGCCGAA AAGACCAU | 11028 |
| 606 | GCAAAAAUU AAUGAUGA | 1610 | UCAUCAUU CUGAUGAGGCCGUUAGGCCGAA AUUUUUGC | 11029 |
| 607 | CAAAAAUUA AUGAUGAA | 1611 | UUCAUCAU CUGAUGAGGCCGUUAGGCCGAA AAUUUUUG | 11030 |
| 619 | AUGAAAGUU ACCAGUCU | 1612 | AGACUGGU CUGAUGAGGCCGUUAGGCCGAA ACUUUCAU | 11031 |
| 620 | UGAAAGUUA CCAGUCUA | 1613 | UAGACUGG CUGAUGAGGCCGUUAGGCCGAA AACUUUCA | 11032 |
| 626 | UUACCAGUC UAUUAUGU | 1614 | ACAUAAUA CUGAUGAGGCCGUUAGGCCGAA ACUGGUAA | 11033 |
| 628 | ACCAGUCUA UUAUGUAC | 1615 | GUACAUAA CUGAUGAGGCCGUUAGGCCGAA AGACUGGU | 11034 |
| 630 | CAGUCUAUU AUGUACAU | 1616 | AUGUACAU CUGAUGAGGCCGUUAGGCCGAA AUAGACUG | 11035 |
| 631 | AGUCUAUUA UGUACAUA | 1617 | UAUGUACA CUGAUGAGGCCGUUAGGCCGAA AAUAGACU | 11036 |
| 635 | UAUUAUGUA CAUAGUUG | 1618 | CAACUAUG CUGAUGAGGCCGUUAGGCCGAA ACAUAAUA | 11037 |
| 639 | AUGUACAUA GUUGUCGU | 1619 | ACGACAAC CUGAUGAGGCCGUUAGGCCGAA AUGUACAU | 11038 |
| 642 | UACAUAGUU GUCGUUGU | 1620 | ACAACGAC CUGAUGAGGCCGUUAGGCCGAA ACUAUGUA | 11039 |
| 645 | AUAGUUGUC GUUGUAGG | 1621 | CCUACAAC CUGAUGAGGCCGUUAGGCCGAA ACAACUAU | 11040 |
| 648 | GUUGUCGUU GUAGGGUA | 1622 | UACCCUAC CUGAUGAGGCCGUUAGGCCGAA ACGACAAC | 11041 |
| 651 | GUCGUUGUA GGGUAUAG | 1623 | CUAUACCC CUGAUGAGGCCGUUAGGCCGAA ACAACGAC | 11042 |
| 656 | UGUAGGGUA UAGGAUUU | 1624 | AAAUCCUA CUGAUGAGGCCGUUAGGCCGAA ACCCUACA | 11043 |
| 658 | UAGGGUAUA GGAUUUAU | 1625 | AUAAAUCC CUGAUGAGGCCGUUAGGCCGAA AUACCCUA | 11044 |
| 663 | UAUAGGAUU UAUGAUGU | 1626 | ACAUCAUA CUGAUGAGGCCGUUAGGCCGAA AUCCUAUA | 11045 |
| 664 | AUAGGAUUU AUGAUGUG | 1627 | CACAUCAU CUGAUGAGGCCGUUAGGCCGAA AAUCCUAU | 11046 |
| 665 | UAGGAUUUA UGAUGUGG | 1628 | CCACAUCA CUGAUGAGGCCGUUAGGCCGAA AAAUCCUA | 11047 |
| 675 | GAUGUGGUU CUGAGUCC | 1629 | GGACUCAG CUGAUGAGGCCGUUAGGCCGAA ACCACAUC | 11048 |
| 676 | AUGUGGUUC UGAGUCCG | 1630 | CGGACUCA CUGAUGAGGCCGUUAGGCCGAA AACCACAU | 11049 |
| 682 | UUCUGAGUC CGUCUCAU | 1631 | AUGAGACG CUGAUGAGGCCGUUAGGCCGAA ACUCAGAA | 11050 |
| 686 | GAGUCCGUC UCAUGGAA | 1632 | UUCCAUGA CUGAUGAGGCCGUUAGGCCGAA ACGGACUC | 11051 |
| 688 | GUCCGUCUC AUGGAAUU | 1633 | AAUUCCAU CUGAUGAGGCCGUUAGGCCGAA AGACGGAC | 11052 |
| 696 | CAUGGAAUU GAACUAUC | 1634 | GAUAGUUC CUGAUGAGGCCGUUAGGCCGAA AUUCCAUG | 11053 |
| 702 | AUUGAACUA UCUGUUGG | 1635 | CCAACAGA CUGAUGAGGCCGUUAGGCCGAA AGUUCAAU | 11054 |
| 704 | UGAACUAUC UGUUGGAG | 1636 | CUCCAACA CUGAUGAGGCCGUUAGGCCGAA AUAGUUCA | 11055 |
| 708 | CUAUCUGUU GGAGAAAA | 1637 | UUUUCUCC CUGAUGAGGCCGUUAGGCCGAA ACAGAUAG | 11056 |
| 720 | GAAAAGCUU GUCUUAAA | 1638 | UUUAAGAC CUGAUGAGGCCGUUAGGCCGAA AGCUUUUC | 11057 |
| 723 | AAGCUUGUC UUAAAUUG | 1639 | CAAUUUAA CUGAUGAGGCCGUUAGGCCGAA ACAAGCUU | 11058 |
| 725 | GCUUGUCUU AAAUUGUA | 1640 | UACAAUUU CUGAUGAGGCCGUUAGGCCGAA AGACAAGC | 11059 |
| 726 | CUUGUCUUA AAUUGUAC | 1641 | GUACAAUU CUGAUGAGGCCGUUAGGCCGAA AAGACAAG | 11060 |
| 730 | UCUUAAAUU GUACAGCA | 1642 | UGCUGUAC CUGAUGAGGCCGUUAGGCCGAA AUUUAAGA | 11061 |
| 733 | UAAAUUGUA CAGCAAGA | 1643 | UCUUGCUG CUGAUGAGGCCGUUAGGCCGAA ACAAUUUA | 11062 |
| 750 | ACUGAACUA AAUGUGGG | 1644 | CCCACAUU CUGAUGAGGCCGUUAGGCCGAA AGUUCAGU | 11063 |

TABLE IV-continued

Human KDR VEGF Receptor-Hammerhead Ribozyme and Substrate Sequence

| Pos | Substrate | Seq ID No | HH Ribozyme Sequence | Seq ID No |
|-----|-----------|-----------|----------------------|-----------|
| 762 | GUGGGGAUU GACUUCAA | 1645 | UUGAAGUC CUGAUGAGGCCGUUAGGCCGAA AUCCCCAC | 11064 |
| 767 | GAUUGACUU CAACUGGG | 1646 | CCCAGUUG CUGAUGAGGCCGUUAGGCCGAA AGUCAAUC | 11065 |
| 768 | AUUGACUUC AACUGGGA | 1647 | UCCCAGUU CUGAUGAGGCCGUUAGGCCGAA AAGUCAAU | 11066 |
| 779 | CUGGGAAUA CCCUUCUU | 1648 | AAGAAGGG CUGAUGAGGCCGUUAGGCCGAA AUUCCCAG | 11067 |
| 784 | AAUACCCUU CUUCGAAG | 1649 | CUUCGAAG CUGAUGAGGCCGUUAGGCCGAA AGGGUAUU | 11068 |
| 785 | AUACCCUUC UUCGAAGC | 1650 | GCUUCGAA CUGAUGAGGCCGUUAGGCCGAA AAGGGUAU | 11069 |
| 787 | ACCCUUCUU CGAAGCAU | 1651 | AUGCUUCG CUGAUGAGGCCGUUAGGCCGAA AGAAGGGU | 11070 |
| 788 | CCCUUCUUC GAAGCAUC | 1652 | GAUGCUUC CUGAUGAGGCCGUUAGGCCGAA AAGAAGGG | 11071 |
| 796 | CGAAGCAUC AGCAUAAG | 1653 | CUUAUGCU CUGAUGAGGCCGUUAGGCCGAA AUGCUUCG | 11072 |
| 802 | AUCAGCAUA AGAAACUU | 1654 | AAGUUUCU CUGAUGAGGCCGUUAGGCCGAA AUGCUGAU | 11073 |
| 810 | AAGAAACUU GUAAACCG | 1655 | CGGUUUAC CUGAUGAGGCCGUUAGGCCGAA AGUUUCUU | 11074 |
| 813 | AAACUUGUA AACCGAGA | 1656 | UCUCGGUU CUGAUGAGGCCGUUAGGCCGAA ACAAGUUU | 11075 |
| 825 | CGAGACCUA AAAACCCA | 1657 | UGGGUUUU CUGAUGAGGCCGUUAGGCCGAA AGGUCUCG | 11076 |
| 836 | AACCCAGUC UGGGAGUG | 1658 | CACUCCCA CUGAUGAGGCCGUUAGGCCGAA ACUGGGUU | 11077 |
| 857 | GAAGAAAUU UUUGAGCA | 1659 | UGCUCAAA CUGAUGAGGCCGUUAGGCCGAA AUUUCUUC | 11078 |
| 858 | AAGAAAUUU UUGAGCAC | 1660 | GUGCUCAA CUGAUGAGGCCGUUAGGCCGAA AAUUUCUU | 11079 |
| 859 | AGAAAUUUU UGAGCACC | 1661 | GGUGCUCA CUGAUGAGGCCGUUAGGCCGAA AAAUUUCU | 11080 |
| 860 | GAAAUUUUU GAGCACCU | 1662 | AGGUGCUC CUGAUGAGGCCGUUAGGCCGAA AAAAUUUC | 11081 |
| 869 | GAGCACCUU AACUAUAG | 1663 | CUAUAGUU CUGAUGAGGCCGUUAGGCCGAA AGGUGCUC | 11082 |
| 870 | AGCACCUUA ACUAUAGA | 1664 | UCUAUAGU CUGAUGAGGCCGUUAGGCCGAA AAGGUGCU | 11083 |
| 874 | CCUUAACUA UAGAUGGU | 1665 | ACCAUCUA CUGAUGAGGCCGUUAGGCCGAA AGUUAAGG | 11084 |
| 876 | UUAACUAUA GAUGGUGU | 1666 | ACACCAUC CUGAUGAGGCCGUUAGGCCGAA AUAGUUAA | 11085 |
| 885 | GAUGGUGUA ACCCGGAG | 1667 | CUCCGGGU CUGAUGAGGCCGUUAGGCCGAA ACACCAUC | 11086 |
| 905 | CCAAGGAUU GUACACCU | 1668 | AGGUGUAC CUGAUGAGGCCGUUAGGCCGAA AUCCUUGG | 11087 |
| 908 | AGGAUUGUA CACCUGUG | 1669 | CACAGGUG CUGAUGAGGCCGUUAGGCCGAA ACAAUCCU | 11088 |
| 923 | UGCAGCAUC CAGUGGGC | 1670 | GCCCACUG CUGAUGAGGCCGUUAGGCCGAA AUGCUGCA | 11089 |
| 956 | CAGCACAUU UGUCAGGG | 1671 | CCCUGACA CUGAUGAGGCCGUUAGGCCGAA AUGUGCUG | 11090 |
| 957 | AGCACAUUU GUCAGGGU | 1672 | ACCCUGAC CUGAUGAGGCCGUUAGGCCGAA AAUGUGCU | 11091 |
| 960 | ACAUUUGUC AGGGUCCA | 1673 | UGGACCCU CUGAUGAGGCCGUUAGGCCGAA ACAAAUGU | 11092 |
| 966 | GUCAGGGUC CAUGAAAA | 1674 | UUUUCAUG CUGAUGAGGCCGUUAGGCCGAA ACCCUGAC | 11093 |
| 979 | AAAAACCUU UUGUUGCU | 1675 | AGCAACAA CUGAUGAGGCCGUUAGGCCGAA AGGUUUUU | 11094 |
| 980 | AAAACCUUU UGUUGCUU | 1676 | AAGCAACA CUGAUGAGGCCGUUAGGCCGAA AAGGUUUU | 11095 |
| 981 | AAACCUUUU GUUGCUUU | 1677 | AAAGCAAC CUGAUGAGGCCGUUAGGCCGAA AAAGGUUU | 11096 |
| 984 | CCUUUUGUU GCUUUUGG | 1678 | CCAAAAGC CUGAUGAGGCCGUUAGGCCGAA ACAAAAGG | 11097 |
| 988 | UUGUUGCUU UUGGAAGU | 1679 | ACUUCCAA CUGAUGAGGCCGUUAGGCCGAA AGCAACAA | 11098 |
| 989 | UGUUGCUUU UGGAAGUG | 1680 | CACUUCCA CUGAUGAGGCCGUUAGGCCGAA AAGCAACA | 11099 |
| 990 | GUUGCUUUU GGAAGUGG | 1681 | CCACUUCC CUGAUGAGGCCGUUAGGCCGAA AAAGCAAC | 11100 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 1007 | CAUGGAAUC UCUGGUGG | 1682 | CCACCAGA CUGAUGAGGCCGUUAGGCCGAA AUUCCAUG | 11101 |
| 1009 | UGGAAUCUC UGGUGGAA | 1683 | UUCCACCA CUGAUGAGGCCGUUAGGCCGAA AGAUUCCA | 11102 |
| 1038 | GAGCGUGUC AGAAUCCC | 1684 | GGGAUUCU CUGAUGAGGCCGUUAGGCCGAA ACACGCUC | 11103 |
| 1044 | GUCAGAAUC CUGCGAA | 1685 | UUCGCAGG CUGAUGAGGCCGUUAGGCCGAA AUUCUGAC | 11104 |
| 1055 | UGCGAAGUA CCUUGGUU | 1686 | AACCAAGG CUGAUGAGGCCGUUAGGCCGAA ACUUCGCA | 11105 |
| 1059 | AAGUACCUU GGUUACCC | 1687 | GGGUAACC CUGAUGAGGCCGUUAGGCCGAA AGGUACUU | 11106 |
| 1063 | ACCUUGGUU ACCCACCC | 1688 | GGGUGGGU CUGAUGAGGCCGUUAGGCCGAA ACCAAGGU | 11107 |
| 1064 | CCUUGGUUA CCCACCCC | 1689 | GGGGUGGG CUGAUGAGGCCGUUAGGCCGAA AACCAAGG | 11108 |
| 1080 | CCAGAAAUA AAAUGGUA | 1690 | UACCAUUU CUGAUGAGGCCGUUAGGCCGAA AUUUCUGG | 11109 |
| 1088 | AAAUGGUA UAAAAAUG | 1691 | CAUUUUUA CUGAUGAGGCCGUUAGGCCGAA ACCAUUUU | 11110 |
| 1090 | AAUGGUAUA AAAUGGA | 1692 | UCCAUUUU CUGAUGAGGCCGUUAGGCCGAA AUACCAUU | 11111 |
| 1101 | AAUGGAAUA CCCCUUGA | 1693 | UCAAGGGG CUGAUGAGGCCGUUAGGCCGAA AUUCCAUU | 11112 |
| 1107 | AUACCCCUU GAGUCCAA | 1694 | UUGGACUC CUGAUGAGGCCGUUAGGCCGAA AGGGGUAU | 11113 |
| 1112 | CCUUGAGUC CAAUCACA | 1695 | UGUGAUUG CUGAUGAGGCCGUUAGGCCGAA ACUCAAGG | 11114 |
| 1117 | AGUCCAAUC ACACAAUU | 1696 | AAUUGUGU CUGAUGAGGCCGUUAGGCCGAA AUUGGACU | 11115 |
| 1125 | CACACAAUU AAAGCGGG | 1697 | CCCGCUUU CUGAUGAGGCCGUUAGGCCGAA AUUGUGUG | 11116 |
| 1126 | ACACAAUUA AAGCGGGG | 1698 | CCCCGCUU CUGAUGAGGCCGUUAGGCCGAA AAUUGUGU | 11117 |
| 1140 | GGGCAUGUA CUGACGAU | 1699 | AUCGUCAG CUGAUGAGGCCGUUAGGCCGAA ACAUGCCC | 11118 |
| 1149 | CUGACGAUU AUGGAAGU | 1700 | ACUUCCAU CUGAUGAGGCCGUUAGGCCGAA AUCGUCAG | 11119 |
| 1150 | UGACGAUUA UGGAAGUG | 1701 | CACUUCCA CUGAUGAGGCCGUUAGGCCGAA AAUCGUCA | 11120 |
| 1180 | CAGGAAAUU ACACUGUC | 1702 | GACAGUGU CUGAUGAGGCCGUUAGGCCGAA AUUUCCUG | 11121 |
| 1181 | AGGAAAUUA CACUGUCA | 1703 | UGACAGUG CUGAUGAGGCCGUUAGGCCGAA AAUUUCCU | 11122 |
| 1188 | UACACUGUC AUCCUUAC | 1704 | GUAAGGAU CUGAUGAGGCCGUUAGGCCGAA ACAGUGUA | 11123 |
| 1191 | ACUGUCAUC CUUACCAA | 1705 | UUGGUAAG CUGAUGAGGCCGUUAGGCCGAA AUGACAGU | 11124 |
| 1194 | GUCAUCCUU ACCAAUCC | 1706 | GGAUUGGU CUGAUGAGGCCGUUAGGCCGAA AGGAUGAC | 11125 |
| 1195 | UCAUCCUUA CCAAUCCC | 1707 | GGGAUUGG CUGAUGAGGCCGUUAGGCCGAA AAGGAUGA | 11126 |
| 1201 | UUACCAAUC CAUUUCA | 1708 | UGAAAUGG CUGAUGAGGCCGUUAGGCCGAA AUUGGUAA | 11127 |
| 1206 | AAUCCCAUU UCAAAGGA | 1709 | UCCUUUGA CUGAUGAGGCCGUUAGGCCGAA AUGGGAUU | 11128 |
| 1207 | AUCCCAUUU CAAAGGAG | 1710 | CUCCUUUG CUGAUGAGGCCGUUAGGCCGAA AAUGGGAU | 11129 |
| 1208 | UCCCAUUUC AAAGGAGA | 1711 | UCUCCUUU CUGAUGAGGCCGUUAGGCCGAA AAAUGGGA | 11130 |
| 1233 | CAUGUGGUC UCUCUGGU | 1712 | ACCAGAGA CUGAUGAGGCCGUUAGGCCGAA ACCACAUG | 11131 |
| 1235 | UGUGGUCUC UCUGGUUG | 1713 | CAACCAGA CUGAUGAGGCCGUUAGGCCGAA AGACCACA | 11132 |
| 1237 | UGGUCUCUC UGGUUGUG | 1714 | CACAACCA CUGAUGAGGCCGUUAGGCCGAA AGAGACCA | 11133 |
| 1242 | UCUCUGGUU GUGUAUGU | 1715 | ACAUACAC CUGAUGAGGCCGUUAGGCCGAA ACCAGAGA | 11134 |
| 1247 | GGUUGUGUA UGUCCCAC | 1716 | GUGGGACA CUGAUGAGGCCGUUAGGCCGAA ACACAACC | 11135 |
| 1251 | GUGUAUGUC CCACCCCA | 1717 | UGGGGUGG CUGAUGAGGCCGUUAGGCCGAA ACAUACAC | 11136 |
| 1263 | CCCCAGAUU GGUGAGAA | 1718 | UUCUCACC CUGAUGAGGCCGUUAGGCCGAA AUCUGGGG | 11137 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 1274 | UGAGAAAUC UCUAAUCU | 1719 | AGAUUAGA CUGAUGAGGCCGUUAGGCCGAA AUUUCUCA | 11138 |
| 1276 | AGAAAUCUC UAAUCUCU | 1720 | AGAGAUUA CUGAUGAGGCCGUUAGGCCGAA AGAUUUCU | 11139 |
| 1278 | AAAUCUCUA AUCUCUCC | 1721 | GGAGAGAU CUGAUGAGGCCGUUAGGCCGAA AGAGAUUU | 11140 |
| 1281 | UCUCUAAUC UCUCCUGU | 1722 | ACAGGAGA CUGAUGAGGCCGUUAGGCCGAA AUUAGAGA | 11141 |
| 1283 | UCUAAUCUC UCCUGUGG | 1723 | CCACAGGA CUGAUGAGGCCGUUAGGCCGAA AGAUUAGA | 11142 |
| 1285 | UAAUCUCUC CUGUGGAU | 1724 | AUCCACAG CUGAUGAGGCCGUUAGGCCGAA AGAGAUUA | 11143 |
| 1294 | CUGUGGAUU CCUACCAG | 1725 | CUGGUAGG CUGAUGAGGCCGUUAGGCCGAA AUCCACAG | 11144 |
| 1295 | UGUGGAUUC CUACCAGU | 1726 | ACUGGUAG CUGAUGAGGCCGUUAGGCCGAA AAUCCACA | 11145 |
| 1298 | GGAUUCCUA CCAGUACG | 1727 | CGUACUGG CUGAUGAGGCCGUUAGGCCGAA AGGAAUCC | 11146 |
| 1304 | CUACCAGUA CGGCACCA | 1728 | UGGUGCCG CUGAUGAGGCCGUUAGGCCGAA ACUGGUAG | 11147 |
| 1315 | GCACCACUC AAACGCUG | 1729 | CAGCGUUU CUGAUGAGGCCGUUAGGCCGAA AGUGGUGC | 11148 |
| 1330 | UGACAUGUA CGGUCUAU | 1730 | AUAGACCG CUGAUGAGGCCGUUAGGCCGAA ACAUGUCA | 11149 |
| 1335 | UGUACGGUC UAUGCCAU | 1731 | AUGGCAUA CUGAUGAGGCCGUUAGGCCGAA ACCGUACA | 11150 |
| 1337 | UACGGUCUA UGCCAUUC | 1732 | GAAUGGCA CUGAUGAGGCCGUUAGGCCGAA AGACCGUA | 11151 |
| 1344 | UAUGCCAUU CCUCCCCC | 1733 | GGGGGAGG CUGAUGAGGCCGUUAGGCCGAA AUGGCAUA | 11152 |
| 1345 | AUGCCAUUC CUCCCCCG | 1734 | CGGGGGAG CUGAUGAGGCCGUUAGGCCGAA AAUGGCAU | 11153 |
| 1348 | CCAUUCCUC CCCGCAU | 1735 | AUGCGGGG CUGAUGAGGCCGUUAGGCCGAA AGGAAUGG | 11154 |
| 1357 | CCCCGCAUC ACAUCCAC | 1736 | GUGGAUGU CUGAUGAGGCCGUUAGGCCGAA AUGCGGGG | 11155 |
| 1362 | CAUCACAUC CACUGGUA | 1737 | UACCAGUG CUGAUGAGGCCGUUAGGCCGAA AUGUGAUG | 11156 |
| 1370 | CCACUGGUA UUGGCAGU | 1738 | ACUGCCAA CUGAUGAGGCCGUUAGGCCGAA ACCAGUGG | 11157 |
| 1372 | ACUGGUAUU GGCAGUUG | 1739 | CAACUGCC CUGAUGAGGCCGUUAGGCCGAA AUACCAGU | 11158 |
| 1379 | UUGGCAGUU GGAGGAAG | 1740 | CUUCCUCC CUGAUGAGGCCGUUAGGCCGAA ACUGCCAA | 11159 |
| 1416 | CAAGCUGUC UCAGUGAC | 1741 | GUCACUGA CUGAUGAGGCCGUUAGGCCGAA ACAGCUUG | 11160 |
| 1418 | AGCUGUCUC AGUGACAA | 1742 | UUGUCACU CUGAUGAGGCCGUUAGGCCGAA AGACAGCU | 11161 |
| 1433 | AAACCCAUA CCCUUGUG | 1743 | CACAAGGG CUGAUGAGGCCGUUAGGCCGAA AUGGGUUU | 11162 |
| 1438 | CAUACCCUU GUGAAGAA | 1744 | UUCUUCAC CUGAUGAGGCCGUUAGGCCGAA AGGGUAUG | 11163 |
| 1466 | GGAGGACUU CCAGGGAG | 1745 | CUCCCUGG CUGAUGAGGCCGUUAGGCCGAA AGUCCUCC | 11164 |
| 1467 | GAGGACUUC CAGGGAGG | 1746 | CCUCCCUG CUGAUGAGGCCGUUAGGCCGAA AAGUCCUC | 11165 |
| 1480 | GAGGAAAUA AAAUUGAA | 1747 | UUCAAUUU CUGAUGAGGCCGUUAGGCCGAA AUUUCCUC | 11166 |
| 1485 | AAUAAAAUU GAAGUUAA | 1748 | UUAACUUC CUGAUGAGGCCGUUAGGCCGAA AUUUUAUU | 11167 |
| 1491 | AUUGAAGUU AAUAAAAA | 1749 | UUUUUAUU CUGAUGAGGCCGUUAGGCCGAA ACUUCAAU | 11168 |
| 1492 | UUGAAGUUA AUAAAAAU | 1750 | AUUUUUAU CUGAUGAGGCCGUUAGGCCGAA AACUUCAA | 11169 |
| 1495 | AAGUUAAUA AAAUCAA | 1751 | UUGAUUUU CUGAUGAGGCCGUUAGGCCGAA AUUAACUU | 11170 |
| 1501 | AUAAAAUC AAUUUGCU | 1752 | AGCAAAUU CUGAUGAGGCCGUUAGGCCGAA AUUUUUAU | 11171 |
| 1505 | AAAUCAAUU UGCUCUAA | 1753 | UUAGAGCA CUGAUGAGGCCGUUAGGCCGAA AUUGAUUU | 11172 |
| 1506 | AAUCAAUUU GCUCUAAU | 1754 | AUUAGAGC CUGAUGAGGCCGUUAGGCCGAA AAUUGAUU | 11173 |
| 1510 | AAUUUGCUC UAAUUGAA | 1755 | UUCAAUUA CUGAUGAGGCCGUUAGGCCGAA AGCAAAUU | 11174 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 1512 | UUUGCUCUA AUUGAAGG | 1756 | CCUUCAAU CUGAUGAGGCCGUUAGGCCGAA AGAGCAAA | 11175 |
| 1515 | GCUCUAAUU GAAGGAAA | 1757 | UUUCCUUC CUGAUGAGGCCGUUAGGCCGAA AUUAGAGC | 11176 |
| 1536 | AAAACUGUA AGUACCCU | 1758 | AGGGUACU CUGAUGAGGCCGUUAGGCCGAA ACAGUUUU | 11177 |
| 1540 | CUGUAAGUA CCCUUGUU | 1759 | AACAAGGG CUGAUGAGGCCGUUAGGCCGAA ACUUACAG | 11178 |
| 1545 | AGUACCCUU GUUAUCCA | 1760 | UGGAUAAC CUGAUGAGGCCGUUAGGCCGAA AGGGUACU | 11179 |
| 1548 | ACCCUUGUU AUCCAAGC | 1761 | GCUUGGAU CUGAUGAGGCCGUUAGGCCGAA ACAAGGGU | 11180 |
| 1549 | CCCUUGUUA UCCAAGCG | 1762 | CGCUUGGA CUGAUGAGGCCGUUAGGCCGAA AACAAGGG | 11181 |
| 1551 | CUUGUUAUC CAAGCGGC | 1763 | GCCGCUUG CUGAUGAGGCCGUUAGGCCGAA AUAACAAG | 11182 |
| 1568 | AAAUGUGUC AGCUUUGU | 1764 | ACAAAGCU CUGAUGAGGCCGUUAGGCCGAA ACACAUUU | 11183 |
| 1573 | UGUCAGCUU UGUACAAA | 1765 | UUUGUACA CUGAUGAGGCCGUUAGGCCGAA AGCUGACA | 11184 |
| 1574 | GUCAGCUUU GUACAAAU | 1766 | AUUUGUAC CUGAUGAGGCCGUUAGGCCGAA AAGCUGAC | 11185 |
| 1577 | AGCUUUGUA CAAAUGUG | 1767 | CACAUUUG CUGAUGAGGCCGUUAGGCCGAA ACAAAGCU | 11186 |
| 1593 | GAAGCGGUC AACAAAGU | 1768 | ACUUUGUU CUGAUGAGGCCGUUAGGCCGAA ACCGCUUC | 11187 |
| 1602 | AACAAAGUC GGGAGAGG | 1769 | CCUCUCCC CUGAUGAGGCCGUUAGGCCGAA ACUUUGUU | 11188 |
| 1623 | AGGGUGAUC UCCUUCCA | 1770 | UGGAAGGA CUGAUGAGGCCGUUAGGCCGAA AUCACCCU | 11189 |
| 1625 | GGUGAUCUC CUUCCACG | 1771 | CGUGGAAG CUGAUGAGGCCGUUAGGCCGAA AGAUCACC | 11190 |
| 1628 | GAUCUCCUU CCACGUGA | 1772 | UCACGUGG CUGAUGAGGCCGUUAGGCCGAA AGGAGAUC | 11191 |
| 1629 | AUCUCCUUC CACGUGAC | 1773 | GUCACGUG CUGAUGAGGCCGUUAGGCCGAA AAGGAGAU | 11192 |
| 1645 | CCAGGGGUC UGAAAUU | 1774 | AAUUUCAG CUGAUGAGGCCGUUAGGCCGAA ACCCCUGG | 11193 |
| 1653 | CCUGAAAUU ACUUUGCA | 1775 | UGCAAAGU CUGAUGAGGCCGUUAGGCCGAA AUUUCAGG | 11194 |
| 1654 | CUGAAAUUA CUUUGCAA | 1776 | UUGCAAAG CUGAUGAGGCCGUUAGGCCGAA AAUUUCAG | 11195 |
| 1657 | AAAUUACUU UGCAACCU | 1777 | AGGUUGCA CUGAUGAGGCCGUUAGGCCGAA AGUAAUUU | 11196 |
| 1658 | AAUUACUUU GCAACCUG | 1778 | CAGGUUGC CUGAUGAGGCCGUUAGGCCGAA AAGUAAUU | 11197 |
| 1697 | GAGCGUGUC UUUGUGGU | 1779 | ACCACAAA CUGAUGAGGCCGUUAGGCCGAA ACACGCUC | 11198 |
| 1699 | GCGUGUCUU UGUGGUGC | 1780 | GCACCACA CUGAUGAGGCCGUUAGGCCGAA AGACACGC | 11199 |
| 1700 | CGUGUCUUU GUGGUGCA | 1781 | UGCACCAC CUGAUGAGGCCGUUAGGCCGAA AAGACACG | 11200 |
| 1721 | AGACAGAUC UACGUUUG | 1782 | CAAACGUA CUGAUGAGGCCGUUAGGCCGAA AUCUGUCU | 11201 |
| 1723 | ACAGAUCUA CGUUUGAG | 1783 | CUCAAACG CUGAUGAGGCCGUUAGGCCGAA AGAUCUGU | 11202 |
| 1727 | AUCUACGUU UGAGAACC | 1784 | GGUUCUCA CUGAUGAGGCCGUUAGGCCGAA ACGUAGAU | 11203 |
| 1728 | UCUACGUUU GAGAACCU | 1785 | AGGUUCUC CUGAUGAGGCCGUUAGGCCGAA AACGUAGA | 11204 |
| 1737 | GAGAACCUC ACAUGGUA | 1786 | UACCAUGU CUGAUGAGGCCGUUAGGCCGAA AGGUUCUC | 11205 |
| 1745 | CACAUGGUA CAAGCUUG | 1787 | CAAGCUUG CUGAUGAGGCCGUUAGGCCGAA ACCAUGUG | 11206 |
| 1752 | UACAAGCUU GGCCCACA | 1788 | UGUGGGCC CUGAUGAGGCCGUUAGGCCGAA AGCUUGUA | 11207 |
| 1765 | CACAGCCUC UGCCAAUC | 1789 | GAUUGGCA CUGAUGAGGCCGUUAGGCCGAA AGGCUGUG | 11208 |
| 1773 | CUGCCAAUC CAUGUGGG | 1790 | CCCACAUG CUGAUGAGGCCGUUAGGCCGAA AUUGGCAG | 11209 |
| 1787 | GGGAGAGUU GCCCACAC | 1791 | GUGUGGGC CUGAUGAGGCCGUUAGGCCGAA ACUCUCCC | 11210 |
| 1800 | ACACCUGUU UGCAAGAA | 1792 | UUCUUGCA CUGAUGAGGCCGUUAGGCCGAA ACAGGUGU | 11211 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 1801 | CACCUGUUU GCAAGAAC | 1793 | GUUCUUGC CUGAUGAGGCCGUUAGGCCGAA AACAGGUG | 11212 |
| 1811 | CAAGAACUU GGAUACUC | 1794 | GAGUAUCC CUGAUGAGGCCGUUAGGCCGAA AGUUCUUG | 11213 |
| 1816 | ACUUGGAUA CUCUUUGG | 1795 | CCAAAGAG CUGAUGAGGCCGUUAGGCCGAA AUCCAAGU | 11214 |
| 1819 | UGGAUACUC UUUGGAAA | 1796 | UUUCCAAA CUGAUGAGGCCGUUAGGCCGAA AGUAUCCA | 11215 |
| 1821 | GAUACUCUU UGGAAAUU | 1797 | AAUUUCCA CUGAUGAGGCCGUUAGGCCGAA AGAGUAUC | 11216 |
| 1822 | AUACUCUUU GGAAAUUG | 1798 | CAAUUUCC CUGAUGAGGCCGUUAGGCCGAA AAGAGUAU | 11217 |
| 1829 | UUGGAAAUU GAAUGCCA | 1799 | UGGCAUUC CUGAUGAGGCCGUUAGGCCGAA AUUUCCAA | 11218 |
| 1844 | CACCAUGUU CUCUAAUA | 1800 | UAUUAGAG CUGAUGAGGCCGUUAGGCCGAA ACAUGGUG | 11219 |
| 1845 | ACCAUGUUC UCUAAUAG | 1801 | CUAUUAGA CUGAUGAGGCCGUUAGGCCGAA AACAUGGU | 11220 |
| 1847 | CAUGUUCUC UAAUAGCA | 1802 | UGCUAUUA CUGAUGAGGCCGUUAGGCCGAA AGAACAUG | 11221 |
| 1849 | UGUUCUCUA AUAGCACA | 1803 | UGUGCUAU CUGAUGAGGCCGUUAGGCCGAA AGAGAACA | 11222 |
| 1852 | UCUCUAAUA GCACAAAU | 1804 | AUUUGUGC CUGAUGAGGCCGUUAGGCCGAA AUUAGAGA | 11223 |
| 1866 | AAUGACAUU UUGAUCAU | 1805 | AUGAUCAA CUGAUGAGGCCGUUAGGCCGAA AUGUCAUU | 11224 |
| 1867 | AUGACAUUU UGAUCAUG | 1806 | CAUGAUCA CUGAUGAGGCCGUUAGGCCGAA AAUGUCAU | 11225 |
| 1868 | UGACAUUUC GAUCAUGG | 1807 | CCAUGAUC CUGAUGAGGCCGUUAGGCCGAA AAAUGUCA | 11226 |
| 1872 | AUUUUGAUC AUGGAGCU | 1808 | AGCUCCAU CUGAUGAGGCCGUUAGGCCGAA AUCAAAAU | 11227 |
| 1881 | AUGGAGCUU AAGAAUGC | 1809 | GCAUUCUU CUGAUGAGGCCGUUAGGCCGAA AGCUCCAU | 11228 |
| 1882 | UGGACCUUA AGAAUGCA | 1810 | UGCAUUCU CUGAUGAGGCCGUUAGGCCGAA AAGCUCCA | 11229 |
| 1892 | GAAUGCAUC CUUGCAGG | 1811 | CCUGCAAG CUGAUGAGGCCGUUAGGCCGAA AUGCAUUC | 11230 |
| 1895 | UGCAUCCUU GCAGGACC | 1812 | GGUCCUGC CUGAUGAGGCCGUUAGGCCGAA AGGAUGCA | 11231 |
| 1913 | AGGAGACUA UGUCUGCC | 1813 | GGCAGACA CUGAUGAGGCCGUUAGGCCGAA AGUCUCCU | 11232 |
| 1917 | GACUAUGUC UGCCUUGC | 1814 | GCAAGGCA CUGAUGAGGCCGUUAGGCCGAA ACAUAGUC | 11233 |
| 1923 | GUCUGCCUU GCUCAAGA | 1815 | UCUUGAGC CUGAUGAGGCCGUUAGGCCGAA AGGCAGAC | 11234 |
| 1927 | GCCUUGCUC AAGACAGG | 1816 | CCUGUCUU CUGAUGAGGCCGUUAGGCCGAA AGCAAGGC | 11235 |
| 1954 | AAAGACAUU GCGUGGUC | 1817 | GACCACGC CUGAUGAGGCCGUUAGGCCGAA AUGUCUUU | 11236 |
| 1962 | UGCGUGGUC AGGCAGCU | 1818 | AGCUGCCU CUGAUGAGGCCGUUAGGCCGAA ACCACGCA | 11237 |
| 1971 | AGGCAGCUC ACAGUCCU | 1819 | AGGACUGU CUGAUGAGGCCGUUAGGCCGAA AGCUGCCU | 11238 |
| 1977 | CUCACAGUC CUAGAGCG | 1820 | CGCUCUAG CUGAUGAGGCCGUUAGGCCGAA ACUGUGAG | 11239 |
| 1980 | ACAGUCCUA GAGCGUGU | 1821 | ACACGCUC CUGAUGAGGCCGUUAGGCCGAA AGGACUGU | 11240 |
| 2001 | CCCACGAUC ACAGGAAA | 1822 | UUUCCUGU CUGAUGAGGCCGUUAGGCCGAA AUCGUGGG | 11241 |
| 2020 | UGGAGAAUC AGACGACA | 1823 | UGUCGUCU CUGAUGAGGCCGUUAGGCCGAA AUUCUCCA | 11242 |
| 2032 | CGACAAGUA UUGGGAA | 1824 | UUCCCCAA CUGAUGAGGCCGUUAGGCCGAA ACUUGUCG | 11243 |
| 2034 | ACAAGUAUU GGGAAAG | 1825 | CUUUCCCC CUGAUGAGGCCGUUAGGCCGAA AUACUUGU | 11244 |
| 2046 | GAAAGCAUC GAAGUCUC | 1826 | GAGACUUC CUGAUGAGGCCGUUAGGCCGAA AUGCUUUC | 11245 |
| 2052 | AUCGAAGUC UCAUGCAC | 1827 | GUGCAUGA CUGAUGAGGCCGUUAGGCCGAA ACUUCGAU | 11246 |
| 2054 | CGAAGUCUC AUGCACGG | 1828 | CCGUGCAU CUGAUGAGGCCGUUAGGCCGAA AGACUUCG | 11247 |
| 2066 | CACGGCAUC UGGGAAUC | 1829 | GAUUCCCA CUGAUGAGGCCGUUAGGCCGAA AUGCCGUG | 11248 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 2074 | CUGGGAAUC CCCCUCCA | 1830 | UGGAGGGG CUGAUGAGGCCGUUAGGCCGAA AUUCCCAG | 11249 |
| 2080 | AUCCCCCUC CACAGAUC | 1831 | GAUCUGUG CUGAUGAGGCCGUUAGGCCGAA AGGGGGAU | 11250 |
| 2088 | CCACAGAUC AUGUGGUU | 1832 | AACCACAU CUGAUGAGGCCGUUAGGCCGAA AUCUGUGG | 11251 |
| 2096 | CAUGUGGUU UAAAGAUA | 1833 | UAUCUUUA CUGAUGAGGCCGUUAGGCCGAA ACCACAUG | 11252 |
| 2097 | AUGUGGUUU AAAGAUAA | 1834 | UUAUCUUU CUGAUGAGGCCGUUAGGCCGAA AACCACAU | 11253 |
| 2098 | UGUGGUUUA AAGAUAAU | 1835 | AUUAUCUU CUGAUGAGGCCGUUAGGCCGAA AAACCACA | 11254 |
| 2104 | UUAAAGAUA AUGAGACC | 1836 | GGUCUCAU CUGAUGAGGCCGUUAGGCCGAA AUCUUUAA | 11255 |
| 2115 | GAGACCCUU GUAGAAGA | 1837 | UCUUCUAC CUGAUGAGGCCGUUAGGCCGAA AGGGUCUC | 11256 |
| 2118 | ACCCUUGUA GAAGACUC | 1838 | GAGUCCUC CUGAUGAGGCCGUUAGGCCGAA ACAAGGGU | 11257 |
| 2126 | AGAAGACUC AGGCAUUG | 1839 | CAAUGCCU CUGAUGAGGCCGUUAGGCCGAA AGUCUUCU | 11258 |
| 2133 | UCAGGCAUU GUAUUGAA | 1840 | UUCAAUAC CUGAUGAGGCCGUUAGGCCGAA AUGCCUGA | 11259 |
| 2136 | GGCAUUGUA UUGAAGGA | 1841 | UCCUUCAA CUGAUGAGGCCGUUAGGCCGAA ACAAUGCC | 11260 |
| 2138 | CAUUGUAUU GAAGGAUG | 1842 | CAUCCUUC CUGAUGAGGCCGUUAGGCCGAA AUACAAUG | 11261 |
| 2160 | CGGAACCUC ACUAUCCG | 1843 | CGGAUAGU CUGAUGAGGCCGUUAGGCCGAA AGGUUCCG | 11262 |
| 2164 | ACCUCACUA UCCGCAGA | 1844 | UCUGCGGA CUGAUGAGGCCGUUAGGCCGAA AGUGAGGU | 11263 |
| 2166 | CUCACUAUC CGCAGAGU | 1845 | ACUCUGCG CUGAUGAGGCCGUUAGGCCGAA AUAGUGAG | 11264 |
| 2196 | GAAGGCCUC UACACCUG | 1846 | CAGGUGUA CUGAUGAGGCCGUUAGGCCGAA AGGCCUUC | 11265 |
| 2198 | AGGCCUCUA CACCUGCC | 1847 | GGCAGGUG CUGAUGAGGCCGUUAGGCCGAA AGAGGCCU | 11266 |
| 2220 | UGCAGUGUU CUUGGCUG | 1848 | CAGCCAAG CUGAUGAGGCCGUUAGGCCGAA ACACUCCA | 11267 |
| 2221 | GCAGUGUUC UUGGCUGU | 1849 | ACAGCCAA CUGAUGAGGCCGUUAGGCCGAA AACACUGC | 11268 |
| 2223 | AGUGUUCUU GGCUGUGC | 1850 | GCACAGCC CUGAUGAGGCCGUUAGGCCGAA AGAACACU | 11269 |
| 2246 | GGAGGCAUU UUUCAUAA | 1851 | UUAUGAAA CUGAUGAGGCCGUUAGGCCGAA AUGCCUCC | 11270 |
| 2247 | GAGGCAUUU UUCAUAAU | 1852 | AUUAUGAA CUGAUGAGGCCGUUAGGCCGAA AAUGCCUC | 11271 |
| 2248 | AGGCAUUUU UCAUAAUA | 1853 | UAUUAUGA CUGAUGAGGCCGUUAGGCCGAA AAAUGCCU | 11272 |
| 2249 | GGCAUUUUU CAUAAUAG | 1854 | CUAUUAUG CUGAUGAGGCCGUUAGGCCGAA AAAAUGCC | 11273 |
| 2250 | GCAUUUUUC AUAAUAGA | 1855 | UCUAUUAU CUGAUGAGGCCGUUAGGCCGAA AAAAAUGC | 11274 |
| 2253 | UUUUUCAUA AUAGAAGG | 1856 | CCUUCUAU CUGAUGAGGCCGUUAGGCCGAA AUGAAAAA | 11275 |
| 2256 | UUCAUAAUA GAAGGUGC | 1857 | GCACCUUC CUGAUGAGGCCGUUAGGCCGAA AUUAUGAA | 11276 |
| 2282 | GACGAACUU GGAAAUCA | 1858 | UGAUUUCC CUGAUGAGGCCGUUAGGCCGAA AGUUCGUC | 11277 |
| 2289 | UUGGAAAUC AUUAUUCU | 1859 | AGAAUAAU CUGAUGAGGCCGUUAGGCCGAA AUUUCCAA | 11278 |
| 2292 | GAAAUCAUU AUUCUAGU | 1860 | ACUAGAAU CUGAUGAGGCCGUUAGGCCGAA AUGAUUUC | 11279 |
| 2293 | AAAUCAUUA UUCUAGUA | 1861 | UACUAGAA CUGAUGAGGCCGUUAGGCCGAA AAUGAUUU | 11280 |
| 2295 | AUCAUUAUU CUAGUAGG | 1862 | CCUACUAG CUGAUGAGGCCGUUAGGCCGAA AUAAUGAU | 11281 |
| 2296 | UCAUUAUUC UAGUAGGC | 1863 | GCCUACUA CUGAUGAGGCCGUUAGGCCGAA AAUAAUGA | 11282 |
| 2298 | AUUAUUCUA GUAGGCAC | 1864 | GUGCCUAC CUGAUGAGGCCGUUAGGCCGAA AGAAUAAU | 11283 |
| 2301 | AUUCUAGUA GGCACGAC | 1865 | GUCGUGCC CUGAUGAGGCCGUUAGGCCGAA ACUAGAAU | 11284 |
| 2316 | ACGGUGAUU GCCAUGUU | 1866 | AACAUGGC CUGAUGAGGCCGUUAGGCCGAA AUCACCGU | 11285 |

TABLE IV-continued

Human KDR VEGF Receptor-Hammerhead Ribozyme and Substrate Sequence

| Pos | Substrate | Seq ID No | HH Ribozyme Sequence | Seq ID No |
|-----|-----------|-----------|----------------------|-----------|
| 2324 | UGCCAUGUU CUUCUGGC | 1867 | GCCAGAAG CUGAUGAGGCCGUUAGGCCGAA ACAUGGCA | 11286 |
| 2325 | GCCAUGUUC UUCUGGCU | 1868 | AGCCAGAA CUGAUGAGGCCGUUAGGCCGAA AACAUGGC | 11287 |
| 2327 | CAUGUUCUU CUGGCUAC | 1869 | GUAGCCAG CUGAUGAGGCCGUUAGGCCGAA AGAACAUG | 11288 |
| 2328 | AUGUUCUUC UGGCUACU | 1870 | AGUAGCCA CUGAUGAGGCCGUUAGGCCGAA AAGAACAU | 11289 |
| 2334 | UUCUGGCUA CUUCUUGU | 1871 | ACAAGAAG CUGAUGAGGCCGUUAGGCCGAA AGCCAGAA | 11290 |
| 2337 | UGGCUACUU CUUGUCAU | 1872 | AUGACAAG CUGAUGAGGCCGUUAGGCCGAA AGUAGCCA | 11291 |
| 2338 | GGCUACUUC UUGUCAUC | 1873 | GAUGACAA CUGAUGAGGCCGUUAGGCCGAA AAGUAGCC | 11292 |
| 2340 | CUACUUCUU GUCAUCAU | 1874 | AUGAUGAC CUGAUGAGGCCGUUAGGCCGAA AGAAGUAG | 11293 |
| 2343 | CUUCUUGUC AUCACCU | 1875 | AGGAUGAU CUGAUGAGGCCGUUAGGCCGAA ACAAGAAG | 11294 |
| 2346 | CUUGUCAUC AUCCUAGG | 1876 | CCUAGGAU CUGAUGAGGCCGUUAGGCCGAA AUGACAAG | 11295 |
| 2349 | GUCAUCAUC CUAGGGAC | 1877 | GUCCCUAG CUGAUGAGGCCGUUAGGCCGAA AUGAUGAC | 11296 |
| 2352 | AUCAUCCUA GGGACCGU | 1878 | ACGGUCCC CUGAUGAGGCCGUUAGGCCGAA AGGAUGAU | 11297 |
| 2361 | GGGACCGUU AAGCGGGC | 1879 | GCCCGCUU CUGAUGAGGCCGUUAGGCCGAA ACGGUCCC | 11298 |
| 2362 | GGACCGUUA AGCGGGCC | 1880 | GGCCCGCU CUGAUGAGGCCGUUAGGCCGAA AACGGUCC | 11299 |
| 2396 | GACAGGCUA CUUGUCCA | 1881 | UGGACAAG CUGAUGAGGCCGUUAGGCCGAA AGCCUGUC | 11300 |
| 2399 | AGGCUACUU GUCCAUCG | 1882 | CGAUGGAC CUGAUGAGGCCGUUAGGCCGAA AGUAGCCU | 11301 |
| 2402 | CUACUUGUC CAUCGUCA | 1883 | UGACGAUG CUGAUGAGGCCGUUAGGCCGAA ACAAGUAG | 11302 |
| 2406 | UUGUCCAUC GUCAUGGA | 1884 | UCCAUGAC CUGAUGAGGCCGUUAGGCCGAA AUGGACAA | 11303 |
| 2409 | UCCAUCGUC AUGGAUCC | 1885 | GGAUCCAU CUGAUGAGGCCGUUAGGCCGAA ACGAUGGA | 11304 |
| 2416 | UCAUGGAUC CAGAUGAA | 1886 | UUCAUCUG CUGAUGAGGCCGUUAGGCCGAA AUCCAUGA | 11305 |
| 2427 | GAUGAACUC CAUUGGA | 1887 | UCCAAUGG CUGAUGAGGCCGUUAGGCCGAA AGUUCAUC | 11306 |
| 2432 | ACUCCCAUU GGAUGAAC | 1888 | GUUCAUCC CUGAUGAGGCCGUUAGGCCGAA AUGGGAGU | 11307 |
| 2443 | AUGAACAUU GUGAACGA | 1889 | UCGUUCAC CUGAUGAGGCCGUUAGGCCGAA AUGUUCAU | 11308 |
| 2458 | GACUGCCUU AUGAUGCC | 1890 | GGCAUCAU CUGAUGAGGCCGUUAGGCCGAA AGGCAGUC | 11309 |
| 2459 | ACUGCCUUA UGAUGCCA | 1891 | UGGCAUCA CUGAUGAGGCCGUUAGGCCGAA AAGGCAGU | 11310 |
| 2480 | AUGGGAAUU CCCCAGAG | 1892 | CUCUGGGG CUGAUGAGGCCGUUAGGCCGAA AUUCCCAU | 11311 |
| 2481 | UGGGAAUUC CCCAGAGA | 1893 | UCUCUGGG CUGAUGAGGCCGUUAGGCCGAA AAUUCCCA | 11312 |
| 2502 | CUGAACCUA GGUAAGCC | 1894 | GGCUUACC CUGAUGAGGCCGUUAGGCCGAA AGGUUCAG | 11313 |
| 2506 | ACCUAGGUA AGCCUCUU | 1895 | AAGAGGCU CUGAUGAGGCCGUUAGGCCGAA ACCUAGGU | 11314 |
| 2512 | GUAAGCCUC UUGGCCGU | 1896 | ACGGCCAA CUGAUGAGGCCGUUAGGCCGAA AGGCUUAC | 11315 |
| 2514 | AAGCCUCUU GGCCGUGG | 1897 | CCACGGCC CUGAUGAGGCCGUUAGGCCGAA AGAGGCUU | 11316 |
| 2528 | UGGUGCCUU UGGCCAAG | 1898 | CUUGGCCA CUGAUGAGGCCGUUAGGCCGAA AGGCACCA | 11317 |
| 2529 | GGUGCCUUU GGCCAAGA | 1899 | UCUUGGCC CUGAUGAGGCCGUUAGGCCGAA AAGGCACC | 11318 |
| 2541 | CAAGAGAUU GAAGCAGA | 1900 | UCUGCUUC CUGAUGAGGCCGUUAGGCCGAA AUCUCUUG | 11319 |
| 2555 | AGAUGCCUU UGGAAUUG | 1901 | CAAUUCCA CUGAUGAGGCCGUUAGGCCGAA AGGCAUCU | 11320 |
| 2556 | GAUGCCUUU GGAAUUGA | 1902 | UCAAUUCC CUGAUGAGGCCGUUAGGCCGAA AAGGCAUC | 11321 |
| 2562 | UUUGGAAUU GACAAGAC | 1903 | GUCUUGUC CUGAUGAGGCCGUUAGGCCGAA AUUCCAAA | 11322 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 2578 | CAGCAACUU GCAGGACA | 1904 | UGUCCUGC CUGAUGAGGCCGUUAGGCCGAA AGUUGCUG | 11323 |
| 2589 | AGGACAGUA GCAGUCAA | 1905 | UUGACUGC CUGAUGAGGCCGUUAGGCCGAA ACUGUCCU | 11324 |
| 2595 | GUAGCAGUC AAAAUGUU | 1906 | AACAUUUU CUGAUGAGGCCGUUAGGCCGAA ACUGCUAC | 11325 |
| 2603 | CAAAAUGUU GAAAGAAG | 1907 | CUUCUUUC CUGAUGAGGCCGUUAGGCCGAA ACAUUUUG | 11326 |
| 2632 | GUGAGCAUC GAGCUCUC | 1908 | GAGAGCUC CUGAUGAGGCCGUUAGGCCGAA AUGCUCAC | 11327 |
| 2638 | AUCGAGCUC UCAUGUCU | 1909 | AGACAUGA CUGAUGAGGCCGUUAGGCCGAA AGCUCGAU | 11328 |
| 2640 | CGAGCUCUC AUGUCUGA | 1910 | UCAGACAU CUGAUGAGGCCGUUAGGCCGAA AGAGCUCG | 11329 |
| 2645 | UCUCAUGUC UGAACUCA | 1911 | UGAGUUCA CUGAUGAGGCCGUUAGGCCGAA ACAUGAGA | 11330 |
| 2652 | UCUGAACUC AAGAUCCU | 1912 | AGGAUCUU CUGAUGAGGCCGUUAGGCCGAA AGUUCAGA | 11331 |
| 2658 | CUCAAGAUC UCAUUCA | 1913 | UGAAUGAG CUGAUGAGGCCGUUAGGCCGAA AUCUUGAG | 11332 |
| 2661 | AAGAUCCUC AUUCAUAU | 1914 | AUAUGAAU CUGAUGAGGCCGUUAGGCCGAA AGGAUCUU | 11333 |
| 2664 | AUCCUCAUU CAUAUUGG | 1915 | CCAAUAUG CUGAUGAGGCCGUUAGGCCGAA AUGAGGAU | 11334 |
| 2665 | UCCUCAUUC AUAUUGGU | 1916 | ACCAAUAU CUGAUGAGGCCGUUAGGCCGAA AAUGAGGA | 11335 |
| 2668 | UCAUUCAUA UUGGUCAC | 1917 | GUGACCAA CUGAUGAGGCCGUUAGGCCGAA AUGAAUGA | 11336 |
| 2670 | AUUCAUAUU GGUCACCA | 1918 | UGGUGACC CUGAUGAGGCCGUUAGGCCGAA AUAUGAAU | 11337 |
| 2674 | AUAUUGGUC ACCAUCUC | 1919 | GAGAUGGU CUGAUGAGGCCGUUAGGCCGAA ACCAAUAU | 11338 |
| 2680 | GUCACCAUC UCAAUGUG | 1920 | CACAUUGA CUGAUGAGGCCGUUAGGCCGAA AUGGUGAC | 11339 |
| 2682 | CACCAUCUC AAUGUGGU | 1921 | ACCACAUU CUGAUGAGGCCGUUAGGCCGAA AGAUGGUG | 11340 |
| 2691 | AAUGUGGUC AACCUUCU | 1922 | AGAAGGUU CUGAUGAGGCCGUUAGGCCGAA ACCACAUU | 11341 |
| 2697 | GUCAACCUU CUAGGUGC | 1923 | GCACCUAG CUGAUGAGGCCGUUAGGCCGAA AGGUUUAC | 11342 |
| 2698 | UCAACCUUC UAGGUGCC | 1924 | GGCACCUA CUGAUGAGGCCGUUAGGCCGAA AAGGUUGA | 11343 |
| 2700 | AACCUUCUA GGUGCCUG | 1925 | CAGGCACC CUGAUGAGGCCGUUAGGCCGAA AGAAGGUU | 11344 |
| 2710 | GUGCCUGUA CCAAGCCA | 1926 | UGGCUUGG CUGAUGAGGCCGUUAGGCCGAA ACAGGCAC | 11345 |
| 2730 | GGGCCACUC AUGGUGAU | 1927 | AUCACCAU CUGAUGAGGCCGUUAGGCCGAA AGUGGCCC | 11346 |
| 2739 | AUGGUGAUU GUGGAAUU | 1928 | AAUUCCAC CUGAUGAGGCCGUUAGGCCGAA AUCACCAU | 11347 |
| 2747 | UGUGGAAUU CUGCAAAU | 1929 | AUUUGCAG CUGAUGAGGCCGUUAGGCCGAA AUUCCACA | 11348 |
| 2748 | GUGGAAUUC UGCAAAUU | 1930 | AAUUUGCA CUGAUGAGGCCGUUAGGCCGAA AAUUCCAC | 11349 |
| 2756 | CUGCAAAUU GGAAACC | 1931 | GGUUUCCA CUGAUGAGGCCGUUAGGCCGAA AUUUGCAG | 11350 |
| 2757 | UGCAAAUUU GGAAACCU | 1932 | AGGUUUCC CUGAUGAGGCCGUUAGGCCGAA AAUUUGCA | 11351 |
| 2768 | AAACCUGUC CACUUACC | 1933 | GGUAAGUG CUGAUGAGGCCGUUAGGCCGAA ACAGGUUU | 11352 |
| 2773 | UGUCCACUU ACCUGAGG | 1934 | CCUCAGGU CUGAUGAGGCCGUUAGGCCGAA AGUGGACA | 11353 |
| 2774 | GUCCACUUA CCUGAGGA | 1935 | UCCUCAGG CUGAUGAGGCCGUUAGGCCGAA AAGUGGAC | 11354 |
| 2798 | AAAUGAAUU GUCCCCU | 1936 | AGGGGACA CUGAUGAGGCCGUUAGGCCGAA AUUCAUUU | 11355 |
| 2799 | AAUGAAUUU GUCCCUA | 1937 | UAGGGGAC CUGAUGAGGCCGUUAGGCCGAA AAUUCAUU | 11356 |
| 2802 | GAAUUUGUC CCUACAA | 1938 | UUGUAGGG CUGAUGAGGCCGUUAGGCCGAA ACAAAUUC | 11357 |
| 2807 | UGUCCCCUA CAAGACCA | 1939 | UGGUCUUG CUGAUGAGGCCGUUAGGCCGAA AGGGGACA | 11358 |
| 2828 | GGCACGAUU CCGUCAAG | 1940 | CUUGACGG CUGAUGAGGCCGUUAGGCCGAA AUCGUGCC | 11359 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 2829 | GCACGAUUC CGUCAAGG | 1941 | CCUUGACG CUGAUGAGGCCGUUAGGCCGAA AAUCGUGC | 11360 |
| 2833 | GAUUCCGUC AAGGGAAA | 1942 | UUUCCCUU CUGAUGAGGCCGUUAGGCCGAA ACGGAAUC | 11361 |
| 2846 | GAAAGACUA CGUUGGAG | 1943 | CUCCAACG CUGAUGAGGCCGUUAGGCCGAA AGUCUUUC | 11362 |
| 2850 | GACUACGUU GGAGCAAU | 1944 | AUUGCUCC CUGAUGAGGCCGUUAGGCCGAA ACGUAGUC | 11363 |
| 2859 | GGAGCAAUC CCUGUGGA | 1945 | UCCACAGG CUGAUGAGGCCGUUAGGCCGAA AUUGCUCC | 11364 |
| 2869 | CUGUGGAUC UGAAACGG | 1946 | CCGUUUCA CUGAUGAGGCCGUUAGGCCGAA AUCCACAG | 11365 |
| 2882 | ACGGCGCUU GGACAGCA | 1947 | UGCUGUCC CUGAUGAGGCCGUUAGGCCGAA AGCGCCGU | 11366 |
| 2892 | GACAGCAUC ACCAGUAG | 1948 | CUACUGGU CUGAUGAGGCCGUUAGGCCGAA AUGCUGUC | 11367 |
| 2899 | UCACCAGUA GCCAGAGC | 1949 | GCUCUGGC CUGAUGAGGCCGUUAGGCCGAA ACUGGUGA | 11368 |
| 2909 | CCAGAGCUC AGCCAGCU | 1950 | AGCUGGCU CUGAUGAGGCCGUUAGGCCGAA AGCUCUGG | 11369 |
| 2918 | AGCCAGCUC UGGAUUUG | 1951 | CAAAUCCA CUGAUGAGGCCGUUAGGCCGAA AGCUGGCU | 11370 |
| 2924 | CUCUGGAUU UGUGGAGG | 1952 | CCUCCACA CUGAUGAGGCCGUUAGGCCGAA AUCCAGAG | 11371 |
| 2925 | UCUGGAUUU GUGGAGGA | 1953 | UCCUCCAC CUGAUGAGGCCGUUAGGCCGAA AAUCCAGA | 11372 |
| 2939 | GGAGAAGUC CCUCAGUG | 1954 | CACUGAGG CUGAUGAGGCCGUUAGGCCGAA ACUUCUCC | 11373 |
| 2943 | AAGUCCCUC AGUGAUGU | 1955 | ACAUCACU CUGAUGAGGCCGUUAGGCCGAA AGGGACUU | 11374 |
| 2952 | AGUGAUGUA GAAGAAGA | 1956 | UCUUCUUC CUGAUGAGGCCGUUAGGCCGAA ACAUCACU | 11375 |
| 2968 | AGGAAGCUC CUGAAGAU | 1957 | AUCUUCAG CUGAUGAGGCCGUUAGGCCGAA AGCUUCCU | 11376 |
| 2977 | CUGAAGAUC UGUAUAAG | 1958 | CUUAUACA CUGAUGAGGCCGUUAGGCCGAA AUCUUCAG | 11377 |
| 2981 | AGAUCUGUA UAAGGACU | 1959 | AGUCCUUA CUGAUGAGGCCGUUAGGCCGAA ACAGAUCU | 11378 |
| 2983 | AUCUGUAUA AGGACUUC | 1960 | GAAGUCCU CUGAUGAGGCCGUUAGGCCGAA AUACAGAU | 11379 |
| 2990 | UAAGGACUU CCUGACCU | 1961 | AGGUCAGG CUGAUGAGGCCGUUAGGCCGAA AGUCCUUA | 11380 |
| 2991 | AAGGACUUC CUGACCUU | 1962 | AAGGUCAG CUGAUGAGGCCGUUAGGCCGAA AAGUCCUU | 11381 |
| 2999 | CCUGACCUU GGAGCAUC | 1963 | GAUGCUCC CUGAUGAGGCCGUUAGGCCGAA AGGUCAGG | 11382 |
| 3007 | UGGAGCAUC UCAUCUGU | 1964 | ACAGAUGA CUGAUGAGGCCGUUAGGCCGAA AUGCUCCA | 11383 |
| 3009 | GAGCAUCUC AUCUGUUA | 1965 | UAACAGAU CUGAUGAGGCCGUUAGGCCGAA AGAUGCUC | 11384 |
| 3012 | CAUCUCAUC UGUUACAG | 1966 | CUGUAACA CUGAUGAGGCCGUUAGGCCGAA AUGAGAUG | 11385 |
| 3016 | UCAUCUGUU ACAGCUUC | 1967 | GAAGCUGU CUGAUGAGGCCGUUAGGCCGAA ACAGAUGA | 11386 |
| 3017 | CAUCUGUUA CAGCUUCC | 1968 | GGAAGCUG CUGAUGAGGCCGUUAGGCCGAA AACAGAUG | 11387 |
| 3023 | UUACAGCUU CCAAGUGG | 1969 | CCACUUGG CUGAUGAGGCCGUUAGGCCGAA AGCUGUAA | 11388 |
| 3024 | UACAGCUUC CAAGUGGC | 1970 | GCCACUUG CUGAUGAGGCCGUUAGGCCGAA AAGCUGUA | 11389 |
| 3034 | AAGUGGCUA AGGCAUG | 1971 | CAUGCCCU CUGAUGAGGCCGUUAGGCCGAA AGCCACUU | 11390 |
| 3047 | CAUGGAGUU CUUGGCAU | 1972 | AUGCCAAG CUGAUGAGGCCGUUAGGCCGAA ACUCCAUG | 11391 |
| 3048 | AUGGAGGUC UUGGCAUC | 1973 | GAUGCCAA CUGAUGAGGCCGUUAGGCCGAA AACUCCAU | 11392 |
| 3050 | GGAGUUCUU GGCAUCGC | 1974 | GCGAUGCC CUGAUGAGGCCGUUAGGCCGAA AGAACUCC | 11393 |
| 3056 | CUUGGCAUC GCGAAAGU | 1975 | ACUUUCGC CUGAUGAGGCCGUUAGGCCGAA AUGCCAAG | 11394 |
| 3067 | GAAAGUGUA UCCACAGG | 1976 | CCUGUGGA CUGAUGAGGCCGUUAGGCCGAA ACACUUUC | 11395 |
| 3069 | AAGUGUAUC CACAGGGA | 1977 | UCCCUGUG CUGAUGAGGCCGUUAGGCCGAA AUACACUU | 11396 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 3094 | CACGAAAUA UCCUCUUA | 1978 | UAAGAGGA CUGAUGAGGCCGUUAGGCCGAA AUUUCCUG | 11397 |
| 3096 | CGAAAUAUC CUCUGAUC | 1979 | GAUAAGAG CUGAUGAGGCCGUUAGGCCGAA AUAUUUCG | 11398 |
| 3099 | AAUAUCCUC UUAUCGGA | 1980 | UCCGAUAA CUGAUGAGGCCGUUAGGCCGAA AGGAUAUU | 11399 |
| 3101 | UAUCCUCUU AUCGGAGA | 1981 | UCUCCGAU CUGAUGAGGCCGUUAGGCCGAA AGAGGAUA | 11400 |
| 3102 | AUCCUCUUA UCGGAGAA | 1982 | UUCUCCGA CUGAUGAGGCCGUUAGGCCGAA AAGAGGAU | 11401 |
| 3104 | CCUCUUAUC GGAGAAGA | 1983 | UCUUCUCC CUGAUGAGGCCGUUAGGCCGAA AUAAGAGG | 11402 |
| 3120 | AACGUGGUU AAAAUCUG | 1984 | CAGAUUUU CUGAUGAGGCCGUUAGGCCGAA ACCACGUU | 11403 |
| 3121 | ACGUGGUUA AAAUCUGU | 1985 | ACAGAUUU CUGAUGAGGCCGUUAGGCCGAA AACCACGU | 11404 |
| 3126 | GUUAAAAUC UGUGACUU | 1986 | AAGUCACA CUGAUGAGGCCGUUAGGCCGAA AUUUUAAC | 11405 |
| 3134 | CUGUGACUU UGGCUUGG | 1987 | CCAAGCCA CUGAUGAGGCCGUUAGGCCGAA AGUCACAG | 11406 |
| 3135 | UGUGACUUU GGCUUGGC | 1988 | GCCAAGCC CUGAUGAGGCCGUUAGGCCGAA AAGUCACA | 11407 |
| 3140 | CUUUGGCUU GGCCCGGG | 1989 | CCCGGGCC CUGAUGAGGCCGUUAGGCCGAA AGCCAAAG | 11408 |
| 3151 | CCCGGGAUA UUUAUAAA | 1990 | UUUAUAAA CUGAUGAGGCCGUUAGGCCGAA AUCCCGGG | 11409 |
| 3153 | CGGGAUAUU UAUAAAGA | 1991 | UCUUUAUA CUGAUGAGGCCGUUAGGCCGAA AUAUCCCG | 11410 |
| 3154 | GGGAUAUUU AUAAAGAU | 1992 | AUCUUUAU CUGAUGAGGCCGUUAGGCCGAA AAUAUCCC | 11411 |
| 3155 | GGAUAUUUA UAAAGAUC | 1993 | GAUCUUUA CUGAUGAGGCCGUUAGGCCGAA AAAUAUCC | 11412 |
| 3157 | AUAUUUAUA AAGAUCCA | 1994 | UGGAUCUU CUGAUGAGGCCGUUAGGCCGAA AUAAAUAU | 11413 |
| 3163 | AUAAAGAUC CAGAUUAU | 1995 | AUAAUCUG CUGAUGAGGCCGUUAGGCCGAA AUCUUUAU | 11414 |
| 3169 | AUCCAGAUU AUGUCAGA | 1996 | UCUGACAU CUGAUGAGGCCGUUAGGCCGAA AUCUGGAU | 11415 |
| 3170 | UCCAGAUUA UGUCAGAA | 1997 | UUCUGACA CUGAUGAGGCCGUUAGGCCGAA AAUCUGGA | 11416 |
| 3174 | GAUUAUGUC AGAAAGG | 1998 | CCUUUUCU CUGAUGAGGCCGUUAGGCCGAA ACAUAAUC | 11417 |
| 3190 | GAGAUGCUC GCCUCCCU | 1999 | AGGGAGGC CUGAUGAGGCCGUUAGGCCGAA AGCAUCUC | 11418 |
| 3195 | GCUCGCCUC CCUUUGAA | 2000 | UUCAAAGG CUGAUGAGGCCGUUAGGCCGAA AGGCGAGC | 11419 |
| 3199 | GCCUCCCUU UGAAAUGG | 2001 | CCAUUUCA CUGAUGAGGCCGUUAGGCCGAA AGGGAGGC | 11420 |
| 3200 | CCUCCCUUU GAAAUGGA | 2002 | UCCAUUUC CUGAUGAGGCCGUUAGGCCGAA AAGGGAGG | 11421 |
| 3225 | GAAACAAUU UUGACAG | 2003 | CUGUCAAA CUGAUGAGGCCGUUAGGCCGAA AUUGUUUC | 11422 |
| 3226 | AAACAAUUU UGACAGA | 2004 | UCUGUCAA CUGAUGAGGCCGUUAGGCCGAA AAUUGUUU | 11423 |
| 3227 | AACAAUUUU UGACAGAG | 2005 | CUCUGUCA CUGAUGAGGCCGUUAGGCCGAA AAAUUGUU | 11424 |
| 3228 | ACAAUUUUU GACAGAGU | 2006 | ACUCUGUC CUGAUGAGGCCGUUAGGCCGAA AAAAUUGU | 11425 |
| 3239 | CAGAGUGUA CACAAUCC | 2007 | GGAUUGUG CUGAUGAGGCCGUUAGGCCGAA ACACUCUG | 11426 |
| 3246 | UACACAAUC CAGAGUGA | 2008 | UCACUCUG CUGAUGAGGCCGUUAGGCCGAA AUUGUGUA | 11427 |
| 3258 | AGUGACGUC UGGUCUUU | 2009 | AAAGACCA CUGAUGAGGCCGUUAGGCCGAA ACGUCACU | 11428 |
| 3263 | CGUCUGGUC UUUUGGUG | 2010 | CACCAAAA CUGAUGAGGCCGUUAGGCCGAA ACCAGACG | 11429 |
| 3265 | UCUGGUCUU UUGGUGUU | 2011 | AACACCAA CUGAUGAGGCCGUUAGGCCGAA AGACCAGA | 11430 |
| 3266 | CUGGUCUUU UGGUGUUU | 2012 | AAACACCA CUGAUGAGGCCGUUAGGCCGAA AAGACCAG | 11431 |
| 3267 | UGGUCUUUU GGUGUUUU | 2013 | AAAACACC CUGAUGAGGCCGUUAGGCCGAA AAAGACCA | 11432 |
| 3273 | UUUGGUGUU UUGCUGUG | 2014 | CACAGCAA CUGAUGAGGCCGUUAGGCCGAA ACACCAAA | 11433 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 3274 | UUGGUGUUU UGCUGUGG | 2015 | CCACAGCA CUGAUGAGGCCGUUAGGCCGAA AACACCAA | 11434 |
| 3275 | UGGUGUUUU GCUGUGGG | 2016 | CCCACAGC CUGAUGAGGCCGUUAGGCCGAA AAACACCA | 11435 |
| 3288 | UGGGAAAUA UUUUCCUU | 2017 | AAGGAAAA CUGAUGAGGCCGUUAGGCCGAA AUUUCCCA | 11436 |
| 3290 | GGAAAUAUU UUCCUUAG | 2018 | CUAAGGAA CUGAUGAGGCCGUUAGGCCGAA AUAUUUCC | 11437 |
| 3291 | GAAAUAUUU UCCUUAGG | 2019 | CCUAAGGA CUGAUGAGGCCGUUAGGCCGAA AAUAUUUC | 11438 |
| 3292 | AAAUAUUUU CCUUAGGU | 2020 | ACCUAAGG CUGAUGAGGCCGUUAGGCCGAA AAAUAUUU | 11439 |
| 3293 | AAUAUUUUC CUUAGGUG | 2021 | CACCUAAG CUGAUGAGGCCGUUAGGCCGAA AAAAUAUU | 11440 |
| 3296 | AUUUUCCUU AGGUGCUU | 2022 | AAGCACCU CUGAUGAGGCCGUUAGGCCGAA AGGAAAAU | 11441 |
| 3297 | UUUUCCUUA GGUGCUUC | 2023 | GAAGCACC CUGAUGAGGCCGUUAGGCCGAA AAGGAAAA | 11442 |
| 3304 | UAGGUGCUU CUCCAUAU | 2024 | AUAUGGAG CUGAUGAGGCCGUUAGGCCGAA AGCACCUA | 11443 |
| 3305 | AGGUGCUUC UCCAUAUC | 2025 | GAUAUGGA CUGAUGAGGCCGUUAGGCCGAA AAGCACCU | 11444 |
| 3307 | GUGCUUCUC CAUAUCCU | 2026 | AGGAUAUG CUGAUGAGGCCGUUAGGCCGAA AGAAGCAC | 11445 |
| 3311 | UUCUCCAUA UCCUGGGG | 2027 | CCCCAGGA CUGAUGAGGCCGUUAGGCCGAA AUGGAGAA | 11446 |
| 3313 | CUCCAUAUC CUGGGGUA | 2028 | UACCCCAG CUGAUGAGGCCGUUAGGCCGAA AUAUGGAG | 11447 |
| 3321 | CCUGGGGUA AAGAUUGA | 2029 | UCAAUCUU CUGAUGAGGCCGUUAGGCCGAA ACCCCAGG | 11448 |
| 3327 | GUAAAGAUU GAUGAAGA | 2030 | UCUUCAUC CUGAUGAGGCCGUUAGGCCGAA AUCUUUAC | 11449 |
| 3338 | UGAAGAAUU UUGUAGGC | 2031 | GCCUACAA CUGAUGAGGCCGUUAGGCCGAA AUUCUUCA | 11450 |
| 3339 | GAAGAAUUU UGUAGGCG | 2032 | CGCCUACA CUGAUGAGGCCGUUAGGCCGAA AAUUCUUC | 11451 |
| 3340 | AAGAAUUUU GUAGGCGA | 2033 | UCGCCUAC CUGAUGAGGCCGUUAGGCCGAA AAAUUCUU | 11452 |
| 3343 | AAUUUUGUA GGCGAUUG | 2034 | CAAUCGCC CUGAUGAGGCCGUUAGGCCGAA ACAAAAUU | 11453 |
| 3350 | UAGGCGAUU GAAAGAAG | 2035 | CUUCUUUC CUGAUGAGGCCGUUAGGCCGAA AUCGCCUA | 11454 |
| 3364 | AAGGAACUA GAAUGAGG | 2036 | CCUCAUUC CUGAUGAGGCCGUUAGGCCGAA AGUUCCUU | 11455 |
| 3382 | CCCCUGAUU AUACUACA | 2037 | UGUAGUAU CUGAUGAGGCCGUUAGGCCGAA AUCAGGGG | 11456 |
| 3383 | CCCUGAUUA UACUACAC | 2038 | GUGUAGUA CUGAUGAGGCCGUUAGGCCGAA AAUCAGGG | 11457 |
| 3385 | CUGAUUAUA CUACACCA | 2039 | UGGUGUAG CUGAUGAGGCCGUUAGGCCGAA AUAAUCAG | 11458 |
| 3388 | AUUAUACUA CACCAGAA | 2040 | UUCUGGUG CUGAUGAGGCCGUUAGGCCGAA AGUAUAAU | 11459 |
| 3401 | AGAAAUGUA CCAGACCA | 2041 | UGGUCUGG CUGAUGAGGCCGUUAGGCCGAA ACAUUUCU | 11460 |
| 3439 | AGCCCAGUC AGAGACCC | 2042 | GGGUCUCU CUGAUGAGGCCGUUAGGCCGAA ACUGGGCU | 11461 |
| 3452 | ACCCACGUU UUCAGAGU | 2043 | ACUCUGAA CUGAUGAGGCCGUUAGGCCGAA ACGUGGGU | 11462 |
| 3453 | CCCACGUUU UCAGAGUU | 2044 | AACUCUGA CUGAUGAGGCCGUUAGGCCGAA AACGUGGG | 11463 |
| 3454 | CCACGUUUU CAGAGUUG | 2045 | CAACUCUG CUGAUGAGGCCGUUAGGCCGAA AAACGUGG | 11464 |
| 3455 | CACGUUUUC AGAGUUGG | 2046 | CCAACUCU CUGAUGAGGCCGUUAGGCCGAA AAAACGUG | 11465 |
| 3461 | UUCAGAGUU GGUGGAAC | 2047 | GUUCCACC CUGAUGAGGCCGUUAGGCCGAA ACUCUGAA | 11466 |
| 3472 | UGGAACAUU UGGGAAAU | 2048 | AUUUCCCA CUGAUGAGGCCGUUAGGCCGAA AUGUUCCA | 11467 |
| 3473 | GGAACAUUU GGGAAAUC | 2049 | GAUUUCCC CUGAUGAGGCCGUUAGGCCGAA AAUGUUCC | 11468 |
| 3481 | UGGGAAAUC UCUUGCAA | 2050 | UUGCAAGA CUGAUGAGGCCGUUAGGCCGAA AUUUCCCA | 11469 |
| 3483 | GGAAAUCUC UUGCAAGC | 2051 | GCUUGCAA CUGAUGAGGCCGUUAGGCCGAA AGAUUUCC | 11470 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 3485 | AAAUCUCUU GCAAGCUA | 2052 | UAGCUUGC CUGAUGAGGCCGUUAGGCCGAA AGAGAUUU | 11471 |
| 3493 | UGCAAGCUA AUGGUCAG | 2053 | CUGAGCAU CUGAUGAGGCCGUUAGGCCGAA AGCUUGCA | 11472 |
| 3499 | CUAAUGCUC AGCAGGAU | 2054 | AUCCUGCU CUGAUGAGGCCGUUAGGCCGAA AGCAUUAG | 11473 |
| 3518 | CAAAGACUA CAUUGUUC | 2055 | GAACAAUG CUGAUGAGGCCGUUAGGCCGAA AGUCUUUG | 11474 |
| 3522 | GACUACAUU GUUCUUCC | 2056 | GGAAGAAC CUGAUGAGGCCGUUAGGCCGAA AUGUAGUC | 11475 |
| 3525 | UACAUUGUU CUUCCGAU | 2057 | AUCGGAAG CUGAUGAGGCCGUUAGGCCGAA ACAAUGUA | 11476 |
| 3526 | ACAUUGUUC UUCCGAUA | 2058 | UAUCGGAA CUGAUGAGGCCGUUAGGCCGAA AACAAUGU | 11477 |
| 3528 | AUUGUUCUU CCGAUAUC | 2059 | GAUAUCGG CUGAUGAGGCCGUUAGGCCGAA AGAACAAU | 11478 |
| 3529 | UUGUUCUUC CGAUAUCA | 2060 | UGAUAUCG CUGAUGAGGCCGUUAGGCCGAA AAGAACAA | 11479 |
| 3534 | CUUCCGAUA UCAGAGAC | 2061 | GUCUCUGA CUGAUGAGGCCGUUAGGCCGAA AUCGGAAG | 11480 |
| 3536 | UCCGAUAUC AGAGACUU | 2062 | AAGUCUCU CUGAUGAGGCCGUUAGGCCGAA AUAUCGGA | 11481 |
| 3544 | CAGAGACUU UGAGCAUG | 2063 | CAUGCUCA CUGAUGAGGCCGUUAGGCCGAA AGUCUCUG | 11482 |
| 3545 | AGAGACUUU GAGCAUGG | 2064 | CCAUGCUC CUGAUGAGGCCGUUAGGCCGAA AAGUCUCU | 11483 |
| 3562 | AAGAGGAUU CUGGACUC | 2065 | GAGUCCAG CUGAUGAGGCCGUUAGGCCGAA AUCCUCUU | 11484 |
| 3563 | AGAGGAUUC UGGACUCU | 2066 | AGAGUCCA CUGAUGAGGCCGUUAGGCCGAA AAUCCUCU | 11485 |
| 3570 | UCGGACUC UCUCUGCC | 2067 | GGCAGAGA CUGAUGAGGCCGUUAGGCCGAA AGUCCAGA | 11486 |
| 3572 | UGGACUCUC UCUGCCUA | 2068 | UAGGCAGA CUGAUGAGGCCGUUAGGCCGAA AGAGUCCA | 11487 |
| 3574 | GACUCUCUC UGCCUACC | 2069 | GGUAGGCA CUGAUGAGGCCGUUAGGCCGAA AGAGAGUC | 11488 |
| 3580 | CUCUGCCUA CCUCACCU | 2070 | AGGUGAGG CUGAUGAGGCCGUUAGGCCGAA AGGCAGAG | 11489 |
| 3584 | GCCUACCUC ACCUGUUU | 2071 | AAACAGGU CUGAUGAGGCCGUUAGGCCGAA AGGUAGGC | 11490 |
| 3591 | UCACCUGUU UCCUGUAU | 2072 | AUACAGGA CUGAUGAGGCCGUUAGGCCGAA ACAGGUGA | 11491 |
| 3592 | CACCUGUUU CCUGUAUG | 2073 | CAUACAGG CUGAUGAGGCCGUUAGGCCGAA AACAGGUG | 11492 |
| 3593 | ACCUGUUUC CUGUAUGG | 2074 | CCAUACAG CUGAUGAGGCCGUUAGGCCGAA AAACAGGU | 11493 |
| 3598 | UUUCCUGUA UGGAGGAG | 2075 | CUCCUCCA CUGAUGAGGCCGUUAGGCCGAA ACAGGAAA | 11494 |
| 3615 | GAGGAAGUA UGUGACCC | 2076 | GGGUCACA CUGAUGAGGCCGUUAGGCCGAA ACUUCCUC | 11495 |
| 3629 | CCCCAAAUU CCAUUAUG | 2077 | CAUAAUGG CUGAUGAGGCCGUUAGGCCGAA AUUUGGGG | 11496 |
| 3630 | CCCAAAUUC CAUUAUGA | 2078 | UCAUAAUG CUGAUGAGGCCGUUAGGCCGAA AAUUUGGG | 11497 |
| 3634 | AAUUCCAUU AUGACAAC | 2079 | GUUGUCAU CUGAUGAGGCCGUUAGGCCGAA AUGGAAUU | 11498 |
| 3635 | AUUCCAUUA UGACAACA | 2080 | UGUUGUCA CUGAUGAGGCCGUUAGGCCGAA AAUGGAAU | 11499 |
| 3654 | GCAGGAAUC AGUCAGUA | 2081 | UACUGACU CUGAUGAGGCCGUUAGGCCGAA AUUCCUGC | 11500 |
| 3658 | GAAUCAGUC AGUAUCUG | 2082 | CAGAUACU CUGAUGAGGCCGUUAGGCCGAA ACUGAUUC | 11501 |
| 3662 | CAGUCAGUA UCUGCAGA | 2083 | UCUGCAGA CUGAUGAGGCCGUUAGGCCGAA ACUGACUG | 11502 |
| 3664 | GUCAGUAUC UGCAGAAC | 2084 | GUUCUGCA CUGAUGAGGCCGUUAGGCCGAA AUACUGAC | 11503 |
| 3676 | AGAACAGUA AGCGAAAG | 2085 | CUUUCGCU CUGAUGAGGCCGUUAGGCCGAA ACUGUUCU | 11504 |
| 3702 | GUGAGUGUA AAAACAUU | 2086 | AAUGUUUU CUGAUGAGGCCGUUAGGCCGAA ACACUCAC | 11505 |
| 3710 | AAAACAUU UGAAGAUA | 2087 | UAUCUUCA CUGAUGAGGCCGUUAGGCCGAA AUGUUUUU | 11506 |
| 3711 | AAAACAUUU GAAGAUAU | 2088 | AUAUCUUC CUGAUGAGGCCGUUAGGCCGAA AAUGUUUU | 11507 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 3718 | UUGAAGAUA UCCCGUUA | 2089 | UAACGGGA CUGAUGAGGCCGUUAGGCCGAA AUCUUCAA | 11508 |
| 3720 | GAAGAUAUC CGUUAGA | 2090 | UCUAACGG CUGAUGAGGCCGUUAGGCCGAA AUAUCUUC | 11509 |
| 3725 | UAUCCCGUU AGAAGAAC | 2091 | GUUCUUCU CUGAUGAGGCCGUUAGGCCGAA ACGGGAUA | 11510 |
| 3726 | AUCCCGUUA GAAGAACC | 2092 | GGUUCUUC CUGAUGAGGCCGUUAGGCCGAA AACGGGAU | 11511 |
| 3741 | CCAGAAGUA AAAGUAAU | 2093 | AUUACUUU CUGAUGAGGCCGUUAGGCCGAA ACUUCUGG | 11512 |
| 3747 | GUAAAGUA AUCCCAGA | 2094 | UCUGGGAU CUGAUGAGGCCGUUAGGCCGAA ACUUUUAC | 11513 |
| 3750 | AAAGUAAUC CCAGAUGA | 2095 | UCAUCUGG CUGAUGAGGCCGUUAGGCCGAA AUUACUUU | 11514 |
| 3778 | ACAGUGGUA UGGUUCUU | 2096 | AAGAACCA CUGAUGAGGCCGUUAGGCCGAA ACCACUGU | 11515 |
| 3783 | GGUAUGGUU CUUGCCUC | 2097 | GAGGCAAG CUGAUGAGGCCGUUAGGCCGAA ACCAUACC | 11516 |
| 3784 | GUAUGGUUC UUGCCUCA | 2098 | UGAGGCAA CUGAUGAGGCCGUUAGGCCGAA AACCAUAC | 11517 |
| 3786 | AUGGUUCUU GCCUCAGA | 2099 | UCUGAGGC CUGAUGAGGCCGUUAGGCCGAA AGAACCAU | 11518 |
| 3791 | UCUUGCCUC AGAAGAGC | 2100 | GCUCUUCU CUGAUGAGGCCGUUAGGCCGAA AGGCAAGA | 11519 |
| 3808 | UGAAAACUU UGGAAGAC | 2101 | GUCUUCCA CUGAUGAGGCCGUUAGGCCGAA AGUUUUCA | 11520 |
| 3809 | GAAAACUUU GGAAGACA | 2102 | UGUCUUCC CUGAUGAGGCCGUUAGGCCGAA AAGUUUUC | 11521 |
| 3827 | AACCAAAUU AUCUCCAU | 2103 | AUGGAGAU CUGAUGAGGCCGUUAGGCCGAA AUUUGGUU | 11522 |
| 3828 | ACCAAAUUA UCUCCAUC | 2104 | GAUGGAGA CUGAUGAGGCCGUUAGGCCGAA AAUUUGGU | 11523 |
| 3830 | CAAAUUAUC UCCAUCUU | 2105 | AAGAUGGA CUGAUGAGGCCGUUAGGCCGAA AUAAUUUG | 11524 |
| 3832 | AAUUAUCUC CAUCUUUU | 2106 | AAAAGAUG CUGAUGAGGCCGUUAGGCCGAA AGAUAAUU | 11525 |
| 3836 | AUCUCCAUC UUUUGGUG | 2107 | CACCAAAA CUGAUGAGGCCGUUAGGCCGAA AUGGAGAU | 11526 |
| 3838 | CUCCAUCUU UUGGUGGA | 2108 | UCCACCAA CUGAUGAGGCCGUUAGGCCGAA AGAUGGAG | 11527 |
| 3839 | UCCAUCUUU UGGUGGAA | 2109 | UUCCACCA CUGAUGAGGCCGUUAGGCCGAA AAGAUGGA | 11528 |
| 3840 | CCAUCUUUU GGUGGAAU | 2110 | AUUCCACC CUGAUGAGGCCGUUAGGCCGAA AAAGAUGG | 11529 |
| 3872 | CAGGGAGUC UGUGGCAU | 2111 | AUGCCACA CUGAUGAGGCCGUUAGGCCGAA ACUCCCUG | 11530 |
| 3881 | UGUGGCAUC UGAAGGCU | 2112 | AGCCUUCA CUGAUGAGGCCGUUAGGCCGAA AUGCCACA | 11531 |
| 3890 | UGAAGGCUC AAACCAGA | 2113 | UCUGGUUU CUGAUGAGGCCGUUAGGCCGAA AGCCUUCA | 11532 |
| 3908 | AAGCGGCUA CCAGUCCG | 2114 | CGGACUGG CUGAUGAGGCCGUUAGGCCGAA AGCCGCUU | 11533 |
| 3914 | CUACCAGUC GGAUAUC | 2115 | GAUAUCCG CUGAUGAGGCCGUUAGGCCGAA ACUGGUAG | 11534 |
| 3920 | GUCCGGAUA UCACUCCG | 2116 | CGGAGUGA CUGAUGAGGCCGUUAGGCCGAA AUCCGGAC | 11535 |
| 3922 | CCGGAUAUC ACUCCGAU | 2117 | AUCGGAGU CUGAUGAGGCCGUUAGGCCGAA AUAUCCGG | 11536 |
| 3926 | AUAUCACUC CGAUGACA | 2118 | UGUCAUCG CUGAUGAGGCCGUUAGGCCGAA AGUGAUAU | 11537 |
| 3950 | CACCGUGUA CUCCAGUG | 2119 | CACUGGAG CUGAUGAGGCCGUUAGGCCGAA ACACGGUG | 11538 |
| 3953 | CGUGUACUC CAGUGAGG | 2120 | CCUCACUG CUGAUGAGGCCGUUAGGCCGAA AGUACACG | 11539 |
| 3972 | GCAGAACUU UUAAAGCU | 2121 | AGCUUUAA CUGAUGAGGCCGUUAGGCCGAA AGUUCUGC | 11540 |
| 3973 | CAGAACUUU UAAAGCUG | 2122 | CAGCUUUA CUGAUGAGGCCGUUAGGCCGAA AAGUUCUG | 11541 |
| 3974 | AGAACUUUU AAAGCUGA | 2123 | UCAGCUUU CUGAUGAGGCCGUUAGGCCGAA AAAGUUCU | 11542 |
| 3975 | GAACUUUUA AAGCUGAU | 2124 | AUCAGCUU CUGAUGAGGCCGUUAGGCCGAA AAAAGUUC | 11543 |
| 3984 | AAGCUGAUA GAGAUUGG | 2125 | CCAAUCUC CUGAUGAGGCCGUUAGGCCGAA AUCAGCUU | 11544 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 3990 | AUAGAGAUU GGAGUGCA | 2126 | UGCACUCC CUGAUGAG<u>GCCGUUAGGCC</u>GAA AUCUCUAU | 11545 |
| 4006 | AAACCGGUA GCACAGCC | 2127 | GGCUGUGC CUGAUGAG<u>GCCGUUAGGCC</u>GAA ACCGGUUU | 11546 |
| 4020 | GCCCAGAUU CUCCAGCC | 2128 | GGCUGGAG CUGAUGAG<u>GCCGUUAGGCC</u>GAA AUCUGGGC | 11547 |
| 4021 | CCCAGAUUC UCCAGCCU | 2129 | AGGCUGGA CUGAUGAG<u>GCCGUUAGGCC</u>GAA AAUCUGGG | 11548 |
| 4023 | CAGAUUCUC CAGCCUGA | 2130 | UCAGGCUG CUGAUGAG<u>GCCGUUAGGCC</u>GAA AGAAUCUG | 11549 |
| 4052 | ACUGAGCUC UCCUCCUG | 2131 | CAGGAGGA CUGAUGAG<u>GCCGUUAGGCC</u>GAA AGCUCAGU | 11550 |
| 4054 | UGAGCUCUC CUCCUGUU | 2132 | AACAGGAG CUGAUGAG<u>GCCGUUAGGCC</u>GAA AGAGCUCA | 11551 |
| 4057 | GCUCUCCUC CUGUUUAA | 2133 | UUAAACAG CUGAUGAG<u>GCCGUUAGGCC</u>GAA AGGAGAGC | 11552 |
| 4062 | CCUCCUGUU UAAAAGGA | 2134 | UCCUUUUA CUGAUGAG<u>GCCGUUAGGCC</u>GAA ACAGGAGG | 11553 |
| 4063 | CUCCUGUUU AAAAGGAA | 2135 | UUCCUUUU CUGAUGAG<u>GCCGUUAGGCC</u>GAA AACAGGAG | 11554 |
| 4064 | UCCUGUUUA AAAGGAAG | 2136 | CUUCCUUU CUGAUGAG<u>GCCGUUAGGCC</u>GAA AAACAGGA | 11555 |
| 4076 | GGAAGCAUC CACACCCC | 2137 | GGGGUGUG CUGAUGAG<u>GCCGUUAGGCC</u>GAA AUGCUUCC | 11556 |
| 4089 | CCCCAACUC CCGGACAU | 2138 | AUGUCCGG CUGAUGAG<u>GCCGUUAGGCC</u>GAA AGUUGGGG | 11557 |
| 4098 | CCGGACAUC ACAUGAGA | 2139 | UCUCAUGU CUGAUGAG<u>GCCGUUAGGCC</u>GAA AUGUCCGG | 11558 |
| 4110 | UGAGAGGUC UGCUCAGA | 2140 | UCUGAGCA CUGAUGAG<u>GCCGUUAGGCC</u>GAA ACCUCUCA | 11559 |
| 4115 | GGUCUGCUC AGAUUUUG | 2141 | CAAAAUCU CUGAUGAG<u>GCCGUUAGGCC</u>GAA AGCAGACC | 11560 |
| 4120 | GCUCAGAUU UUGAAGUG | 2142 | CACUUCAA CUGAUGAG<u>GCCGUUAGGCC</u>GAA AUCUGAGC | 11561 |
| 4121 | CUCAGAUUU UGAAGUGU | 2143 | ACACUUCA CUGAUGAG<u>GCCGUUAGGCC</u>GAA AAUCUGAG | 11562 |
| 4122 | UCAGAUUUU GAAGUGUU | 2144 | AACACUUC CUGAUGAG<u>GCCGUUAGGCC</u>GAA AAAUCUGA | 11563 |
| 4130 | UGAAGUGUU GUUCUUUC | 2145 | GAAAGAAC CUGAUGAG<u>GCCGUUAGGCC</u>GAA ACACUUCA | 11564 |
| 4133 | AGUGUUGUU CUUUCCAC | 2146 | GUGGAAAG CUGAUGAG<u>GCCGUUAGGCC</u>GAA ACAACACU | 11565 |
| 4134 | GUGUUGUUC UUUCCACC | 2147 | GGUGGAAA CUGAUGAG<u>GCCGUUAGGCC</u>GAA AACAACAC | 11566 |
| 4136 | GUUGUUCUU UCCACCAG | 2148 | CUGGUGGA CUGAUGAG<u>GCCGUUAGGCC</u>GAA AGAACAAC | 11567 |
| 4137 | UUGUUCUUU CCACCAGC | 2149 | GCUGGUGG CUGAUGAG<u>GCCGUUAGGCC</u>GAA AAGAACAA | 11568 |
| 4138 | UGUUCUUUC CACCAGCA | 2150 | UGCUGGUG CUGAUGAG<u>GCCGUUAGGCC</u>GAA AAAGAACA | 11569 |
| 4153 | CAGGAAGUA GCCGCAUU | 2151 | AAUGCGGC CUGAUGAG<u>GCCGUUAGGCC</u>GAA ACUUCCUG | 11570 |
| 4161 | AGCCGCAUU UGAUUUUC | 2152 | GAAAAUCA CUGAUGAG<u>GCCGUUAGGCC</u>GAA AUGCGGCU | 11571 |
| 4162 | GCCGCAUUU GAUUUUCA | 2153 | UGAAAAUC CUGAUGAG<u>GCCGUUAGGCC</u>GAA AAUGCGGC | 11572 |
| 4166 | CAUUUGAUU UUCAUUUC | 2154 | GAAAUGAA CUGAUGAG<u>GCCGUUAGGCC</u>GAA AUCAAAUG | 11573 |
| 4167 | AUUUGAUUU UCAUUUCG | 2155 | CGAAAUGA CUGAUGAG<u>GCCGUUAGGCC</u>GAA AAUCAAAU | 11574 |
| 4168 | UUUGAUUUU CAUUUCGA | 2156 | UCGAAAUG CUGAUGAG<u>GCCGUUAGGCC</u>GAA AAAUCAAA | 11575 |
| 4169 | UUGAUUUUC AUUUCGAC | 2157 | GUCGAAAU CUGAUGAG<u>GCCGUUAGGCC</u>GAA AAAAUCAA | 11576 |
| 4172 | AUUUUCAUU UCGACAAC | 2158 | GUUGUCGA CUGAUGAG<u>GCCGUUAGGCC</u>GAA AUGAAAAU | 11577 |
| 4173 | UUUUCAUUU CGACAACA | 2159 | UGUUGUCG CUGAUGAG<u>GCCGUUAGGCC</u>GAA AAUGAAAA | 11578 |
| 4174 | UUUCAUUUC GACAACAG | 2160 | CUGUUGUC CUGAUGAG<u>GCCGUUAGGCC</u>GAA AAAUGAAA | 11579 |
| 4194 | AAGGACCUC GGACUGCA | 2161 | UGCAGUCC CUGAUGAG<u>GCCGUUAGGCC</u>GAA AGGUCCUU | 11580 |
| 4214 | AGCCAGCUC UUCUAGGC | 2162 | GCCUAGAA CUGAUGAG<u>GCCGUUAGGCC</u>GAA AGCUGGCU | 11581 |

TABLE IV-continued

Human KDR VEGF Receptor-Hammerhead Ribozyme and Substrate Sequence

| Pos | Substrate | Seq ID No | HH Ribozyme Sequence | Seq ID No |
|-----|-----------|-----------|----------------------|-----------|
| 4216 | CCAGCUCUU CUAGGCUU | 2163 | AAGCCUAG CUGAUGAG<u>GCCGUUAGGC</u>CGAA AGAGCUGG | 11582 |
| 4217 | CAGCUCUUC UAGGCUUG | 2164 | CAAGCCUA CUGAUGAG<u>GCCGUUAGGC</u>CGAA AAGAGCUG | 11583 |
| 4219 | GCUCUUCUA GGCUUGUG | 2165 | CACAAGCC CUGAUGAG<u>GCCGUUAGGC</u>CGAA AGAAGAGC | 11584 |

Where "X" represents stem II region of a HH ribozyme (Hertel et al., 1992 Nucleic Acids Res. 20 3252).
The length of stem II maybe 2 base-pairs.
Underlined region can be any X sequence or linker, as described herein.

TABLE V

Human KDR VEGF Receptor-Hairpin Ribozyme and Substrate Sequences

| Pos | Substrate | Seq ID No | Hairpin Ribozyme Sequence | Seq ID No |
|-----|-----------|-----------|---------------------------|-----------|
| 11 | AGGUGCU GCU GGCCGUCG | 2166 | CGACGGCC AGAA GCACCU ACCAGAGAAACACACGUUGUGGUACAUUACCUGGUA | 11585 |
| 18 | GCUGGCC GUC GCCCUGUG | 2167 | CACAGGGC AGAA GCCAGC ACCAGAGAAACACACGUUGUGGUACAUUACCUGGUA | 11586 |
| 51 | CCGGGCC GCC UCUGUGGG | 2168 | CCCACAGA AGAA GCCCGG ACCAGAGAAACACACGUUGUGGUACAUUACCUGGUA | 11587 |
| 86 | UUGAUCU CCC CAGGCUCA | 2169 | UGAGCCUG AGAA GAUCAA ACCAGAGAAACACACGUUGUGGUACAUUACCUGGUA | 11588 |
| 318 | GGAAACU GAC UUGGCCUC | 2170 | GAGGCCAA AGAA GUUUCC ACCAGAGAAACACACGUUGUGGUACAUUACCUGGUA | 11589 |
| 358 | GAUUACA GAU CUCCAUUU | 2171 | AAAUGGAG AGAA GUAAUC ACCAGAGAAACACACGUUGUGGUACAUUACCUGGUA | 11590 |
| 510 | UGUUCCU GAU GGUAACAG | 2172 | CUGUUACC AGAA GGAACA ACCAGAGAAACACACGUUGUGGUACAUUACCUGGUA | 11591 |
| 623 | GUUACCA GUC UAUUAUGU | 2173 | ACAUAAUA AGAA GGUAAC ACCAGAGAAACACACGUUGUGGUACAUUACCUGGUA | 11592 |
| 683 | UGAGUCC GUC UCAUGGAA | 2174 | UUCCAUGA AGAA CACUCA ACCAGAGAAACACACGUUGUGGUACAUUACCUGGUA | 11593 |
| 705 | ACUAUCU GUU GGAGAAAA | 2175 | UUUUCUCC AGAA GAUAGU ACCAGAGAAACACACGUUGUGGUACAUUACCUGGUA | 11594 |
| 833 | AAACCCA GUC UGGGAGUG | 2176 | CACUCCCA AGAA GGGUUU ACCAGAGAAACACACGUUGUGGUACAUUACCUGGUA | 11595 |
| 932 | GUGGGCU GAU GACCAACA | 2177 | UCUUGGUC AGAA GCCCAC ACCAGAGAAACACACGUUGUGGUACAUUACCUGGUA | 11596 |
| 1142 | AUGUACU GAC GAUUAUGG | 2178 | CCAUAAUC AGAA GUACAU ACCAGAGAAACACACGUUGUGGUACAUUACCUGGUA | 11597 |
| 1259 | CACCCCA GAU UGGUGAGA | 2179 | UCUCACCA AGAA GGGGUG ACCAGAGAAACACACGUUGUGGUACAUUACCUGGUA | 11598 |
| 1332 | AUGUACG GUC UAUGCCAU | 2180 | AUGGCAUA AGAA GUACAU ACCAGAGAAACACACGUUGUGGUACAUUACCUGGUA | 11599 |
| 1376 | AUUGGCA GUU GGAGGAAG | 2181 | CUUCCUCC AGAA GCCAAU ACCAGAGAAACACACGUUGUGGUACAUUACCUGGUA | 11600 |
| 1413 | CCAAGCU GUC UCAGUGAC | 2182 | GUCACUGA AGAA GCUUGG ACCAGAGAAACACACGUUGUGGUACAUUACCUGGUA | 11601 |
| 1569 | UGUGUCA GCU UUGUACAA | 2183 | UUGUACAA AGAA GACACA ACCAGAGAAACACACGUUGUGGUACAUUACCUGGUA | 11602 |
| 1673 | ACAUGCA GCC CACUGAGC | 2184 | GCUCAGUG AGAA GCAUGU ACCAGAGAAACACACGUUGUGGUACAUUACCUGGUA | 11603 |
| 1717 | GCAGACA GAU CUACGUUU | 2185 | AAACGUAG AGAA GUCUGC ACCAGAGAAACACACGUUGUGGUACAUUACCUGGUA | 11604 |
| 1760 | GCCCACA CCC UCUGCCAA | 2186 | UUGGCAGA AGAA GUGGGC ACCAGAGAAACACACGUUGUGGUACAUUACCUGGUA | 11605 |
| 1797 | CACACCU GUU UGCAAGAA | 2187 | UUCUUGCA AGAA GGUGUG ACCAGAGAAACACACGUUGUGGUACAUUACCUGGUA | 11606 |
| 1918 | UAUGUCU GCC UUGCUCAA | 2188 | UUGAGCAA AGAA GACAUA ACCAGAGAAACACACGUUGUGGUACAUUACCUGGUA | 11607 |
| 1967 | UCAGGCA GCU CACAGUCC | 2189 | GGACUGUG AGAA GCCUGA ACCAGAGAAACACACGUUGUGGUACAUUACCUGGUA | 11608 |
| 1974 | GCUCACA GUC CUAGAGCG | 2190 | CGCUCUAG AGAA GUGAGC ACCAGAGAAACACACGUUGUGGUACAUUACCUGGUA | 11609 |
| 2021 | AGAAUCA GAC GACAAGUA | 2191 | UACUUGUC AGAA GAUUCU ACCAGAGAAACACACGUUGUGGUACAUUACCUGGUA | 11610 |
| 2084 | CUCCACA GAU CAUGUGGU | 2192 | ACCACAUG AGAA GUGGAG ACCAGAGAAACACACGUUGUGGUACAUUACCUGGUA | 11611 |

TABLE V-continued

Human KDR VEGF Receptor-Hairpin Ribozyme and Substrate Sequences

| Pos | Substrate | Seq ID No | Hairpin Ribozyme Sequence | Seq ID No |
|---|---|---|---|---|
| 2418 | GGAUCCA GAU GAACUCCC | 2193 | GGGAGUUC AGAA GGAUCC ACCAGAGAAACACACGUUGUGGUACAUUACCUGGUA | 11612 |
| 2453 | AACGACU GCC UUAUGAUG | 2194 | CAUCAUAA AGAA GUCGUU ACCAGAGAAACACACGUUGUGGUACAUUACCUGGUA | 11613 |
| 2492 | GAGACCG GCU GAACCUAG | 2195 | CUAGGUUC AGAA GGUCUC ACCAGAGAAACACACGUUGUGGUACAUUACCUGGUA | 11614 |
| 2547 | UGAAGCA GAU GCCUUUGG | 2196 | CCAAAGGC AGAA GCUUCA ACCAGAGAAACACACGUUGUGGUACAUUACCUGGUA | 11615 |
| 2765 | GAAACCU CUC CACUUACC | 2197 | GGUAAGUG AGAA GGUUUC ACCAGAGAAACACACGUUGUGGUACAUUACCUGGUA | 11616 |
| 2914 | UCAGCCA GCU CUGGAUUU | 2198 | AAAUCCAG AGAA GGCUGA ACCAGAGAAACACACGUUGUGGUACAUUACCUGGUA | 11617 |
| 2993 | ACUUCCU GAC CUUGGAGC | 2199 | GCUCCAAG AGAA GGAAGU ACCAGAGAAACACACGUUGUGGUACAUUACCUGGUA | 11618 |
| 3019 | UGUUACA GCU UCCAAGUG | 2200 | CACUUGGA AGAA GUAACA ACCAGAGAAACACACGUUGUGGUACAUUACCUGGUA | 11619 |
| 3165 | AGAUCCA GAU UAUGUCAG | 2201 | CUGACAUA AGAA GGAUCU ACCAGAGAAACACACGUUGUGGUACAUUACCUGGUA | 11620 |
| 3378 | GGCCCCU GAU UAUACUAC | 2202 | GUAGUAUA AGAA GGGGCC ACCAGAGAAACACACGUUGUGGUACAUUACCUGGUA | 11621 |
| 3404 | UGUACCA GAC CAUGCUGG | 2203 | CCAGCAUG AGAA GGUACA ACCAGAGAAACACACGUUGUGGUACAUUACCUGGUA | 11622 |
| 3418 | CUGGACU GCU GGCACGGG | 2204 | CCCGUGCC AGAA GUCCAG ACCAGAGAAACACACGUUGUGGUACAUUACCUGGUA | 11623 |
| 3575 | UCUCUCU GCC UACCUCAC | 2205 | GUGAGGUA AGAA GAGAGA ACCAGAGAAACACACGUUGUGGUACAUUACCUGGUA | 11624 |
| 3588 | CUCACCU GUU UCCUGUAU | 2206 | AUACAGGA AGAA GGUGAG ACCAGAGAAACACACGUUGUGGUACAUUACCUGGUA | 11625 |
| 3689 | AGAGCCG GCC UGUGAGUG | 2207 | CACUCACA AGAA GGCUCU ACCAGAGAAACACACGUUGUGGUACAUUACCUGGUA | 11626 |
| 3753 | AAUCCCA GAU GACAACCA | 2208 | UGGUUGUC AGAA GGGAUU ACCAGAGAAACACACGUUGUGGUACAUUACCUGGUA | 11627 |
| 3764 | ACAACCA GAC GGACAGUG | 2209 | CACUGUCC AGAA GGUUGU ACCAGAGAAACACACGUUGUGGUACAUUACCUGGUA | 11628 |
| 3911 | GCUACCA GUC CGGAUAUC | 2210 | GAUAUCCG AGAA GGUAGC ACCAGAGAAACACACGUUGUGGUACAUUACCUGGUA | 11629 |
| 3927 | UCACUCC GAU GACACAGA | 2211 | UCUGUGUC AGAA GAGUGA ACCAGAGAAACACACGUUGUGGUACAUUACCUGGUA | 11630 |
| 4011 | UAGCACA GCC CAGAUUCU | 2212 | AGAAUCUG AGAA GUGCUA ACCAGAGAAACACACGUUGUGGUACAUUACCUGGUA | 11631 |
| 4016 | CAGCCCA GAU UCUCCAGC | 2213 | GCUGGAGA AGAA GGGCUG ACCAGAGAAACACACGUUGUGGUACAUUACCUGGUA | 11632 |
| 4025 | UUCUCCA GCC UGACACGG | 2214 | CCGUGUCA AGAA GGAGAA ACCAGAGAAACACACGUUGUGGUACAUUACCUGGUA | 11633 |
| 4059 | UCCUCCU GUU UAAAAGGA | 2215 | UCCUUUUA AGAA GGAGGA ACCAGAGAAACACACGUUGUGGUACAUUACCUGGUA | 11634 |
| 4111 | GAGGUCU GCU CAGAUUUU | 2216 | AAAAUCUG AGAA GACCUC ACCAGAGAAACACACGUUGUGGUACAUUACCUGGUA | 11635 |
| 4116 | CUGCUCA GAU UUUGAAGU | 2217 | ACUUCAAA AGAA GAGCAG ACCAGAGAAACACACGUUGUGGUACAUUACCUGGUA | 11636 |
| 4195 | GACCUCG GAC UGCAGGGA | 2218 | UCCCUGCA AGAA GAGGUC ACCAGAGAAACACACGUUGUGGUACAUUACCUGGUA | 11637 |
| 4210 | GGAGCCA GCU CUUCUAGG | 2219 | CCUAGAAG AGAA GGCUCC ACCAGAGAAACACACGUUGUGGUACAUUACCUGGUA | 11638 |

TABLE VI

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 13 | GGGCGAAUU GGGUACGG | 2220 | CCGUACCC CUGAUGAGGCCGUUAGGCCGAA AUUCGCCC | 11639 |
| 18 | AAUUGGGUA CGGGACCC | 2221 | GGGUCCCG CUGAUGAGGCCGUUAGGCCGAA ACCCAAUU | 11640 |
| 31 | ACCCCCUC GAGGUCGA | 2222 | UCGACCUC CUGAUGAGGCCGUUAGGCCGAA AGGGGGGU | 11641 |
| 37 | CUCGAGGUC GACGGUAU | 2223 | AUACCGUC CUGAUGAGGCCGUUAGGCCGAA ACCUCGAG | 11642 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 44 | UCGACGGUA UCGAUAAG | 2224 | CUUAUCGA CUGAUGAGGCCGUUAGGCCGAA ACCGUCGA | 11643 |
| 46 | GACGGUAUC GAUAAGCU | 2225 | AGCUUAUC CUGAUGAGGCCGUUAGGCCGAA AUACCGUC | 11644 |
| 50 | GUAUCGAUA AGCUUGAU | 2226 | AUCAAGCU CUGAUGAGGCCGUUAGGCCGAA AUCGAUAC | 11645 |
| 55 | GAUAAGCUU GAUAUCGA | 2227 | UCGAUAUC CUGAUGAGGCCGUUAGGCCGAA AGCUUAUC | 11646 |
| 59 | AGCUUGAUA UCGAAUUC | 2228 | GAAUUCGA CUGAUGAGGCCGUUAGGCCGAA AUCAAGCU | 11647 |
| 61 | CUUGAUAUC GAAUUCGG | 2229 | CCGAAUUC CUGAUGAGGCCGUUAGGCCGAA AUAUCAAG | 11648 |
| 66 | UAUCGAAUU CGGGCCCA | 2230 | UGGGCCCG CUGAUGAGGCCGUUAGGCCGAA AUUCGAUA | 11649 |
| 67 | AUCGAAUUC GGGCCCAG | 2231 | CUGGGCCC CUGAUGAGGCCGUUAGGCCGAA AAUUCGAU | 11650 |
| 83 | GACUGUGUC CCGCAGCC | 2232 | GGCUGCGG CUGAUGAGGCCGUUAGGCCGAA ACACAGUC | 11651 |
| 97 | GCCGGGAUA ACCUGGCU | 2233 | AGCCAGGU CUGAUGAGGCCGUUAGGCCGAA AUCCCGGC | 11652 |
| 114 | GACCCGAUU CCGCGGAC | 2234 | GUCCGCGG CUGAUGAGGCCGUUAGGCCGAA AUCGGGUC | 11653 |
| 115 | ACCCGAUUC CGCGGACA | 2235 | UGUCCGCG CUGAUGAGGCCGUUAGGCCGAA AAUCGGGU | 11654 |
| 169 | CCCGCGCUC UCCCCGGU | 2236 | ACCGGGGA CUGAUGAGGCCGUUAGGCCGAA AGCGCGGG | 11655 |
| 171 | CGCGCUCUC CCCGGUCU | 2237 | AGACCGGG CUGAUGAGGCCGUUAGGCCGAA AGAGCGCG | 11656 |
| 178 | UCCCCGGUC UUGCGCUG | 2238 | CAGCGCAA CUGAUGAGGCCGUUAGGCCGAA ACCGGGGA | 11657 |
| 180 | CCCGGUCUU GCGCUGCG | 2239 | CGCAGCGC CUGAUGAGGCCGUUAGGCCGAA AGACCGGG | 11658 |
| 197 | GGGGCCAUA CCGCCUCU | 2240 | AGAGGCGG CUGAUGAGGCCGUUAGGCCGAA AUGGCCCC | 11659 |
| 204 | UACCGCCUC UGUGACUU | 2241 | AAGUCACA CUGAUGAGGCCGUUAGGCCGAA AGGCGGUA | 11660 |
| 212 | CUGUGACUU CUUUGCGG | 2242 | CCGCAAAG CUGAUGAGGCCGUUAGGCCGAA AGUCACAG | 11661 |
| 213 | UGUGACUUC UUUGCGGG | 2243 | CCCGCAAA CUGAUGAGGCCGUUAGGCCGAA AAGUCACA | 11662 |
| 215 | UGACUUCUU UGCGGGCC | 2244 | GGCCCGCA CUGAUGAGGCCGUUAGGCCGAA AGAAGUCA | 11663 |
| 216 | GACUUCUUU GCGGGCCA | 2245 | UGGCCCGC CUGAUGAGGCCGUUAGGCCGAA AAGAAGUC | 11664 |
| 241 | GAAGGAGUC UGUGCCUG | 2246 | CAGGCACA CUGAUGAGGCCGUUAGGCCGAA ACUCCUUC | 11665 |
| 262 | ACUGGGCUC UGUGCCCA | 2247 | UGGGCACA CUGAUGAGGCCGUUAGGCCGAA AGCCCAGU | 11666 |
| 306 | GCGCUGCUA GCUGUCGC | 2248 | GCGACAGC CUGAUGAGGCCGUUAGGCCGAA AGCAGCGC | 11667 |
| 312 | CUAGCUGUC GCUCUGUG | 2249 | CACAGAGC CUGAUGAGGCCGUUAGGCCGAA ACAGCUAG | 11668 |
| 316 | CUGUCGCUC UGUGGUUC | 2250 | GAACCACA CUGAUGAGGCCGUUAGGCCGAA AGCGACAG | 11669 |
| 323 | UCUGUGGUU CUGCGUGG | 2251 | CCACGCAG CUGAUGAGGCCGUUAGGCCGAA ACCACAGA | 11670 |
| 324 | CUGUGGUUC UGCGUGGA | 2252 | UCCACGCA CUGAUGAGGCCGUUAGGCCGAA AACCACAG | 11671 |
| 347 | AGCCGCCUC UGUGGGUU | 2253 | AACCCACA CUGAUGAGGCCGUUAGGCCGAA AGGCGGCU | 11672 |
| 355 | CUGUGGGUU UGACUGGC | 2254 | GCCAGUCA CUGAUGAGGCCGUUAGGCCGAA ACCCACAG | 11673 |
| 356 | UGUGGGUUU GACUGGCG | 2255 | CGCCAGUC CUGAUGAGGCCGUUAGGCCGAA AACCCACA | 11674 |
| 367 | CUGGCGAUU UUCUCCAU | 2256 | AUGGAGAA CUGAUGAGGCCGUUAGGCCGAA AUCGCCAG | 11675 |
| 368 | UGGCGAUUU UCUCCAUC | 2257 | GAUGGAGA CUGAUGAGGCCGUUAGGCCGAA AAUCGCCA | 11676 |
| 369 | GGCGAUUUU CUCCAUCC | 2258 | GGAUGGAG CUGAUGAGGCCGUUAGGCCGAA AAAUCGCC | 11677 |
| 370 | GCGAUUUUC UCCAUCCC | 2259 | GGGAUGGA CUGAUGAGGCCGUUAGGCCGAA AAAAUCGC | 11678 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 372 | GAUUUCUC CAUCCCCC | 2260 | GGGGGAUG CUGAUGAGGCCGUUAGGCCGAA AGAAAAUC | 11679 |
| 376 | UUCUCCAUC CCCCCAAG | 2261 | CUUGGGGG CUGAUGAGGCCGUUAGGCCGAA AUGGAGAA | 11680 |
| 387 | CCCAAGCUC AGCACACA | 2262 | UGUGUGCU CUGAUGAGGCCGUUAGGCCGAA AGCUUGGG | 11681 |
| 405 | AAAGACAUA CUGACAAU | 2263 | AUUGUCAG CUGAUGAGGCCGUUAGGCCGAA AUGUCUUU | 11682 |
| 414 | CUGACAAUU UUGGCAAA | 2264 | UUUGCCAA CUGAUGAGGCCGUUAGGCCGAA AUUGUCAG | 11683 |
| 415 | UGACAAUUU UGGCAAAU | 2265 | AUUUGCCA CUGAUGAGGCCGUUAGGCCGAA AAUUGUCA | 11684 |
| 416 | GACAAUUUU GGCAAAUA | 2266 | UAUUUGCC CUGAUGAGGCCGUUAGGCCGAA AAAUUGUC | 11685 |
| 424 | UGGCAAAUA CAACCCUU | 2267 | AAGGGUUG CUGAUGAGGCCGUUAGGCCGAA AUUUGCCA | 11686 |
| 432 | ACAACCCUU CAGAUUAC | 2268 | GUAAUCUG CUGAUGAGGCCGUUAGGCCGAA AGGGUUGU | 11687 |
| 433 | CAACCCUUC AGAUUACU | 2269 | AGUAAUCU CUGAUGAGGCCGUUAGGCCGAA AAGGGUUG | 11688 |
| 438 | CUUCAGAUU ACUUGCAG | 2270 | CUGCAAGU CUGAUGAGGCCGUUAGGCCGAA AUCUGAAG | 11689 |
| 439 | UUCAGAUUA CUUGCAGG | 2271 | CCUGCAAG CUGAUGAGGCCGUUAGGCCGAA AAUCUGAA | 11690 |
| 442 | AGAUUACUU GCAGGGA | 2272 | UCCCCUGC CUGAUGAGGCCGUUAGGCCGAA AGUAAUCU | 11691 |
| 471 | GACUGGCUU UGGCCCAA | 1534 | UUGGGCCA CUGAUGAGGCCGUUAGGCCGAA AGCCAGUC | 10953 |
| 472 | ACUGGCUUU GGCCCAAU | 1535 | AUUGGGCC CUGAUGAGGCCGUUAGGCCGAA AAGCCAGU | 10954 |
| 484 | CCAAUGCUC AGCGUGAU | 2273 | AUCACGCU CUGAUGAGGCCGUUAGGCCGAA AGCAUUGG | 11692 |
| 493 | AGCGUGAUU CUGAGGAA | 2274 | DUCCUCAG CUGAUGAGGCCGUUAGGCCGAA AUCACGCU | 11693 |
| 494 | GCGUGAUUC UGAGGAAA | 2275 | UUUCCUCA CUGAUGAGGCCGUUAGGCCGAA AAUCACGC | 11694 |
| 507 | GAAAGGGUA UUGGUGAC | 2276 | GUCACCAA CUGAUGAGGCCGUUAGGCCGAA ACCCUUUC | 11695 |
| 509 | AAGGGUAUU GGUGACUG | 2277 | CAGUCACC CUGAUGAGGCCGUUAGGCCGAA AUACCCUU | 11696 |
| 538 | GUGACAGUA UCUUCUGC | 2278 | GCAGAAGA CUGAUGAGGCCGUUAGGCCGAA ACUGUCAC | 11697 |
| 540 | GACAGUAUC UUCUGCAA | 2279 | UUGCAGAA CUGAUGAGGCCGUUAGGCCGAA AUACUGUC | 11698 |
| 542 | CAGUAUCUU CUGCAAAA | 2280 | UUUUGCAG CUGAUGAGGCCGUUAGGCCGAA AGAUACUG | 11699 |
| 543 | AGUAUCUUC UGCAAAAC | 2281 | GUUUUGCA CUGAUGAGGCCGUUAGGCCGAA AAGAUACU | 11700 |
| 555 | AAAACACUC ACCAUUCC | 2282 | GGAAUGGU CUGAUGAGGCCGUUAGGCCGAA AGUGUUUU | 11701 |
| 561 | CUCACCAUU CCCAGGGU | 2283 | ACCCUGGG CUGAUGAGGCCGUUAGGCCGAA AUGGUGAG | 11702 |
| 562 | UCACCAUUC CCAGGGUG | 2284 | CACCCUGG CUGAUGAGGCCGUUAGGCCGAA AAUGGUGA | 11703 |
| 573 | AGGGUGGUU GGAAAUGA | 2285 | UCAUUUCC CUGAUGAGGCCGUUAGGCCGAA ACCACCCU | 11704 |
| 583 | GAAAUGAUA CUGGAGCC | 2286 | GGCUCCAG CUGAUGAGGCCGUUAGGCCGAA AUCAUUUC | 11705 |
| 593 | UGGAGCCUA CAAGUGCU | 1546 | AGCACUUG CUGAUGAGGCCGUUAGGCCGAA AGGCUCCA | 10965 |
| 602 | CAAGUGCUC GUACCGGG | 2287 | CCCGGUAC CUGAUGAGGCCGUUAGGCCGAA AGCACUUG | 11706 |
| 605 | GUGCUCGUA CCGGGACG | 2288 | CGUCCCGG CUGAUGAGGCCGUUAGGCCGAA ACGAGCAC | 11707 |
| 615 | CGGGACGUC GACAUAGC | 2289 | GCUAUGUC CUGAUGAGGCCGUUAGGCCGAA ACGUCCCG | 11708 |
| 621 | GUCGACAUA GCCUCCAC | 2290 | GUGGAGGC CUGAUGAGGCCGUUAGGCCGAA AUGUCGAC | 11709 |
| 626 | CAUAGCCUC CACUGUUU | 2291 | AAACAGUG CUGAUGAGGCCGUUAGGCCGAA AGGCUAUG | 11710 |
| 633 | UCCACUGUU UAUGUCUA | 2292 | UAGACAUA CUGAUGAGGCCGUUAGGCCGAA ACAGUGGA | 11711 |
| 634 | CCACUGUUU AUGUCUAU | 2293 | AUAGACAU CUGAUGAGGCCGUUAGGCCGAA AACAGUGG | 11712 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 635 | CACUGUUUA UGUCUAUG | 2294 | CAUAGACA CUGAUGAGGCCGUUAGGCCGAA AAACAGUG | 11713 |
| 639 | GUUUAUGUC UAUGUUCG | 2295 | CGAACAUA CUGAUGAGGCCGUUAGGCCGAA ACAUAAAC | 11714 |
| 641 | UUAUGUCUA UGUUCGAG | 2296 | CUCGAACA CUGAUGAGGCCGUUAGGCCGAA AGACAUAA | 11715 |
| 645 | GUCUAUGUU CGAGAUUA | 2297 | UAAUCUCG CUGAUGAGGCCGUUAGGCCGAA ACAUAGAC | 11716 |
| 646 | UCUAUGUUC GAGAUUAC | 2298 | GUAAUCUC CUGAUGAGGCCGUUAGGCCGAA AACAUAGA | 11717 |
| 652 | UUCGAGAUU ACAGAUCA | 2299 | UGAUCUGU CUGAUGAGGCCGUUAGGCCGAA AUCUCGAA | 11718 |
| 653 | UCGAGAUUA CAGAUCAC | 2300 | GUGAUCUG CUGAUGAGGCCGUUAGGCCGAA AAUCUCGA | 11719 |
| 659 | UUACAGAUC ACCAUUCA | 2301 | UGAAUGGU CUGAUGAGGCCGUUAGGCCGAA AUCUGUAA | 11720 |
| 665 | AUCACCAUU CAUCGCCU | 2302 | AGGCGAUG CUGAUGAGGCCGUUAGGCCGAA AUGGUGAU | 11721 |
| 666 | UCACCAUUC AUCGCCUC | 2303 | GAGGCGAU CUGAUGAGGCCGUUAGGCCGAA AAUGGUGA | 11722 |
| 669 | CCAUUCAUC GCCUCUGU | 2304 | ACAGAGGC CUGAUGAGGCCGUUAGGCCGAA AUGAAUGG | 11723 |
| 674 | CAUCGCCUC UGUCAGUG | 2305 | CACUGACA CUGAUGAGGCCGUUAGGCCGAA AGGCGAUG | 11724 |
| 678 | GCCUCUGUC AGUGACCA | 2306 | UGGUCACU CUGAUGAGGCCGUUAGGCCGAA ACAGAGGC | 11725 |
| 696 | CAUGGCAUC GUGUACAU | 2307 | AUGUACAC CUGAUGAGGCCGUUAGGCCGAA AUGCCAUG | 11726 |
| 701 | CAUCGUGUA CAUCACCG | 2308 | CGGUGAUG CUGAUGAGGCCGUUAGGCCGAA ACACGAUG | 11727 |
| 705 | GUGUACAUC ACCGAGAA | 2309 | UUCUCGGU CUGAUGAGGCCGUUAGGCCGAA AUGUACAC | 11728 |
| 735 | GUGGUGAUC CCCUGCCG | 2310 | CGGCAGGG CUGAUGAGGCCGUUAGGCCGAA AUCACCAC | 11729 |
| 749 | CCGAGGGUC GAUUUCAA | 2311 | UUGAAAUC CUGAUGAGGCCGUUAGGCCGAA ACCCUCGG | 11730 |
| 753 | GGGUCGAUU UCAAACCU | 2312 | AGGUUUGA CUGAUGAGGCCGUUAGGCCGAA AUCGACCC | 11731 |
| 754 | GGUCGAUUU CAAACCUC | 2313 | GAGGUUUG CUGAUGAGGCCGUUAGGCCGAA AAUCGACC | 11732 |
| 755 | GUCGAUUUC AAACCUCA | 2314 | UGAGGUUU CUGAUGAGGCCGUUAGGCCGAA AAAUCGAC | 11733 |
| 762 | UCAAACCUC AAUGUGUC | 2315 | GACACAUU CUGAUGAGGCCGUUAGGCCGAA AGGUUUGA | 11734 |
| 770 | CAAUGUGUC UCUUUGCG | 2316 | CGCAAAGA CUGAUGAGGCCGUUAGGCCGAA ACACAUUG | 11735 |
| 772 | AUGUGUCUC UUUGCGCU | 2317 | AGCGCAAA CUGAUGAGGCCGUUAGGCCGAA AGACACAU | 11736 |
| 774 | GUGUCUCUU UGCGCUAG | 2318 | CUAGCGCA CUGAUGAGGCCGUUAGGCCGAA AGAGACAC | 11737 |
| 775 | UGUCUCUUU GCGCUAGG | 2319 | CCUAGCGC CUGAUGAGGCCGUUAGGCCGAA AAGAGACA | 11738 |
| 781 | UUUGCGCUA GGUAUCCA | 2320 | UGGAUACC CUGAUGAGGCCGUUAGGCCGAA AGCGCAAA | 11739 |
| 785 | CGCUAGGUA UCCAGAAA | 2321 | UUUCUGGA CUGAUGAGGCCGUUAGGCCGAA ACCUAGCG | 11740 |
| 787 | CUAGGUAUC CAGAAAAG | 2322 | CUUUUCUG CUGAUGAGGCCGUUAGGCCGAA AUACCUAG | 11741 |
| 800 | AAAGAGAUU GUUCCGG | 2323 | CCGGAACA CUGAUGAGGCCGUUAGGCCGAA AUCUCUUU | 11742 |
| 801 | AAGAGAUUU GUUCCGGA | 2324 | UCCGGAAC CUGAUGAGGCCGUUAGGCCGAA AAUCUCUU | 11743 |
| 804 | AGAUUUGUU CCGGAUGG | 2325 | CCAUCCGG CUGAUGAGGCCGUUAGGCCGAA ACAAAUCU | 11744 |
| 805 | GAUUUGUUC CGGAUGGA | 2326 | UCCAUCCG CUGAUGAGGCCGUUAGGCCGAA AACAAAUC | 11745 |
| 822 | AACAGAAUU UCCUGGGA | 1595 | UCCCAGGA CUGAUGAGGCCGUUAGGCCGAA AUUCUGUU | 11014 |
| 823 | ACAGAAUUU CCUGGGAC | 1596 | GUCCCAGG CUGAUGAGGCCGUUAGGCCGAA AAUUCUGU | 11015 |
| 824 | CAGAAUUUC CUGGGACA | 1597 | UGUCCCAG CUGAUGAGGCCGUUAGGCCGAA AAAUUCUG | 11016 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 840 | AGCGAGAUA GGCUUUAC | 2327 | GUAAAGCC CUGAUGAGGCCGUUAGGCCGAA AUCUCGCU | 11746 |
| 845 | GAUAGGCUU UACUCUCC | 2328 | GGAGAGUA CUGAUGAGGCCGUUAGGCCGAA AGCCUAUC | 11747 |
| 846 | AUAGGCUUU ACUCUCCC | 2329 | GGGAGAGU CUGAUGAGGCCGUUAGGCCGAA AAGCCUAU | 11748 |
| 847 | UAGGCUUUA CUCUCCCC | 2330 | GGGGAGAG CUGAUGAGGCCGUUAGGCCGAA AAAGCCUA | 11749 |
| 850 | GCUUUACUC UCCCAGU | 2331 | ACUGGGGA CUGAUGAGGCCGUUAGGCCGAA AGUAAAGC | 11750 |
| 852 | UUUACUCUC CCAGUUA | 2332 | UAACUGGG CUGAUGAGGCCGUUAGGCCGAA AGAGUAAA | 11751 |
| 859 | UCCCCAGUU ACAUGAUC | 2333 | GAUCAUGU CUGAUGAGGCCGUUAGGCCGAA ACUGGGGA | 11752 |
| 860 | CCCCAGUUA CAUGAUCA | 2334 | UGAUCAUG CUGAUGAGGCCGUUAGGCCGAA AACUGGGG | 11753 |
| 867 | UACAUGAUC AGCUAUGC | 1605 | GCAUAGCU CUGAUGAGGCCGUUAGGCCGAA AUCAUGUA | 11024 |
| 872 | GAUCAGCUA UGCCGGCA | 2335 | UGCCGGCA CUGAUGAGGCCGUUAGGCCGAA AGCUGAUC | 11754 |
| 885 | GGCAUGGUC UUCUGUGA | 1607 | UCACAGAA CUGAUGAGGCCGUUAGGCCGAA ACCAUGCC | 11026 |
| 887 | CAUGGUCUU CUGUGAGG | 2336 | CCUCACAG CUGAUGAGGCCGUUAGGCCGAA AGACCAUG | 11755 |
| 888 | AUGGUCUUC UGUGAGGC | 2337 | GCCUCACA CUGAUGAGGCCGUUAGGCCGAA AAGACCAU | 11756 |
| 903 | GCAAAGAUC AAUGAUGA | 2338 | UCAUCAUU CUGAUGAGGCCGUUAGGCCGAA AUCUUUGC | 11757 |
| 917 | UGAAACCUA UCAGUCUA | 2339 | UAGACUGA CUGAUGAGGCCGUUAGGCCGAA AGGUUUCA | 11758 |
| 919 | AAACCUAUC AGUCUAUC | 2340 | GAUAGACU CUGAUGAGGCCGUUAGGCCGAA AUAGGUUU | 11759 |
| 923 | CUAUCAGUC UAUCAUGU | 2341 | ACAUGAUA CUGAUGAGGCCGUUAGGCCGAA ACUGAUAG | 11760 |
| 925 | AUCAGUCUA UCAUGUAC | 2342 | GUACAUGA CUGAUGAGGCCGUUAGGCCGAA AGACUGAU | 11761 |
| 927 | CAGUCUAUC AUGUACAU | 2343 | AUGUACAU CUGAUGAGGCCGUUAGGCCGAA AUAGACUG | 11035 |
| 932 | UAUCAUGUA CAUAGUUG | 2344 | CAACUAUG CUGAUGAGGCCGUUAGGCCGAA ACAUGAUA | 11762 |
| 936 | AUGUACAUA GUUGUGGU | 2345 | ACCACAAC CUGAUGAGGCCGUUAGGCCGAA AUGUACAU | 11763 |
| 939 | UACAUAGUU GUGGUUGU | 2346 | ACAACCAC CUGAUGAGGCCGUUAGGCCGAA ACUAUGUA | 11764 |
| 945 | GUUGUGGUU GUAGGAUA | 2347 | UAUCCUAC CUGAUGAGGCCGUUAGGCCGAA ACCACAAC | 11765 |
| 948 | GUGGUUGUA GGAUAUAG | 2348 | CUAUAUCC CUGAUGAGGCCGUUAGGCCGAA ACAACCAC | 11766 |
| 953 | UGUAGGAUA UAGGAUUU | 2349 | AAAUCCUA CUGAUGAGGCCGUUAGGCCGAA AUCCUACA | 11767 |
| 955 | UAGGAUAUA GGAUUUAU | 2350 | AUAAAUCC CUGAUGAGGCCGUUAGGCCGAA AUAUCCUA | 11768 |
| 960 | UAUAGGAUU UAUGAUGU | 1626 | ACAUCAUA CUGAUGAGGCCGUUAGGCCGAA AUCCUAUA | 11045 |
| 961 | AUAGGAUUU AUGAUGUG | 1627 | CACAUCAU CUGAUGAGGCCGUUAGGCCGAA AAUCCUAU | 11046 |
| 962 | UAGGAUUUA UGAUGUGA | 2351 | UCACAUCA CUGAUGAGGCCGUUAGGCCGAA AAAUCCUA | 11769 |
| 972 | GAUGUGAUU CUGAGCCC | 2352 | GGGCUCAG CUGAUGAGGCCGUUAGGCCGAA AUCACAUC | 11770 |
| 973 | AUGUGAUUC UGAGCCCC | 2353 | GGGGCUCA CUGAUGAGGCCGUUAGGCCGAA AAUCACAU | 11771 |
| 993 | CAUGAAAUU GAGCUAUC | 2354 | GAUAGCUC CUGAUGAGGCCGUUAGGCCGAA AUUUCAUG | 11772 |
| 999 | AUUGAGCUA UCUGCCGG | 2355 | CCGGCAGA CUGAUGAGGCCGUUAGGCCGAA AGCUCAAU | 11773 |
| 1001 | UGAGCUAUC UGCCGGAG | 2356 | CUCCGGCA CUGAUGAGGCCGUUAGGCCGAA AUAGCUCA | 11774 |
| 1017 | GAAAACUU GUCUUAAA | 2357 | UUUAAGAC CUGAUGAGGCCGUUAGGCCGAA AGUUUUUC | 11775 |
| 1020 | AACUUGUC UUAAAUUG | 2358 | CAAUUUAA CUGAUGAGGCCGUUAGGCCGAA ACAAGUUU | 11776 |
| 1022 | ACUUGUCUU AAAUUGUA | 2359 | UACAAUUU CUGAUGAGGCCGUUAGGCCGAA AGACAAGU | 11777 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 1023 | CUUGUCUUA AAUUGUAC | 1641 | GUACAAUU CUGAUGAGGCCGUUAGGCCGAA AAGACAAG | 11060 |
| 1027 | UCUUAAAUU GUACAGCG | 2360 | CGCUGUAC CUGAUGAGGCCGUUAGGCCGAA AUUUAAGA | 11778 |
| 1030 | UAAAUUGUA CAGCGAGA | 2361 | UCUCGCUG CUGAUGAGGCCGUUAGGCCGAA ACAAUUUA | 11779 |
| 1047 | ACAGAGCUC AAUGUGGG | 2362 | CCCACAUU CUGAUGAGGCCGUUAGGCCGAA AGCUCUGU | 11780 |
| 1059 | GUGGGGCUU GAUUUCAC | 2363 | GUGAAAUC CUGAUGAGGCCGUUAGGCCGAA AGCCCCAC | 11781 |
| 1063 | GGCUUGAUU UCACCUGG | 2364 | CCAGGUGA CUGAUGAGGCCGUUAGGCCGAA AUCAAGCC | 11782 |
| 1064 | GCUUGAUUU CACCUGGC | 2365 | GCCAGGUG CUGAUGAGGCCGUUAGGCCGAA AAUCAAGC | 11783 |
| 1065 | CUUGAUUUC ACCUGGCA | 2366 | UGCCAGGU CUGAUGAGGCCGUUAGGCCGAA AAAUCAAG | 11784 |
| 1076 | CUGGCACUC UCCACCUU | 2367 | AAGGUGGA CUGAUGAGGCCGUUAGGCCGAA AGUGCCAG | 11785 |
| 1078 | GGCACUCUC CACCUUCA | 2368 | UGAAGGUG CUGAUGAGGCCGUUAGGCCGAA AGAGUGCC | 11786 |
| 1084 | CUCCACCUU CAAAGUCU | 2369 | AGACUUUG CUGAUGAGGCCGUUAGGCCGAA AGGUGGAG | 11787 |
| 1085 | UCCACCUUC AAAGUCUC | 2370 | GAGACUUU CUGAUGAGGCCGUUAGGCCGAA AAGGUGGA | 11788 |
| 1091 | UUCAAAGUC UCAUCAUA | 2371 | UAUGAUGA CUGAUGAGGCCGUUAGGCCGAA ACUUUGAA | 11789 |
| 1093 | CAAAGUCUC AUCAUAAG | 2372 | CUUAUGAU CUGAUGAGGCCGUUAGGCCGAA AGACUUUG | 11790 |
| 1096 | AGUCUCAUC AUAAGAAG | 2373 | CUUCUUAU CUGAUGAGGCCGUUAGGCCGAA AUGAGACU | 11791 |
| 1099 | CUCAUCAUA AGAAGAUU | 2374 | AAUCUUCU CUGAUGAGGCCGUUAGGCCGAA AUGAUGAG | 11792 |
| 1107 | AAGAAGAUU GUAAACCG | 2375 | CGGUUUAC CUGAUGAGGCCGUUAGGCCGAA AUCUUCUU | 11793 |
| 1110 | AAGAUUGUA AACCGGGA | 2376 | UCCCGGUU CUGAUGAGGCCGUUAGGCCGAA ACAAUCUU | 11794 |
| 1130 | GAAACCCUU UCCUGGGA | 2377 | UCCCAGGA CUGAUGAGGCCGUUAGGCCGAA AGGGUUUC | 11795 |
| 1131 | AAACCCUUU CCUGGGAC | 2378 | GUCCCAGG CUGAUGAGGCCGUUAGGCCGAA AAGGGUUU | 11796 |
| 1132 | AACCCUUUC CUGGGACU | 2379 | AGUCCCAG CUGAUGAGGCCGUUAGGCCGAA AAAGGGUU | 11797 |
| 1154 | GAAGAUGUU UUUGAGCA | 2380 | UGCUCAAA CUGAUGAGGCCGUUAGGCCGAA ACAUCUUC | 11798 |
| 1155 | AAGAUGUUU UUGAGCAC | 2381 | GUGCUCAA CUGAUGAGGCCGUUAGGCCGAA AACAUCUU | 11799 |
| 1156 | AGAUGUUUU UGAGCACC | 2382 | GGUGCUCA CUGAUGAGGCCGUUAGGCCGAA AAACAUCU | 11800 |
| 1157 | GAUGUUUUU GAGCACCU | 2383 | AGGUGCUC CUGAUGAGGCCGUUAGGCCGAA AAAACAUC | 11801 |
| 1166 | GAGCACCUU GACAAUAG | 2384 | CUAUUGUC CUGAUGAGGCCGUUAGGCCGAA AGGUGCUC | 11802 |
| 1173 | UUGACAAUA GAAAGUGU | 2385 | ACACUUUC CUGAUGAGGCCGUUAGGCCGAA AUUGUCAA | 11803 |
| 1205 | AGGGGAAUA CACCUGUG | 2386 | CACAGGUG CUGAUGAGGCCGUUAGGCCGAA AUUCCCCU | 11804 |
| 1215 | ACCUGUGUA GCGUCCAG | 2387 | CUGGACGC CUGAUGAGGCCGUUAGGCCGAA ACACAGGU | 11805 |
| 1220 | UGUAGCGUC CAGUGGAC | 2388 | GUCCACUG CUGAUGAGGCCGUUAGGCCGAA ACGCUACA | 11806 |
| 1236 | CGGAUGAUC AAGAGAAA | 2389 | UUUCUCUU CUGAUGAGGCCGUUAGGCCGAA AUCAUCCG | 11807 |
| 1246 | AGAGAAAUA GAACAUUU | 2390 | AAAUGUUC CUGAUGAGGCCGUUAGGCCGAA AUUUCUCU | 11808 |
| 1253 | UAGAACAUU UGUCCGAG | 2391 | CUCGGACA CUGAUGAGGCCGUUAGGCCGAA AUGUUCUA | 11809 |
| 1254 | AGAACAUUU GUCCGAGU | 2392 | ACUCGGAC CUGAUGAGGCCGUUAGGCCGAA AAUGUUCU | 11810 |
| 1257 | ACAUUUGUC CGAGUUCA | 2393 | UGAACUCG CUGAUGAGGCCGUUAGGCCGAA ACAAAUGU | 11811 |
| 1263 | GUCCGAGUU CACACAAA | 2394 | UUUGUGUG CUGAUGAGGCCGUUAGGCCGAA ACUCGGAC | 11812 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 1264 | UCCGAGUUC ACACAAAG | 2395 | CUUUGUGU CUGAUGAGGCCGUUAGGCCGAA AACUCGGA | 11813 |
| 1276 | CAAAGCCUU UUAUUGCU | 2396 | AGCAAUAA CUGAUGAGGCCGUUAGGCCGAA AGGCUUUG | 11814 |
| 1277 | AAAGCCUUU UAUUGCUU | 2397 | AAGCAAUA CUGAUGAGGCCGUUAGGCCGAA AAGGCUUU | 11815 |
| 1278 | AAGCCUUUU AUUGCUUU | 2398 | AAAGCAAU CUGAUGAGGCCGUUAGGCCGAA AAAGGCUU | 11816 |
| 1279 | AGCCUUUUA UUGCUUUC | 2399 | GAAAGCAA CUGAUGAGGCCGUUAGGCCGAA AAAAGGCU | 11817 |
| 1281 | CCUUUUAUU GCUUUCGG | 2400 | CCGAAAGC CUGAUGAGGCCGUUAGGCCGAA AUAAAAGG | 11818 |
| 1285 | UUAUUGCUU UCGGUAGU | 2401 | ACUACCGA CUGAUGAGGCCGUUAGGCCGAA AGCAAUAA | 11819 |
| 1286 | UAUUGCUUU CGGUAGUG | 2402 | CACUACCG CUGAUGAGGCCGUUAGGCCGAA AAGCAAUA | 11820 |
| 1287 | AUUGCUUUC GGUAGUGG | 2403 | CCACUACC CUGAUGAGGCCGUUAGGCCGAA AAAGCAAU | 11821 |
| 1291 | CUUUCGGUA GUGGGAUG | 2404 | CAUCCCAC CUGAUGAGGCCGUUAGGCCGAA ACCGAAAG | 11822 |
| 1304 | GAUGAAAUC UUGGUGG | 2405 | CCACCAAA CUGAUGAGGCCGUUAGGCCGAA AUUUCAUC | 11823 |
| 1306 | UGAAAUCUU GGUGGAA | 2406 | UUCCACCA CUGAUGAGGCCGUUAGGCCGAA AGAUUUCA | 11824 |
| 1307 | GAAAUCUUU GGUGGAAG | 2407 | CUUCCACC CUGAUGAGGCCGUUAGGCCGAA AAGAUUUC | 11825 |
| 1330 | UGGGCAGUC AAGUCCGA | 2408 | UCGGACUU CUGAUGAGGCCGUUAGGCCGAA ACUGCCCA | 11826 |
| 1335 | AGUCAAGUC CGAAUCCC | 2409 | GGGAUUCG CUGAUGAGGCCGUUAGGCCGAA ACUUGACU | 11827 |
| 1341 | GUCCGAAUC CUGUGAA | 2410 | UUCACAGG CUGAUGAGGCCGUUAGGCCGAA AUUCGGAC | 11828 |
| 1352 | UGUGAAGUA UCUCAGUU | 2411 | AACUGAGA CUGAUGAGGCCGUUAGGCCGAA ACUUCACA | 11829 |
| 1354 | UGAAGUAUC UCAGUUAC | 2412 | GUAACUGA CUGAUGAGGCCGUUAGGCCGAA AUACUUCA | 11830 |
| 1356 | AAGUAUCUC AGUUACCC | 2413 | GGGUAACU CUGAUGAGGCCGUUAGGCCGAA AGAUACUU | 11831 |
| 1360 | AUCUCAGUU ACCCAGCU | 2414 | AGCUGGGU CUGAUGAGGCCGUUAGGCCGAA ACUGAGAU | 11832 |
| 1361 | UCUCAGUUA CCCAGCUC | 2415 | GAGCUGGG CUGAUGAGGCCGUUAGGCCGAA AACUGAGA | 11833 |
| 1369 | ACCCAGCUC UGAUAUC | 2416 | GAUAUCAG CUGAUGAGGCCGUUAGGCCGAA AGCUGGGU | 11834 |
| 1375 | CUCCUGAUA UCAAAUGG | 2417 | CCAUUUGA CUGAUGAGGCCGUUAGGCCGAA AUCAGGAG | 11835 |
| 1377 | CCUGAUAUC AAAUGGUA | 2418 | UACCAUUU CUGAUGAGGCCGUUAGGCCGAA AUAUCAGG | 11836 |
| 1385 | CAAAUGGUA CAGAAAUG | 2419 | CAUUUCUG CUGAUGAGGCCGUUAGGCCGAA ACCAUUUG | 11837 |
| 1404 | AGGCCCAUU GAGUCCAA | 2420 | UUGGACUC CUGAUGAGGCCGUUAGGCCGAA AUGGGCCU | 11838 |
| 1409 | CAUUGAGUC CAACUACA | 2421 | UGUAGUUG CUGAUGAGGCCGUUAGGCCGAA ACUCAAUG | 11839 |
| 1415 | GUCCAACUA CACAAUGA | 2422 | UCAUUGUG CUGAUGAGGCCGUUAGGCCGAA AGUUGGAC | 11840 |
| 1425 | ACAAUGAUU GUUGGCGA | 2423 | UCGCCAAC CUGAUGAGGCCGUUAGGCCGAA AUCAUUGU | 11841 |
| 1428 | AUGAUUGUU GGCGAUGA | 2424 | UCAUCGCC CUGAUGAGGCCGUUAGGCCGAA ACAAUCAU | 11842 |
| 1440 | GAUGAACUC ACCAUCAU | 2425 | AUGAUGGU CUGAUGAGGCCGUUAGGCCGAA AGUUCAUC | 11843 |
| 1446 | CUCACCAUC AUGGAAGU | 2426 | ACUUCCAU CUGAUGAGGCCGUUAGGCCGAA AUGGUGAG | 11844 |
| 1478 | AGGAAACUA CACGGUCA | 2427 | UGACCGUG CUGAUGAGGCCGUUAGGCCGAA AGUUUCCU | 11845 |
| 1485 | UACACGGUC AUCCUCAC | 2428 | GUGAGGAU CUGAUGAGGCCGUUAGGCCGAA ACCGUGUA | 11846 |
| 1488 | ACGGUCAUC CUCACCAA | 2429 | UUGGUGAG CUGAUGAGGCCGUUAGGCCGAA AUGACCGU | 11847 |
| 1491 | GUCAUCCUC ACCAACCC | 2430 | GGGUUGGU CUGAUGAGGCCGUUAGGCCGAA AGGAUGAC | 11848 |
| 1503 | AACCCCAUU UCAAUGGA | 2431 | UCCAUUGA CUGAUGAGGCCGUUAGGCCGAA AUGGGGUU | 11849 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 1504 | ACCCCAUUU CAAUGGAG | 2432 | CUCCAUUG CUGAUGAGGCCGUUAGGCCGAA AAUGGGGU | 11850 |
| 1505 | CCCCAUUUC AAUGGAGA | 2433 | UCUCCAUU CUGAUGAGGCCGUUAGGCCGAA AAAUGGGG | 11851 |
| 1530 | CACAUGGUC UCUCUGGU | 2434 | ACCAGAGA CUGAUGAGGCCGUUAGGCCGAA ACCAUGUG | 11852 |
| 1532 | CAUGGUCUC UCUGGUUG | 2435 | CAACCAGA CUGAUGAGGCCGUUAGGCCGAA AGACCAUG | 11853 |
| 1534 | UGGUCUCUC UGGUUGUG | 1714 | CACAACCA CUGAUGAGGCCGUUAGGCCGAA AGAGACCA | 11133 |
| 1539 | UCUCUGGUU GUGAAUGU | 2436 | ACAUUCAC CUGAUGAGGCCGUUAGGCCGAA ACCAGAGA | 11854 |
| 1548 | GUGAAUGUC CCACCCCA | 2437 | UGGGGUGG CUGAUGAGGCCGUUAGGCCGAA ACAUUCAC | 11855 |
| 1560 | CCCCAGAUC GGUGAGAA | 2438 | UUCUCACC CUGAUGAGGCCGUUAGGCCGAA AUCUGGGG | 11137 |
| 1574 | GAAAGCCUU GAUCUCGC | 2439 | GCGAGAUC CUGAUGAGGCCGUUAGGCCGAA AGGCUUUC | 11856 |
| 1578 | GCCUUGAUC UCGCCUAU | 2440 | AUAGGCGA CUGAUGAGGCCGUUAGGCCGAA AUCAAGGC | 11857 |
| 1580 | CUUGAUCUC GCCUAUGG | 2441 | CCAUAGGC CUGAUGAGGCCGUUAGGCCGAA AGAUCAAG | 11858 |
| 1585 | UCUCGCCUA UGGAUUCC | 2442 | GGAAUCCA CUGAUGAGGCCGUUAGGCCGAA AGGCGAGA | 11859 |
| 1591 | CUAUGGAUU CCUACCAG | 2443 | CUGGUAGG CUGAUGAGGCCGUUAGGCCGAA AUCCAUAG | 11860 |
| 1592 | UAUGGAUUC CUACCAGU | 2444 | ACUGGUAG CUGAUGAGGCCGUUAGGCCGAA AAUCCAUA | 11861 |
| 1595 | GGAUUCCUA CCAGUAUG | 2445 | CAUACUGG CUGAUGAGGCCGUUAGGCCGAA AGGAAUCC | 11862 |
| 1601 | CUACCAGUA UGGGACCA | 2446 | UGGUCCCA CUGAUGAGGCCGUUAGGCCGAA ACUGGUAG | 11863 |
| 1619 | GCAGACAUU GACAUGCA | 2447 | UGCAUGUC CUGAUGAGGCCGUUAGGCCGAA AUGUCUGC | 11864 |
| 1632 | UCCACAGUC UACGCCAA | 2448 | UUGGCGUA CUGAUGAGGCCGUUAGGCCGAA ACUGUGGA | 11865 |
| 1634 | CACAGUCUA CGCCAACC | 2449 | GGUUGGCG CUGAUGAGGCCGUUAGGCCGAA AGACUGUG | 11866 |
| 1645 | CCAACCCUC CCCUGCAC | 2450 | GUGCAGGG CUGAUGAGGCCGUUAGGCCGAA AGGGUUGG | 11867 |
| 1659 | CACCACAUC CAGUGGUA | 2451 | UACCACUG CUGAUGAGGCCGUUAGGCCGAA AUGUGGUG | 11868 |
| 1667 | CCAGUGGUA CUGGCAGC | 2452 | GCUGCCAG CUGAUGAGGCCGUUAGGCCGAA ACCACUGG | 11869 |
| 1677 | UGGCAGCUA AAGAAGC | 2453 | GCUUCUUC CUGAUGAGGCCGUUAGGCCGAA AGCUGCCA | 11870 |
| 1691 | AGCCUGCUC CUACAGAC | 2454 | GUCUGUAG CUGAUGAGGCCGUUAGGCCGAA AGCAGGCU | 11871 |
| 1694 | CUGCUCCUA CAGACCCG | 2455 | CGGGUCUG CUGAUGAGGCCGUUAGGCCGAA AGGAGCAG | 11872 |
| 1718 | AAGCCCGUA UGCUUGUA | 2456 | UACAAGCA CUGAUGAGGCCGUUAGGCCGAA ACGGGCUU | 11873 |
| 1723 | CGUAUGCUU GUAAAGAA | 2457 | UUCUUUAC CUGAUGAGGCCGUUAGGCCGAA AGCAUACG | 11874 |
| 1726 | AUGCUUGUA AGAAUGG | 2458 | CCAUUCUU CUGAUGAGGCCGUUAGGCCGAA ACAAGCAU | 11875 |
| 1750 | UGGAGGAUU UCCAGGGG | 2459 | CCCCUGGA CUGAUGAGGCCGUUAGGCCGAA AUCCUCCA | 11876 |
| 1751 | GGAGGAUUU CCAGGGGG | 2460 | CCCCCUGG CUGAUGAGGCCGUUAGGCCGAA AAUCCUCC | 11877 |
| 1752 | GAGGAUUUC CAGGGGGU | 2461 | CCCCCCUG CUGAUGAGGCCGUUAGGCCGAA AAAUCCUC | 11878 |
| 1770 | AACAAGAUC GAAGUCAC | 2462 | GUGACUUC CUGAUGAGGCCGUUAGGCCGAA AUCUUGUU | 11879 |
| 1776 | AUCGAAGUC ACCAAAAA | 2463 | UUUUUGGU CUGAUGAGGCCGUUAGGCCGAA ACUUCGAU | 11880 |
| 1790 | AAACCAAUA UGCCCUGA | 2464 | UCAGGGCA CUGAUGAGGCCGUUAGGCCGAA AUUGGUUU | 11881 |
| 1800 | GCCCUGAUU GAAGGAAA | 2465 | UUUCCUUC CUGAUGAGGCCGUUAGGCCGAA AUCAGGGC | 11882 |
| 1821 | AAAACUGUA AGUACGCU | 2466 | AGCGUACU CUGAUGAGGCCGUUAGGCCGAA ACAGUUUU | 11883 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 1825 | CUGUAAGUA CGCUGGUC | 2467 | GACCAGCG CUGAUGAGGCCGUUAGGCCGAA ACUUACAG | 11884 |
| 1833 | ACGCUGGUC AUCCAAGC | 2468 | GCUUGGAU CUGAUGAGGCCGUUAGGCCGAA ACCAGCGU | 11885 |
| 1836 | CUGGUCAUC CAAGCUGC | 2469 | GCAGCUUG CUGAUGAGGCCGUUAGGCCGAA AUGACCAG | 11886 |
| 1853 | CAACGUGUC AGCGUUGU | 2470 | ACAACGCU CUGAUGAGGCCGUUAGGCCGAA ACACGUUG | 11887 |
| 1859 | GUCAGCGUU GUACAAAU | 2471 | AUUUGUAC CUGAUGAGGCCGUUAGGCCGAA ACGCUGAC | 11888 |
| 1862 | AGCGUUGUA CAAAUGUG | 2472 | CACAUUUG CUGAUGAGGCCGUUAGGCCGAA ACAACGCU | 11889 |
| 1878 | GAAGCCAUC AACAAAGC | 2473 | GCUUUGUU CUGAUGAGGCCGUUAGGCCGAA AUGGCUUC | 11890 |
| 1905 | GAGAGGGUC AUCUCCUU | 2474 | AAGGAGAU CUGAUGAGGCCGUUAGGCCGAA ACCCUCUC | 11891 |
| 1908 | AGGGUCAUC UCCUUCCA | 2475 | UGGAAGGA CUGAUGAGGCCGUUAGGCCGAA AUGACCCU | 11892 |
| 1910 | GGUCAUCUC CUUCCAUG | 2476 | CAUGGAAG CUGAUGAGGCCGUUAGGCCGAA AGAUGACC | 11893 |
| 1913 | CAUCUCCUU CCAUGUGA | 2477 | UCACAUGG CUGAUGAGGCCGUUAGGCCGAA AGGAGAUG | 11894 |
| 1914 | AUCUCCUUC CAUGUGAU | 2478 | AUCACAUG CUGAUGAGGCCGUUAGGCCGAA AAGGAGAU | 11895 |
| 1923 | CAUGUGAUC AGGGUCC | 2479 | GGACCCCU CUGAUGAGGCCGUUAGGCCGAA AUCACAUG | 11896 |
| 1930 | UCAGGGGUC UGAAAUU | 2480 | AAUUUCAG CUGAUGAGGCCGUUAGGCCGAA ACCCCUGA | 11897 |
| 1938 | CCUGAAAUU ACUGUGCA | 2481 | UGCACAGU CUGAUGAGGCCGUUAGGCCGAA AUUUCAGG | 11898 |
| 1939 | CUGAAAUUA CUGUGCAA | 2482 | UUGCACAG CUGAUGAGGCCGUUAGGCCGAA AAUUUCAG | 11899 |
| 1982 | GAGUGUGUC CUGUUUGU | 2483 | ACAACAGG CUGAUGAGGCCGUUAGGCCGAA ACACACUC | 11900 |
| 1988 | GUCCCUGUU GUGCACUG | 2484 | CAGUGCAC CUGAUGAGGCCGUUAGGCCGAA ACAGGGAC | 11901 |
| 2008 | ACAGAAAUA CGUUUGAG | 2485 | CUCAAACG CUGAUGAGGCCGUUAGGCCGAA AUUUCUGU | 11902 |
| 2012 | AAAUACGUU UGAGAACC | 2486 | GGUUCUCA CUGAUGAGGCCGUUAGGCCGAA ACGUAUUU | 11903 |
| 2013 | AAUACGUUU GAGAACCU | 2487 | AGGUUCUC CUGAUGAGGCCGUUAGGCCGAA AACGUAUU | 11904 |
| 2022 | GAGAACCUC ACGUGGUA | 2488 | UACCACGU CUGAUGAGGCCGUUAGGCCGAA AGGUUCUC | 11905 |
| 2030 | CACGUGGUA CAAGCUUG | 2489 | CAAGCUUG CUGAUGAGGCCGUUAGGCCGAA ACCACGUG | 11906 |
| 2037 | UACAAGCUU GGCUCACA | 2490 | UGUGAGCC CUGAUGAGGCCGUUAGGCCGAA AGCUUGUA | 11907 |
| 2042 | GCUUGGCUC ACAGGCAA | 2491 | UUGCCUGU CUGAUGAGGCCGUUAGGCCGAA AGCCAAGC | 11908 |
| 2054 | GGCAACAUC GGUCCACA | 2492 | UGUGGACC CUGAUGAGGCCGUUAGGCCGAA AUGUUGCC | 11909 |
| 2058 | ACAUCGGUC CACAUGGG | 2493 | CCCAUGUG CUGAUGAGGCCGUUAGGCCGAA ACCGAUGU | 11910 |
| 2072 | GGGCGAAUC ACUCACAC | 2494 | GUGUGAGU CUGAUGAGGCCGUUAGGCCGAA AUUCGCCC | 11911 |
| 2076 | GAAUCACUC ACACCAGU | 2495 | ACUGGUGU CUGAUGAGGCCGUUAGGCCGAA AGUGAUUC | 11912 |
| 2085 | ACACCAGUU UGCAAGAA | 2496 | UUCUUGCA CUGAUGAGGCCGUUAGGCCGAA ACUGGUGU | 11913 |
| 2086 | CACCAGUUU GCAAGAAC | 2497 | GUUCUUGC CUGAUGAGGCCGUUAGGCCGAA AACUGGUG | 11914 |
| 2096 | CAAGAACUU GGAUGCUC | 2498 | GAGCAUCC CUGAUGAGGCCGUUAGGCCGAA AGUUCUUG | 11915 |
| 2104 | UGGAUGCUC UUUGGAAA | 2499 | UUUCCAAA CUGAUGAGGCCGUUAGGCCGAA AGCAUCCA | 11916 |
| 2106 | GAUGCUCUU UGGAAACU | 2500 | AGUUUCCA CUGAUGAGGCCGUUAGGCCGAA AGACCAUC | 11917 |
| 2107 | AUGCUCUUU GGAAACUG | 2501 | CAGUUUCC CUGAUGAGGCCGUUAGGCCGAA AAGAGCAU | 11918 |
| 2129 | CACCAUGUU UUCUAACA | 2502 | UGUUAGAA CUGAUGAGGCCGUUAGGCCGAA ACAUGGUG | 11919 |
| 2130 | ACCAUGUUU UCUAACAG | 2503 | CUGUUAGA CUGAUGAGGCCGUUAGGCCGAA AACAUGGU | 11920 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 2131 | CCAUGUUUU CUAACAGC | 2504 | GCUGUUAG CUGAUGAGGCCGUUAGGCCGAA AAACAUGG | 11921 |
| 2132 | CAUGUUUUC UAACAGCA | 2505 | UGCUGUUA CUGAUGAGGCCGUUAGGCCGAA AAAACAUG | 11922 |
| 2134 | UGUUUUCUA ACAGCACA | 2506 | UGUGCUGU CUGAUGAGGCCGUUAGGCCGAA AGAAAACA | 11923 |
| 2151 | AAUGACAUC UUGAUUGU | 2507 | ACAAUCAA CUGAUGAGGCCGUUAGGCCGAA AUGUCAUU | 11924 |
| 2153 | UGACAUCUU GAUUGUGG | 2508 | CCACAAUC CUGAUGAGGCCGUUAGGCCGAA AGAUGUCA | 11925 |
| 2157 | AUCUUGAUU GUGGCAUU | 2509 | AAUGCCAC CUGAUGAGGCCGUUAGGCCGAA AUCAAGAU | 11926 |
| 2165 | UGUGGCAUU UCAGAAUG | 2510 | CAUUCUGA CUGAUGAGGCCGUUAGGCCGAA AUGCCACA | 11927 |
| 2166 | GUGGCAUUU CAGAAUGC | 2511 | GCAUUCUG CUGAUGAGGCCGUUAGGCCGAA AAUGCCAC | 11928 |
| 2167 | UGGCAUUUC AGAAUGCC | 2512 | GGCAUUCU CUGAUGAGGCCGUUAGGCCGAA AAAUGCCA | 11929 |
| 2177 | GAAUGCCUC UCUGCAGG | 2513 | CCUGCAGA CUGAUGAGGCCGUUAGGCCGAA AGGCAUUC | 11930 |
| 2179 | AUGCCUCUC UGCAGGAC | 2514 | GUCCUGCA CUGAUGAGGCCGUUAGGCCGAA AGAGGCAU | 11931 |
| 2198 | AGGCGACUA UGUUUGCU | 2515 | AGCAAACA CUGAUGAGGCCGUUAGGCCGAA AGUCGCCU | 11932 |
| 2202 | GACUAUGUU UGCUCUGC | 2516 | GCAGAGCA CUGAUGAGGCCGUUAGGCCGAA ACAUAGUC | 11933 |
| 2203 | ACUAUGUUU GCUCUGCU | 2517 | AGCAGAGC CUGAUGAGGCCGUUAGGCCGAA AACAUAGU | 11934 |
| 2207 | UGUUUGCUC UGCUCAAG | 2518 | CUUGAGCA CUGAUGAGGCCGUUAGGCCGAA AGCAAACA | 11935 |
| 2212 | GCUCUGCUC AAGAUAAG | 2519 | CUUAUCUU CUGAUGAGGCCGUUAGGCCGAA AGCAGAGC | 11936 |
| 2218 | CUCAAGAUA AGAAGACC | 2520 | GGUCUUCU CUGAUGAGGCCGUUAGGCCGAA AUCUUGAG | 11937 |
| 2239 | AAAGACAUU GCCUGGUC | 2521 | GACCAGGC CUGAUGAGGCCGUUAGGCCGAA AUGUCUUU | 11938 |
| 2247 | UGCCUGGUC AAACAGCU | 2522 | AGCUGUUU CUGAUGAGGCCGUUAGGCCGAA ACCAGGCA | 11939 |
| 2256 | AAACAGCUC AUCAUCCU | 2523 | AGGAUGAU CUGAUGAGGCCGUUAGGCCGAA AGCUGUUU | 11940 |
| 2259 | CAGCUCAUC AUCCUAGA | 2524 | UCUAGGAU CUGAUGAGGCCGUUAGGCCGAA AUGAGCUG | 11941 |
| 2262 | CUCAUCAUC CUAGAGCG | 2525 | CGCUCUAG CUGAUGAGGCCGUUAGGCCGAA AUGAUGAG | 11942 |
| 2265 | AUCAUCCUA GAGCGCAU | 2526 | AUGCGCUC CUGAUGAGGCCGUUAGGCCGAA AGGAUGAU | 11943 |
| 2286 | CCCAUGAUC ACCGGAAA | 2527 | UUUCCGGU CUGAUGAGGCCGUUAGGCCGAA AUCAUGGG | 11944 |
| 2296 | CCGGAAAUC UGGAGAAU | 2528 | AUUCUCCA CUGAUGAGGCCGUUAGGCCGAA AUUUCCGG | 11945 |
| 2305 | UGGAGAAUC AGACAACA | 2529 | UGUUGUCU CUGAUGAGGCCGUUAGGCCGAA AUUCUCCA | 11946 |
| 2319 | ACAACCAUU GGCGAGAC | 2530 | GUCUCGCC CUGAUGAGGCCGUUAGGCCGAA AUGGUUGU | 11947 |
| 2331 | GAGACCAUU GAAGUGAC | 2531 | GUCACUUC CUGAUGAGGCCGUUAGGCCGAA AUGGUCUC | 11948 |
| 2341 | AAGUGACUU GCCCAGCA | 2532 | UGCUGGGC CUGAUGAGGCCGUUAGGCCGAA AGUCACUU | 11949 |
| 2351 | CCCAGCAUC UGGAAAUC | 2533 | GAUUUCCA CUGAUGAGGCCGUUAGGCCGAA AUGCUGGG | 11950 |
| 2359 | CUGGAAAUC UACCCCA | 2534 | UGGGGUAG CUGAUGAGGCCGUUAGGCCGAA AUUUCCAG | 11951 |
| 2362 | GAAAUCCUA CCCCACAC | 2535 | GUGUGGGG CUGAUGAGGCCGUUAGGCCGAA AGGAUUUC | 11952 |
| 2373 | CCACACAUU ACAUGGUU | 2536 | AACCAUGU CUGAUGAGGCCGUUAGGCCGAA AUGUGUGG | 11953 |
| 2374 | CACACAUUA CAUGGUUC | 2537 | GAACCAUG CUGAUGAGGCCGUUAGGCCGAA AAUGUGUG | 11954 |
| 2381 | UACAUGGUU CAAAGACA | 2538 | UGUCUUUG CUGAUGAGGCCGUUAGGCCGAA ACCAUGUA | 11955 |
| 2382 | ACAUGGUUC AAAGACAA | 2539 | UUGUCUUU CUGAUGAGGCCGUUAGGCCGAA AACCAUGU | 11956 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 2403 | ACCCUGGUA GAAGAUUC | 2540 | GAAUCUUC CUGAUGAGGCCGUUAGGCCGAA ACCAGGGU | 11957 |
| 2410 | UAGAAGAUU CAGGCAUU | 2541 | AAUGCCUG CUGAUGAGGCCGUUAGGCCGAA AUCUUCUA | 11958 |
| 2411 | AGAAGAUUC AGGCAUUG | 2542 | CAAUGCCU CUGAUGAGGCCGUUAGGCCGAA AAUCUUCU | 11959 |
| 2418 | UCAGGCAUU GUACUGAG | 2543 | CUCAGUAC CUGAUGAGGCCGUUAGGCCGAA AUGCCUGA | 11960 |
| 2421 | GGCAUUGUA CUGAGAGA | 2544 | UCUCUCAG CUGAUGAGGCCGUUAGGCCGAA ACAAUGCC | 11961 |
| 2449 | ACCUGACUA UCCGCAGG | 2545 | CCUGCGGA CUGAUGAGGCCGUUAGGCCGAA AGUCAGGU | 11962 |
| 2451 | CUGACUAUC CGCAGGGU | 2546 | ACCCUGCG CUGAUGAGGCCGUUAGGCCGAA AUAGUCAG | 11963 |
| 2481 | GGAGGCCUC UACACCUG | 2547 | CAGGUGUA CUGAUGAGGCCGUUAGGCCGAA AGGCCUCC | 11964 |
| 2483 | AGGCCUCUA CACCUGCC | 1847 | GGCAGGUG CUGAUGAGGCCGUUAGGCCGAA AGAGGCCU | 11266 |
| 2505 | UGCAAUGUC CUUGGCUG | 2548 | CAGCCAAG CUGAUGAGGCCGUUAGGCCGAA ACAUUGCA | 11965 |
| 2508 | AAUGUCCUU GGCUGUGC | 2549 | GCACAGCC CUGAUGAGGCCGUUAGGCCGAA AGGACAUU | 11966 |
| 2532 | GAGACGCUC UUCAUAAU | 2550 | AUUAUGAA CUGAUGAGGCCGUUAGGCCGAA AGCGUCUC | 11967 |
| 2534 | GACGCUCUU CAUAAUAG | 2551 | CUAUUAUG CUGAUGAGGCCGUUAGGCCGAA AGAGCGUC | 11968 |
| 2535 | ACGCUCUUC AUAAUAGA | 2552 | UCUAUUAU CUGAUGAGGCCGUUAGGCCGAA AAGAGCGU | 11969 |
| 2538 | CUCUUCAUA AUAGAAGG | 2553 | CCUUCUAU CUGAUGAGGCCGUUAGGCCGAA AUGAAGAG | 11970 |
| 2541 | UUCAUAAUA GAAGGUGC | 1857 | GCACCUUC CUGAUGAGGCCGUUAGGCCGAA AUUAUGAA | 11276 |
| 2567 | GACCAACUU GGAAGUCA | 2554 | UGACUUCC CUGAUGAGGCCGUUAGGCCGAA AGUUGGUC | 11971 |
| 2574 | UUGGAAGUC AUUAUCCU | 2555 | AGGAUAAU CUGAUGAGGCCGUUAGGCCGAA ACUUCCAA | 11972 |
| 2577 | GAAGUCAUU AUCCUCGU | 2556 | ACGAGGAU CUGAUGAGGCCGUUAGGCCGAA AUGACUUC | 11973 |
| 2578 | AAGUCAUUA UCCUCGUC | 2557 | GACGAGGA CUGAUGAGGCCGUUAGGCCGAA AAUGACUU | 11974 |
| 2580 | GUCAUUAUC CUCGUCGG | 2558 | CCGACGAG CUGAUGAGGCCGUUAGGCCGAA AUAAUGAC | 11975 |
| 2583 | AUUAUCCUC GUCGGCAC | 2559 | GUGCCGAC CUGAUGAGGCCGUUAGGCCGAA AGGAUAAU | 11976 |
| 2586 | AUCCUCGUC GGCACUGC | 2560 | GCAGUGCC CUGAUGAGGCCGUCAGGCCGAA ACGAGGAU | 11977 |
| 2601 | GCAGUGAUU GCCAUGUU | 2561 | AACAUGGC CUGAUGAGGCCGUUAGGCCGAA AUCACUGC | 11978 |
| 2609 | UGCCAUGUU CUUCUGGC | 1867 | GCCAGAAG CUGAUGAGGCCGUUAGGCCGAA ACAUGGCA | 11286 |
| 2610 | GCCAUGUUC UUCUGGCU | 1868 | AGCCAGAA CUGAUGAGGCCGUUAGGCCGAA AACAUGGC | 11287 |
| 2612 | CAUGUUCUU CUGGCUCC | 2562 | GGAGCCAG CUGAUGAGGCCGUUAGGCCGAA AGAACAUG | 11979 |
| 2613 | AUGUUCUUC UGGCUCCU | 2563 | AGGAGCCA CUGAUGAGGCCGUUAGGCCGAA AAGAACAU | 11980 |
| 2619 | UUCUGGCUC CUUCUUGU | 2564 | ACAAGAAG CUGAUGAGGCCGUUAGGCCGAA AGCCAGAA | 11290 |
| 2622 | UGGCUCCUU CUUGUCAU | 2565 | AUGACAAG CUGAUGAGGCCGUUAGGCCGAA AGGAGCCA | 11981 |
| 2623 | GGCUCCUUC UUGUCAUU | 2566 | AAUGACAA CUGAUGAGGCCGUUAGGCCGAA AAGGAGCC | 11982 |
| 2625 | CUCCUUCUU GUCAUUGU | 2567 | ACAAUGAC CUGAUGAGGCCGUUAGGCCGAA AGAAGGAG | 11983 |
| 2628 | CUUCUUGUC AUUGUCCU | 2568 | AGGACAAU CUGAUGAGGCCGUUAGGCCGAA ACAAGAAG | 11984 |
| 2631 | CUUGUCAUU GUCCUACG | 2569 | CGUAGGAC CUGAUGAGGCCGUUAGGCCGAA AUGACAAG | 11985 |
| 2634 | GUCAUUGUC CUACGGAC | 2570 | GUCCGUAG CUGAUGAGGCCGUUAGGCCGAA ACAAUGAC | 11986 |
| 2637 | AUUGUCCUA CGGACCGU | 2571 | ACGGUCCG CUGAUGAGGCCGUUAGGCCGAA AGGACAAU | 11987 |
| 2646 | CGGACCGUU AAGCGGGC | 2572 | GCCCGCUU CUGAUGAGGCCGUUAGGCCGAA ACGGUCCG | 11988 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 2647 | GGACCGUUA AGCGGGCC | 1880 | GGCCCGCU CUGAUGAGGCCGUUAGGCCGAA AACGGUCC | 11299 |
| 2681 | GACAGGCUA CUUGUCUA | 2573 | UAGACAAG CUGAUGAGGCCGUUAGGCCGAA AGCCUGUC | 11989 |
| 2684 | AGGCUACUU GUCUAUUG | 2574 | CAAUAGAC CUGAUGAGGCCGUUAGGCCGAA AGUAGCCU | 11990 |
| 2687 | CUACUUGUC UAUUGUCA | 2575 | UGACAAUA CUGAUGAGGCCGUUAGGCCGAA ACAAGUAG | 11991 |
| 2689 | ACUUGUCUA UUGUCAUG | 2576 | CAUGACAA CUGAUGAGGCCGUUAGGCCGAA AGACAAGU | 11992 |
| 2691 | UUGUCUAUU GUCAUGGA | 2577 | UCCAUGAC CUGAUGAGGCCGUUAGGCCGAA AUAGACAA | 11993 |
| 2694 | UCUAUUGUC AUGGAUCC | 2578 | GGAUCCAU CUGAUGAGGCCGUUAGGCCGAA ACAAUAGA | 11994 |
| 2701 | UCAUGGAUC CAGAUGAA | 1886 | UUCAUCUG CUGAUGAGGCCGUUAGGCCGAA AUCCAUGA | 11305 |
| 2711 | AGAUGAAUU GCCCUUGG | 2579 | CCAAGGGC CUGAUGAGGCCGUUAGGCCGAA AUUCAUCU | 11995 |
| 2717 | AUUGCCCUU GGAUGAGC | 2580 | GCUCAUCC CUGAUGAGGCCGUUAGGCCGAA AGGGCAAU | 11996 |
| 2738 | UGAACGCUU GCCUUAUG | 2581 | CAUAAGGC CUGAUGAGGCCGUUAGGCCGAA AGCGUUCA | 11997 |
| 2743 | GCUUGCCUU AUGAUGCC | 2582 | GGCAUCAU CUGAUGAGGCCGUUAGGCCGAA AGGCAAGC | 11998 |
| 2744 | CUUGCCUUA UGAUGCCA | 2583 | UGGCAUCA CUGAUGAGGCCGUUAGGCCGAA AAGGCAAG | 11999 |
| 2765 | GUGGGAAUU CCCCAGGG | 2584 | CCCUGGGG CUGAUGAGGCCGUUAGGCCGAA AUUCCCAC | 12000 |
| 2766 | UGGGAAUUC CCCAGGGA | 2585 | UCCCUGGG CUGAUGAGGCCGUUAGGCCGAA AAUUCCCA | 12001 |
| 2787 | CUGAAACUA GGAAAACC | 2586 | GGUUUUCC CUGAUGAGGCCGUUAGGCCGAA AGUUUCAG | 12002 |
| 2797 | GAAAACCUC UUGGCCGC | 2587 | GCGGCCAA CUGAUGAGGCCGUUAGGCCGAA AGGUUUUC | 12003 |
| 2799 | AAACCUCUU GGCCGCGG | 2588 | CCGCGGCC CUGAUGAGGCCGUUAGGCCGAA AGAGGUUU | 12004 |
| 2813 | CGGUGCCUU CGGCCAAG | 2589 | CUUGGCCG CUGAUGAGGCCGUUAGGCCGAA AGGCACCG | 12005 |
| 2814 | GGUGCCUUC GGCCAAGU | 2590 | ACUUGGCC CUGAUGAGGCCGUUAGGCCGAA AAGGCACC | 12006 |
| 2826 | CAAGUGAUU GAGGCAGA | 2591 | UCUGCCUC CUGAUGAGGCCGUUAGGCCGAA AUCACUUG | 12007 |
| 2839 | CAGACGCUU UUGGAAUU | 2592 | AAUUCCAA CUGAUGAGGCCGUUAGGCCGAA AGCGUCUG | 12008 |
| 2840 | AGACGCUUU UGGAAUUG | 2593 | CAAUUCCA CUGAUGAGGCCGUUAGGCCGAA AAGCGUCU | 12009 |
| 2841 | GACGCUUUU GGAAUUGA | 2594 | UCAAUUCC CUGAUGAGGCCGUUAGGCCGAA AAAGCGUC | 12010 |
| 2847 | UUUGGAAUU GACAAGAC | 1903 | GUCUUGUC CUGAUGAGGCCGUUAGGCCGAA AUUCCAAA | 11322 |
| 2863 | CAGCGACUU GCAAAACA | 2595 | UGUUUUGC CUGAUGAGGCCGUUAGGCCGAA AGUCGCUG | 12011 |
| 2874 | AAAACAGUA GCCGUCAA | 2596 | UUGACGGC CUGAUGAGGCCGUUAGGCCGAA ACUGUUUU | 12012 |
| 2880 | GUAGCCGUC AAGAUGUU | 2597 | AACAUCUU CUGAUGAGGCCGUUAGGCCGAA ACGGCUAC | 12013 |
| 2888 | CAAGAUGUU GAAAGAAG | 2598 | CUUCUUUC CUGAUGAGGCCGUUAGGCCGAA ACAUCUUG | 12014 |
| 2917 | GCGAGCAUC GAGCCCUC | 2599 | GAGGGCUC CUGAUGAGGCCGUUAGGCCGAA AUGCUCGC | 12015 |
| 2925 | CGAGCCCUC AUGUCUGA | 2600 | UCAGACAU CUGAUGAGGCCGUUAGGCCGAA AGGGCUCG | 12016 |
| 2930 | CCUCAUGUC UGAACUCA | 2601 | UGAGUUCA CUGAUGAGGCCGUUAGGCCGAA ACAUGAGG | 12017 |
| 2937 | UCUGAACUC AAGAUCCU | 1912 | AGGAUCUU CUGAUGAGGCCGUUAGGCCGAA AGUUCAGA | 11331 |
| 2943 | CUCAAGAUC CUCAUCCA | 2602 | UGGAUGAG CUGAUGAGGCCGUUAGGCCGAA AUCUUGAG | 12018 |
| 2946 | AAGAUCCUC AUCCACAU | 2603 | AUGUGGAU CUGAUGAGGCCGUUAGGCCGAA AGGAUCUU | 12019 |
| 2949 | AUCCUCAUC CACAUUGG | 2604 | CCAAUGUG CUGAUGAGGCCGUUAGGCCGAA AUGAGGAU | 12020 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 2955 | AUCCACAUU GGUCACCA | 2605 | UGGUGACC CUGAUGAGGCCGUUAGGCCGAA AUGUGGAU | 12021 |
| 2959 | ACAUUGGUC ACCAUCUC | 2606 | GAGAUGGU CUGAUGAGGCCGUUAGGCCGAA ACCAAUGU | 12022 |
| 2965 | GUCACCAUC UCAAUGUG | 1920 | CACAUUGA CUGAUGAGGCCGUUAGGCCGAA AUGGUGAC | 11339 |
| 2967 | CACCAUCUC AAUGUGGU | 1921 | ACCACAUU CUGAUGAGGCCGUUAGGCCGAA AGAUGGUG | 11340 |
| 2982 | GUGAACCUC CUAGGCGC | 2607 | GCGCCUAG CUGAUGAGGCCGUUAGGCCGAA AGGUUCAC | 12023 |
| 2985 | AACCUCCUA GGCGCCUG | 2808 | CAGGCGCC CUGAUGAGGCCGUUAGGCCGAA AGGAGGUU | 12024 |
| 3013 | GAGGGCCUC UCAUGGUG | 2609 | CACCAUGA CUGAUGAGGCCGUUAGGCCGAA AGGCCCUC | 12025 |
| 3015 | GGGCCUCUC AUGGUGAU | 2610 | AUCACCAU CUGAUGAGGCCGUUAGGCCGAA AGAGGCCC | 12026 |
| 3024 | AUGGUGAUU GUGGAAUU | 1928 | AAUUCCAC CUGAUGAGGCCGUUAGGCCGAA AUCACCAU | 11347 |
| 3032 | UGUGGAAUU CUGCAAGU | 2611 | ACUUGCAG CUGAUGAGGCCGUUAGGCCGAA AUUCCACA | 12027 |
| 3033 | GUGGAAUUC UGCAAGUU | 2612 | AACUUGCA CUGAUGAGGCCGUUAGGCCGAA AAUUCCAC | 12028 |
| 3041 | CUGCAAGUU UGGAAACC | 2613 | GGUUUCCA CUGAUGAGGCCGUUAGGCCGAA ACUUGCAG | 12029 |
| 3042 | UGCAAGUUU GGAAACCU | 2614 | AGGUUUCC CUGAUGAGGCCGUUAGGCCGAA AACUUGCA | 12030 |
| 3051 | GGAAACCUA UCAACUUA | 2615 | UAAGUUGA CUGAUGAGGCCGUUAGGCCGAA AGGUUUCC | 12031 |
| 3053 | AAACCUAUC AACUUACU | 2616 | AGUAAGUU CUGAUGAGGCCGUUAGGCCGAA AUAGGUUU | 12032 |
| 3058 | UAUCAACUU ACUUACGG | 2617 | CCGUAAGU CUGAUGAGGCCGUUAGGCCGAA AGUUGAUA | 12033 |
| 3059 | AUCAACUUA CUUACGGG | 2618 | CCCGUAAG CUGAUGAGGCCGUUAGGCCGAA AAGUUGAU | 12034 |
| 3062 | AACUUACUU ACGGGCA | 2619 | UGCCCCGU CUGAUGAGGCCGUUAGGCCGAA AGUAAGUU | 12035 |
| 3063 | ACUUACUUA CGGGCAA | 2620 | UUGCCCCG CUGAUGAGGCCGUUAGGCCGAA AAGUAAGU | 12036 |
| 3083 | AAAUGAAUU GUUCCCU | 2621 | AGGGAACA CUGAUGAGGCCGUUAGGCCGAA AUUCAUUU | 12037 |
| 3084 | AAUGAAUUU GUUCCUA | 2622 | UAGGGAAC CUGAUGAGGCCGUUAGGCCGAA AAUUCAUU | 12038 |
| 3087 | GAAUUUGUU CCUAUAA | 2623 | UUAUAGGG CUGAUGAGGCCGUUAGGCCGAA ACAAAUUC | 12039 |
| 3088 | AAUUUGUUC CUAUAAG | 2624 | CUUAUAGG CUGAUGAGGCCGUUAGGCCGAA AACAAAUU | 12040 |
| 3092 | UGUUCCCUA UAAGCA | 2625 | UGCUCUUA CUGAUGAGGCCGUUAGGCCGAA AGGGAACA | 12041 |
| 3094 | UUCCCUAUA AGAGCAAA | 2626 | UUUGCUCU CUGAUGAGGCCGUUAGGCCGAA AUAGGGAA | 12042 |
| 3113 | GGCACGCUU CCGCCAGG | 2627 | CCUGGCGG CUGAUGAGGCCGUUAGGCCGAA AGCGUGCC | 12043 |
| 3114 | GCACGCUUC CGCCAGGG | 2628 | CCCUGGCG CUGAUGAGGCCGUUAGGCCGAA AAGCGUGC | 12044 |
| 3131 | CAAGGACUA CGUUGGGG | 2629 | CCCCAACG CUGAUGAGGCCGUUAGGCCGAA AGUCCUUG | 12045 |
| 3135 | GACUACGUU GGGGAGCU | 2630 | AGCUCCCC CUGAUGAGGCCGUUAGGCCGAA ACGUAGUC | 12046 |
| 3144 | GGGGAGCUC UCCGUGGA | 2631 | UCCACGGA CUGAUGAGGCCGUUAGGCCGAA AGCUCCCC | 12047 |
| 3146 | GGAGCUCUC CGUGGAUC | 2632 | GAUCCACG CUGAUGAGGCCGUUAGGCCGAA AGAGCUCC | 12048 |
| 3154 | CCGUGGAUC UGAAAGA | 2633 | UCUUUUCA CUGAUGAGGCCGUUAGGCCGAA AUCCACGG | 12049 |
| 3167 | AAGACGCUU GGACAGCA | 2634 | UGCUGUCC CUGAUGAGGCCGUUAGGCCGAA AGCGUCUU | 12050 |
| 3177 | GACAGCAUC ACCAGCAG | 2635 | CUGCUGGU CUGAUGAGGCCGUUAGGCCGAA AUGCUGUC | 12051 |
| 3194 | CCAGAGCUC UGCCAGCU | 2636 | AGCUGGCA CUGAUGAGGCCGUUAGGCCGAA AGCUCUGG | 12052 |
| 3203 | UGCCAGCUC AGGCUUUG | 2637 | CAAAGCCU CUGAUGAGGCCGUUAGGCCGAA AGCUGGCA | 12053 |
| 3209 | CUCAGGCUU UGUUGAGG | 2638 | CCUCAACA CUGAUGAGGCCGUUAGGCCGAA AGCCUGAG | 12054 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 3210 | UCAGGCUUU GUUGAGGA | 2639 | UCCUCAAC CUGAUGAGGCCGUUAGGCCGAA AAGCCUGA | 12055 |
| 3213 | GGCUUUGUU GAGGAGAA | 2640 | UUCUCCUC CUGAUGAGGCCGUUAGGCCGAA ACAAAGCC | 12056 |
| 3224 | GGAGAAAUC GCUCAGUG | 2641 | CACUGAGC CUGAUGAGGCCGUUAGGCCGAA AUUUCUCC | 12057 |
| 3228 | AAAUCGCUC AGUGAUGU | 2642 | ACAUCACU CUGAUGAGGCCGUUAGGCCGAA AGCGAUUU | 12058 |
| 3237 | AGUGAUGUA GAGGAAGA | 2643 | UCUUCCUC CUGAUGAGGCCGUUAGGCCGAA ACAUCACU | 9921 |
| 3253 | AAGAAGCUU CUGAAGAA | 2644 | UUCUUCAG CUGAUGAGGCCGUUAGGCCGAA AGCUUCUU | 12059 |
| 3254 | AGAAGCUUC UGAAGAAC | 2645 | GUUCUUCA CUGAUGAGGCCGUUAGGCCGAA AAGCUUCU | 12060 |
| 3266 | AGAACUGUA CAAGGACU | 2646 | AGUCCUUG CUGAUGAGGCCGUUAGGCCGAA ACAGUUCU | 12061 |
| 3275 | CAAGGACUU CCUGACCU | 2647 | AGGUCAGG CUGAUGAGGCCGUUAGGCCGAA AGUCCUUG | 12062 |
| 3276 | AAGGACUUC CUGACCUU | 1962 | AAGGUCAG CUGAUGAGGCCGUUAGGCCGAA AAGUCCUU | 11381 |
| 3284 | CCUGACCUU GGAGCAUC | 1963 | GAUGCUCC CUGAUGAGGCCGUUAGGCCGAA AGGUCAGG | 11382 |
| 3292 | UGGAGCAUC UCAUCUGU | 1964 | ACAGAUGA CUGAUGAGGCCGUUAGGCCGAA AUGCUCCA | 11383 |
| 3294 | GACCAUCUC AUCUGUUA | 1965 | UAACAGAU CUGAUGAGGCCGUUAGGCCGAA AGAUGCUC | 11384 |
| 3297 | CAUCUCAUC UGUUACAG | 1966 | CUGUAACA CUGAUGAGGCCGUUAGGCCGAA AUGAGAUG | 11385 |
| 3301 | UCAUCUGUU ACAGCUUC | 1967 | GAAGCUGU CUGAUGAGGCCGUUAGGCCGAA ACAGAUGA | 11386 |
| 3302 | CAUCUGUUA CAGCUUCC | 1968 | GGAAGCUG CUGAUGAGGCCGUUAGGCCGAA AACAGAUG | 11387 |
| 3308 | UUACAGCUU CCAAGUGG | 1969 | CCACUUGG CUGAUGAGGCCGUUAGGCCGAA AGCUGUAA | 11388 |
| 3309 | UACAGCUUC CAAGUGGC | 1970 | GCCACUUG CUGAUGAGGCCGUUAGGCCGAA AAGCUGUA | 11389 |
| 3319 | AAGUGGCUA AGGGCAUG | 1971 | CAUGCCCU CUGAUGAGGCCGUUAGGCCGAA AGCCACUU | 11390 |
| 3332 | CAUGGAGUU CUUGGCAU | 1972 | AUGCCAAG CUGAUGAGGCCGUUAGGCCGAA ACUCCAUG | 11391 |
| 3333 | AUGGAGUUC UUGGCAUC | 1973 | GAUGCCAA CUGAUGAGGCCGUUAGGCCGAA AACUCCAU | 11392 |
| 3335 | GGAGUUCUU GGCAUCAA | 2648 | UUGAUGCC CUGAUGAGGCCGUUAGGCCGAA AGAACUCC | 12063 |
| 3341 | CUUGGCAUC AAGGAAGU | 2649 | ACUUCCUU CUGAUGAGGCCGUUAGGCCGAA AUGCCAAG | 12064 |
| 3352 | GGAAGUGUA UCCACAGG | 2650 | CCUGUGGA CUGAUGAGGCCGUUAGGCCGAA ACACUUCC | 12065 |
| 3354 | AAGUGUAUC CACAGGGA | 1977 | UCCCUGUG CUGAUGAGGCCGUUAGGCCGAA AUACACUU | 11396 |
| 3381 | CGAAACAUU CUCCUAUC | 2651 | GAUAGGAG CUGAUGAGGCCGUUAGGCCGAA AUGUUUCG | 12066 |
| 3382 | GAAACAUUC UCCUAUCG | 2652 | CGAUAGGA CUGAUGAGGCCGUUAGGCCGAA AAUGUUUC | 12067 |
| 3384 | AACAUUCUC CUAUCGGA | 2653 | UCCGAUAG CUGAUGAGGCCGUUAGGCCGAA AGAAUGUU | 12068 |
| 3387 | AUUCUCCUA UCGGAAA | 2654 | UUUCCGA CUGAUGAGGCCGUUAGGCCGAA AGGAGAAU | 12069 |
| 3389 | UCUCCUAUC GGAGAAGA | 2655 | UCUUCUCC CUGAUGAGGCCGUUAGGCCGAA AUAGGAGA | 12070 |
| 3405 | AAUGGGUU AAGAUCUG | 2656 | CAGAUCUU CUGAUGAGGCCGUUAGGCCGAA ACCACAUU | 12071 |
| 3406 | AUGUGGUUA AGAUCUGU | 2657 | ACAGAUCU CUGAUGAGGCCGUUAGGCCGAA AACCACAU | 12072 |
| 3411 | GUUAAGAUC UGUGACUU | 2658 | AAGUCACA CUGAUGAGGCCGUUAGGCCGAA AUCUUAAC | 12073 |
| 3419 | CUGUGACUU CGGCUUGG | 2659 | CCAAGCCG CUGAUGAGGCCGUUAGGCCGAA AGUCACAG | 12074 |
| 3420 | UGUGACUUC GGCUUGGC | 2660 | GCCAAGCC CUGAUGAGGCCGUUAGGCCGAA AAGUCACA | 11407 |
| 3425 | CUUCGGCUU GGCCCGGG | 2661 | CCCGGGCC CUGAUGAGGCCGUUAGGCCGAA AGCCGAAG | 12075 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 3438 | CGGGACAUU UAUAAAGA | 2662 | UCUUUAUA CUGAUGAGGCCGUUAGGCCGAA AUGUCCCG | 12076 |
| 3439 | GGGACAUUU AUAAAGAC | 2663 | GUCUUUAU CUGAUGAGGCCGUUAGGCCGAA AAUGUCCC | 12077 |
| 3440 | GGACAUUUA UAAAGACC | 2664 | GGUCUUUA CUGAUGAGGCCGUUAGGCCGAA AAAUGUCC | 12078 |
| 3442 | ACAUUUAUA AAGACCCG | 2665 | CGGGUCUU CUGAUGAGGCCGUUAGGCCGAA AUAAAUGU | 12079 |
| 3454 | ACCCGGAUU AUGUCAGA | 2666 | UCUGACAU CUGAUGAGGCCGUUAGGCCGAA AUCCGGGU | 12080 |
| 3455 | CCCGGAUUA UGUCAGAA | 2667 | UUCUGACA CUGAUGAGGCCGUUAGGCCGAA AAUCCGGG | 12081 |
| 3459 | GAUUAUGUC AGAAAAGG | 1998 | CCUUUUCU CUGAUGAGGCCGUUAGGCCGAA ACAUAAUC | 11417 |
| 3480 | GCCCGACUC CUUUGAA | 2668 | UUCAAAGG CUGAUGAGGCCGUUAGGCCGAA AGUCGGGC | 12082 |
| 3484 | GACUCCCUU UGAAGUGG | 2669 | CCACUUCA CUGAUGAGGCCGUUAGGCCGAA AGGGAGUC | 12083 |
| 3485 | ACUCCCUUU GAAGUGGA | 2670 | UCCACUUC CUGAUGAGGCCGUUAGGCCGAA AAGGGAGU | 12084 |
| 3510 | GAAACCAUU UUUGACAG | 2671 | CUGUCAAA CUGAUGAGGCCGUUAGGCCGAA AUGGUUUC | 12085 |
| 3511 | AAACCAUUU UGACAGA | 2672 | UCUGUCAA CUGAUGAGGCCGUUAGGCCGAA AAUGGUUU | 12086 |
| 3512 | AACCAUUUU UGACAGAG | 2673 | CUCUGUCA CUGAUGAGGCCGUUAGGCCGAA AAAUGGUU | 12087 |
| 3513 | ACCAUUUUU GACAGAGU | 2674 | ACUCUGUC CUGAUGAGGCCGUUAGGCCGAA AAAAUGGU | 12088 |
| 3522 | GACAGAGUA UACACAAU | 2675 | AUUGUGUA CUGAUGAGGCCGUUAGGCCGAA ACUCUGUC | 12089 |
| 3524 | CAGAGUAUA CACAAUUC | 2676 | GAAUUGUG CUGAUGAGGCCGUUAGGCCGAA AUACUCUG | 12090 |
| 3531 | UACACAAUU CAGAGCGA | 2677 | UCGCUCUG CUGAUGAGGCCGUUAGGCCGAA AUUGUGUA | 12091 |
| 3532 | ACACAAUUC AGAGCGAU | 2678 | AUCGCUCU CUGAUGAGGCCGUUAGGCCGAA AAUUGUGU | 12092 |
| 3548 | UGUGUGGUC UUUCGGUG | 2679 | CACCGAAA CUGAUGAGGCCGUUAGGCCGAA ACCACACA | 12093 |
| 3550 | UGUGGUCUU UCGGUGUG | 2680 | CACACCGA CUGAUGAGGCCGUUAGGCCGAA AGACCACA | 12094 |
| 3551 | GUGGUCUUU CGGUGUGU | 2681 | ACACACCG CUGAUGAGGCCGUUAGGCCGAA AAGACCAC | 12095 |
| 3552 | UGGUCUUUC GGUGUGUU | 2682 | AACACACC CUGAUGAGGCCGUUAGGCCGAA AAAGACCA | 12096 |
| 3560 | CGGUGUGUU GCUCUGGG | 2683 | CCCAGAGC CUGAUGAGGCCGUUAGGCCGAA ACACACCG | 12097 |
| 3564 | GUGUUGCUC UGGGAAAU | 2684 | AUUUCCCA CUGAUGAGGCCGUUAGGCCGAA AGCAACAC | 12098 |
| 3573 | UGGGAAAUA UUUUCCUU | 2017 | AAGGAAAA CUGAUGAGGCCGUUAGGCCGAA AUUUCCCA | 11436 |
| 3575 | GGAAAUAUU UUCCUUAG | 2018 | CUAAGGAA CUGAUGAGGCCGUUAGGCCGAA AUAUUUCC | 11437 |
| 3576 | GAAAUAUUU UCCUUAGG | 2019 | CCUAAGGA CUGAUGAGGCCGUUAGGCCGAA AAUAUUUC | 11438 |
| 3577 | AAAUAUUUU CCUUAGGU | 2020 | ACCUAAGG CUGAUGAGGCCGUUAGGCCGAA AAAUAUUU | 11439 |
| 3578 | AAUAUUUUC CUUAGGUG | 2021 | CACCUAAG CUGAUGAGGCCGUUAGGCCGAA AAAAUAUU | 11440 |
| 3581 | AUUUUCCUU AGGUGCCU | 2685 | AGGCACCU CUGAUGAGGCCGUUAGGCCGAA AGGAAAAU | 12099 |
| 3582 | UUUUCCUUA GGUGCCUC | 2686 | GAGGCACC CUGAUGAGGCCGUUAGGCCGAA AAGGAAAA | 12100 |
| 3590 | AGGUGCCUC CCCAUACC | 2687 | GGUAUGGG CUGAUGAGGCCGUUAGGCCGAA AGGCACCU | 12101 |
| 3596 | CUCCCCAUA CCCUGGGG | 2688 | CCCCAGGG CUGAUGAGGCCGUUAGGCCGAA AUGGGGAG | 12102 |
| 3606 | CCUGGGGUC AAGAUUGA | 2689 | UCAAUCUU CUGAUGAGGCCGUUAGGCCGAA ACCCCAGG | 11448 |
| 3612 | GUCAAGAUU GAUGAAGA | 2690 | UCUUCAUC CUGAUGAGGCCGUUAGGCCGAA AUCUUGAC | 12103 |
| 3623 | UGAAGAAUU UUGUAGGA | 2691 | UCCUACAA CUGAUGAGGCCGUUAGGCCGAA AUUCUUCA | 12104 |
| 3624 | GAAGAAUUU UGUAGGAG | 2692 | CUCCUACA CUGAUGAGGCCGUUAGGCCGAA AAUUCUUC | 12105 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 3625 | AAGAAUUUU GUAGGAGA | 2693 | UCUCCUAC CUGAUGAGGCCGUUAGGCCGAA AAAUUCUU | 12106 |
| 3628 | AAUUUUGUA GGAGAUUG | 2694 | CAAUCUCC CUGAUGAGGCCGUUAGGCCGAA ACAAAAUU | 12107 |
| 3635 | UAGGAGAUU GAAAGAAG | 2695 | CUUCUUUC CUGAUGAGGCCGUUAGGCCGAA AUCUCCUA | 12108 |
| 3649 | AAGGAACUA GAAUGCGG | 2696 | CCGCAUUC CUGAUGAGGCCGUUAGGCCGAA AGUUCCUU | 12109 |
| 3661 | UGCGGGCUC CUGACUAC | 2697 | GUAGUCAG CUGAUGAGGCCGUUAGGCCGAA AGCCCGCA | 12110 |
| 3668 | UCCGACUA CACUACCC | 2698 | GGGUAGUG CUGAUGAGGCCGUUAGGCCGAA AGUCAGGA | 12111 |
| 3673 | ACUACACUA CCCCAGAA | 2699 | UUCGGGG CUGAUGAGGCCGUUAGGCCGAA AGUGUAGU | 12112 |
| 3686 | AGAAAUGUA CCAGACCA | 2041 | UGGUCUGG CUGAUGAGGCCGUUAGGCCGAA ACAUUUCU | 11460 |
| 3734 | GAGACCCUC GUUUUCAG | 2700 | CUGAAAAC CUGAUGAGGCCGUUAGGCCGAA AGGGUCUC | 12113 |
| 3737 | ACCCUCGUU UUCAGAGU | 2701 | ACUCUGAA CUGAUGAGGCCGUUAGGCCGAA ACGAGGGU | 12114 |
| 3738 | CCCUCGUUU UCAGAGUU | 2702 | AACUCUGA CUGAUGAGGCCGUUAGGCCGAA AACGAGGG | 12115 |
| 3739 | CCUCGUUUU CAGAGUUG | 2703 | CAACUCUG CUGAUGAGGCCGUUAGGCCGAA AAACGAGG | 12116 |
| 3740 | CUCGUUUUC AGAGUUGG | 2704 | CCAACUCU CUGAUGAGGCCGUUAGGCCGAA AAAACGAG | 12117 |
| 3746 | UUCAGAGUU GGUGGAGC | 2705 | GCUCCACC CUGAUGAGGCCGUUAGGCCGAA ACUCUGAA | 12118 |
| 3757 | UGGAGCAUU UGGGAAAC | 2706 | GUUUCCCA CUGAUGAGGCCGUUAGGCCGAA AUGCUCCA | 12119 |
| 3758 | GGAGCAUUU GGGAAACC | 2707 | GGUUUCCC CUGAUGAGGCCGUUAGGCCGAA AAUGCUCC | 12120 |
| 3768 | GGAAACCUC CUGCAAGC | 2708 | GCUUGCAG CUGAUGAGGCCGUUAGGCCGAA AGGUUUCC | 12121 |
| 3803 | CAAAGACUA UAUUGUUC | 2709 | GAACAAUA CUGAUGAGGCCGUUAGGCCGAA AGUCUUUG | 12122 |
| 3805 | AAGACUAUA UUGUUCUU | 2710 | AAGAACAA CUGAUGAGGCCGUUAGGCCGAA AUAGUCUU | 12123 |
| 3807 | GACUAUAUU GUUCUUCC | 2711 | GGAAGAAC CUGAUGAGGCCGUUAGGCCGAA AUAUAGUC | 12124 |
| 3810 | UAUAUUGUU CUUCCAAU | 2712 | AUUGGAAG CUGAUGAGGCCGUUAGGCCGAA ACAAUAUA | 12125 |
| 3811 | AUAUUGUUC UUCCAAUG | 2713 | CAUUGGAA CUGAUGAGGCCGUUAGGCCGAA AACAAUAU | 12126 |
| 3813 | AUUGUUCUU CCAAUGUC | 2714 | GACAUUGG CUGAUGAGGCCGUUAGGCCGAA AGAACAAU | 12127 |
| 3814 | UUGUUCUUC CAAUGUCA | 2715 | UGACAUUG CUGAUGAGGCCGUUAGGCCGAA AGAACAA | 12128 |
| 3821 | UCCAAUGUC AGAGACAC | 2716 | GUGUCUCU CUGAUGAGGCCGUUAGGCCGAA ACAUUGGA | 12129 |
| 3847 | AAGAGGAUU CUGGACUC | 2065 | GAGUCCAG CUGAUGAGGCCGUUAGGCCGAA AUCCUCUU | 11484 |
| 3848 | AGAGGAUUC UGGACUCU | 2066 | AGAGUCCA CUGAUGAGGCCGUUAGGCCGAA AAUCCUCU | 11485 |
| 3855 | UCUGGACUC UCCCUGCC | 2717 | GGCAGGGA CUGAUGAGGCCGUUAGGCCGAA AGUCCAGA | 12130 |
| 3857 | UGGACUCUC CCUGCCUA | 2718 | UAGGCAGG CUGAUGAGGCCGUUAGGCCGAA AGAGUCCA | 12131 |
| 3865 | CCCUGCCUA CCUCACCU | 2719 | AGGUGAGG CUGAUGAGGCCGUUAGGCCGAA AGGCAGGG | 12132 |
| 3869 | GCCUACCUC ACCUGUUU | 2071 | AAACAGGU CUGAUGAGGCCGUUAGGCCGAA AGGUAGGC | 11490 |
| 3876 | UCACCUGUU UCCUGUAU | 2072 | AUACAGGA CUGAUGAGGCCGUUAGGCCGAA ACAGGUGA | 11491 |
| 3877 | CACCUGUUU CCUGUAUG | 2073 | CAUACAGG CUGAUGAGGCCGUUAGGCCGAA AACAGGUG | 11492 |
| 3878 | ACCUGUUUC CUGUAUGG | 2074 | CCAUACAG CUGAUGAGGCCGUUAGGCCGAA AAACAGGU | 11493 |
| 3883 | UUCCUGUA UGGAGGAA | 2720 | UUCCUCCA CUGAUGAGGCCGUUAGGCCGAA ACAGGAAA | 12133 |
| 3914 | CCCCAAAUU CCAUUAUG | 2077 | CAUAAUGG CUGAUGAGGCCGUUAGGCCGAA AUUUGGGG | 11496 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 3915 | CCCAAAUUC CAUUAUGA | 2078 | UCAUAAUG CUGAUGAGGCCGUUAGGCCGAA AAUUUGGG | 11497 |
| 3919 | AAUUCCAUU AUGACAAC | 2079 | GUUGUCAU CUGAUGAGGCCGUUAGGCCGAA AUGGAAUU | 11498 |
| 3920 | AUUCCAUUA UGACAACA | 2080 | UGUUGUCA CUGAUGAGGCCGUUAGGCCGAA AAUGGAAU | 11499 |
| 3939 | GCAGGAAUC AGUCAUUA | 2721 | UAAUGACU CUGAUGAGGCCGUUAGGCCGAA AUUCCUGC | 12134 |
| 3943 | GAAUCAGUC AUUAUCUC | 2722 | GAGAUAAU CUGAUGAGGCCGUUAGGCCGAA ACUGACUC | 12135 |
| 3946 | UCAGUCAUU AUCUCCAG | 2723 | CUGGAGAU CUGAUGAGGCCGUUAGGCCGAA AUGACUGA | 12136 |
| 3947 | CAGUCAUUA UCUCCAGA | 2724 | UCUGGAGA CUGAUGAGGCCGUUAGGCCGAA AAUGACUG | 12137 |
| 3949 | GUCAUUAUC UCCAGAAC | 2725 | GUUCUGGA CUGAUGAGGCCGUUAGGCCGAA AUAAUGAC | 12138 |
| 3951 | CAUUAUCUC CAGAACAG | 2726 | CUGUUCUG CUGAUGAGGCCGUUAGGCCGAA AGAUAAUG | 12139 |
| 3961 | AGAACAGUA AGCGAAAG | 2085 | CUUUCGCU CUGAUGAGGCCGUUAGGCCGAA ACUGUUCU | 11504 |
| 3987 | GUGAGUGUA AAAACAUU | 2086 | AAUGUUUU CUGAUGAGGCCGUUAGGCCGAA ACACUCAC | 11505 |
| 3995 | AAAAACAUU UGAAGAUA | 2087 | UAUCUUCA CUGAUGAGGCCGUUAGGCCGAA AUGUUUUU | 11506 |
| 3996 | AAAACAUUU GAAGAUAU | 2088 | AUAUCUUC CUGAUGAGGCCGUUAGGCCGAA AAUGUUUU | 11507 |
| 4003 | UUGAAGAUA UCCCAUUG | 2727 | CAAUGGGA CUGAUGAGGCCGUUAGGCCGAA AUCUUCAA | 12140 |
| 4005 | GAAGAUAUC CCAUUGGA | 2728 | UCCAAUGG CUGAUGAGGCCGUUAGGCCGAA AUAUCUUC | 12141 |
| 4010 | UAUCCCAUU GGAGGAAC | 2729 | GUUCCUCC CUGAUGAGGCCGUUAGGCCGAA AUGGGAUA | 12142 |
| 4026 | CCAGAAGUA AAAGUGAU | 2730 | AUCACUUU CUGAUGAGGCCGUUAGGCCGAA ACUUCUGG | 12143 |
| 4035 | AAAGUGAUC CAGAUGA | 2731 | UCAUCUGG CUGAUGAGGCCGUUAGGCCGAA AUCACUUU | 12144 |
| 4068 | GGGAUGGUC CUUGCAUC | 2732 | GAUGCAAG CUGAUGAGGCCGUUAGGCCGAA ACCAUCCC | 12145 |
| 4071 | AUGGUCCUU GCAUCAGA | 2733 | UCUGAUGC CUGAUGAGGCCGUUAGGCCGAA AGGACCAU | 12146 |
| 4076 | CCUUGCAUC AGAAGAGC | 2734 | GCUCUUCU CUGAUGAGGCCGUUAGGCCGAA AUGCAAGG | 12147 |
| 4093 | UGAAAACUC UGGAAGAC | 2735 | GUCUUCCA CUGAUGAGGCCGUUAGGCCGAA AGUUUUCA | 11520 |
| 4112 | GAACAAAUU AUCUCCAU | 2736 | AUGGAGAU CUGAUGAGGCCGUUAGGCCGAA AUUUGUUC | 12148 |
| 4113 | AACAAAUUA UCUCCAUC | 2737 | GAUGGAGA CUGAUGAGGCCGUUAGGCCGAA AAUUUGUU | 12149 |
| 4115 | CAAAUUAUC UCCAUCUU | 2105 | AAGAUGGA CUGAUGAGGCCGUUAGGCCGAA AUAAUUUG | 11524 |
| 4117 | AAUUAUCUC CAUCUUUU | 2106 | AAAAGAUG CUGAUGAGGCCGUUAGGCCGAA AGAUAAUU | 11525 |
| 4121 | AUCUCCAUC UUUUGGUG | 2107 | CACCAAAA CUGAUGAGGCCGUUAGGCCGAA AUGGAGAU | 11526 |
| 4123 | CUCCAUCUU UUGGUGGA | 2108 | UCCACCAA CUGAUGAGGCCGUUAGGCCGAA AGAUGGAG | 11527 |
| 4124 | UCCAUCUUU UGGUGGAA | 2109 | UUCCACCA CUGAUGAGGCCGUUAGGCCGAA AAGAUGGA | 11528 |
| 4125 | CCAUCUUUU GGUGGAAU | 2110 | AUUCCACC CUGAUGAGGCCGUUAGGCCGAA AAAGAUGG | 11529 |
| 4144 | UGCCCAGUA AAAGCAGG | 2738 | CCUGCUUU CUGAUGAGGCCGUUAGGCCGAA ACUGGGCA | 12150 |
| 4157 | CAGGGAGUC UGUGGCCU | 2739 | AGGCCACA CUGAUGAGGCCGUUAGGCCGAA ACUCCCUG | 12151 |
| 4166 | UGUGGCCUC GGAAGGCU | 2740 | AGCCUUCC CUGAUGAGGCCGUUAGGCCGAA AGGCCACA | 12152 |
| 4175 | GGAAGGCUC CAACCAGA | 2741 | UCUGGUUG CUGAUGAGGCCGUUAGGCCGAA AGCCUUCC | 12153 |
| 4193 | CAGUGGCUA CCAGUCUG | 2742 | CAGACUGG CUGAUGAGGCCGUUAGGCCGAA AGCCACUG | 12154 |
| 4199 | CUACCAGUC UGGGUAUC | 2743 | GAUACCCA CUGAUGAGGCCGUUAGGCCGAA ACUGGUAG | 12155 |
| 4205 | GUCUGGGUA UCACUCAG | 2744 | CUGAGUGA CUGAUGAGGCCGUUAGGCCGAA ACCCAGAC | 12156 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 4207 | CUGGGUAUC ACUCAGAU | 2745 | AUCUGAGU CUGAUGAGgccguuaggcCGAA AUACCCAG | 12157 |
| 4211 | GUAUCACUC AGAUGACA | 2746 | UGUCAUCU CUGAUGAGgccguuaggcCGAA AGUGAUAC | 12158 |
| 4235 | CACCGUGUA CUCCAGCG | 2747 | CGCUGGAG CUGAUGAGgccguuaggcCGAA ACACGGUG | 12159 |
| 4238 | CGUGUACUC CAGCGACG | 2748 | CGUCGCUG CUGAUGAGgccguuaggcCGAA AGUACACG | 12160 |
| 4257 | GCAGGACUU UUAAAGAU | 2749 | AUCUUUAA CUGAUGAGgccguuaggcCGAA AGUCCUGC | 12161 |
| 4258 | CAGGACUUU UAAAGAUG | 2750 | CAUCUUUA CUGAUGAGgccguuaggcCGAA AAGUCCUG | 12162 |
| 4259 | AGGACUUUU AAAGAUGG | 2751 | CCAUCUUU CUGAUGAGgccguuaggcCGAA AAAGUCCU | 12163 |
| 4260 | GGACUUUUA AAGAUGGU | 2752 | ACCAUCUG CUGAUGAGgccguuaggcCGAA AAAAGUCC | 12164 |
| 4281 | GCUGCAGUU CACGCUGA | 2753 | UCAGCGUG CUGAUGAGgccguuaggcCGAA ACUGCAGC | 12165 |
| 4282 | CUGCAGUUC ACGCUGAC | 2754 | GUCAGCGU CUGAUGAGgccguuaggcCGAA AACUGCAG | 12166 |
| 4292 | CGCUGACUC AGGGACCA | 2755 | UGGUCCCU CUGAUGAGgccguuaggcCGAA AGUCAGCG | 12167 |
| 4311 | CUGCAGCUC ACCUCCUG | 2756 | CAGGAGGU CUGAUGAGgccguuaggcCGAA AGCUGCAG | 12168 |
| 4316 | GCUCACCUC CUGUUUAA | 2757 | UUAAACAG CUGAUGAGgccguuaggcCGAA AGGUGAGC | 12169 |
| 4321 | CCUCCUGUU UAAAUGGA | 2758 | UCCAUUUA CUGAUGAGgccguuaggcCGAA ACAGGAGG | 12170 |
| 4322 | CUCCUGUUU AAAUGGAA | 2759 | UUCCAUUU CUGAUGAGgccguuaggcCGAA AACAGGAG | 12171 |
| 4323 | UCCUGUUUA AAUGGAAG | 2760 | CUUCCAUU CUGAUGAGgccguuaggcCGAA AAACAGGA | 12172 |
| 4336 | GAAGUGGUC UGUCCCG | 2761 | CGGGACAG CUGAUGAGgccguuaggcCGAA ACCACUUC | 12173 |
| 4341 | GGUCCUGUC CCGGCUCC | 2762 | GGAGCCGG CUGAUGAGgccguuaggcCGAA ACAGGACC | 12174 |
| 4348 | UCCCGGCUC CGCCCCCA | 2763 | UGGGGGCG CUGAUGAGgccguuaggcCGAA AGCCGGGA | 12175 |
| 4360 | CCCCAACUC CUGGAAAU | 2764 | AUUUCCAG CUGAUGAGgccguuaggcCGAA AGUUGGGG | 12176 |
| 4369 | CUGGAAAUC ACGAGAGA | 2765 | UCUCUCGU CUGAUGAGgccguuaggcCGAA AUUUCCAG | 12177 |
| 4387 | GUGCUGCUU AGAUUUUC | 2766 | GAAAAUCU CUGAUGAGgccguuaggcCGAA AGCAGCAC | 12178 |
| 4388 | UGCUGCUUA GAUUUUCA | 2767 | UGAAAAUC CUGAUGAGgccguuaggcCGAA AAGCAGCA | 12179 |
| 4392 | GCUUAGAUU UUCAAGUG | 2768 | CACUUGAA CUGAUGAGgccguuaggcCGAA AUCUAAGC | 12180 |
| 4393 | CUUAGAUUU UCAAGUGU | 2769 | ACACUUGA CUGAUGAGgccguuaggcCGAA AAUCUAAG | 12181 |
| 4394 | UUAGAUUUU CAAGUGUU | 2770 | AACACUUG CUGAUGAGgccguuaggcCGAA AAAUCUAA | 12182 |
| 4395 | UAGAUUUUC AAGUGUUG | 2771 | CAACACUG CUGAUGAGgccguuaggcCGAA AAAAUCUA | 12183 |
| 4402 | UCAAGUGUU GUUCUUUC | 2772 | GAAAGAAC CUGAUGAGgccguuaggcCGAA ACACUUGA | 12184 |
| 4405 | AGUGUUGUU CUUCCAC | 2146 | GUGGAAAG CUGAUGAGgccguuaggcCGAA ACAACACU | 11565 |
| 4406 | GUGUUGUUC UUUCCACC | 2147 | GGUGGAAA CUGAUGAGgccguuaggcCGAA AACAACAC | 11566 |
| 4408 | GUUGUUCUU UCCACCAC | 2773 | GUGGUGGA CUGAUGAGgccguuaggcCGAA AGAACAAC | 12185 |
| 4409 | UUGUUCUUU CCACCACC | 2774 | GGUGGUGG CUGAUGAGgccguuaggcCGAA AAGAACAA | 12186 |
| 4410 | UGUUCUUUC CACCACCC | 2775 | GGGUGGUG CUGAUGAGgccguuaggcCGAA AAAGAACA | 12187 |
| 4425 | CCGGAAGUA GCCACAUU | 2776 | AAUGUGGC CUGAUGAGgccguuaggcCGAA ACUUCCGG | 12188 |
| 4433 | AGCCACAUU UGAUUUUC | 2777 | GAAAAUCA CUGAUGAGgccguuaggcCGAA AUGGGCU | 12189 |
| 4434 | GCCACAUUU GAUUUUCA | 2778 | UGAAAAUC CUGAUGAGgccguuaggcCGAA AAUGUGGC | 12190 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 4438 | CAUUUGAUU UUCAUUUU | 2779 | AAAAUGAA CUGAUGAGGCCGUUAGGCCGAA AUCAAAUG | 12191 |
| 4439 | AUUUGAUUU UCAUUUUU | 2780 | AAAAAUGA CUGAUGAGGCCGUUAGGCCGAA AAUCAAAU | 12192 |
| 4440 | UUUGAUUUU CAUUUUUG | 2781 | CAAAAAUG CUGAUGAGGCCGUUAGGCCGAA AAAUCAAA | 12193 |
| 4441 | UUGAUUUUC AUUUUUGG | 2782 | CCAAAAAU CUGAUGAGGCCGUUAGGCCGAA AAAAUCAA | 12194 |
| 4444 | AUUUUCAUU UUUGGAGG | 2783 | CCUCCAAA CUGAUGAGGCCGUUAGGCCGAA AUGAAAAU | 12195 |
| 4445 | UUUUCAUUU UUGGAGGA | 2784 | UCCUCCAA CUGAUGAGGCCGUUAGGCCGAA AAUGAAAA | 12196 |
| 4446 | UUUCAUUUU UGGAGGAG | 2785 | CUCCUCCA CUGAUGAGGCCGUUAGGCCGAA AAAUGAAA | 12197 |
| 4447 | UUCAUUUUU GGAGGAGG | 2786 | CCUCCUCC CUGAUGAGGCCGUUAGGCCGAA AAAAUGAA | 12198 |
| 4461 | AGGGACCUC AGACUGCA | 2787 | UGCAGUCU CUGAUGAGGCCGUUAGGCCGAA AGUCCCU | 12199 |
| 4477 | AAGGAGCUU GUCCUCAG | 2788 | CUGAGGAC CUGAUGAGGCCGUUAGGCCGAA AGCUCCUU | 12200 |
| 4480 | GAGCUUGUC UCAGGGC | 2789 | GCCCUGAG CUGAUGAGGCCGUUAGGCCGAA ACAAGCUC | 12201 |
| 4483 | CUUGUCCUC AGGGCAUU | 2790 | AAUGCCCU CUGAUGAGGCCGUUAGGCCGAA AGGACAAG | 12202 |
| 4491 | CAGGGCAUU UCCAGAGA | 2791 | UCUCUGGA CUGAUGAGGCCGUUAGGCCGAA AUGCCCUG | 12203 |
| 4492 | AGGGCAUUU CCAGAGAA | 2792 | UUCUCUGG CUGAUGAGGCCGUUAGGCCGAA AAUGCCCU | 12204 |
| 4493 | GGGCAUUUC CAGAAGAAG | 2793 | CUUCUCUG CUGAUGAGGCCGUUAGGCCGAA AAAUGCCC | 12205 |
| 4525 | GAAUGUGUU GACUCUAC | 2794 | GUAGAGUC CUGAUGAGGCCGUUAGGCCGAA ACACAUUC | 12206 |
| 4530 | UGUUGACUC UACUCUCU | 2795 | AGAGAGUA CUGAUGAGGCCGUUAGGCCGAA AGUCAACA | 12207 |
| 4532 | UUGACUCUA CUCUCUUU | 2796 | AAAGAGAG CUGAUGAGGCCGUUAGGCCGAA AGAGUCAA | 12208 |
| 4535 | ACUCUACUC UCUUUUCC | 2797 | GGAAAAGA CUGAUGAGGCCGUUAGGCCGAA AGUAGAGU | 12209 |
| 4537 | UCUACUCUC UUUUCCAU | 2798 | AUGGAAAA CUGAUGAGGCCGUUAGGCCGAA AGAGUAGA | 12210 |
| 4539 | UACUCUCUU UUCCAUUC | 2799 | GAAUGGAA CUGAUGAGGCCGUUAGGCCGAA AGAGAGUA | 12211 |
| 4540 | ACUCUCUUU UCCAUUCA | 2800 | UGAAUGGA CUGAUGAGGCCGUUAGGCCGAA AAGAGAGU | 12212 |
| 4541 | CUCUCUUUU CCAUUCAU | 2801 | AUGAAUGG CUGAUGAGGCCGUUAGGCCGAA AAAGAGAG | 12213 |
| 4542 | UCUCUUUUC CAUUCAUU | 2802 | AAUGAAUG CUGAUGAGGCCGUUAGGCCGAA AAAAGAGA | 12214 |
| 4546 | UUUUCCAUU CAUUUAAA | 2803 | UUUAAAUG CUGAUGAGGCCGUUAGGCCGAA AUGGAAAA | 12215 |
| 4547 | UUUCCAUUC AUUUAAAA | 2804 | UUUUAAAU CUGAUGAGGCCGUUAGGCCGAA AAUGGAAA | 12216 |
| 4550 | CCAUUCAUU UAAAAGUC | 2805 | GACUUUUA CUGAUGAGGCCGUUAGGCCGAA AUGAAUGG | 12217 |
| 4551 | CAUUCAUUU AAAAGUCC | 2806 | GGACUUUU CUGAUGAGGCCGUUAGGCCGAA AAUGAAUG | 12218 |
| 4552 | AUUCAUUUA AAAGUCCU | 2807 | AGGACUUU CUGAUGAGGCCGUUAGGCCGAA AAAUGAAU | 12219 |
| 4558 | UUAAAAGUC UAUAUAA | 2808 | UUAUAUAG CUGAUGAGGCCGUUAGGCCGAA ACUUUUAA | 12220 |
| 4561 | AAAGUCCUA UAUAAUGU | 2809 | ACAUUAUA CUGAUGAGGCCGUUAGGCCGAA AGGACUUU | 12221 |
| 4563 | AGUCCUAUA UAAUGUGC | 2810 | GCACAUUA CUGAUGAGGCCGUUAGGCCGAA AUAGGACU | 12222 |
| 4565 | UCCUAUAUA AUGUGCCC | 2811 | GGGCACAU CUGAUGAGGCCGUUAGGCCGAA AUAUAGGA | 12223 |
| 4583 | GCUGUGGUC UCACUACC | 2812 | GGUAGUGA CUGAUGAGGCCGUUAGGCCGAA ACCACAGC | 12224 |
| 4585 | UGUGGUCUC ACUACCAG | 2813 | CUGGUAGU CUGAUGAGGCCGUUAGGCCGAA AGACCACA | 12225 |
| 4589 | GUCUCACUA CCAGUUAA | 2814 | UUAACUGG CUGAUGAGGCCGUUAGGCCGAA AGUGAGAC | 12226 |
| 4595 | CUACCAGUU AAAGCAAA | 2815 | UUUGCUUU CUGAUGAGGCCGUUAGGCCGAA ACUGGUAG | 12227 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 4596 | UACCAGUUA AAGCAAAA | 2816 | UUUUGCUU CUGAUGAGGCCGUUAGGCCGAA AACUGGUA | 12228 |
| 4609 | AAAAGACUU UCAAACAC | 2817 | GUGUUUGA CUGAUGAGGCCGUUAGGCCGAA AGUCUUUU | 12229 |
| 4610 | AAAGACUUU CAAACACG | 2818 | CGUGUUUG CUGAUGAGGCCGUUAGGCCGAA AAGUCUUU | 12230 |
| 4611 | AAGACUUUC AAACACGU | 2819 | ACGUGUUU CUGAUGAGGCCGUUAGGCCGAA AAAGUCUU | 12231 |
| 4625 | CGUGGACUC UGUCCUCC | 2820 | GGAGGACA CUGAUGAGGCCGUUAGGCCGAA AGUCCACG | 12232 |
| 4629 | GACUCUGUC CUCCAAGA | 2821 | UCUUGGAG CUGAUGAGGCCGUUAGGCCGAA ACAGAGUC | 12233 |
| 4632 | UCUGUCCUC CAAGAAGU | 2822 | ACUUCUUG CUGAUGAGGCCGUUAGGCCGAA AGGACAGA | 12234 |
| 4654 | CGGCACCUC UGUGAAAC | 2823 | GUUUCACA CUGAUGAGGCCGUUAGGCCGAA AGGUGCCG | 12235 |
| 4668 | AACUGGAUC GAAUGGGC | 2824 | GCCCAUUC CUGAUGAGGCCGUUAGGCCGAA AUCCAGUU | 12236 |
| 4683 | GCAAUGCUU UGUGUGUU | 2825 | AACACACA CUGAUGAGGCCGUUAGGCCGAA AGCAUUGC | 12237 |
| 4684 | CAAUGCUUU GUGUGUUG | 2826 | CAACACAC CUGAUGAGGCCGUUAGGCCGAA AAGCAUUG | 12238 |
| 4691 | UUGUGUGUU GAGGAUGG | 2827 | CCAUCCUC CUGAUGAGGCCGUUAGGCCGAA ACACACAA | 12239 |
| 4709 | UGAGAUGUC CCAGGGCC | 2828 | GGCCCUGG CUGAUGAGGCCGUUAGGCCGAA ACAUCUCA | 12240 |
| 4722 | GGCCGAGUC UGUCUACC | 2829 | GGUAGACA CUGAUGAGGCCGUUAGGCCGAA ACUCGGCC | 12241 |
| 4726 | GAGUCUGUC UACCUUGG | 2830 | CCAAGGUA CUGAUGAGGCCGUUAGGCCGAA ACAGACUC | 12242 |
| 4728 | GUCUGUCUA CCUUGGAG | 2831 | CUCCAAGG CUGAUGAGGCCGUUAGGCCGAA AGACAGAC | 12243 |
| 4732 | GUCUACCUU GGAGGCUU | 2832 | AAGCCUCC CUGAUGAGGCCGUUAGGCCGAA AGGUAGAC | 12244 |
| 4740 | UGGAGGCUU UGUGGAGG | 2833 | CCUCCACA CUGAUGAGGCCGUUAGGCCGAA AGCCUCCA | 12245 |
| 4741 | GGAGGCUUU GUGGAGGA | 2834 | UCCUCCAC CUGAUGAGGCCGUUAGGCCGAA AAGCCUCC | 12246 |
| 4758 | UGCGGGCUA UGAGCCAA | 2835 | UUGGCUCA CUGAUGAGGCCGUUAGGCCGAA AGCCCGCA | 12247 |
| 4771 | CCAAGUGUU AAGUGUGG | 2836 | CCACACUU CUGAUGAGGCCGUUAGGCCGAA ACACUUGG | 12248 |
| 4772 | CAAGUGUUA AGUGUGGG | 2837 | CCCACACU CUGAUGAGGCCGUUAGGCCGAA AACACUUG | 12249 |
| 4811 | GCGCAAGUC GCUCGGAG | 2838 | CUCCGAGC CUGAUGAGGCCGUUAGGCCGAA ACUUGCGC | 12250 |
| 4815 | AAGUCGCUC GGAGAGCG | 2839 | CGCUCUCC CUGAUGAGGCCGUUAGGCCGAA AGCGACUU | 12251 |
| 4826 | AGAGCGGUU GGAGCCUG | 2840 | CAGGCUCC CUGAUGAGGCCGUUAGGCCGAA ACCGCUCU | 12252 |
| 4844 | AGAUGCAUU GUGCUGGC | 2841 | GCCAGCAC CUGAUGAGGCCGUUAGGCCGAA AUGCAUCU | 12253 |
| 4854 | UGCUGGCUC UGGUGGAG | 2842 | CUCCACCA CUGAUGAGGCCGUUAGGCCGAA AGCCAGCA | 12254 |
| 4870 | GGUGGGCUU UGGGCCUG | 2843 | CAGGCCAC CUGAUGAGGCCGUUAGGCCGAA AGCCCACC | 12255 |
| 4880 | UGGCCUGUC AGGAAACG | 2844 | CGUUUCCU CUGAUGAGGCCGUUAGGCCGAA ACAGGCCA | 12256 |
| 4908 | GGCAGGGUU UGGUUUUG | 2845 | CAAAACCA CUGAUGAGGCCGUUAGGCCGAA ACCCUGCC | 12257 |
| 4909 | GCAGGGUUU GGUUUUGG | 2846 | CCAAAACC CUGAUGAGGCCGUUAGGCCGAA AACCCUGC | 12258 |
| 4913 | GGUUUGGUU UUGGAAGG | 2847 | CCUUCCAA CUGAUGAGGCCGUUAGGCCGAA ACCAAACC | 12259 |
| 4914 | GUUUGGUUU UGGAAGGU | 2848 | ACCUUCCA CUGAUGAGGCCGUUAGGCCGAA AACCAAAC | 12260 |
| 4915 | UUUGGUUUU GGAAGGUU | 2849 | AACCUUCC CUGAUGAGGCCGUUAGGCCGAA AAACCAAA | 12261 |
| 4923 | UGGAAGGUU UGCGUGCU | 2850 | AGCACGCA CUGAUGAGGCCGUUAGGCCGAA ACCUUCCA | 12262 |
| 4924 | GGAAGGUUU GCGUGCUC | 2851 | GAGCACGC CUGAUGAGGCCGUUAGGCCGAA AACCUUCC | 12263 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 4932 | UGCGUGCUC UUCACAGU | 2852 | ACUGUGAA CUGAUGAGGCCGUUAGGCCGAA AGCACGCA | 12264 |
| 4934 | CGUGCUCUU CACAGUCG | 2853 | CGACUGUG CUGAUGAGGCCGUUAGGCCGAA AGAGCACG | 12265 |
| 4935 | GUGCUCUUC ACAGUCGG | 2854 | CCGACUGU CUGAUGAGGCCGUUAGGCCGAA AAGAGCAC | 12266 |
| 4941 | UUCACAGUC GGGUUACA | 2855 | UGUAACCC CUGAUGAGGCCGUUAGGCCGAA ACUGUGAA | 12267 |
| 4946 | AGUCGGGUU ACAGGCGA | 2856 | UCGCCUGU CUGAUGAGGCCGUUAGGCCGAA ACCCGACU | 12268 |
| 4947 | GUCGGGUUA CAGGCGAG | 2857 | CUCGCCUG CUGAUGAGGCCGUUAGGCCGAA AACCCGAC | 12269 |
| 4957 | AGGCGAGUU CCCUGUGG | 2858 | CCACAGGG CUGAUGAGGCCGUUAGGCCGAA ACUCGCCU | 12270 |
| 4958 | GGCGAGUUC CCUGUGGC | 2859 | GCCACAGG CUGAUGAGGCCGUUAGGCCGAA AACUCGCC | 12271 |
| 4969 | UGGCGUUU UCCUACUC | 2860 | GAGUAGGA CUGAUGAGGCCGUUAGGCCGAA ACGCCACA | 12272 |
| 4970 | GUGGCGUUU CCUACUCC | 2861 | GGAGUAGG CUGAUGAGGCCGUUAGGCCGAA AACGCCAC | 12273 |
| 4971 | UGGCGUUUC CUACUCCU | 2862 | AGGAGUAG CUGAUGAGGCCGUUAGGCCGAA AAACGCCA | 12274 |
| 4974 | CGUUUCCUA CUCCUAAU | 2863 | AUUAGGAG CUGAUGAGGCCGUUAGGCCGAA AGGAAACG | 12275 |
| 4977 | UUCCUACUC CUAAUGAG | 2864 | CUCAUUAG CUGAUGAGGCCGUUAGGCCGAA AGUAGGAA | 12276 |
| 4980 | CUACUCCUA AUGAGAGU | 2865 | ACUCUCAU CUGAUGAGGCCGUUAGGCCGAA AGGAGUAG | 12277 |
| 4989 | AUGAGAGUU CCUUCCGG | 2866 | CCGGAAGG CUGAUGAGGCCGUUAGGCCGAA ACUCUCAU | 12278 |
| 4990 | UGAGAGUUC CUUCCGGA | 2867 | UCCGGAAG CUGAUGAGGCCGUUAGGCCGAA AACUCUCA | 12279 |
| 4993 | GAGUUCCUU CCGGACUC | 2868 | GAGUCCGG CUGAUGAGGCCGUUAGGCCGAA AGGAACUC | 12280 |
| 4994 | AGUUCCUUC CGGACUCU | 2869 | AGAGUCCG CUGAUGAGGCCGUUAGGCCGAA AAGGAACU | 12281 |
| 5001 | UCCGGACUC UUACGUGU | 2870 | ACACGUAA CUGAUGAGGCCGUUAGGCCGAA AGUCCGGA | 12282 |
| 5003 | CGGACUCUU ACGUGUCU | 2871 | AGACACGU CUGAUGAGGCCGUUAGGCCGAA AGAGUCCG | 12283 |
| 5004 | GGACUCUUA CGUGUCUC | 2872 | GAGACACG CUGAUGAGGCCGUUAGGCCGAA AAGAGUCC | 12284 |
| 5010 | UUACGUGUC UCCUGGCC | 2873 | GGCCAGGA CUGAUGAGGCCGUUAGGCCGAA ACACGUAA | 12285 |
| 5012 | ACGUGUCUC CUGGCCUG | 2874 | CAGGCCAG CUGAUGAGGCCGUUAGGCCGAA AGACACGU | 12286 |
| 5046 | AUGCAGCUU GCUCCUUC | 2875 | GAAGGAGC CUGAUGAGGCCGUUAGGCCGAA AGCUGCAU | 12287 |
| 5050 | AGCUUGCUC CUUCCUCA | 2876 | UGAGGAAG CUGAUGAGGCCGUUAGGCCGAA AGCAAGCU | 12288 |
| 5053 | UUGCUCCUU CCUCAUCU | 2877 | AGAUGAGG CUGAUGAGGCCGUUAGGCCGAA AGGAGCAA | 12289 |
| 5054 | UGCUCCUUC CUCAUCUC | 2878 | GAGAUGAG CUGAUGAGGCCGUUAGGCCGAA AAGGAGCA | 12290 |
| 5057 | UCCUUCCUC AUCUCUCA | 2879 | UGAGAGAU CUGAUGAGGCCGUUAGGCCGAA AGGAAGGA | 12291 |
| 5060 | UUCCUCAUC UCUCAGGC | 2880 | GCCUGAGA CUGAUGAGGCCGUUAGGCCGAA AUGAGGAA | 12292 |
| 5062 | CCUCAUCUC UCAGGCUG | 2881 | CAGCCUGA CUGAUGAGGCCGUUAGGCCGAA AGAUGAGG | 12293 |
| 5064 | UCAUCUCUC AGGCUGUG | 2882 | CACAGCCU CUGAUGAGGCCGUUAGGCCGAA AGAGAUGA | 12294 |
| 5076 | CUGUGCCUU AAUUCAGA | 2883 | UCUGAAUU CUGAUGAGGCCGUUAGGCCGAA AGGCACAG | 12295 |
| 5077 | UGUGCCUUA AUUCAGAA | 2884 | UUCUGAAU CUGAUGAGGCCGUUAGGCCGAA AAGGCACA | 12296 |
| 5080 | GCCUUAAUU CAGAACAC | 2885 | GUGUUCUG CUGAUGAGGCCGUUAGGCCGAA AUUAAGGC | 12297 |
| 5081 | CCUUAAUUC AGAACACC | 2886 | GGUGUUCU CUGAUGAGGCCGUUAGGCCGAA AAUUAAGG | 12298 |
| 5105 | AGGAACGUC GGCAGAGG | 2887 | CCUCUGCC CUGAUGAGGCCGUUAGGCCGAA ACGUUCCU | 12299 |
| 5116 | CAGAGGCUC UGACGGG | 2888 | CCCGUCAG CUGAUGAGGCCGUUAGGCCGAA AGCCUCUG | 12300 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 5135 | CGAAGAAUU GUGAGAAC | 2889 | GUUCUCAC CUGAUGAGGCCGUUAGGCCGAA AUUCUUCG | 12301 |
| 5156 | CAGAAACUC AGGGUUUC | 2890 | GAAACCCU CUGAUGAGGCCGUUAGGCCGAA AGUUUCUG | 12302 |
| 5162 | CUCAGGGUU UCUGCUGG | 2891 | CCAGCAGA CUGAUGAGGCCGUUAGGCCGAA ACCCUGAG | 12303 |
| 5163 | UCAGGGUUU CUGCUGGG | 2892 | CCCAGCAG CUGAUGAGGCCGUUAGGCCGAA AACCCUGA | 12304 |
| 5164 | CAGGGUUUC UGCUGGGU | 2893 | ACCCAGCA CUGAUGAGGCCGUUAGGCCGAA AAACCCUG | 12305 |
| 5203 | UGGCAGGUC UGAGGGUU | 2894 | AACCCUCA CUGAUGAGGCCGUUAGGCCGAA ACCUGCCA | 12306 |
| 5211 | CUGAGGGUU CUCUGUCA | 2895 | UGACAGAG CUGAUGAGGCCGUUAGGCCGAA ACCCUCAG | 12307 |
| 5212 | UGAGGGUUC UCUGUCAA | 2896 | UUGACAGA CUGAUGAGGCCGUUAGGCCGAA AACCCUCA | 12308 |
| 5214 | AGGGUUCUC UGUCAAGU | 2897 | ACUUGACA CUGAUGAGGCCGUUAGGCCGAA AGAACCCU | 12309 |
| 5218 | UUCUCUGUC AAGUGGCG | 2898 | CGCCACUU CUGAUGAGGCCGUUAGGCCGAA ACAGAGAA | 12310 |
| 5229 | GUGGCGGUA AAGGCUCA | 2899 | UGAGCCUU CUGAUGAGGCCGUUAGGCCGAA ACCGCCAC | 12311 |
| 5236 | UAAAGGCUC AGGCUGGU | 2900 | ACCAGCCU CUGAUGAGGCCGUUAGGCCGAA AGCCUUUA | 12312 |
| 5247 | GCUGGUGUU CUUCCUCU | 2901 | AGAGGAAG CUGAUGAGGCCGUUAGGCCGAA ACACCAGC | 12313 |
| 5248 | CUGGUGUUC UUCCUCUA | 2902 | UAGAGGAA CUGAUGAGGCCGUUAGGCCGAA AACACCAG | 12314 |
| 5250 | GGUGUUCUU CCUCUAUC | 2903 | GAUAGAGG CUGAUGAGGCCGUUAGGCCGAA AGAACACC | 12315 |
| 5251 | GUGUUCUUC CUCUAUCU | 2904 | AGAUAGAG CUGAUGAGGCCGUUAGGCCGAA AAGAACAC | 12316 |
| 5254 | UUCUUCCUC UAUCUCCA | 2905 | UGGAGAUA CUGAUGAGGCCGUUAGGCCGAA AGGAAGAA | 12317 |
| 5256 | CUUCCUCUA UCUCCACU | 2906 | AGUGGAGA CUGAUGAGGCCGUUAGGCCGAA AGAGGAAG | 12318 |
| 5258 | UCCUCUAUC UCCACUCC | 2907 | GGAGUGGA CUGAUGAGGCCGUUAGGCCGAA AUAGAGGA | 12319 |
| 5260 | CUCUAUCUC CACUCCUG | 2908 | CAGGAGUG CUGAUGAGGCCGUUAGGCCGAA AGAUAGAG | 12320 |
| 5265 | UCCCACUC CUGUCAGG | 2909 | CCUGACAG CUGAUGAGGCCGUUAGGCCGAA AGUGGAGA | 12321 |
| 5270 | ACUCCUGUC AGGCCCCC | 2910 | GGGGGCCU CUGAUGAGGCCGUUAGGCCGAA ACAGGAGU | 12322 |
| 5283 | CCCCAAGUC UCAGUAU | 2911 | AUACUGAG CUGAUGAGGCCGUUAGGCCGAA ACUUGGGG | 12323 |
| 5286 | CAAGUCCUC AGUAUUUU | 2912 | AAAAUACU CUGAUGAGGCCGUUAGGCCGAA AGGACUUG | 12324 |
| 5290 | UCCUCAGUA UUUUAGCU | 2913 | AGCUAAAA CUGAUGAGGCCGUUAGGCCGAA ACUGAGGA | 12325 |
| 5292 | CUCAGUAUU UUAGCUUU | 2914 | AAAGCUAA CUGAUGAGGCCGUUAGGCCGAA AUACUGAG | 12326 |
| 5293 | UCAGUAUUU UAGCUUUG | 2915 | CAAAGCUA CUGAUGAGGCCGUUAGGCCGAA AAUACUGA | 12327 |
| 5294 | CAGUAUUUU AGCUUUGU | 2916 | ACAAAGCU CUGAUGAGGCCGUUAGGCCGAA AAAUACUG | 12328 |
| 5295 | AGUAUUUUA GCUUUGUG | 2917 | CACAAAGC CUGAUGAGGCCGUUAGGCCGAA AAAAUACU | 12329 |
| 5299 | UUUUAGCUU UGUGGCUU | 2918 | AAGCCACA CUGAUGAGGCCGUUAGGCCGAA AGCUAAAA | 12330 |
| 5300 | UUUAGCUUU GUGGCUUC | 2919 | GAAGCCAC CUGAUGAGGCCGUUAGGCCGAA AAGCUAAA | 12331 |
| 5307 | UUGUGGCUU CCUGAUGG | 2920 | CCAUCAGG CUGAUGAGGCCGUUAGGCCGAA AGCCACAA | 12332 |
| 5308 | UGUGGCUUC CUGAUGGC | 2921 | GCCAUCAG CUGAUGAGGCCGUUAGGCCGAA AAGCCACA | 12333 |
| 5325 | AGAAAAAUC UUAAUUGG | 2922 | CCAAUUAA CUGAUGAGGCCGUUAGGCCGAA AUUUUUCU | 12334 |
| 5327 | AAAAAUCUU AAUUGGUU | 2923 | AACCAAUU CUGAUGAGGCCGUUAGGCCGAA AGAUUUUU | 12335 |
| 5328 | AAAAUCUUA AUUGGUUG | 2924 | CAACCAAU CUGAUGAGGCCGUUAGGCCGAA AAGAUUUU | 12336 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 5331 | AUCUUAAUU GGUUGGUU | 2925 | AACCAACC CUGAUGAGGCCGUUAGGCCGAA AUUAAGAU | 12337 |
| 5335 | UAAUUGGUU GGUUUGCU | 2926 | AGCAAACC CUGAUGAGGCCGUUAGGCCGAA ACCAAUUA | 12338 |
| 5339 | UGGUUGGUU UGCUCUCC | 2927 | GGAGAGCA CUGAUGAGGCCGUUAGGCCGAA ACCAACCA | 12339 |
| 5340 | GGUUGGUUU GCUCUCCA | 2928 | UGGAGAGC CUGAUGAGGCCGUUAGGCCGAA AACCAACC | 12340 |
| 5344 | GGUUUGCUC UCCAGAUA | 2929 | UAUCUGGA CUGAUGAGGCCGUUAGGCCGAA AGCAAACC | 12341 |
| 5346 | UUUGCUCUC CAGAUAAU | 2930 | AUUAUCUG CUGAUGAGGCCGUUAGGCCGAA AGAGCAAA | 12342 |
| 5352 | CUCCAGAUA AUCACUAG | 2931 | CUAGUGAU CUGAUGAGGCCGUUAGGCCGAA AUCUGGAG | 12343 |
| 5355 | CAGAUAAUC ACUAGCCA | 2932 | UGGCUAGU CUGAUGAGGCCGUUAGGCCGAA AUUAUCUG | 12344 |
| 5359 | UAAUCACUA GCCAGAUU | 2933 | AAUCUGGC CUGAUGAGGCCGUUAGGCCGAA AGUGAUUA | 12345 |
| 5367 | AGCCAGAUU UCGAAAUU | 2934 | AAUUUCGA CUGAUGAGGCCGUUAGGCCGAA AUCUGGCU | 12346 |
| 5368 | GCCAGAUUU CGAAAUUA | 2935 | UAAUUUCG CUGAUGAGGCCGUUAGGCCGAA AAUCUGGC | 12347 |
| 5369 | CCAGAUUUC GAAAUUAC | 2936 | GUAAUUUC CUGAUGAGGCCGUUAGGCCGAA AAAUCUGG | 12348 |
| 5375 | UUCGAAAUU ACUUUUUA | 2937 | UAAAAAGU CUGAUGAGGCCGUUAGGCCGAA AUUUCGAA | 12349 |
| 5376 | UCGAAAUUA CUUUUUAG | 2938 | CUAAAAAG CUGAUGAGGCCGUUAGGCCGAA AAUUUCGA | 12350 |
| 5379 | AAAUUACUU UUAGCCG | 2939 | CGGCUAAA CUGAUGAGGCCGUUAGGCCGAA AGUAAUUU | 12351 |
| 5380 | AAUUACUUU UUAGCCGA | 2940 | UCGGCUAA CUGAUGAGGCCGUUAGGCCGAA AAGUAAUU | 12352 |
| 5381 | AUUACUUUU UAGCCGAG | 2941 | CUCGGCUA CUGAUGAGGCCGUUAGGCCGAA AAAGUAAU | 12353 |
| 5382 | UUACUUUUU AGCCGAGG | 2942 | CCUCGGCU CUGAUGAGGCCGUUAGGCCGAA AAAAGUAA | 12354 |
| 5383 | UACUUUUUA GCCGAGGU | 2943 | ACCUCGGC CUGAUGAGGCCGUUAGGCCGAA AAAAAGUA | 12355 |
| 5392 | GCCGAGGUU AUGAUAAC | 2944 | GUUAUCAU CUGAUGAGGCCGUUAGGCCGAA ACCUCGGC | 12356 |
| 5393 | CCGAGGUUA UGAUAACA | 2945 | UGUUAUCA CUGAUGAGGCCGUUAGGCCGAA AACCUCGG | 12357 |
| 5398 | GUUAUGAUA ACAUCUAC | 2946 | GUAGAUGU CUGAUGAGGCCGUUAGGCCGAA AUCAUAAC | 12358 |
| 5403 | GAUAACAUC UACGUAU | 2947 | AUACAGUA CUGAUGAGGCCGUUAGGCCGAA AUGUUAUC | 12359 |
| 5405 | UAACAUCUA CUGUAUCC | 2948 | GGAUACAG CUGAUGAGGCCGUUAGGCCGAA AGAUGUUA | 12360 |
| 5410 | UCUACUGUA UCCUUUAG | 2949 | CUAAAGGA CUGAUGAGGCCGUUAGGCCGAA ACAGUAGA | 12361 |
| 5412 | UACUGUAUC CUUUAGAA | 2950 | UUCUAAAG CUGAUGAGGCCGUUAGGCCGAA AUACAGUA | 12362 |
| 5415 | UGUACCUU UAGAAUUU | 2951 | AAAUUCUA CUGAUGAGGCCGUUAGGCCGAA AGGAUACA | 12363 |
| 5416 | GUAUCCUUU AGAAUUUU | 2952 | AAAAUUCU CUGAUGAGGCCGUUAGGCCGAA AAGGAUAC | 12364 |
| 5417 | UAUCCUUUA GAAUUUUA | 2953 | UAAAAUUC CUGAUGAGGCCGUUAGGCCGAA AAAGGAUA | 12365 |
| 5422 | UUUAGAAUU UUAACCUA | 2954 | UAGGUUAA CUGAUGAGGCCGUUAGGCCGAA AUUCUAAA | 12366 |
| 5423 | UUAGAAUUU UAACCUAU | 2955 | AUAGGUUA CUGAUGAGGCCGUUAGGCCGAA AAUUCUAA | 12367 |
| 5424 | UAGAAUUUU AACCUAUA | 2956 | UAUAGGUU CUGAUGAGGCCGUUAGGCCGAA AAAUUCUA | 12368 |
| 5425 | AGAAUUUUA ACCUAUAA | 2957 | UUAUAGGU CUGAUGAGGCCGUUAGGCCGAA AAAAUUCU | 12369 |
| 5430 | UUUAACCUA UAAACUA | 2958 | UAGUUUUA CUGAUGAGGCCGUUAGGCCGAA AGGUUAAA | 12370 |
| 5432 | UAACCUAUA AAACUAUG | 2959 | CAUAGUUU CUGAUGAGGCCGUUAGGCCGAA AUAGGUUA | 12371 |
| 5438 | AUAAACUA UGUCUACU | 2960 | AGUAGACA CUGAUGAGGCCGUUAGGCCGAA AGUUUUAU | 12372 |
| 5442 | AACUAUGUC UACGGUU | 2961 | AACCAGUA CUGAUGAGGCCGUUAGGCCGAA ACAUAGUU | 12373 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 5444 | CUAUGUCUA CUGGUUUC | 2962 | GAAACCAG CUGAUGACgccguuaggcCGAA AGACAUAG | 12374 |
| 5450 | CUACUGGUU UCUGCCUG | 2963 | CAGGCAGA CUGAUGAGgccguuaggcCGAA ACCAGUAG | 12375 |
| 5451 | UACUGGUUU CUGCCUGU | 2964 | ACAGGCAG CUGAUGAGgccguuaggcCGAA AACCAGUA | 12376 |
| 5452 | ACUGGUUUC UGCCUGUG | 2965 | CACAGGCA CUGAUGAGgccguuaggcCGAA AAACCAGU | 12377 |

Where "X" represents stem II region of a HH ribozyme (Hertel et al., 1992 Nucleic Acids Res. 20 3252).
The length of stem II may be 2 base-pairs.
Underlined region can be any X sequence or linker, as described herein.

TABLE VII

Mouse flk-1 VEGF Receptor-Hairpin Ribozyme and Substrate Sequences

| Pos | Substrate | Seq ID No | HP Ribozyme Sequences | Seq ID No |
|---|---|---|---|---|
| 74 | GGGCCCA GAC UGUGUCCC | 2966 | GGGACACA AGAA GGGCCC ACCAGAGAAACACACGUUGUGGUACAUUACCUGGUA | 12378 |
| 88 | UCCCGCA GCC GGGAUAAC | 2967 | GUUAUCCC AGAA GCGGGA ACCAGAGAAACACACGUUGUGGUACAUUACCUGGUA | 12379 |
| 105 | CCUGGCU GAC CCGAUUCC | 2968 | GGAAUCGG AGAA GCCAGG ACCAGAGAAACACACGUUGUGGUACAUUACCUGGUA | 12380 |
| 110 | GUGACCC GAU UCCGCGGA | 2969 | UCCGCGGA AGAA GGUCAG ACCAGAGAAACACACGUUGUGGUACAUUACCUGGUA | 12381 |
| 125 | GGACACC GCU GACAGCCG | 2970 | GGGCUGUC AGAA GUGUGC ACCAGAGAAACACACGUUGUGGUACAUUACCUGGUA | 12382 |
| 132 | GCUGACA GCC GCGGCUGG | 2971 | CCAGCCGC AGAA GUCAGC ACCAGAGAAACACACGUUGUGGUACAUUACCUGGUA | 12383 |
| 138 | AGCCGCG GCU GGAGCCAG | 2972 | CUGGCUCC AGAA GCGGCU ACCAGAGAAACACACGUUGUGGUACAUUACCUGGUA | 12384 |
| 175 | CUCCCCG GUC UUGCGCUG | 2973 | CAGCGCAA AGAA GGGGAG ACCAGAGAAACACACGUUGUGGUACAUUACCUGGUA | 12385 |
| 199 | CCAUACC GCC UCUGUGAC | 2974 | GUCACAGA AGAA GUAUGG ACCAGAGAAACACACGUUGUGGUACAUUACCUGGUA | 12386 |
| 309 | GCUAGCU GUC GCUCUGUG | 2975 | CACAGAGC AGAA GCUAGC ACCAGAGAAACACACGUUGUGGUACAUUACCUGGUA | 12387 |
| 342 | CCGAGCC CCC UCUGUGGG | 2976 | CCCACAGA AGAA GCUCGG ACCAGAGAAACACACGUUGUGGUACAUUACCUGGUA | 12388 |
| 434 | CCCUUCA GAU UACUUGCA | 2977 | UGCAAGUA AGAA GAAGGG ACCAGAGAAACACACGUUGUGGUACAUUACCUGGUA | 12389 |
| 630 | GUCCACU GUU UAUGUCUA | 2978 | UAGACAUA AGAA GUGGAG ACCAGAGAAACACACGUUGUGGUACAUUACCUGGUA | 12390 |
| 655 | GAUUACA GAU CACCAUUC | 2979 | GAAUGGUG AGAA GUAAUC ACCAGAGAAACACACGUUGUGGUACAUUACCUGGUA | 12391 |
| 739 | AUCCCCU GCC GAGGGUCG | 2980 | GGACCCUC AGAA GGGGAU ACCAGAGAAACACACGUUGUGGUACAUUACCUGGUA | 12392 |
| 807 | UGUUCCG GAU GGAAACAG | 2981 | CUGUUUCC AGAA GGAACA ACCAGAGAAACACACGUUGUGGUACAUUACCUGGUA | 12393 |
| 920 | GCUAUCA GUC UAUCAUGU | 2982 | ACAUGAUA AGAA GAUAGG ACCAGAGAAACACACGUUGUGGUACAUUACCUGGUA | 12394 |
| 1002 | GCUAUCU GCC GGAGAAAA | 2983 | UUUUCUCC AGAA GAUAGC ACCAGAGAAACACACGUUGUGGUACAUUACCUGGUA | 12395 |
| 1229 | GUGGACG GAU GAUCAAGA | 2984 | UCUUGAUC AGAA GUCCAC ACCAGAGAAACACACGUUGUGGUACAUUACCUGGUA | 12396 |
| 1365 | UUACCCA GCU CCUGAUAU | 2985 | AUAUCAGG AGAA GGGUAA ACCAGAGAAACACACGUUGUGGUACAUUACCUGGUA | 12397 |
| 1556 | CACCCCA GAU COGUGAGA | 2986 | UCUCACCG AGAA GGGGUG ACCAGAGAAACACACGUUGUGGUACAUUACCUGGUA | 12398 |
| 1629 | AUCCACA GUC UACGCCAA | 2987 | UUGGCGUA AGAA GUGCAU ACCAGAGAAACACACGUUGUGGUACAUUACCUGGUA | 12399 |
| 1687 | GAAGCCU GCU CCUACAGA | 2988 | UCUGUAGG AGAA GGCUUC ACCAGAGAAACACACGUUGUGGUACAUUACCUGGUA | 12400 |
| 1696 | UCCUACA GAC CCGGCCAA | 2989 | UUGGCCGG AGAA GUAGGA ACCAGAGAAACACACGUUGUGGUACAUUACCUGGUA | 12401 |
| 1795 | AUGCCCU GAU UGAAGGAA | 2990 | UUCCUUCA AGAA GGGCAU ACCAGAGAAACACACGUUGUGGUACAUUACCUGGUA | 12402 |

TABLE VII-continued

Mouse flk-1 VEGF Receptor-Hairpin Ribozyme and Substrate Sequences

| Pos | Substrate | Seq ID No | HP Ribozyme Sequences | Seq ID No |
|---|---|---|---|---|
| 1950 | GCAACCU GCU GCCCAGCC | 2991 | GGCUGGGC AGAA GGUUGC ACCAGAGAAACACACGUUGUGGUACAUUACCUGGUA | 12403 |
| 1953 | ACCUGCU GCC CAGCCAAC | 2992 | GUUGGCUG AGAA GCAGGU ACCAGAGAAACACACGUUGUGGUACAUUACCUGGUA | 12404 |
| 1985 | UGUCCCU GUU GUCCACUG | 2993 | CAGUGGAC AGAA GGGACA ACCAGAGAAACACACGUUGUGGUACAUUACCUGGUA | 12405 |
| 2055 | AACAUCG GUC CACAUGGG | 2994 | CCCAUGUG AGAA GAUGUU ACCAGAGAAACACACGUUGUGGUACAUUACCUGGUA | 12406 |
| 2082 | CACACCA GUU UGCAAGAA | 2995 | UUCUUGCA AGAA GGUGUG ACCAGAGAAACACACGUUGUGGUACAUUACCUGGUA | 11606 |
| 2208 | UUGCUCU GCU CAAGAUAA | 2996 | UUAUCUUG AGAA GAGCAA ACCAGAGAAACACACGUUGUGGUACAUUACCUGGUA | 12407 |
| 2252 | UCAAACA GCU CAUCAUCC | 2997 | GGAUGAUG AGAA GUUUGA ACCAGAGAAACACACGUUGUGGUACAUUACCUGGUA | 12408 |
| 2444 | GGAACCU GAC UAUCCGCA | 2998 | UGCGGAUA AGAA GGUUCC ACCAGAGAAACACACGUUGUGGUACAUUACCUGGUA | 12409 |
| 2639 | UCCUACG GAC CGUUAAGC | 2999 | GCUUAACG AGAA GUAGGA ACCAGAGAAACACACGUUGUGGUACAUUACCUGGUA | 12410 |
| 2703 | GGAUCCA GAU GAAUUGCC | 3000 | GGCAAUUC AGAA GGAUCC ACCAGAGAAACACACGUUGUGGUACAUUACCUGGUA | 12411 |
| 2777 | GGGACCG GCU GAAACUAG | 3001 | CUAGUUUC AGAA GGUCCC ACCAGAGAAACACACGUUGUGGUACAUUACCUGGUA | 12412 |
| 2832 | UGAGGCA GAC GCUUUUGG | 3002 | CCAAAAGC AGAA GCCUCA ACCAGAGAAACACACGUUGUGGUACAUUACCUGGUA | 12413 |
| 3199 | UCUGCCA GCU CAGGCUUU | 3003 | AAAGCCUG AGAA GGCAGA ACCAGAGAAACACACGUUGUGGUACAUUACCUGGUA | 12414 |
| 3278 | ACUUCCU GAC CUUGGAGC | 2199 | GCUCCAAG AGAA GGAAGU ACCAGAGAAACACACGUUGUGGUACAUUACCUGGUA | 11618 |
| 3304 | UGUUACA GCU UCCAAGUG | 2200 | GACUUGGA AGAA GUAACA ACCAGAGAAACACACGUUGUGGUACAUUACCUGGUA | 11619 |
| 3421 | GACUUCG GCU UGGCCCGG | 3004 | CCGGGCCA AGAA GAAGUC ACCAGAGAAACACACGUUGUGGUACAUUACCUGGUA | 12415 |
| 3450 | AGACCCG GAU UAUGUCAG | 3005 | CUGACAUA AGAA GGGUCU ACCAGAGAAACACACGUUGUGGUACAUUACCUGGUA | 12416 |
| 3475 | GAUGCCC GAC UCCCUUUG | 3006 | CAAAGGGA AGAA GGCAUC ACCAGAGAAACACACGUUGUGGUACAUUACCUGGUA | 12417 |
| 3663 | GGCUCCU GAC UACACUAC | 3007 | GUAGUGUA AGAA GGAGCC ACCAGAGAAACACACGUUGUGGUACAUUACCUGGUA | 12418 |
| 3689 | UGUACCA GAC CAUGCUGG | 2203 | CCAGCAUG AGAA GGUACA ACCAGAGAAACACACGUUGUGGUACAUUACCUGGUA | 11622 |
| 3703 | CUGGACU GCU GGCAUGAG | 3008 | CUCAUGCC AGAA GUCCAG ACCAGAGAAACACACGUUGUGGUACAUUACCUGGUA | 12419 |
| 3860 | UCUCCCU GCC UACCUCAC | 3009 | GUGAGGUA AGAA GGGAGA ACCAGAGAAACACACGUUGUGGUACAUUACCUGGUA | 12420 |
| 3873 | CUCACCU GUU UCCUGUAU | 2205 | AUACAGGA AGAA GGUGAG ACCAGAGAAACACACGUUGUGGUACAUUACCUGGUA | 11625 |
| 4038 | GAUCCCA GAU GACAGCCA | 3010 | UGGCUGUC AGAA GGGAUC ACCAGAGAAACACACGUUGUGGUACAUUACCUGGUA | 12421 |
| 4181 | CCAACCA GAC CAGUGGCU | 3011 | AGCCACUG AGAA GGUUGG ACCAGAGAAACACACGUUGUGGUACAUUACCUGGUA | 12422 |
| 4196 | GCUACCA GUC UGGGUAUC | 3012 | GAUACCCA AGAA GGUAGC ACCAGAGAAACACACGUUGUGGUACAUUACCUGGUA | 12423 |
| 4212 | UCACUCA GAU GACACAGA | 3013 | UCUGUGUC AGAA GAGUGA ACCAGAGAAACACACGUUGUGGUACAUUACCUGGUA | 11630 |
| 4278 | UGCUGCA GUC CACGCUGA | 3014 | UCAGCGUG AGAA GCAGCA ACCAGAGAAACACACGUUGUGGUACAUUACCUGGUA | 12424 |
| 4287 | UCACGCU GAC UCAGGGAC | 3015 | GUCCCUGA AGAA GCGUGA ACCAGAGAAACACACGUUGUGGUACAUUACCUGGUA | 12425 |
| 4307 | CACUGCA GCU CACCUCCU | 3015 | AGGAGGUG AGAA GCAGUG ACCAGAGAAACACACGUUGUGGUACAUUACCUGGUA | 12426 |
| 4318 | ACCUCCU GUU UAAAUGGA | 3017 | UCCAUUUA AGAA GGAGGU ACCAGAGAAACACACGUUGUGGUACAUUACCUGGUA | 12427 |
| 4338 | UGGUCCU GUC CCGGCUCC | 3018 | GGAGCCGG AGAA GGACCA ACCAGAGAAACACACGUUGUGGUACAUUACCUGGUA | 12428 |
| 4344 | UGUCCCG GCU CCGCCCCC | 3019 | GGGGGCGG AGAA GGGACA ACCAGAGAAACACACGUUGUGGUACAUUACCUGGUA | 12429 |
| 4349 | CGGCUCC GCC CCCAACUC | 3020 | GAGUUGGG AGAA GAGCCG ACCAGAGAAACACACGUUGUGGUACAUUACCUGGUA | 12430 |
| 4383 | AGGUGCU GCU UAGAUUUU | 3021 | AAAAUCUA AGAA GCACCU ACCAGAGAAACACACGUUGUGGUACAUUACCUGGUA | 12431 |
| 4462 | GACCUCA GAC UGCAAGGA | 3022 | UCCUUGCA AGAA GAGGUC ACCAGAGAAACACACGUUGUGGUACAUUACCUGGUA | 12432 |

TABLE VII-continued

Mouse flk-1 VEGF Receptor-Hairpin Ribozyme and Substrate Sequences

| Pos | Substrate | Seq ID No | HP Ribozyme Sequences | Seq ID No |
|---|---|---|---|---|
| 4574 | GUGCCCU GCU GUGGUCUC | 3023 | GAGACCAC AGAA GGGCAC ACCAGAGAAACACACGUUGUGGUACAUUACCUGGUA | 12433 |
| 4626 | GGACUCU GUC CUCCAAGA | 3024 | UCUUGGAG AGAA GAGUCC ACCAGAGAAACACACGUUGUGGUACAUUACCUGGUA | 12434 |
| 4723 | CGAGUCU GUC UACCUUGG | 3025 | CCAAGGUA AGAA GACUCG ACCAGAGAAACACACGUUGUGGUACAUUACCUGGUA | 12435 |
| 4823 | GAGAGCG GUU GGAGCCUG | 3026 | CAGGCUCC AGAA GCUCUC ACCAGAGAAACACACGUUGUGGUACAUUACCUGGUA | 12436 |
| 4836 | GCCUGCA GAU GCAUUGUG | 3027 | CACAAUGC AGAA GCAGGC ACCAGAGAAACACACGUUGUGGUACAUUACCUGGUA | 12437 |
| 4895 | AAAGGCG CCC GGCAGGGU | 3028 | ACCCUGCC AGAA CCCUUU ACCAGAGAAACACACGUUGUGGUACAUUACCUGGUA | 12438 |
| 4938 | CUUCACA GUC GGGUUACA | 3029 | UGUAACCC AGAA GUGAAG ACCAGAGAAACACACGUUGUGGUACAUUACCUGGUA | 12439 |
| 4996 | CCUUCCG GAC UCUUACGU | 3030 | ACGUAAGA AGAA GGAAGG ACCAGAGAAACACACGUUGUGGUACAUUACCUGGUA | 12440 |
| 5042 | UGAUCCA GCU UGCUCCUU | 3031 | AAGGAGCA AGAA GCAUCA ACCAGAGAAACACACGUUGUGGUACAUUACCUGGUA | 12441 |
| 5118 | GGCUCCU GAC GGGGCCGA | 3032 | UCGGCCCC AGAA GGAGCC ACCAGAGAAACACACGUUGUGGUACAUUACCUGGUA | 12442 |
| 5165 | GGUUUCU GCU GUGUGGAG | 3033 | CUCCACCC AGAA GAAACC ACCAGAGAAACACACGUUGUGGUACAUUACCUGGUA | 12443 |
| 5310 | GCUUCCU GAU GGCAGAAA | 3034 | UUUCUGCC AGAA GGAAGC ACCAGAGAAACACACGUUGUGGUACAUUACCUGGUA | 12444 |
| 5363 | CUAGCCA GAU UUCGAAAU | 3035 | AUUUCGAA AGAA GGCUAG ACCAGAGAAACACACGUUGUGGUACAUUACCUGGUA | 12445 |
| 5453 | GGUUUCU CCC UGUGUGCU | 3035 | AGCACACA AGAA GAAACC ACCAGAGAAACACACGUUGUGGUACAUUACCUGGUA | 12446 |

TABLE VIII

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 17 | GGCCGCGUC UUGCUCAC | 3037 | GUGAGCAA CUGAUGAGGCCGUUAGGCCGAA ACGCGGCC | 12447 |
| 19 | CCGCGUCUU GCUCACCA | 3038 | UGGUGAGC CUGAUGAGGCCGUUAGGCCGAA AGACGCGG | 12448 |
| 23 | GUCUUGCUC ACCAUGGU | 3039 | ACCAUGGU CUGAUGAGGCCGUUAGGCCGAA AGCAAGAC | 12449 |
| 32 | ACCAUGGUC AGCUGCUG | 3040 | CAGCAGCU CUGAUGAGGCCGUUAGGCCGAA ACCAUGGU | 12450 |
| 53 | ACCGCGGUC UUGCCUUA | 3041 | UAAGGCAA CUGAUGAGGCCGUUAGGCCGAA ACCGCGGU | 12451 |
| 55 | CGCGGUCUU GCCUUACG | 3042 | CGUAAGGC CUGAUGAGGCCGUUAGGCCGAA AGACCGCG | 12452 |
| 60 | UCUUGCCUU ACGCGCUG | 3043 | CAGCGCGU CUGAUGAGGCCGUUAGGCCGAA AGGCAAGA | 12453 |
| 61 | CUUGCCUUA CGCGCUGC | 3044 | GCAGCGCG CUGAUGAGGCCGUUAGGCCGAA AAGGCAAG | 12454 |
| 71 | GCGCUGCUC GGGUGUCU | 3045 | AGACACCC CUGAUGAGGCCGUUAGGCCGAA AGCAGCGC | 12455 |
| 78 | UCGGGUGUC UGCUUCUC | 3046 | GAGAAGCA CUGAUGAGGCCGUUAGGCCGAA ACACCCGA | 12456 |
| 83 | UGUCUGCUU CUCACAGG | 25 | CCUGUGAG CUGAUGAGGCCGUUAGGCCGAA AGCAGACA | 9444 |
| 84 | GUCUGCUUC UCACAGGA | 26 | UCCUGUGA CUGAUGAGGCCGUUAGGCCGAA AAGCAGAC | 9445 |
| 86 | CUGCUUCUC ACAGGAUA | 3047 | UAUCCUGU CUGAUGAGGCCGUUAGGCCGAA AGAAGCAG | 12457 |
| 94 | CACAGGAUA UGGCUCAG | 3048 | CUGAGCCA CUGAUGAGGCCGUUAGGCCGAA AUCCUGUG | 12458 |
| 100 | AUAUGGCUC AGGGUCGA | 3049 | UCGACCCU CUGAUGAGGCCGUUAGGCCGAA AGCCAUAU | 12459 |
| 106 | CUCAGGGUC GAAGUUAA | 3050 | UUAACUUC CUGAUGAGGCCGUUAGGCCGAA ACCCUGAG | 12460 |
| 112 | GUCGAAGUU AAAAGUGC | 3051 | GCACUUUU CUGAUGAGGCCGUUAGGCCGAA ACUUCGAC | 12461 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 113 | UCGAAGUUA AAAGUGCC | 3052 | GGCACUUU CUGAUGAGGCCGUUAGGCCGAA AACUUCGA | 12462 |
| 132 | AACUGAGUU UAAAAGGC | 37 | GCCUUUUA CUGAUGAGGCCGUUAGGCCGAA ACUCAGUU | 9456 |
| 133 | ACUGAGUUU AAAAGGCA | 38 | UGCCUUUU CUGAUGAGGCCGUUAGGCCGAA AACUCAGU | 9457 |
| 134 | CUGAGUUUA AAGGCAC | 39 | GUGCCUUU CUGAUGAGGCCGUUAGGCCGAA AAACUCAG | 9458 |
| 152 | CAGCAUGUC AUGCAAGC | 3053 | GCUUGCAU CUGAUGAGGCCGUUAGGCCGAA ACAUGCUG | 12463 |
| 171 | GCCAGACUC UCUUUCUC | 3054 | GAGAAAGA CUGAUGAGGCCGUUAGGCCGAA AGUCUGGC | 12464 |
| 173 | CAGACUCUC UUUCUCAA | 3055 | UUGAGAAA CUGAUGAGGCCGUUAGGCCGAA AGAGUCUG | 12465 |
| 175 | GACUCUCUU UCUCAAGU | 3056 | ACUUGAGA CUGAUGAGGCCGUUAGGCCGAA AGAGAGUC | 12466 |
| 176 | ACUCUCUUU CUCAAGUG | 3057 | CACUUGAG CUGAUGAGGCCGUUAGGCCGAA AAGAGAGU | 12467 |
| 177 | CUCUCUUUC UCAAGUGC | 3058 | GCACUUGA CUGAUGAGGCCGUUAGGCCGAA AAAGAGAG | 12468 |
| 179 | CUCUUUCUC AAGUGCAG | 3059 | CUGCACUU CUGAUGAGGCCGUUAGGCCGAA AGAAAGAG | 12469 |
| 205 | AGCCCACUC AUGGUCUC | 3060 | GAGACCAU CUGAUGAGGCCGUUAGGCCGAA AGUGGGCU | 12470 |
| 211 | CUCAUGGUC UCUGCCCA | 3061 | UGGGCAGA CUGAUGAGGCCGUUAGGCCGAA ACCAUGAG | 12471 |
| 213 | CAUGGUCUC UGCCCACG | 3062 | CGUGGGCA CUGAUGAGGCCGUUAGGCCGAA AGACCAUG | 12472 |
| 254 | CUGAGCAUC ACUCCCCC | 3063 | GGGGGAGU CUGAUGAGGCCGUUAGGCCGAA AUGCUCAG | 12473 |
| 258 | GCAUCACUC CCCAUCG | 3064 | CGAUGGGG CUGAUGAGGCCGUUAGGCCGAA AGUGAUGC | 12474 |
| 265 | UCCCCAUC GGCCUGUG | 3065 | CACAGGCC CUGAUGAGGCCGUUAGGCCGAA AUGGGGA | 12475 |
| 282 | GGAGGGAUA ACAGGCAA | 3066 | UUGCCUGU CUGAUGAGGCCGUUAGGCCGAA AUCCCUCC | 12476 |
| 292 | CAGGCAAUU CUGCAGCA | 3067 | UGCUGCAG CUGAUGAGGCCGUUAGGCCGAA AUUGCCUG | 12477 |
| 293 | AGGCAAUUC UGCAGCAC | 3068 | GUGCUGCA CUGAUGAGGCCGUUAGGCCGAA AAUUGCCU | 12478 |
| 304 | CAGCACCUU GACCUUGG | 3069 | CCAAGGUC CUGAUGAGGCCGUUAGGCCGAA AGGUGCUG | 12479 |
| 310 | CUUGACCUU GGACACGG | 3070 | CCGUGUCC CUGAUGAGGCCGUUAGGCCGAA AGGUCAAG | 12480 |
| 341 | ACGGCCUC UACACCUG | 3071 | CAGGUGUA CUGAUGAGGCCGUUAGGCCGAA AGGCCCGU | 12481 |
| 343 | GGCCUCUA CACCUGUA | 3072 | UACAGGUG CUGAUGAGGCCGUUAGGCCGAA AGAGGCCC | 12482 |
| 351 | ACACCUGUA GAUACCUC | 3073 | GAGGUAUC CUGAUGAGGCCGUUAGGCCGAA ACAGGUGU | 12483 |
| 355 | CUGUAGAUA CCUCCCUA | 3074 | UAGGGAGG CUGAUGAGGCCGUUAGGCCGAA AUCUACAG | 12484 |
| 359 | AGAUACCUC CUACAUC | 3075 | GAUGUAGG CUGAUGAGGCCGUUAGGCCGAA AGGUAUCU | 12485 |
| 363 | ACCUCCCUA CAUCUACU | 3076 | AGUAGAUG CUGAUGAGGCCGUUAGGCCGAA AGGGAGGU | 12486 |
| 367 | CCCUACAUC UACUUCGA | 3077 | UCGAAGUA CUGAUGAGGCCGUUAGGCCGAA AUGUAGGG | 12487 |
| 369 | CUACAUCUA CUUCGAAG | 3078 | CUUCGAAG CUGAUGAGGCCGUUAGGCCGAA AGAUGUAG | 12488 |
| 372 | CAUCUACUU CGAAGAAA | 3079 | UUUCUUCG CUGAUGAGGCCGUUAGGCCGAA AGUAGAUG | 12489 |
| 373 | AUCUACUUC GAAGAAAA | 3080 | UUUUCUUC CUGAUGAGGCCGUUAGGCCGAA AAGUAGAU | 12490 |
| 394 | AGCGGAAUC UUCAAUCU | 3081 | AGAUUGAA CUGAUGAGGCCGUUAGGCCGAA AUUCCGCU | 12491 |
| 396 | CGGAAUCUU CAAUCUAC | 3082 | GUAGAUUG CUGAUGAGGCCGUUAGGCCGAA AGAUUCCG | 12492 |
| 397 | GGAAUCUUC AAUCUACA | 3083 | UGUAGAUU CUGAUGAGGCCGUUAGGCCGAA AAGAUUCC | 12493 |
| 401 | UCUUCAAUC UACAUAUU | 3084 | AAUAUGUA CUGAUGAGGCCGUUAGGCCGAA AUUGAAGA | 12494 |
| 403 | AUCAAUCUA CAUAUUUG | 3085 | CAAAUAUG CUGAUGAGGCCGUUAGGCCGAA AGAUUGAA | 12495 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 407 | AUCUACAUA UUUGUUAG | 3086 | CUAACAAA CUGAUGAGGCCGUUAGGCCGAA AUGUAGAU | 12496 |
| 409 | CUACAUAUU UGUUAGUG | 3087 | CACUAACA CUGAUGAGGCCGUUAGGCCGAA AUAUGUAG | 12497 |
| 410 | UACAUAUUU GUUAGUGA | 3088 | UCACUAAC CUGAUGAGGCCGUUAGGCCGAA AAUAUGUA | 12498 |
| 413 | AUAUUUGUU AGUGAUGC | 3089 | GCAUCACU CUGAUGAGGCCGUUAGGCCGAA ACAAAUAU | 12499 |
| 414 | UAUUUGUUA GUGAUGCA | 3090 | UGCAUCAC CUGAUGAGGCCGUUAGGCCGAA AACAAAUA | 12500 |
| 429 | CAGGGAGUC CUUUCAUA | 3091 | UAUGAAAG CUGAUGAGGCCGUUAGGCCGAA ACUCCCUG | 12501 |
| 432 | GGAGUCCUU UCAUAGAG | 3092 | CUCUAUGA CUGAUGAGGCCGUUAGGCCGAA AGGACUCC | 12502 |
| 433 | GAGUCCUUU CAUAGAGA | 3093 | UCUCUAUG CUGAUGAGGCCGUUAGGCCGAA AAGGACUC | 12503 |
| 434 | AGUCCUUUC AUAGAGAU | 3094 | AUCUCUAU CUGAUGAGGCCGUUAGGCCGAA AAAGGACU | 12504 |
| 437 | CCUUUCAUA GAGAUGCA | 3095 | UGCAUCUC CUGAUGAGGCCGUUAGGCCGAA AUGAAAGG | 12505 |
| 455 | ACUGACAUA CCCAAACU | 3096 | AGUUUGGG CUGAUGAGGCCGUUAGGCCGAA AUGUCAGU | 12506 |
| 464 | CCCAAACUU GUGCACAU | 3097 | AUGUGCAC CUGAUGAGGCCGUUAGGCCGAA AGUUUGGG | 12507 |
| 491 | AGACAGCUC AUCAUCCC | 3098 | GGGAUGAU CUGAUGAGGCCGUUAGGCCGAA AGCUGUCU | 12508 |
| 494 | CAGCUCAUC AUCCCCUG | 3099 | CAGGGGAU CUGAUGAGGCCGUUAGGCCGAA AUGAGCUG | 12509 |
| 497 | CUCAUCAUC CCCUGCCG | 3100 | CGGCAGGG CUGAUGAGGCCGUUAGGCCGAA AUGAUGAG | 12510 |
| 514 | GGUGACGUC ACCCAACG | 3101 | CGUUGGGU CUGAUGAGGCCGUUAGGCCGAA ACGUCACC | 12511 |
| 524 | CCCAACGUC ACAGUCAC | 3102 | GUGACUGU CUGAUGAGGCCGUUAGGCCGAA ACGUUGGG | 12512 |
| 530 | GUCACAGUC ACCCUAAA | 3103 | UUUAGGGU CUGAUGAGGCCGUUAGGCCGAA ACUGUGAC | 12513 |
| 536 | GUCACCCUA AAAAAGUU | 3104 | AACUUUUU CUGAUGAGGCCGUUAGGCCGAA AGGGUGAC | 12514 |
| 544 | AAAAAGUU UCCAUUUG | 3105 | CAAAUGGA CUGAUGAGGCCGUUAGGCCGAA ACUUUUUU | 12515 |
| 545 | AAAAAGUUU CCAUUUGA | 3106 | UCAAAUGG CUGAUGAGGCCGUUAGGCCGAA AACUUUUU | 12516 |
| 546 | AAAGUUUC CAUUUGAU | 3107 | AUCAAAUG CUGAUGAGGCCGUUAGGCCGAA AAACUUUU | 12517 |
| 550 | GUUUCCAUU UGAUACUC | 3108 | GAGUAUCA CUGAUGAGGCCGUUAGGCCGAA AUGGAAAC | 12518 |
| 551 | UUUCCAUUU GAUACUCU | 3109 | AGAGUAUC CUGAUGAGGCCGUUAGGCCGAA AAUGGAAA | 12519 |
| 555 | CAUUUGAUA CUCUUACC | 3110 | GGUAAGAG CUGAUGAGGCCGUUAGGCCGAA AUCAAAUG | 12520 |
| 558 | UUGAUACUC UUACCCCU | 3111 | AGGGGUAA CUGAUGAGGCCGUUAGGCCGAA AGUAUCAA | 12521 |
| 560 | GAUACUCUU ACCCUGA | 3112 | UCAGGGGU CUGAUGAGGCCGUUAGGCCGAA AGAGUAUC | 12522 |
| 561 | AUACUCUUA CCCUGAU | 3113 | AUCAGGGG CUGAUGAGGCCGUUAGGCCGAA AAGAGUAU | 12523 |
| 581 | CAAAGAAUA ACAUGGGA | 3114 | UCCCAUGU CUGAUGAGGCCGUUAGGCCGAA AUUCUUUG | 12524 |
| 594 | GGGACAGUA GGAGAGGC | 3115 | GCCUCUCC CUGAUGAGGCCGUUAGGCCGAA ACUGUCCC | 12525 |
| 604 | GAGAGGCUU UAUAAUAG | 3116 | CUAUUAUA CUGAUGAGGCCGUUAGGCCGAA AGCCUCUC | 12526 |
| 605 | AGAGGCUUU AUAAUAGC | 3117 | GCUAUUAU CUGAUGAGGCCGUUAGGCCGAA AAGCCUCU | 12527 |
| 606 | GAGGCUUUA UAAUAGCA | 3118 | UGCUAUUA CUGAUGAGGCCGUUAGGCCGAA AAAGCCUC | 12528 |
| 608 | GGCUUUAUA AUAGCAAA | 3119 | UUUGCUAU CUGAUGAGGCCGUUAGGCCGAA AUAAAGCC | 12529 |
| 611 | UUUAUAAUA GCAAAUGC | 3120 | GCAUUUGC CUGAUGAGGCCGUUAGGCCGAA AUUAUAAA | 12530 |
| 625 | UGCAACGUA CAAAGAGA | 3121 | UCUCUUUG CUGAUGAGGCCGUUAGGCCGAA ACGUUGCA | 12531 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|-----|-----------|-----------|----------------------|-----------|
| 635 | AAAGAGAUA GGACUGCU | 3122 | AGCAGUCC CUGAUGAGGCCGUUAGGCCGAA AUCUCUUU | 12532 |
| 662 | GCCACCGUC AACGGGCA | 3123 | UGCCCGUU CUGAUGAGGCCGUUAGGCCGAA ACGCUGGC | 12533 |
| 676 | GCACCUGUA CCAGACAA | 3124 | UUGUCUGG CUGAUGAGGCCGUUAGGCCGAA ACAGGUGC | 12534 |
| 688 | GACAAACUA UCUGACCC | 3125 | GGGUCAGA CUGAUGAGGCCGUUAGGCCGAA AGUUUGUC | 12535 |
| 690 | CAAACUAUC UGACCCAU | 3126 | AUGGGUCA CUGAUGAGGCCGUUAGGCCGAA AUAGUUUG | 12536 |
| 699 | UGACCCAUC GGCAGACC | 3127 | GGUCUGCC CUGAUGAGGCCGUUAGGCCGAA AUGGGUCA | 12537 |
| 711 | AGACCAAUA CAAUCCUA | 3128 | UAGGAUUG CUGAUGAGGCCGUUAGGCCGAA AUUGGUCU | 12538 |
| 716 | AAUACAAUC UAGAUGU | 3129 | ACAUCUAG CUGAUGAGGCCGUUAGGCCGAA AUUGUAUU | 12539 |
| 719 | ACAAUCCUA GAUGUCCA | 3130 | UGGACAUC CUGAUGAGGCCGUUAGGCCGAA AGGAUUGU | 12540 |
| 725 | CUAGAUGUC CAAAUACG | 3131 | CGUAUUUG CUGAUGAGGCCGUUAGGCCGAA ACAUCUAG | 12541 |
| 731 | GUCCAAAUA CGCCCGCC | 3132 | GGCGGGCG CUGAUGAGGCCGUUAGGCCGAA AUUUGGAC | 12542 |
| 758 | AGACUGCUC CACGGGCA | 3133 | UGCCCGUG CUGAUGAGGCCGUUAGGCCGAA AGCAGUCU | 12543 |
| 771 | GGCAGACUC UUGUCCUC | 3134 | GAGGACAA CUGAUGAGGCCGUUAGGCCGAA AGUCUGCC | 12544 |
| 773 | CAGACUCUU GUCCUCAA | 3135 | UUGAGGAC CUGAUGAGGCCGUUAGGCCGAA AGAGUCUG | 12545 |
| 776 | ACUCUUGUC CUCAACUG | 3136 | CAGUUGAG CUGAUGAGGCCGUUAGGCCGAA ACAAGAGU | 12546 |
| 779 | CUUGUCCUC AACUGCAC | 3137 | GUGCAGUU CUGAUGAGGCCGUUAGGCCGAA AGGACAAG | 12547 |
| 803 | ACGGAGCUC AAUACGAG | 3138 | CUCGUAUU CUGAUGAGGCCGUUAGGCCGAA AGCUCCGU | 12548 |
| 807 | AGCUCAAUA CGAGGGUG | 3139 | CACCCUCG CUGAUGAGGCCGUUAGGCCGAA AUUGAGCU | 12549 |
| 831 | GCUGGAAUU ACCCUGGU | 3140 | ACCAGGGU CUGAUGAGGCCGUUAGGCCGAA AUUCCAGC | 12550 |
| 832 | CUGGAAUUA CCCUGGUA | 3141 | UACCAGGG CUGAUGAGGCCGUUAGGCCGAA AAUUCCAG | 12551 |
| 840 | ACCCUGGUA AAGCAACU | 3142 | AGUUGCUU CUGAUGAGGCCGUUAGGCCGAA ACCAGGGU | 12552 |
| 849 | AAGCAACUA AGAGAUCA | 3143 | UGCUCUCU CUGAUGAGGCCGUUAGGCCGAA AGUUGCUU | 12553 |
| 859 | GAGAGCAUC UAUAAGGC | 3144 | GCCUUAUA CUGAUGAGGCCGUUAGGCCGAA AUGCUCUC | 12554 |
| 861 | GAGCAUCUA UAAGGCAG | 3145 | CUGCCUUA CUGAUGAGGCCGUUAGGCCGAA AGAUGCUC | 12555 |
| 863 | GCAUCUAUA AGGCAGCG | 3146 | CGCUGCCU CUGAUGAGGCCGUUAGGCCGAA AUAGAUGC | 12556 |
| 875 | CAGCGGAUU GACCGGAG | 3147 | CUCCGGUC CUGAUGAGGCCGUUAGGCCGAA AUCCGCUG | 12557 |
| 888 | GGAGCCAUU CCCACAAC | 3148 | GUUGUGGG CUGAUGAGGCCGUUAGGCCGAA AUGGCUCC | 12558 |
| 889 | GAGCCAUUC CCACAACA | 3149 | UGUUGUGG CUGAUGAGGCCGUUAGGCCGAA AAUGGCUC | 12559 |
| 904 | CAAUGUGUU CCACAGUG | 3150 | CACUGUGG CUGAUGAGGCCGUUAGGCCGAA ACACAUUG | 12560 |
| 905 | AAUGUGUUC CACAGUGU | 3151 | ACACUGUG CUGAUGAGGCCGUUAGGCCGAA AACACAUU | 12561 |
| 914 | CACAGUGUU CUUAAGAU | 3152 | AUCUUAAG CUGAUGAGGCCGUUAGGCCGAA ACACUGUG | 12562 |
| 915 | ACAGUGUUC UUAAGAUC | 3153 | GAUCUUAA CUGAUGAGGCCGUUAGGCCGAA AACACUGU | 12563 |
| 917 | AGUGUUCUU AAGAUCAA | 3154 | UUGAUCUU CUGAUGAGGCCGUUAGGCCGAA AGAACACU | 12564 |
| 918 | GUGUUCUUA AGAUCAAC | 3155 | GUUGAUCU CUGAUGAGGCCGUUAGGCCGAA AAGAACAC | 12565 |
| 923 | CUUAAGAUC AACAAUGU | 3156 | ACAUUGUU CUGAUGAGGCCGUUAGGCCGAA AUCUUAAG | 12566 |
| 953 | AAGGGCUC UACACCUG | 3157 | CAGGUGUA CUGAUGAGGCCGUUAGGCCGAA AGCCCUU | 12567 |
| 955 | GGGCUCUA CACCUGUC | 3158 | GACAGGUG CUGAUGAGGCCGUUAGGCCGAA AGAGCCCC | 12568 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 963 | ACACCUGUC GCGUGAAG | 3159 | CUUCACGC CUGAUGAGGCCGUUAGGCCGAA ACAGGUGU | 12569 |
| 979 | GAGUGGGUC CUCGUUCC | 3160 | GGAACGAG CUGAUGAGGCCGUUAGGCCGAA ACCCACUC | 12570 |
| 982 | UGGGUCCUC GUUCCAGU | 3161 | ACUGGAAC CUGAUGAGGCCGUUAGGCCGAA AGGACCCA | 12571 |
| 985 | GUCCUCGUU CCAGUCUU | 3162 | AAGACUGG CUGAUGAGGCCGUUAGGCCGAA ACGAGGAC | 12572 |
| 986 | UCCUCGUUC CAGUCUUU | 3163 | AAAGACUG CUGAUGAGGCCGUUAGGCCGAA AACGAGGA | 12573 |
| 991 | GUUCCAGUC UUUCAACA | 3164 | UGUUGAAA CUGAUGAGGCCGUUAGGCCGAA ACUGGAAC | 12574 |
| 993 | UCCAGUCUU UCAACACC | 3165 | GGUGUUGA CUGAUGAGGCCGUUAGGCCGAA AGACUGGA | 12575 |
| 994 | CCAGUCUUU CAACACCU | 3166 | AGGUGUUG CUGAUGAGGCCGUUAGGCCGAA AAGACUGG | 12576 |
| 995 | CAGUCUUUC AACACCUC | 3167 | GAGGUGUU CUGAUGAGGCCGUUAGGCCGAA AAAGACUG | 12577 |
| 1003 | CAACACCUC CGUGCAUG | 3168 | CAUGCACG CUGAUGAGGCCGUUAGGCCGAA AGGUGUUG | 12578 |
| 1015 | GCAUGUGUA UGAAAAAG | 3169 | CUUUUUCA CUGAUGAGGCCGUUAGGCCGAA ACACAUGC | 12579 |
| 1027 | AAAAGGAUU CAUCAGUG | 3170 | CACUGAUG CUGAUGAGGCCGUUAGGCCGAA AUCCUUUU | 12580 |
| 1028 | AAAGGAUUC AUCAGUGU | 3171 | ACACUGAU CUGAUGAGGCCGUUAGGCCGAA AAUCCUUU | 12581 |
| 1031 | GGAUUCAUC AGUGUGAA | 3172 | UUCACACU CUGAUGAGGCCGUUAGGCCGAA AUGAAUCC | 12582 |
| 1044 | UGAAACAUC GGAAGCAG | 3173 | CUGCUUCC CUGAUGAGGCCGUUAGGCCGAA AUGUUUCA | 12583 |
| 1084 | AAGACGGUC CUAUCGGC | 3174 | GCCGAUAG CUGAUGAGGCCGUUAGGCCGAA ACCGUCUU | 12584 |
| 1087 | ACGGUCCUA UCGGCUGU | 3175 | ACAGCCGA CUGAUGAGGCCGUUAGGCCGAA AGGACCGU | 12585 |
| 1089 | GGUCCUAUC GGCUGUCC | 3176 | GGACAGCC CUGAUGAGGCCGUUAGGCCGAA AUAGGACC | 12586 |
| 1096 | UCGGCUGUC CAUGAAAG | 3177 | CUUUCAUG CUGAUGAGGCCGUUAGGCCGAA ACAGCCGA | 12587 |
| 1114 | GAAGGCCUU CCCCUCCC | 3178 | GGGAGGGG CUGAUGAGGCCGUUAGGCCGAA AGGCCUUC | 12588 |
| 1115 | AAGGCCUUC CCCUCCCC | 3179 | GGGGAGGG CUGAUGAGGCCGUUAGGCCGAA AAGGCCUU | 12589 |
| 1120 | CUUCCCCUC CCAGAAAU | 3180 | UUUCUGGG CUGAUGAGGCCGUUAGGCCGAA AGGGGAAG | 12590 |
| 1130 | CCAGAAAUC GUAUGGUU | 3181 | AACCAUAC CUGAUGAGGCCGUUAGGCCGAA AUUUCUGG | 12591 |
| 1133 | GAAAUCGUA UGGUUAAA | 3182 | UUUAACCA CUGAUGAGGCCGUUAGGCCGAA ACGAUUUC | 12592 |
| 1138 | CGUAUGGUU AAAGAUG | 3183 | CAUCUUUU CUGAUGAGGCCGUUAGGCCGAA ACCAUACG | 12593 |
| 1139 | GUAUGGUUA AAGAUGG | 210 | CCAUCUUU CUGAUGAGGCCGUUAGGCCGAA AACCAUAC | 9629 |
| 1150 | AGAUGGCUC GCCUGCAA | 3184 | UUGCAGGC CUGAUGAGGCCGUUAGGCCGAA AGCCAUCU | 12594 |
| 1162 | UGCAACAUU GAAGUCUG | 3185 | CAGACUUC CUGAUGAGGCCGUUAGGCCGAA AUGUUGCA | 12595 |
| 1168 | AUUGAAGUC UGCUCGCU | 3186 | AGCGAGCA CUGAUGAGGCCGUUAGGCCGAA ACUUCAAU | 12596 |
| 1173 | AGUCUGCUC GCUAUUUG | 3187 | CAAAUAGC CUGAUGAGGCCGUUAGGCCGAA AGCAGACU | 12597 |
| 1177 | UGCUCGCUA UUUGGUAC | 3188 | GUACCAAA CUGAUGAGGCCGUUAGGCCGAA AGCGAGCA | 12598 |
| 1179 | CUCGCUAUU UGGUACAU | 3189 | AUGUACCA CUGAUGAGGCCGUUAGGCCGAA AUAGCGAG | 12599 |
| 1180 | UCGCUAUUU GGUACAUG | 3190 | CAUGUACC CUGAUGAGGCCGUUAGGCCGAA AAUAGCGA | 12600 |
| 1184 | UAUUUGGUA CAUGGCUA | 3191 | UAGCCAUG CUGAUGAGGCCGUUAGGCCGAA ACCAAAUA | 12601 |
| 1192 | ACAUGGCUA CUCAUUAA | 3192 | UUAAUGAG CUGAUGAGGCCGUUAGGCCGAA AGCCAUGU | 12602 |
| 1195 | UGGCUACUC AUUAAUUA | 3193 | UAAUUAAU CUGAUGAGGCCGUUAGGCCGAA AGUAGCCA | 12603 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 1198 | CUACUCAUU AAUUAUCA | 3194 | UGAUAAUU CUGAUGAGGCCGUUAGGCCGAA AUGAGUAG | 12604 |
| 1199 | UACUCAUUA AUUAUCAA | 3195 | UUGAUAAU CUGAUGAGGCCGUUAGGCCGAA AAUGAGUA | 12605 |
| 1202 | UCAUUAAUU AUCAAAGA | 3196 | UCUUUGAU CUGAUGAGGCCGUUAGGCCGAA AUUAAUGA | 12606 |
| 1203 | CAUUAAUUA UCAAAGAU | 3197 | AUCUUUGA CUGAUGAGGCCGUUAGGCCGAA AAUUAAUG | 12607 |
| 1205 | UUAAUUAUC AAAGAUGU | 3198 | ACAUCUUU CUGAUGAGGCCGUUAGGCCGAA AUAAUUAA | 12608 |
| 1237 | AGGGGACUA UACGAUCU | 3199 | AGAUCGUA CUGAUGAGGCCGUUAGGCCGAA AGUCCCCU | 12609 |
| 1239 | GGGACUAUA CGAUCUUG | 3200 | CAAGAUCG CUGAUGAGGCCGUUAGGCCGAA AUAGUCCC | 12610 |
| 1244 | UAUACGAUC UUGCUGGG | 3201 | CCCAGCAA CUGAUGAGGCCGUUAGGCCGAA AUCGUAUA | 12611 |
| 1246 | UACGAUCUU GCUGGGCA | 3202 | UGCCCAGC CUGAUGAGGCCGUUAGGCCGAA AGAUCGUA | 12612 |
| 1256 | CUGGGCAUA AAGCAGUC | 3203 | GACUGCUU CUGAUGAGGCCGUUAGGCCGAA AUGCCCAG | 12613 |
| 1264 | AAAGCAGUC AAGGCUAU | 3204 | AUAGCCUU CUGAUGAGGCCGUUAGGCCGAA ACUGCUUU | 12614 |
| 1271 | UCAAGGCUA UUUAAAAA | 3205 | UUUUUAAA CUGAUGAGGCCGUUAGGCCGAA AGCCUUGA | 12615 |
| 1273 | AAGGCUAUU UAAAACC | 3206 | GGUUUUUA CUGAUGAGGCCGUUAGGCCGAA AUAGCCUU | 12616 |
| 1274 | AGGCUAUUU AAAACCU | 3207 | AGGUUUUU CUGAUGAGGCCGUUAGGCCGAA AAUAGCCU | 12617 |
| 1275 | GGCUAUUUA AAACCUC | 3208 | GAGGUUUU CUGAUGAGGCCGUUAGGCCGAA AAAUAGCC | 12618 |
| 1283 | AAAACCUC ACUGCCAC | 237 | GUGGCAGU CUGAUGAGGCCGUUAGGCCGAA AGGUUUUU | 9656 |
| 1293 | CUGCCACUC UCAUUGUA | 3209 | UACAAUGA CUGAUGAGGCCGUUAGGCCGAA AGUGGCAG | 12619 |
| 1295 | GCCACUCUC AUUGUAAA | 3210 | UUUACAAU CUGAUGAGGCCGUUAGGCCGAA AGAGUGGC | 12620 |
| 1298 | ACUCAUU GUAAACGU | 3211 | ACGUUUAC CUGAUGAGGCCGUUAGGCCGAA AUGAGAGU | 12621 |
| 1301 | CUCAUUGUA AACGUGAA | 3212 | UUCACGUU CUGAUGAGGCCGUUAGGCCGAA ACAAUGAG | 12622 |
| 1314 | UGAAACCUC AGAUCUAC | 3213 | GUAGAUCU CUGAUGAGGCCGUUAGGCCGAA AGGUUUCA | 12623 |
| 1319 | CCUCAGAUC UACGAAAA | 3214 | UUUUCGUA CUGAUGAGGCCGUUAGGCCGAA AUCUGAGG | 12624 |
| 1321 | UCAGAUCUA CGAAAAGU | 3215 | ACUUUUCG CUGAUGAGGCCGUUAGGCCGAA AGAUCUGA | 12625 |
| 1330 | CGAAAAGUC CGUGUCCU | 3216 | AGGACACG CUGAUGAGGCCGUUAGGCCGAA ACUUUUCG | 12626 |
| 1336 | GUCCGUGUC CUCGCUUC | 3217 | GAAGCGAG CUGAUGAGGCCGUUAGGCCGAA ACACGGAC | 12627 |
| 1339 | CGUGUCCUC GCUUCCAA | 3218 | UUGGAAGC CUGAUGAGGCCGUUAGGCCGAA AGGACACG | 12628 |
| 1343 | UCCUCGCUU CCAAGCCC | 3219 | GGGCUUGG CUGAUGAGGCCGUUAGGCCGAA AGCGAGGA | 12629 |
| 1344 | CCUCGCUUC CAAGCCCA | 3220 | UGGGCUUG CUGAUGAGGCCGUUAGGCCGAA AAGCGAGG | 12630 |
| 1356 | GCCCACCUC UCUAUCCG | 3221 | CGGAUAGA CUGAUGAGGCCGUUAGGCCGAA AGGUGGGC | 12631 |
| 1358 | CCACCUCUC UAUCCGCU | 3222 | AGCGGAUA CUGAUGAGGCCGUUAGGCCGAA AGAGGUGG | 12632 |
| 1360 | ACCUCUCUA UCCGCUGG | 3223 | CCAGCGGA CUGAUGAGGCCGUUAGGCCGAA AGAGAGGU | 12633 |
| 1362 | CUCUCUAUC CGCUGGGC | 3224 | GCCCAGCG CUGAUGAGGCCGUUAGGCCGAA AUAGAGAG | 12634 |
| 1382 | AGACAAGUC UCACUUG | 3225 | CAAGUGAG CUGAUGAGGCCGUUAGGCCGAA ACUUGUCU | 12635 |
| 1385 | CAAGUCCUC ACUUGCAC | 3226 | GUGCAAGU CUGAUGAGGCCGUUAGGCCGAA AGGACUUG | 12636 |
| 1389 | UCCUCACUU GCACCGUG | 3227 | CACGGUGC CUGAUGAGGCCGUUAGGCCGAA AGUGAGGA | 12637 |
| 1399 | CACCGUGUA UGGCAUCC | 3228 | GGAUGCCA CUGAUGAGGCCGUUAGGCCGAA ACACGGUG | 12638 |
| 1406 | UAUGGCAUC CCUCGGCC | 3229 | GGCCGAGG CUGAUGAGGCCGUUAGGCCGAA AUGCCAUA | 12639 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 1410 | GCAUCCCUC GGCCAACA | 3230 | UGUUGGCC CUGAUGAGGCCGUUAGGCCGAA AGGGAUGC | 12640 |
| 1421 | CCAACAAUC ACGUGGCU | 3231 | AGCCACGU CUGAUGAGGCCGUUAGGCCGAA AUUGUUGG | 12641 |
| 1430 | ACGUGGCUC UGGCACCC | 3232 | GGGUGCCA CUGAUGAGGCCGUUAGGCCGAA AGCCACGU | 12642 |
| 1443 | ACCCCUGUC ACCACAAU | 3233 | AUUGUGGU CUGAUGAGGCCGUUAGGCCGAA ACAGGGGU | 12643 |
| 1452 | ACCACAAUC ACUCCAAA | 3234 | UUUGGAGU CUGAUGAGGCCGUUAGGCCGAA AUUGUGGU | 12644 |
| 1456 | CAAUCACUC CAAAGAAA | 3235 | UUUCUUUG CUGAUGAGGCCGUUAGGCCGAA AGUGAUUG | 12645 |
| 1468 | AGAAAGGUA UGACUUCU | 3236 | AGAAGUCA CUGAUGAGGCCGUUAGGCCGAA ACCUUUCU | 12646 |
| 1474 | GUAUGACUU CUGCACUG | 3237 | CAGUGCAG CUGAUGAGGCCGUUAGGCCGAA AGUCAUAC | 12647 |
| 1475 | UAUGACUUC UGCACUGA | 3238 | UCAGUGCA CUGAUGAGGCCGUUAGGCCGAA AAGUCAUA | 12648 |
| 1495 | UGAAGAAUC CUUUAUCC | 3239 | GGAUAAAG CUGAUGAGGCCGUUAGGCCGAA AUUCUUCA | 12649 |
| 1498 | AGAAUCCUU UAUCCUGG | 3240 | CCAGGAUA CUGAUGAGGCCGUUAGGCCGAA AGGAUUCU | 12650 |
| 1499 | GAAUCCUUU AUCCUGGA | 3241 | UCCAGGAU CUGAUGAGGCCGUUAGGCCGAA AAGGAUUC | 12651 |
| 1500 | AAUCCUUUA UCCUGGAU | 3242 | AUCCAGGA CUGAUGAGGCCGUUAGGCCGAA AAAGGAUU | 12652 |
| 1502 | UCCUUUAUC CUGGAUCC | 3243 | GGAUCCAG CUGAUGAGGCCGUUAGGCCGAA AUAAAGGA | 12653 |
| 1509 | UCCUGGAUC CCAGCAGC | 3244 | GCUGCUGG CUGAUGAGGCCGUUAGGCCGAA AUCCAGGA | 12654 |
| 1522 | CAGCAACUU AGGAAACA | 3245 | UGUUUCCU CUGAUGAGGCCGUUAGGCCGAA AGUUGCUG | 12655 |
| 1523 | AGCAACUUA GGAAACAG | 3246 | CUGUUUCC CUGAUGAGGCCGUUAGGCCGAA AAGUUGCU | 12656 |
| 1535 | AACAGAAUU GAGAGCAU | 280 | AUGCUCUC CUGAUGAGGCCGUUAGGCCGAA AUUCUGUU | 9699 |
| 1544 | GAGAGCAUC UCUCAGCG | 3247 | CGCUGAGA CUGAUGAGGCCGUUAGGCCGAA AUGCUCUC | 12657 |
| 1546 | GAGCAUCUC UCAGCGCA | 3248 | UGCGCUGA CUGAUGAGGCCGUUAGGCCGAA AGAUGCUC | 12658 |
| 1548 | GCAUCUCUC AGCGCAUG | 3249 | CAUGCGCU CUGAUGAGGCCGUUAGGCCGAA AGAGAUGC | 12659 |
| 1562 | AUGACGGUC UAUAGAAGG | 3250 | CCUUCUAU CUGAUGAGGCCGUUAGGCCGAA ACCGUCAU | 12660 |
| 1565 | ACGGUCAUA GAAGGAAC | 3251 | GUUCCUUC CUGAUGAGGCCGUUAGGCCGAA AUGACCGU | 12661 |
| 1578 | GAACAAAUA AGACGGUU | 3252 | AACCGUCU CUGAUGAGGCCGUUAGGCCGAA AUUUGUUC | 12662 |
| 1586 | AAGACGGUU AGCACAUU | 3253 | AAUGUGCU CUGAUGAGGCCGUUAGGCCGAA ACCGUCUU | 12663 |
| 1587 | AGACGGUUA GCACAUUG | 3254 | CAAUGUGC CUGAUGAGGCCGUUAGGCCGAA AACCGUCU | 12664 |
| 1594 | UAGCACAUU GGUGGUGG | 3255 | CCACCACC CUGAUGAGGCCGUUAGGCCGAA AUGUGCUA | 12665 |
| 1609 | GGCUGACUC UCAGACCC | 3256 | GGGUCUGA CUGAUGAGGCCGUUAGGCCGAA AGUCAGCC | 12666 |
| 1611 | CUGACUCUC AGACCCCU | 3257 | AGGGGUCU CUGAUGAGGCCGUUAGGCCGAA AGAGUCAG | 12667 |
| 1625 | CCUGGAAUC UACAGCUG | 3258 | CAGCUGUA CUGAUGAGGCCGUUAGGCCGAA AUUCCAGG | 12668 |
| 1627 | UGGAAUCUA CAGCUGCC | 3259 | GGCAGCUG CUGAUGAGGCCGUUAGGCCGAA AGAUUCCA | 12669 |
| 1642 | CCGGGCCUU CAAUAAAA | 3260 | UUUUAUUG CUGAUGAGGCCGUUAGGCCGAA AGGCCCGG | 12670 |
| 1643 | CGGGCCUUC AAUAAAAU | 3261 | AUUUUAUU CUGAUGAGGCCGUUAGGCCGAA AAGGCCCG | 12671 |
| 1647 | CCUUCAAUA AAAUAGGG | 3262 | CCCUAUUU CUGAUGAGGCCGUUAGGCCGAA AUUGAAGG | 12672 |
| 1652 | AAUAAAAUA GGGACUGU | 3263 | ACAGUCCC CUGAUGAGGCCGUUAGGCCGAA AUUUUAUU | 12673 |
| 1673 | AGAAACAUA AAAUUUUA | 3264 | UAAAAUUU CUGAUGAGGCCGUUAGGCCGAA AUGUUUCU | 12674 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 1678 | CAUAAAAUU UUAUGUCA | 3265 | UGACAUAA CUGAUGAGgccGUUAGGCcCGAA AUUUUAUG | 12675 |
| 1679 | AUAAAAUUU UAUGUCAC | 3266 | GUGACAUA CUGAUGAGgccGUUAGGCcCGAA AAUUUUAU | 12676 |
| 1680 | UAAAAUUUU AUGUCACA | 3267 | UGUGACAU CUGAUGAGgccGUUAGGCcCGAA AAAUUUUA | 12677 |
| 1681 | AAAAUUUUA UGUCACAG | 3268 | CUGUGACA CUGAUGAGgccGUUAGGCcCGAA AAAAUUUU | 12678 |
| 1685 | UUUUAUGUC ACAGAUGU | 3269 | ACAUCUGU CUGAUGAGgccGUUAGGCcCGAA ACAUAAAA | 12679 |
| 1705 | GAAUGGCUU UCACGUUU | 3270 | AAACGUGA CUGAUGAGgccGUUAGGCcCGAA AGCCAUUC | 12680 |
| 1706 | AAUGGCUUU CACGUUUC | 3271 | GAAACGUG CUGAUGAGgccGUUAGGCcCGAA AAGCCAUU | 12681 |
| 1707 | AUGGCUUUC ACGUUUCC | 3272 | GGAAACGU CUGAUGAGgccGUUAGGCcCGAA AAAGCCAU | 12682 |
| 1712 | UUUCACGUU UCCUUGGA | 3273 | UCCAAGGA CUGAUGAGgccGUUAGGCcCGAA ACGUGAAA | 12683 |
| 1713 | UUCACGUUU CCUUGGAA | 3274 | UUCCAAGG CUGAUGAGgccGUUAGGCcCGAA AACGUGAA | 12684 |
| 1714 | UCACGUUUC CUUGGAAA | 3275 | UUUCCAAG CUGAUGAGgccGUUAGGCcCGAA AAACGUGA | 12685 |
| 1717 | CGUUUCCUU GGAAAGA | 3276 | UCUUUUCC CUGAUGAGgccGUUAGGCcCGAA AGGAAACG | 12686 |
| 1756 | GAAACUGUC CUGUGUGG | 3277 | CCACACAG CUGAUGAGgccGUUAGGCcCGAA ACAGUUUC | 12687 |
| 1766 | UGUGUGGUC AAUAAAUU | 3278 | AAUUUAUU CUGAUGAGgccGUUAGGCcCGAA ACCACACA | 12688 |
| 1770 | UGGUCAAUA AAUUCCUG | 3279 | CAGGAAUU CUGAUGAGgccGUUAGGCcCGAA AUUGACCA | 12689 |
| 1774 | CAAUAAAUU CCUGUACA | 3280 | UGUACAGG CUGAUGAGgccGUUAGGCcCGAA AUUUAUUG | 12690 |
| 1775 | AAUAAAUUC CUGUACAG | 3281 | CUGUACAG CUGAUGAGgccGUUAGGCcCGAA AAUUUAUU | 12691 |
| 1780 | AUUCCUGUA CAGAGACA | 3282 | UGUCUCUG CUGAUGAGgccGUUAGGCcCGAA ACAGGAAU | 12692 |
| 1790 | AGAGACAUG ACCUGGAU | 3283 | AUCCAGGU CUGAUGAGgccGUUAGGCcCGAA AUGUCUCU | 12693 |
| 1791 | GAGACAUUA CCUGGAUU | 3284 | AAUCCAGG CUGAUGAGgccGUUAGGCcCGAA AAUGUCUC | 12694 |
| 1799 | ACCUGGAUU CUGCUACG | 3285 | CGUAGCAG CUGAUGAGgccGUUAGGCcCGAA AUCCAGGU | 12695 |
| 1800 | CCUGGAUUC UGCUACGG | 3286 | CCGUAGCA CUGAUGAGgccGUUAGGCcCGAA AAUCCAGG | 12696 |
| 1805 | AUUCUGCUA CGGACAGU | 3287 | ACUGUCCG CUGAUGAGgccGUUAGGCcCGAA AGCAGAAU | 12697 |
| 1814 | CGGACAGUU AACAACAG | 3288 | CUGUUGUU CUGAUGAGgccGUUAGGCcCGAA ACUGUCCG | 12698 |
| 1815 | GGACAGUUA ACAACAGA | 3289 | UCUGUUGU CUGAUGAGgccGUUAGGCcCGAA AACUGUCC | 12699 |
| 1836 | UGCACCAUA GUAUCAGC | 3290 | GCUGAUAC CUGAUGAGgccGUUAGGCcCGAA AUGGUGCA | 12700 |
| 1839 | ACCAUAGUA UCAGCAAG | 3291 | CUUGCUGA CUGAUGAGgccGUUAGGCcCGAA ACUAUGGU | 12701 |
| 1841 | CAUAGUAUC AGCAAGCA | 3292 | UGCUUGCU CUGAUGAGgccGUUAGGCcCGAA AUACUAUG | 12702 |
| 1866 | CCACCACUC AAGAUUAC | 3293 | GUAAUCUU CUGAUGAGgccGUUAGGCcCGAA AGUGGUGG | 12703 |
| 1872 | CUCAAGAUU ACUCCAUC | 3294 | GAUGGAGU CUGAUGAGgccGUUAGGCcCGAA AUCUUGAG | 12704 |
| 1873 | UCAAGAUUA CUCCAUCA | 3295 | UGAUGGAG CUGAUGAGgccGUUAGGCcCGAA AAUCUUGA | 12705 |
| 1876 | AGAUUACUC CAUCACUC | 3296 | GAGUGAUG CUGAUGAGgccGUUAGGCcCGAA AGUAAUCU | 12706 |
| 1880 | UACUCCAUC ACUCUGAA | 3297 | UUCAGAGU CUGAUGAGgccGUUAGGCcCGAA AUGGAGUA | 12707 |
| 1884 | CCAUCACUC UGAACCUU | 3298 | AAGGUUCA CUGAUGAGgccGUUAGGCcCGAA AGUGAUGG | 12708 |
| 1892 | CUGAACCUU GUCAUCAA | 3299 | UUGAUGAC CUGAUGAGgccGUUAGGCcCGAA AGGUUCAG | 12709 |
| 1895 | AACCUUGUC AUCAAGAA | 3300 | UUCUUGAU CUGAUGAGgccGUUAGGCcCGAA ACAAGGUU | 12710 |
| 1898 | CUUGUCAUC AAGAACGU | 3301 | ACGUUCUU CUGAUGAGgccGUUAGGCcCGAA AUGACAAG | 12711 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 1909 | GAACGUGUC UCUAGAAG | 3302 | CUUCUAGA CUGAUGAGGCCGUUAGGCCGAA ACACGUUC | 12712 |
| 1911 | ACGUGUCUC UAGAAGAC | 3303 | GUCUUCUA CUGAUGAGGCCGUUAGGCCGAA AGACACGU | 12713 |
| 1913 | GUGUCUCUA GAAGACUC | 3304 | GAGUCUUC CUGAUGAGGCCGUUAGGCCGAA AGAGACAC | 12714 |
| 1921 | AGAAGACUC GGGCACCU | 3305 | AGGUGCCC CUGAUGAGGCCGUUAGGCCGAA AGUCUUCU | 12715 |
| 1930 | GGGCACCUA UGCGUGCA | 3306 | UGCACGCA CUGAUGAGGCCGUUAGGCCGAA AGGUGCCC | 12716 |
| 1952 | AGGAACAUA UACACAGG | 3307 | CCUGUGUA CUGAUGAGGCCGUUAGGCCGAA AUGUUCCU | 12717 |
| 1954 | GAACAUAUA CACAGGGG | 3308 | CCCCUGUG CUGAUGAGGCCGUUAGGCCGAA AUAUGUUC | 12718 |
| 1970 | GAAGACAUC CUUCGAA | 3309 | UUCCGAAG CUGAUGAGGCCGUUAGGCCGAA AUGUCUUC | 12719 |
| 1973 | GACAUCCUU CGGAAGAC | 3310 | GUCUUCCG CUGAUGAGGCCGUUAGGCCGAA AGGAUGUC | 12720 |
| 1974 | ACAUCCUUC GGAAGACA | 3311 | UGUCUUCC CUGAUGAGGCCGUUAGGCCGAA AAGGAUGU | 12721 |
| 1988 | ACAGAAGUU CUCGUUAG | 3312 | CUAACGAG CUGAUGAGGCCGUUAGGCCGAA ACUUCUGU | 12722 |
| 1989 | CAGAAGUUC UCGUUAGA | 3313 | UCUAACGA CUGAUGAGGCCGUUAGGCCGAA AACUUCUG | 12723 |
| 1991 | GAAGUUCUC GUUAGAGA | 3314 | UCUCUAAC CUGAUGAGGCCGUUAGGCCGAA AGAACUUC | 12724 |
| 1994 | GUUCUCGUU AGAGAUUC | 3315 | GAAUCUCU CUGAUGAGGCCGUUAGGCCGAA ACGAGAAC | 12725 |
| 1995 | UUCUCGUUA GAGAUUCG | 3316 | CGAAUCUC CUGAUGAGGCCGUUAGGCCGAA AACGAGAA | 12726 |
| 2001 | UUAGAGAUU CGGAAGCG | 3317 | CGCUUCCG CUGAUGAGGCCGUUAGGCCGAA AUCUCUAA | 12727 |
| 2002 | UAGAGAUUC GGAAGCGC | 3318 | GCGCUUCC CUGAUGAGGCCGUUAGGCCGAA AAUCUCUA | 12728 |
| 2021 | CACCUGCUU CAAAACCU | 3319 | AGGUUUUG CUGAUGAGGCCGUUAGGCCGAA AGCAGGUG | 12729 |
| 2022 | ACCUGCUUC AAAACCUC | 3320 | GAGGUUUU CUGAUGAGGCCGUUAGGCCGAA AAGCAGGU | 12730 |
| 2030 | CAAAACCUC AGUGACUA | 3321 | UAGUCACU CUGAUGAGGCCGUUAGGCCGAA AGGUUUUG | 12731 |
| 2038 | CAGUGACUA CGAGGUCU | 3322 | AGACCUCG CUGAUGAGGCCGUUAGGCCGAA AGUCACUG | 12732 |
| 2045 | UACGAGGUC UCCAUCAG | 3323 | CUGAUGGA CUGAUGAGGCCGUUAGGCCGAA ACCUCGUA | 12733 |
| 2047 | CGAGGUCUC CAUCAGUG | 3324 | CACUGAUG CUGAUGAGGCCGUUAGGCCGAA AGACCUCG | 12734 |
| 2051 | GUCUCCAUC AGUGGCUC | 3325 | GAGCCACU CUGAUGAGGCCGUUAGGCCGAA AUGGAGAC | 12735 |
| 2059 | CAGUGGCUC UACGACCU | 3326 | AGGUCGUA CUGAUGAGGCCGUUAGGCCGAA AGCCACUG | 12736 |
| 2061 | GUGGCUCUA CGACCUUA | 3327 | UAAGGUCG CUGAUGAGGCCGUUAGGCCGAA AGAGCCAC | 12737 |
| 2068 | UACGACCUU AGACUGUC | 3328 | GACAGUCU CUGAUGAGGCCGUUAGGCCGAA AGGUCGUA | 12738 |
| 2069 | ACGACCUUA GACUGUCA | 3329 | UGACAGUC CUGAUGAGGCCGUUAGGCCGAA AAGGUCGU | 12739 |
| 2076 | UAGACUGUC AAGCUAGA | 3330 | UCUAGCUU CUGAUGAGGCCGUUAGGCCGAA ACAGUCUA | 12740 |
| 2082 | GUCAAGCUA GAGGUGUC | 3331 | GACACCUC CUGAUGAGGCCGUUAGGCCGAA AGCUUGAC | 12741 |
| 2090 | AGAGGUGUC CCCGCGCC | 3332 | GGCGCGGG CUGAUGAGGCCGUUAGGCCGAA ACACCUCU | 12742 |
| 2100 | CCGCGCCUC AGAUCACU | 3333 | AGUGAUCU CUGAUGAGGCCGUUAGGCCGAA AGGCGCGG | 12743 |
| 2105 | CCUCAGAUC ACUUGGUU | 378 | AACCAAGU CUGAUGAGGCCGUUAGGCCGAA AUCUGAGG | 9797 |
| 2109 | AGAUCACUU GGUUCAAA | 3334 | UUUGAACC CUGAUGAGGCCGUUAGGCCGAA AGUGAUCU | 12744 |
| 2113 | CACUUGGUU CAAAACA | 3335 | UGUUUUUG CUGAUGAGGCCGUUAGGCCGAA ACCAAGUG | 12745 |
| 2114 | ACUUGGUUC AAAACAA | 3336 | UUGUUUUU CUGAUGAGGCCGUUAGGCCGAA AACCAAGU | 9800 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 2132 | CACAAAAUA CAACAAGA | 383 | UCUUGUUG CUGAUGAGGCCGUUAGGCCGAA AUUUUGUG | 9802 |
| 2150 | CCGGGAAUU AUUUUAGG | 3337 | CCUAAAAU CUGAUGAGGCCGUUAGGCCGAA AUUCCCGG | 12746 |
| 2151 | CGGGAAUUA UUUUAGGA | 3338 | UCCUAAAA CUGAUGAGGCCGUUAGGCCGAA AAUUCCCG | 12747 |
| 2153 | GGAAUUAUU UUAGGACC | 386 | GGUCCUAA CUGAUGAGGCCGUUAGGCCGAA AUAAUUCC | 9805 |
| 2154 | GAAUUAUUU UAGGACCA | 387 | UGGUCCUA CUGAUGAGGCCGUUAGGCCGAA AAUAAUUC | 9806 |
| 2155 | AAUUAUUUU AGGACCAG | 388 | CUGGUCCU CUGAUGAGGCCGUUAGGCCGAA AAAUAAUU | 9807 |
| 2156 | AUUAUUUUA GGACCAGG | 389 | CCUGGUCC CUGAUGAGGCCGUUAGGCCGAA AAAAUAAU | 9808 |
| 2179 | CACGCUGUU UAUUGAAA | 390 | UUUCAAUA CUGAUGAGGCCGUUAGGCCGAA ACAGCGUG | 9809 |
| 2180 | ACGCUGUUU AUUGAAAG | 391 | CUUUCAAU CUGAUGAGGCCGUUAGGCCGAA AACAGCGU | 9810 |
| 2181 | CGCUGUUUA UUGAAAGA | 392 | UCUUUCAA CUGAUGAGGCCGUUAGGCCGAA AAACAGCG | 9811 |
| 2183 | CUGUUUAUU GAAAGAGU | 393 | ACUCUUUC CUGAUGAGGCCGUUAGGCCGAA AUAAACAG | 9812 |
| 2192 | GAAAGAGUC ACAGAGGA | 3339 | UCCUCUGU CUGAUGAGGCCGUUAGGCCGAA ACUCUUUC | 12748 |
| 2213 | GAGGGUGUC UAUAGGUG | 3340 | CACCUAUA CUGAUGAGGCCGUUAGGCCGAA ACACCCUC | 12749 |
| 2215 | GGGUGUCUA UAGGUGCC | 3341 | GGCACCUA CUGAUGAGGCCGUUAGGCCGAA AGACACCC | 12750 |
| 2217 | GUGUCUAUA GGUGCCGA | 3342 | UCGGCACC CUGAUGAGGCCGUUAGGCCGAA AUAGACAC | 12751 |
| 2263 | CGCAGCCUA CCUCACCG | 3343 | CGGUGAGG CUGAUGAGGCCGUUAGGCCGAA AGGCUGCG | 12752 |
| 2267 | GCCUACCUC ACCGUGCA | 3344 | UGCACGGU CUGAUGAGGCCGUUAGGCCGAA AGGUAGGC | 12753 |
| 2284 | AGGAACCUC AGACAAGU | 3345 | ACUUGUCU CUGAUGAGGCCGUUAGGCCGAA AGGUUCCU | 12754 |
| 2293 | AGACAAGUC AAACCUGG | 3346 | CCAGGUUU CUGAUGAGGCCGUUAGGCCGAA ACUUGUCU | 12755 |
| 2309 | GAGCUGAUC ACGCUCAC | 3347 | GUGAGCGU CUGAUGAGGCCGUUAGGCCGAA AUCAGCUC | 12756 |
| 2315 | AUCACGCUC ACGUGCAC | 3348 | GUGCACGU CUGAUGAGGCCGUUAGGCCGAA AGCGUGAU | 12757 |
| 2342 | GCGACCCUC UUUUGGCU | 3349 | AGCCAAAA CUGAUGAGGCCGUUAGGCCGAA AGGGUCGC | 12758 |
| 2344 | GACCCUCUU UUGGCUCC | 3350 | GGAGCCAA CUGAUGAGGCCGUUAGGCCGAA AGAGGGUC | 12759 |
| 2345 | ACCCUCUUU UGGCUCCU | 3351 | AGGAGCCA CUGAUGAGGCCGUUAGGCCGAA AAGAGGGU | 12760 |
| 2346 | CCCUCUUUU GGCUCCUU | 3352 | AAGGAGCC CUGAUGAGGCCGUUAGGCCGAA AAAGAGGG | 12761 |
| 2351 | UUUUGGCUC CUUCUAAC | 3353 | GUUAGAAG CUGAUGAGGCCGUUAGGCCGAA AGCCAAAA | 12762 |
| 2354 | UGGCUCCUU CUAACUCU | 3354 | AGAGUUAG CUGAUGAGGCCGUUAGGCCGAA AGGAGCCA | 12763 |
| 2355 | GGCUCCUUC UAACUCUC | 3355 | GAGAGUUA CUGAUGAGGCCGUUAGGCCGAA AAGGAGCC | 12764 |
| 2357 | CUCCUUCUA ACUCUCUU | 3356 | AAGAGAGU CUGAUGAGGCCGUUAGGCCGAA AGAAGGAG | 12765 |
| 2361 | UUCUAACUC UCUUCAUC | 3357 | GAUGAAGA CUGAUGAGGCCGUUAGGCCGAA AGUUAGAA | 12766 |
| 2363 | CUAACUCUC UUCAUCAG | 3358 | CUGAUGAA CUGAUGAGGCCGUUAGGCCGAA AGAGGUAG | 12767 |
| 2365 | AACUCUCUU CAUCAGAA | 3359 | UUCUGAUG CUGAUGAGGCCGUUAGGCCGAA AGAGAGUU | 12768 |
| 2366 | ACUCUCUUC AUCAGAAA | 3360 | UUUCUGAU CUGAUGAGGCCGUUAGGCCGAA AAGAGAGU | 12769 |
| 2369 | CUCUUCAUC AGAAACU | 3361 | AGUUUUCU CUGAUGAGGCCGUUAGGCCGAA AUGAAGAG | 12770 |
| 2386 | GAAGCGGUC UUCUUCCG | 3362 | CGGAAGAA CUGAUGAGGCCGUUAGGCCGAA ACCGCUUC | 12771 |
| 2388 | AGCGGUCUU CUUCCGAA | 3363 | UUCGGAAG CUGAUGAGGCCGUUAGGCCGAA AGACCGCU | 12772 |
| 2389 | GCGGUCUUC UUCCGAAG | 3364 | CUUCGGAA CUGAUGAGGCCGUUAGGCCGAA AAGACCGC | 12773 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 2391 | GGUCUUCUU CCGAAGUA | 3365 | UACUUCGG CUGAUGAGGCCGUUAGGCCGAA AGAAGACC | 12774 |
| 2392 | GUCUUCUUC CGAAGUAA | 3366 | UUACUUCG CUGAUGAGGCCGUUAGGCCGAA AAGAAGAC | 12775 |
| 2399 | UCCGAAGUA AAGACAGA | 3367 | UCUGUCUU CUGAUGAGGCCGUUAGGCCGAA ACUUCGGA | 12776 |
| 2410 | GACAGACUA CCUGUCAA | 3368 | UUGACAGG CUGAUGAGGCCGUUAGGCCGAA AGUCUGUC | 12777 |
| 2416 | CUACCUGUC AAUCAUUA | 3369 | UAAUGAUU CUGAUGAGGCCGUUAGGCCGAA ACAGGUAG | 12778 |
| 2420 | CUGUCAAUC AUUAUGGA | 3370 | UCCAUAAU CUGAUGAGGCCGUUAGGCCGAA AUUGACAG | 12779 |
| 2423 | UCAAUCAUU AUGGACCC | 3371 | GGGUCCAU CUGAUGAGGCCGUUAGGCCGAA AUGAUUGA | 12780 |
| 2424 | CAAUCAUUA UGGACCCA | 3372 | UGGGUCCA CUGAUGAGGCCGUUAGGCCGAA AAUGAUUG | 12781 |
| 2441 | GAUGAAGUU CCCCUGGA | 3373 | UCCAGGGG CUGAUGAGGCCGUUAGGCCGAA ACUUCAUC | 12782 |
| 2442 | AUGAAGUUC CCCUGGAU | 3374 | AUCCAGGG CUGAUGAGGCCGUUAGGCCGAA AACUUCAU | 12783 |
| 2473 | GCUGCCCUA UGAUGCCA | 3375 | UGGCAUCA CUGAUGAGGCCGUUAGGCCGAA AGGGCAGC | 12784 |
| 2494 | GUGGGAGUU UGCACGGG | 3376 | CCCGUGCA CUGAUGAGGCCGUUAGGCCGAA ACUCCCAC | 12785 |
| 2495 | UGGGAGUUU GCACGGGA | 3377 | UCCCGUGC CUGAUGAGGCCGUUAGGCCGAA AACUCCCA | 12786 |
| 2916 | CUGAAACUA GGCAAAUC | 3378 | GAUUUGCC CUGAUGAGGCCGUUAGGCCGAA AGUUUCAG | 12787 |
| 2524 | AGGCAAAUC GCUCGGAA | 3379 | UUCCGAGC CUGAUGAGGCCGUUAGGCCGAA AUUUGCCU | 12788 |
| 2528 | AAAUCGCUC GGAAGAGG | 3380 | CCUCUUCC CUGAUGAGGCCGUUAGGCCGAA AGCGAUUU | 12789 |
| 2541 | GAGGGCUUU UUGGGAAA | 3381 | UUUCCCAA CUGAUGAGGCCGUUAGGCCGAA AGCCCCUC | 12790 |
| 2542 | AGGGCUUUU UGGGAAAG | 3382 | CUUUCCCA CUGAUGAGGCCGUUAGGCCGAA AAGCCCCU | 12791 |
| 2543 | GGGGCUUUU GGGAAAGU | 3383 | ACUUUCCC CUGAUGAGGCCGUUAGGCCGAA AAAGCCCC | 12792 |
| 2552 | GGGAAAGUC GUUCAAGC | 3384 | GCUUGAAC CUGAUGAGGCCGUUAGGCCGAA ACUUUCCC | 12793 |
| 2555 | AAAGUCGUU CAAGCCUC | 3385 | GAGGCUUG CUGAUGAGGCCGUUAGGCCGAA ACGACUUU | 12794 |
| 2556 | AAGUCGUUC AAGCCUCU | 3386 | AGAGGCUU CUGAUGAGGCCGUUAGGCCGAA AACGACUU | 12795 |
| 2563 | UCAAGCCUC UGCAUUUG | 3387 | CAAAUGCA CUGAUGAGGCCGUUAGGCCGAA AGGCUUGA | 12796 |
| 2569 | CUCUGCAUU UGGCAUUA | 3388 | UAAUGCCA CUGAUGAGGCCGUUAGGCCGAA AUGCAGAG | 12797 |
| 2570 | UCUGCAUUU GGCAUUAA | 3389 | UUAAUGCC CUGAUGAGGCCGUUAGGCCGAA AAUGCAGA | 12798 |
| 2576 | UUUGGCAUU AAGAAAUC | 457 | GAUUUCUU CUGAUGAGGCCGUUAGGCCGAA AUGCCAAA | 9876 |
| 2577 | UUGGCAUUA AGAAAUCA | 458 | UGAUUUCU CUGAUGAGGCCGUUAGGCCGAA AAUGCCAA | 9877 |
| 2584 | UAAGAAAUC ACCCACCU | 3390 | AGGUGGGU CUGAUGAGGCCGUUAGGCCGAA AUUUCUUA | 12799 |
| 2617 | GAAGAUGUU GAAAGAGG | 3391 | CCUCUUUC CUGAUGAGGCCGUUAGGCCGAA ACAUCUUC | 12800 |
| 2644 | CAGUGAGUA CAAAGCUC | 3392 | GAGCUUUG CUGAUGAGGCCGUUAGGCCGAA ACUCACUG | 12801 |
| 2652 | ACAAAGCUC UGAUGACC | 3393 | GGUCAUCA CUGAUGAGGCCGUUAGGCCGAA AGCUUUGU | 12802 |
| 2666 | ACCGAACUC AAGAUCUU | 3394 | AAGAUCUU CUGAUGAGGCCGUUAGGCCGAA AGUUCGGU | 12803 |
| 2672 | CUCAAGAUC UUGACCCA | 3395 | UGGGUCAA CUGAUGAGGCCGUUAGGCCGAA AUCUUGAG | 12804 |
| 2674 | CAAGAUCUU GACCCACA | 3396 | UGUGGGUC CUGAUGAGGCCGUUAGGCCGAA AGAUCUUG | 12805 |
| 2684 | ACCCACAUC GGCCAUCA | 3397 | UGAUGGCC CUGAUGAGGCCGUUAGGCCGAA AUGUGGGU | 12806 |
| 2691 | UCGGCCAUC AUCUGAAU | 3398 | AUUCAGAU CUGAUGAGGCCGUUAGGCCGAA AUGGCCGA | 12807 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 2694 | GCCAUCAUC UGAAUGUG | 3399 | CACAUUCA CUGAUGAGGCCGUUAGGCCGAA AUGAUGGC | 12808 |
| 2705 | AAUGUGGUU AACCUCCU | 3400 | AGGAGGUU CUGAUGAGGCCGUUAGGCCGAA ACCACAUU | 12809 |
| 2706 | AUGUGGUUA ACCUCCUG | 3401 | CAGGAGGU CUGAUGAGGCCGUUAGGCCGAA AACCACAU | 12810 |
| 2711 | GUUAACCUC CUGGGAGC | 3402 | GCUCCCAG CUGAUGAGGCCGUUAGGCCGAA AGGUUAAC | 12811 |
| 2742 | GAGGGCCUC UGAUGGUG | 470 | CACCAUCA CUGAUGAGGCCGUUAGGCCGAA AGGCCCUC | 9889 |
| 2753 | AUGGUGAUC GUGGAAUA | 3403 | UAUUCCAC CUGAUGAGGCCGUUAGGCCGAA AUCACCAU | 12812 |
| 2761 | CGUGGAAUA CUGCAAAU | 3404 | AUUUGCAG CUGAUGAGGCCGUUAGGCCGAA AUUCCACG | 12813 |
| 2770 | CUGCAAAUA CGGAAACC | 3405 | GGUUUCCG CUGAUGAGGCCGUUAGGCCGAA AUUUGCAG | 12814 |
| 2782 | AAACCUGUC CAACUACC | 3406 | GGUAGUUG CUGAUGAGGCCGUUAGGCCGAA ACAGGUUU | 12815 |
| 2788 | GUCCAACUA CCUCAAGA | 3407 | UCUUGAGG CUGAUGAGGCCGUUAGGCCGAA AGUUGGAC | 12816 |
| 2792 | AACUACCUC AAGAGCAA | 479 | UUGCUCUU CUGAUGAGGCCGUUAGGCCGAA AGGUAGUU | 9898 |
| 2809 | ACGUGACUU AUUCUGUC | 3408 | GACAGAAU CUGAUGAGGCCGUUAGGCCGAA AGUCACGU | 12817 |
| 2810 | CGUGACUUA UUCUGUCU | 3409 | AGACAGAA CUGAUGAGGCCGUUAGGCCGAA AAGUCACG | 12818 |
| 2812 | UGACUUAUU CUGUCUCA | 3410 | UGAGACAG CUGAUGAGGCCGUUAGGCCGAA AUAAGUCA | 12819 |
| 2813 | GACUUAUUC UGUCUCAA | 3411 | UUGAGACA CUGAUGAGGCCGUUAGGCCGAA AAUAAGUC | 12820 |
| 2817 | UAUUCUGUC UCAACAAG | 3412 | CUUGUUGA CUGAUGAGGCCGUUAGGCCGAA ACAGAAUA | 12821 |
| 2819 | UUCUGUCUC AACAAGGA | 3413 | UCCUUGUU CUGAUGAGGCCGUUAGGCCGAA AGACAGAA | 12822 |
| 2836 | CGCAGCCUU GCAUAUGG | 3414 | CCAUAUGC CUGAUGAGGCCGUUAGGCCGAA AGGCUGCG | 12823 |
| 2841 | CCUUGCAUA UGGAGCUC | 3415 | GAGCUCCA CUGAUGAGGCCGUUAGGCCGAA AUGCAAGG | 12824 |
| 2849 | AUGGAGCUC AAGAAAGA | 3416 | UCUUUCUU CUGAUGAGGCCGUUAGGCCGAA AGCUCCAU | 12825 |
| 2900 | CCCCGCCUA GACAGUGU | 3417 | ACACUGUC CUGAUGAGGCCGUUAGGCCGAA AGGCGGGG | 12826 |
| 2909 | GACAGUGUC AGCAGCUC | 3418 | GAGCUGCU CUGAUGAGGCCGUUAGGCCGAA ACACUGUC | 12827 |
| 2917 | CAGCAGCUC AAGUGUCA | 3419 | UGACACUU CUGAUGAGGCCGUUAGGCCGAA AGCUGCUG | 12828 |
| 2924 | UCAAGUGUC ACCAGCUC | 3420 | GAGCUGGU CUGAUGAGGCCGUUAGGCCGAA ACACUUGA | 12829 |
| 2932 | CACCAGCUC CAGCUUCC | 3421 | GGAAGCUG CUGAUGAGGCCGUUAGGCCGAA AGCUGGUG | 12830 |
| 2938 | CUCCAGCUU CCCUGAAG | 3422 | CUUCAGGG CUGAUGAGGCCGUUAGGCCGAA AGCUGGAG | 12831 |
| 2939 | UCCAGCUUC CCUGAAGA | 3423 | UCUUCAGG CUGAUGAGGCCGUUAGGCCGAA AAGCUGGA | 12832 |
| 2982 | ACGAGGAUU ACAGUGAG | 3424 | CUCACUGU CUGAUGAGGCCGUUAGGCCGAA AUCCUCGU | 12833 |
| 2983 | CGAGGAUUA CAGUGAGA | 3425 | UCUCACUG CUGAUGAGGCCGUUAGGCCGAA AAUCCUCG | 12834 |
| 2993 | AGUGAGAUC UCCAAGCA | 3426 | UGCUUGGA CUGAUGAGGCCGUUAGGCCGAA AUCUCACU | 12835 |
| 2995 | UGAGAUCUC CAAGCAGC | 3427 | GCUGCUUG CUGAUGAGGCCGUUAGGCCGAA AGAUCUCA | 12836 |
| 3008 | CAGCCCCUC ACCAUGGA | 3428 | UCCAUGGU CUGAUGAGGCCGUUAGGCCGAA AGGGGCUG | 12837 |
| 3026 | GACCUGAUU UCCUACAG | 3429 | CUGUAGGA CUGAUGAGGCCGUUAGGCCGAA AUCAGGUC | 12838 |
| 3027 | ACCUGAUUU CCUACAGU | 3430 | ACUGUAGG CUGAUGAGGCCGUUAGGCCGAA AAUCAGGU | 12839 |
| 3028 | CCUGAUUUC CUACAGUU | 3431 | AACUGUAG CUGAUGAGGCCGUUAGGCCGAA AAAUCAGG | 12840 |
| 3031 | GAUUUCCUA CAGUUCC | 3432 | GGAAACUG CUGAUGAGGCCGUUAGGCCGAA AGGAAAUC | 12841 |
| 3036 | CCUACAGUU UCCAAGUG | 3433 | CACUUGGA CUGAUGAGGCCGUUAGGCCGAA ACUGUAGG | 12842 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 3037 | CUACAGUUU CCAAGUGG | 3434 | CCACUUGG CUGAUGAGGCCGUUAGGCCGAA AACUGUAG | 12843 |
| 3038 | UACAGUUUC CAAGUGGC | 3435 | GCCACUUG CUGAUGAGGCCGUUAGGCCGAA AAACUGUA | 9938 |
| 3061 | CAUGGAGUU UCUGUCCU | 3436 | AGGACAGA CUGAUGAGGCCGUUAGGCCGAA ACUCCAUG | 12844 |
| 3062 | AUGGAGUUU CUGUCCUC | 3437 | GAGGACAG CUGAUGAGGCCGUUAGGCCGAA AACUCCAU | 12845 |
| 3063 | UGGAGUUUC UGUCCUCC | 3438 | GGAGGACA CUGAUGAGGCCGUUAGGCCGAA AAACUCCA | 12846 |
| 3067 | GUUUCUGUC CUCCAGAA | 3439 | UUCUGGAG CUGAUGAGGCCGUUAGGCCGAA ACAGAAAC | 12847 |
| 3070 | UCUGUCCUC CAGAAAGU | 3440 | ACUUUCUG CUGAUGAGGCCGUUAGGCCGAA AGGACAGA | 12848 |
| 3083 | AAGUGCAUU CAUCGGGA | 526 | UCCCGAUG CUGAUGAGGCCGUUAGGCCGAA AUGCACUU | 9945 |
| 3084 | AGUGCAUUC AUCGGGAC | 527 | GUCCCGAU CUGAUGAGGCCGUUAGGCCGAA AAUGCACU | 9946 |
| 3087 | GCAUUCAUC GGGACCUG | 528 | CAGGUCCC CUGAUGAGGCCGUUAGGCCGAA AUGAAUGC | 9947 |
| 3110 | AGAAACAUC CUUUUAUC | 3441 | GAUAAAAG CUGAUGAGGCCGUUAGGCCGAA AUGUUUCU | 9948 |
| 3113 | AACAUCCUU UUAUCUGA | 3442 | UCAGAUAA CUGAUGAGGCCGUUAGGCCGAA AGGAUGUU | 12849 |
| 3114 | ACAUCCUUU UAUCUGAG | 3443 | CUCAGAUA CUGAUGAGGCCGUUAGGCCGAA AAGGAUGU | 12850 |
| 3115 | CAUCCUUUU AUCUGAGA | 3444 | UCUCAGAU CUGAUGAGGCCGUUAGGCCGAA AAAGGAUG | 12851 |
| 3116 | AUCCUUUUA UCUGAGAA | 3445 | UUCUCAGA CUGAUGAGGCCGUUAGGCCGAA AAAAGGAU | 12852 |
| 3118 | CCUUUUAUC UGAGAACA | 3446 | UGUUCUCA CUGAUGAGGCCGUUAGGCCGAA AUAAAAGG | 12853 |
| 3140 | GUGAAGAUU UGCGACUU | 3447 | AAGUCGCA CUGAUGAGGCCGUUAGGCCGAA AUCUUCAC | 12854 |
| 3141 | UGAAGAUUU GCGACUUU | 3448 | AAAGUCGC CUGAUGAGGCCGUUAGGCCGAA AAUCUUCA | 12855 |
| 3148 | UUGCGACUU UGGCCUGG | 3449 | CCAGGCCA CUGAUGAGGCCGUUAGGCCGAA AGUCGCAA | 12856 |
| 3149 | UGCGACUUU GGCCUGGC | 3450 | GCCAGGCC CUGAUGAGGCCGUUAGGCCGAA AAGUCGCA | 12857 |
| 3165 | CCCGGGAUA UUUAUAAG | 542 | CUUAUAAA CUGAUGAGGCCGUUAGGCCGAA AUCCCGGG | 9961 |
| 3167 | CGGGAUAUU UAUAAGAA | 543 | UUCUUAUA CUGAUGAGGCCGUUAGGCCGAA AUAUCCCG | 9962 |
| 3168 | GGGAUAUUU AUAAGAAC | 544 | GUUCUUAU CUGAUGAGGCCGUUAGGCCGAA AAUAUCCC | 9963 |
| 3169 | GGAUAUUUA UAAGAACC | 545 | GGUUCUUA CUGAUGAGGCCGUUAGGCCGAA AAAUAUCC | 9964 |
| 3171 | AUAUUUAUA AGAACCCU | 3451 | AGGGUUCU CUGAUGAGGCCGUUAGGCCGAA AUAAAUAU | 12858 |
| 3183 | ACCCUGAUU AUGUGAGG | 3452 | CCUCACAU CUGAUGAGGCCGUUAGGCCGAA AUCAGGGU | 12859 |
| 3184 | CCCUGAUUA UGUGAGGA | 3453 | UCCUCACA CUGAUGAGGCCGUUAGGCCGAA AAUCAGGG | 12860 |
| 3201 | GAGGAGAUA CUCGACUU | 3454 | AAGUCGAG CUGAUGAGGCCGUUAGGCCGAA AUCUCCUC | 12861 |
| 3204 | GAGAUACUC GACUUCCC | 3455 | GGGAAGUC CUGAUGAGGCCGUUAGGCCGAA AGUAUCUC | 12862 |
| 3209 | ACUCGACUU CCCCUAAA | 3456 | UUUAGGGG CUGAUGAGGCCGUUAGGCCGAA AGUCGAGU | 12863 |
| 3210 | CUCGACUUC CCCUAAAA | 3457 | UUUUAGGG CUGAUGAGGCCGUUAGGCCGAA AAGUCGAG | 12864 |
| 3215 | CUUCCCCUA AAAUGGAU | 3458 | AUCCAUUU CUGAUGAGGCCGUUAGGCCGAA AGGGGAAG | 12865 |
| 3228 | GGAUGGCUC CUGAAUCC | 3459 | GGAUUCAG CUGAUGAGGCCGUUAGGCCGAA AGCCAUCC | 12866 |
| 3235 | UCCUGAAUC CAUCUUUG | 3460 | CAAAGAUG CUGAUGAGGCCGUUAGGCCGAA AUUCAGGA | 12867 |
| 3239 | GAAUCCAUC UUUGACAA | 3461 | UUGUCAAA CUGAUGAGGCCGUUAGGCCGAA AUGGAUUC | 12868 |
| 3241 | AUCCAUCUU UGACAAGG | 3462 | CCUUGUCA CUGAUGAGGCCGUUAGGCCGAA AGAUGGAU | 12869 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 3242 | UCCAUCUUU GACAAGGU | 3463 | ACCUUGUC CUGAUGAGGCCGUUAGGCCGAA AAGAUGGA | 12870 |
| 3251 | GACAAGGUC UACAGCAC | 3464 | GUGCUGUA CUGAUGAGGCCGUUAGGCCGAA ACCUUGUC | 12871 |
| 3253 | CAAGGUCUA CAGCACCA | 3465 | UGGUGCUG CUGAUGAGGCCGUUAGGCCGAA AGACCUUG | 12872 |
| 3277 | UGUGUGGUC CUAUGGCG | 3466 | CGCCAUAG CUGAUGAGGCCGUUAGGCCGAA ACCACACA | 12873 |
| 3280 | GUGGUCCUA UGGCGUGU | 3467 | ACACGCCA CUGAUGAGGCCGUUAGGCCGAA AGGACCAC | 12874 |
| 3289 | UGGCGUGUU GCUGUGGG | 3468 | CCCACAGC CUGAUGAGGCCGUUAGGCCGAA ACACGCCA | 12875 |
| 3302 | UGGGAGAUC UUCUCCUU | 3469 | AAGGAGAA CUGAUGAGGCCGUUAGGCCGAA AUCUCCCA | 12876 |
| 3304 | GGAGAUCUU CUCCUUAG | 3470 | CUAAGGAG CUGAUGAGGCCGUUAGGCCGAA AGAUCUCC | 12877 |
| 3305 | GAGAUCUUC UCCUUAGG | 3471 | CCUAAGGA CUGAUGAGGCCGUUAGGCCGAA AAGAUCUC | 12878 |
| 3307 | GAUCUUCUC CUUAGGGG | 3472 | CCCCUAAG CUGAUGAGGCCGUUAGGCCGAA AGAAGAUC | 12879 |
| 3310 | CUUCUCCUU AGGGGUU | 3473 | AACCCCCU CUGAUGAGGCCGUUAGGCCGAA AGGAGAAG | 12880 |
| 3311 | UUCUCCUUA GGGGUUC | 3474 | GAACCCCC CUGAUGAGGCCGUUAGGCCGAA AAGGAGAA | 12881 |
| 3328 | UAGGGGUU CUCCAUAC | 3475 | GUAUGGAG CUGAUGAGGCCGUUAGGCCGAA ACCCCCUA | 12882 |
| 3319 | AGGGGUUC UCCAUACC | 3476 | GGUAUGGA CUGAUGAGGCCGUUAGGCCGAA AACCCCCU | 12883 |
| 3321 | GGGUUCUC CAUACCCA | 3477 | UGGGUAUG CUGAUGAGGCCGUUAGGCCGAA AGAACCCC | 12884 |
| 3325 | UUCUCCAUA CCCAGGAG | 3478 | CUCCUGGG CUGAUGAGGCCGUUAGGCCGAA AUGGAGAA | 12885 |
| 3352 | UGAAGACUU CUGCAGCC | 3479 | GGCUGCAG CUGAUGAGGCCGUUAGGCCGAA AGUCUUCA | 12886 |
| 3353 | GAAGACUUC UGCAGCCG | 3480 | CGGCUGCA CUGAUGAGGCCGUUAGGCCGAA AAGUCUUC | 12887 |
| 3397 | CCCGGAGUA UGCCACAC | 3481 | GUGUGGCA CUGAUGAGGCCGUUAGGCCGAA ACUCCGGG | 12888 |
| 3413 | CCUGAAAUC UACCAAAU | 3482 | AUUUGGUA CUGAUGAGGCCGUUAGGCCGAA AUUUCAGG | 12889 |
| 3415 | UGAAAUCUA CCAAAUCA | 3483 | UGAUUUGG CUGAUGAGGCCGUUAGGCCGAA AGAUUUCA | 12890 |
| 3422 | UACCAAAUC AUGGUGGA | 3484 | UCCAACAU CUGAUGAGGCCGUUAGGCCGAA AUUUGGUA | 12891 |
| 3427 | AAUCAUGUU GGAUUGCU | 3485 | AGCAAUCC CUGAUGAGGCCGUUAGGCCGAA ACAUGAUU | 12892 |
| 3432 | UGUUGGAUU GCUGGCAC | 3486 | GUGCCAGC CUGAUGAGGCCGUUAGGCCGAA AUCCAACA | 12893 |
| 3466 | GCCCCGGUU UGCUGAAC | 3487 | GUUCAGCA CUGAUGAGGCCGUUAGGCCGAA ACCGGGGC | 12894 |
| 3467 | CCCCGGUUU GCUGAACU | 3488 | AGUUCAGC CUGAUGAGGCCGUUAGGCCGAA AACCGGGG | 12895 |
| 3476 | GCUGAACUU GUGGAGAA | 3489 | UUCUCCAC CUGAUGAGGCCGUUAGGCCGAA AGUUCAGC | 12896 |
| 3488 | GAGAAACUU GGUGACCU | 3490 | AGGUCACC CUGAUGAGGCCGUUAGGCCGAA AGUUUCUC | 12897 |
| 3500 | GACCUGCUU CAAGCCAA | 3491 | UUGGCUUG CUGAUGAGGCCGUUAGGCCGAA AGCAGGUC | 12898 |
| 3501 | ACCUGCUUC AAGCCAAC | 3492 | GUUGGCUU CUGAUGAGGCCGUUAGGCCGAA AAGCAGGU | 12899 |
| 3512 | GCCAACGUC CAACAGGA | 3493 | UCCUGUUG CUGAUGAGGCCGUUAGGCCGAA ACGUUGGC | 12900 |
| 3531 | GGAAAGAUU ACAUCCCC | 3494 | GGGGAUGU CUGAUGAGGCCGUUAGGCCGAA AUCUUUCC | 12901 |
| 3532 | GAAAGAUUA CAUCCCCC | 3495 | GGGGGAUG CUGAUGAGGCCGUUAGGCCGAA AAUCUUUC | 12902 |
| 3536 | GAUUACAUC CCCUCAA | 3496 | UUGAGGGG CUGAUGAGGCCGUUAGGCCGAA AUGUAAUC | 12903 |
| 3542 | AUCCCCCUC AAUGCCAU | 3497 | AUGGCAUU CUGAUGAGGCCGUUAGGCCGAA AGGGGGAU | 12904 |
| 3551 | AAUGCCAUA CUGACUAG | 3498 | CUAGUCAG CUGAUGAGGCCGUUAGGCCGAA AUGGCAUU | 12905 |
| 3558 | UACUGACUA GAAACAGU | 3499 | ACUGUUUC CUGAUGAGGCCGUUAGGCCGAA AGUCAGUA | 12906 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 3567 | GAAACAGUA GCUUCACA | 3500 | UGUGAAGC CUGAUGAGGCCGUUAGGCCGAA ACUGUUUC | 12907 |
| 3571 | CAGUAGCUU CACAUACU | 3501 | AGUAUGUG CUGAUGAGGCCGUUAGGCCGAA AGCUACUG | 12908 |
| 3572 | AGUAGCUUC ACAUACUC | 3502 | GAGUAUGU CUGAUGAGGCCGUUAGGCCGAA AAGCUACU | 12909 |
| 3577 | CUUCACAUA CUCGACCC | 3503 | GGGUCGAG CUGAUGAGGCCGUUAGGCCGAA AUGUGAAG | 12910 |
| 3580 | CACAUACUC GACCCCCA | 3504 | UGGGGGUC CUGAUGAGGCCGUUAGGCCGAA AGUAUGUG | 12911 |
| 3592 | CCCCACCUU CUCUGAGG | 3505 | CCUCAGAG CUGAUGAGGCCGUUAGGCCGAA AGGUGGGG | 12912 |
| 3593 | CCCACCUUC UCUGAGGA | 3506 | UCCUCAGA CUGAUGAGGCCGUUAGGCCGAA AAGGUGGG | 12913 |
| 3595 | CACCUUCUC UGAGGACC | 3507 | GGUCCUCA CUGAUGAGGCCGUUAGGCCGAA AGAAGGUG | 12914 |
| 3605 | GAGGACCUU UUCAAGGA | 3508 | UCCUUGAA CUGAUGAGGCCGUUAGGCCGAA AGGUCCUC | 12915 |
| 3606 | AGGACCUUU UCAAGGAC | 3509 | GUCCUUGA CUGAUGAGGCCGUUAGGCCGAA AAGGUCCU | 12916 |
| 3607 | GGACCUUUU CAAGGACG | 3510 | CGUCCUUG CUGAUGAGGCCGUUAGGCCGAA AAAGGUCC | 12917 |
| 3608 | GACCUUUUC AAGGACGG | 3511 | CCGUCCUU CUGAUGAGGCCGUUAGGCCGAA AAAAGGUC | 12918 |
| 3619 | GGACGGCUU UGCAGAUC | 3512 | GAUCUCCA CUGAUGAGGCCGUUAGGCCGAA AGCCGUCC | 12919 |
| 3620 | GACGGCUUU GCAGAUCC | 3513 | GGAUCUGC CUGAUGAGGCCGUUAGGCCGAA AAGCCGUC | 12920 |
| 3627 | UUGCAGAUC CACAUUUU | 3514 | AAAAUGUG CUGAUGAGGCCGUUAGGCCGAA AUCUGCAA | 12921 |
| 3633 | AUCCACAUU UUCAUUCC | 3515 | GGAAUGAA CUGAUGAGGCCGUUAGGCCGAA AUGUGGAU | 12922 |
| 3634 | UCCACAUUU UCAUUCCG | 3516 | CGGAAUGA CUGAUGAGGCCGUUAGGCCGAA AAUGUGGA | 12923 |
| 3635 | CCACAUUUU CAUUCCGG | 3517 | CCGGAAUG CUGAUGAGGCCGUUAGGCCGAA AAAUGUGG | 12924 |
| 3636 | CACAUUUUC AUUCCGGA | 3518 | UCCGGAAU CUGAUGAGGCCGUUAGGCCGAA AAAAUGUG | 12925 |
| 3639 | AUUUUCAUU CCGGAAGC | 3519 | GCUUCCGG CUGAUGAGGCCGUUAGGCCGAA AUGAAAAU | 12926 |
| 3640 | UUUUCAUUC CGGAAGCU | 3520 | AGCUUCCG CUGAUGAGGCCGUUAGGCCGAA AAUGAAAA | 12927 |
| 3649 | CGGAAGCUC UGAUGAUG | 3521 | CAUCAUCA CUGAUGAGGCCGUUAGGCCGAA AGCUUCCG | 12928 |
| 3664 | UGUGAGAUA UGUAAACG | 3522 | CGUUUACA CUGAUGAGGCCGUUAGGCCGAA AUCUCACA | 12929 |
| 3668 | AGAUAUGUA AACGCUUU | 3523 | AAAGCGUU CUGAUGAGGCCGUUAGGCCGAA ACAUAUCU | 12930 |
| 3675 | UAAACGCUU UCAAAUUC | 3524 | GAAUUUGA CUGAUGAGGCCGUUAGGCCGAA AGCGUUUA | 12931 |
| 3676 | AAACGCUUU CAAAUUCA | 3525 | UGAAUUUG CUGAUGAGGCCGUUAGGCCGAA AAGCGUUU | 12932 |
| 3677 | AACGCUUUC AAAUUCAU | 3526 | AUGAAUUU CUGAUGAGGCCGUUAGGCCGAA AAAGCGUU | 12933 |
| 3682 | UUUCAAAUU CAUGAGCC | 3527 | GGCUCAUG CUGAUGAGGCCGUUAGGCCGAA AUUUGAAA | 12934 |
| 3683 | UUCAAAUUC AUGAGCCU | 3528 | AGGCUCAU CUGAUGAGGCCGUUAGGCCGAA AAUUUGAA | 12935 |
| 3701 | GAAAGAAUC AAAACCUU | 637 | AAGGUUUU CUGAUGAGGCCGUUAGGCCGAA AUUCUUUC | 10056 |
| 3709 | CAAAACCUU UGAGGAGC | 3529 | GCUCCUCA CUGAUGAGGCCGUUAGGCCGAA AGGUUUUG | 12936 |
| 3710 | AAAACCUUU GAGGAGCU | 3530 | AGCUCCUC CUGAUGAGGCCGUUAGGCCGAA AAGGUUUU | 12937 |
| 3719 | GAGGAGCUU UCACCGAA | 3531 | UUCGGUGA CUGAUGAGGCCGUUAGGCCGAA AGCUCCUC | 12938 |
| 3720 | AGGAGCUUU CACCGAAC | 3532 | GUUCGGUG CUGAUGAGGCCGUUAGGCCGAA AAGCUCCU | 12939 |
| 3721 | GGAGCUUUC ACCGAACU | 3533 | AGUUCGGU CUGAUGAGGCCGUUAGGCCGAA AAAGCUCC | 12940 |
| 3730 | ACCGAACUC CACCUCCA | 3534 | UGGAGGUG CUGAUGAGGCCGUUAGGCCGAA AGUUCGGU | 12941 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 3736 | CUCCACCUC CAUGUUUG | 3535 | CAAACAUG CUGAUGAGGCCGUUAGGCCGAA AGGUGGAG | 12942 |
| 3742 | CUCCAUGUU UGAGGACU | 3536 | AGUCCUCA CUGAUGAGGCCGUUAGGCCGAA ACAUGGAG | 12943 |
| 3743 | UCCAUGUUU GAGGACUA | 3537 | UAGUCCUC CUGAUGAGGCCGUUAGGCCGAA AACAUGGA | 12944 |
| 3751 | UGAGGACUA UCAGCUGG | 3538 | CCAGCUGA CUGAUGAGGCCGUUAGGCCGAA AGUCCUCA | 12945 |
| 3753 | AGGACUAUC AGCUGGAC | 3539 | GUCCAGCU CUGAUGAGGCCGUUAGGCCGAA AUAGUCCU | 12946 |
| 3765 | UGGACACUA GCACUCUG | 3540 | CAGAGUGC CUGAUGAGGCCGUUAGGCCGAA AGUGUCCA | 12947 |
| 3771 | CUAGCACUC UGCUGGGC | 3541 | GCCCAGCA CUGAUGAGGCCGUUAGGCCGAA AGUGCUAG | 12948 |
| 3781 | GCUGGGCUC CCCCUUGC | 3542 | GCAAGGGG CUGAUGAGGCCGUUAGGCCGAA AGCCCAGC | 12949 |
| 3787 | CUCCCCCUU GCUGAAGC | 3543 | GCUUCAGC CUGAUGAGGCCGUUAGGCCGAA AGGGGGAG | 12950 |
| 3799 | GAAGCGGUU CACCUGGA | 3544 | UCCAGGUG CUGAUGAGGCCGUUAGGCCGAA ACCGCUUC | 12951 |
| 3800 | AAGCGGUUC ACCUGGAC | 3545 | GUCCAGGU CUGAUGAGGCCGUUAGGCCGAA AACCGCUU | 12952 |
| 3829 | CAAGGCCUC CAUGAAGA | 3546 | UCUUCAUG CUGAUGAGGCCGUUAGGCCGAA AGGCCUUG | 12953 |
| 3839 | AUGAAGAUA GACUUGAG | 3547 | CUCAAGUC CUGAUGAGGCCGUUAGGCCGAA AUCUUCAU | 12954 |
| 3844 | GAUAGACUU GAGAAUAG | 3548 | CUAUUCUC CUGAUGAGGCCGUUAGGCCGAA AGUCUAUC | 12955 |
| 3851 | UUGAGAAUA GCGAGUAA | 3549 | UUACUCGC CUGAUGAGGCCGUUAGGCCGAA AUUCUCAA | 12956 |
| 3858 | UAGCGAGUA AAAGCAAG | 3550 | CUUGCUUU CUGAUGAGGCCGUUAGGCCGAA ACUCGCUA | 12957 |
| 3878 | GCGGGACUU UCCGAUCU | 3551 | AGAUCGGA CUGAUGAGGCCGUUAGGCCGAA AGUCCCGC | 12958 |
| 3879 | CGGGACUUU CCGAUCUG | 3552 | CAGAUCGG CUGAUGAGGCCGUUAGGCCGAA AAGUCCCG | 12959 |
| 3880 | GGGACUUUC CGAUCUGC | 3553 | GCAGAUCG CUGAUGAGGCCGUUAGGCCGAA AAAGUCCC | 12960 |
| 3885 | UUUCCGAUC UGCCGAGG | 3554 | CCUCGGCA CUGAUGAGGCCGUUAGGCCGAA AUCGGAAA | 12961 |
| 3901 | GCCCAGCUU CUGCUUCU | 3555 | AGAAGCAG CUGAUGAGGCCGUUAGGCCGAA AGCUGGGC | 12962 |
| 3902 | CCCAGCUUC UGCUUCUC | 3556 | GAGAAGCA CUGAUGAGGCCGUUAGGCCGAA AAGCUGGG | 12963 |
| 3907 | CUUCUGCUU CUCCAGCU | 3557 | AGCUGGAG CUGAUGAGGCCGUUAGGCCGAA AGCAGAAG | 12964 |
| 3908 | UUCUGCUUC UCCAGCUG | 3558 | CAGCUGGA CUGAUGAGGCCGUUAGGCCGAA AAGCAGAA | 12965 |
| 3910 | CUGCUUCUC CAGCUGUG | 3559 | CACAGCUG CUGAUGAGGCCGUUAGGCCGAA AGAAGCAG | 12966 |
| 3926 | GGCCACAUC AGGCCCGU | 3560 | ACGGGCCU CUGAUGAGGCCGUUAGGCCGAA AUGUGGCC | 12967 |
| 3949 | CGAUGAAUC UGAGCUGG | 3561 | CCAGCUCA CUGAUGAGGCCGUUAGGCCGAA AUUCAUCG | 12968 |
| 3967 | AAAGGAGUC CUGCUGUU | 3562 | AACAGCAG CUGAUGAGGCCGUUAGGCCGAA ACUCCUUU | 12969 |
| 3975 | CCUGCUGUU CUCCACCC | 3563 | GGGUGGAG CUGAUGAGGCCGUUAGGCCGAA ACAGCAGG | 12970 |
| 3976 | CUGCUGUUC UCCACCCC | 3564 | GGGGUGGA CUGAUGAGGCCGUUAGGCCGAA AACAGCAG | 12971 |
| 3978 | GCUGUUCUC CACCCCCA | 3565 | UGGGGGUG CUGAUGAGGCCGUUAGGCCGAA AGAACAGC | 12972 |
| 3991 | CCCAGACUA CAACUCCG | 3566 | CGGAGUUG CUGAUGAGGCCGUUAGGCCGAA AGUCUGGG | 12973 |
| 3997 | CUACAACUC CGUGGUGU | 3567 | ACACCACG CUGAUGAGGCCGUUAGGCCGAA AGUUGUAG | 12974 |
| 4006 | CGUGGUGUU GUACCUCU | 3568 | AGGAGUAC CUGAUGAGGCCGUUAGGCCGAA ACACCACG | 12975 |
| 4009 | GGUGUUGUA CUCCUCCC | 3569 | GGGAGGAG CUGAUGAGGCCGUUAGGCCGAA ACAACACC | 12976 |
| 4012 | GUUGUACUC CUCCCGC | 3570 | GCGGGGAG CUGAUGAGGCCGUUAGGCCGAA AGUACAAC | 12977 |
| 4015 | GUACUCCUC CCCGCCCG | 3571 | CGGGCGGG CUGAUGAGGCCGUUAGGCCGAA AGGAGUAC | 12978 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 4027 | GCCCGCCUA AAGCUUCU | 3572 | AGAAGCUU CUGAUGAGGCCGUUAGGCCGAA AGGCGGGC | 12979 |
| 4033 | CUAAAGCUU CUCACCAG | 3573 | CUGGUGAG CUGAUGAGGCCGUUAGGCCGAA AGCUUUAG | 12980 |
| 4034 | UAAAGCUUC UCACCAGC | 3574 | GCUGGUGA CUGAUGAGGCCGUUAGGCCGAA AAGCUUUA | 12981 |
| 4036 | AGCUUCUC ACCAGCCC | 3575 | GGGCUGGU CUGAUGAGGCCGUUAGGCCGAA AGAAGCUU | 12982 |
| 4066 | CUGACAGUA UUAUACAU | 3576 | AUGUAUAA CUGAUGAGGCCGUUAGGCCGAA ACUGUCAG | 12983 |
| 4068 | GACAGUAUU AUACUCU | 3577 | AGAUGUAU CUGAUGAGGCCGUUAGGCCGAA AUACUGUC | 12984 |
| 4069 | ACAGUAUUA UACAUCUA | 3578 | UAGAUGUA CUGAUGAGGCCGUUAGGCCGAA AAUACUGU | 12985 |
| 4071 | AGUAUUAUA CAUCUAUG | 3579 | CAUAGAUG CUGAUGAGGCCGUUAGGCCGAA AUAAUACU | 12986 |
| 4075 | UUAUACAUC UAUGAGUU | 3580 | AACUCAUA CUGAUGAGGCCGUUAGGCCGAA AUGUAUAA | 12987 |
| 4077 | AUACAUCUA UGAGUUUA | 3581 | UAAACUCA CUGAUGAGGCCGUUAGGCCGAA AGAUGUAU | 12988 |
| 4083 | CUAUGAGUU UACACCUA | 3582 | UAGGUGUA CUGAUGAGGCCGUUAGGCCGAA ACUCAUAG | 12989 |
| 4084 | UAUGAGUUU ACACCUAU | 3583 | AUAGGUGU CUGAUGAGGCCGUUAGGCCGAA AACUCAUA | 12990 |
| 4085 | AUGAGUUUA CACCUAUU | 3584 | AAUAGGUG CUGAUGAGGCCGUUAGGCCGAA AAACUCAU | 12991 |
| 4091 | UUACACCUA UUCCGCUC | 3585 | GAGCGGAA CUGAUGAGGCCGUUAGGCCGAA AGGUGUAA | 12992 |
| 4093 | ACACCUAUU CCGCUCCA | 3586 | UGGAGCGG CUGAUGAGGCCGUUAGGCCGAA AUAGGUGU | 12993 |
| 4094 | CACCUAUUC CGCUCCAC | 3587 | GUGGAGCG CUGAUGAGGCCGUUAGGCCGAA AAUAGGUG | 12994 |
| 4099 | AUUCCGCUC CACAGGAG | 3588 | CUCCUGUG CUGAUGAGGCCGUUAGGCCGAA AGCGGAAU | 12995 |
| 4117 | CAGCUGCUU UUCGUGAC | 3589 | GUCACGAA CUGAUGAGGCCGUUAGGCCGAA AGCAGCUG | 12996 |
| 4118 | AGCUGCUUU UCGUGACC | 3590 | GGUCACGA CUGAUGAGGCCGUUAGGCCGAA AAGCAGCU | 12997 |
| 4119 | GCUGCUUUU CGUGACCU | 3591 | AGGUCACG CUGAUGAGGCCGUUAGGCCGAA AAAGCAGC | 12998 |
| 4120 | CUGCUUUUC GUGACCUU | 3592 | AAGGUCAC CUGAUGAGGCCGUUAGGCCGAA AAAAGCAG | 12999 |
| 4128 | CGUGACCUU UAAUCGUG | 3593 | CACGAUUA CUGAUGAGGCCGUUAGGCCGAA AGGUCACG | 13000 |
| 4129 | GUGACCUUU AAUCGUGC | 3594 | GCACGAUU CUGAUGAGGCCGUUAGGCCGAA AAGGUCAC | 13001 |
| 4130 | UGACCUUUA AUCGUGCU | 3595 | AGCACGAU CUGAUGAGGCCGUUAGGCCGAA AAAGGUCA | 13002 |
| 4133 | CCUUUAAUC GUGCUUUU | 3596 | AAAAGCAC CUGAUGAGGCCGUUAGGCCGAA AUUAAAGG | 13003 |
| 4139 | AUCGUGCUU UUUEGUUU | 3597 | AAACAAAA CUGAUGAGGCCGUUAGGCCGAA AGCACGAU | 13004 |
| 4140 | UCGUGCUUU UUUGUUUU | 3598 | AAAACAAA CUGAUGAGGCCGUUAGGCCGAA AAGCACGA | 13005 |
| 4141 | CGUGCUUUU UUGUUUUU | 3599 | AAAAACAA CUGAUGAGGCCGUUAGGCCGAA AAAGCACG | 13006 |
| 4142 | GUGCUUUUU UGUUUUUU | 3600 | AAAAAACA CUGAUGAGGCCGUUAGGCCGAA AAAAGCAC | 13007 |
| 4143 | UGCUUUUUU GUUUUUUG | 3601 | CAAAAAAC CUGAUGAGGCCGUUAGGCCGAA AAAAAGCA | 13008 |
| 4146 | UUUUUUGUU UUUUGUUU | 3602 | AAACAAAA CUGAUGAGGCCGUUAGGCCGAA ACAAAAAA | 13009 |
| 4147 | UUUUUGUUU UUUGUUJU | 3603 | AAAACAAA CUGAUGAGGCCGUUAGGCCGAA AACAAAAA | 13010 |
| 4148 | UUUUGUUUU UUGUUUUG | 3604 | CAAAACAA CUGAUGAGGCCGUUAGGCCGAA AAACAAAA | 13011 |
| 4149 | UUUGUUUUU UGUUUUGU | 3605 | ACAAAACA CUGAUGAGGCCGUUAGGCCGAA AAAACAAA | 13012 |
| 4150 | UUGUUUUUU GUUUUGUU | 3606 | AACAAAAC CUGAUGAGGCCGUUAGGCCGAA AAAAACAA | 13013 |
| 4153 | UUUUUUGUU UUGUUUGU | 3607 | ACAAACAA CUGAUGAGGCCGUUAGGCCGAA ACAAAAAA | 13014 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 4154 | UUUUUGUUU UGUUUGUU | 3608 | AACAAACA CUGAUGAGGCCGUUAGGCCGAA AACAAAAA | 13015 |
| 4255 | UUUUGUUUU GUUUGUUG | 3609 | CAACAAAC CUGAUGAGGCCGUUAGGCCGAA AAACAAAA | 13016 |
| 4258 | UGUUUGUU UGUUGUUG | 3610 | CAACAACA CUGAUGAGGCCGUUAGGCCGAA ACAAAACA | 13017 |
| 4259 | GUUUUGUUU GUUGUUGC | 3611 | GCAACAAC CUGAUGAGGCCGUUAGGCCGAA AACAAAAC | 13018 |
| 4162 | UUGUUUGUU GUUGCUGU | 3612 | ACAGCAAC CUGAUGAGGCCGUUAGGCCGAA ACAAACAA | 13019 |
| 4165 | UUUGUUGUU GCUGUUUU | 3613 | AAAACAGC CUGAUGAGGCCGUUAGGCCGAA ACAACAAA | 13020 |
| 4171 | GUUGCUGUU UUGACUAA | 3614 | UUAGUCAA CUGAUGAGGCCGUUAGGCCGAA ACAGCAAC | 13021 |
| 4172 | UUGCUGUUU UGACUAAC | 3615 | GUUAGUCA CUGAUGAGGCCGUUAGGCCGAA AACAGCAA | 13022 |
| 4173 | UGCUGUUUU GACUAACA | 3616 | UGUUAGUC CUGAUGAGGCCGUUAGGCCGAA AAACAGCA | 13023 |
| 4178 | UUUUGACUA ACAAGAAU | 737 | AUUCUUGU CUGAUGAGGCCGUUAGGCCGAA AGUCAAAA | 10156 |
| 4189 | AAGAAUGUA ACCCCAGU | 3617 | ACUGGGGU CUGAUGAGGCCGUUAGGCCGAA ACAUUCUU | 13024 |
| 4198 | ACCCCAGUU AGUGACGU | 3618 | ACGUCACU CUGAUGAGGCCGUUAGGCCGAA ACUGGGGU | 13025 |
| 4199 | CCCCAGUUA GUGACGUG | 3619 | CACGUCAC CUGAUGAGGCCGUUAGGCCGAA AACUGGGG | 13026 |
| 4216 | UGAAGAAUA CUAUUGUU | 3620 | AACAAUAG CUGAUGAGGCCGUUAGGCCGAA AUUCUUCA | 13027 |
| 4219 | AGAAUACUA UUGUUAGA | 3621 | UCUAACAA CUGAUGAGGCCGUUAGGCCGAA AGUAUUCU | 13028 |
| 4221 | AAUACUAUU GUUAGAGA | 3622 | UCUCUAAC CUGAUGAGGCCGUUAGGCCGAA AUAGUAUU | 13029 |
| 4224 | ACUAUUGUU AGAGAAAU | 3623 | AUUUCUCU CUGAUGAGGCCGUUAGGCCGAA ACAAUAGU | 13030 |
| 4225 | CUAUUGUUA GAGAAAUC | 3624 | GAUUUCUC CUGAUGAGGCCGUUAGGCCGAA AACAAUAG | 13031 |
| 4233 | AGAGAAAUC CCCCCGC | 3625 | GCGGGGGG CUGAUGAGGCCGUUAGGCCGAA AUUUCUCU | 13032 |
| 4249 | CAAAGCCUC AGGGUAAC | 3626 | GUUACCCU CUGAUGAGGCCGUUAGGCCGAA AGGCUUUG | 13033 |
| 4255 | CUCAGGGUA ACCUGGAC | 3627 | GUCCAGGU CUGAUGAGGCCGUUAGGCCGAA ACCCUGAG | 13034 |
| 4282 | AGGUGCCUC UGGCGACC | 3628 | GGUCGCCA CUGAUGAGGCCGUUAGGCCGAA AGGCACCU | 13035 |
| 4323 | CCCACCCUC CCUGCAGC | 3629 | GCUGCAGG CUGAUGAGGCCGUUAGGCCGAA AGGGUGGG | 13036 |
| 4341 | GUGGGACUA GAGGCAGU | 3630 | ACUGCCUC CUGAUGAGGCCGUUAGGCCGAA AGUCCCAC | 13037 |
| 4350 | GAGGCAGUA AGCCCAUU | 3631 | AAUGGGCU CUGAUGAGGCCGUUAGGCCGAA ACUGCCUC | 13038 |
| 4358 | AAGCCCAUU AGCUCAUG | 3632 | CAUGAGCU CUGAUGAGGCCGUUAGGCCGAA AUGGGCUU | 13039 |
| 4359 | AGCCCAUUA GCUCAUGG | 3633 | CCAUGAGC CUGAUGAGGCCGUUAGGCCGAA AAUGGGCU | 13040 |
| 4363 | CAUUAGCUC AUGGCUGC | 3634 | GCAGCCAU CUGAUGAGGCCGUUAGGCCGAA AGCUAAUG | 13041 |
| 4387 | GACCUGCUC UGUCUCUC | 3635 | GAGAGACA CUGAUGAGGCCGUUAGGCCGAA AGCAGGUC | 13042 |
| 4391 | UGCUCUGUC UCUCUUAU | 3636 | AUAAGAGA CUGAUGAGGCCGUUAGGCCGAA ACAGAGCA | 13043 |
| 4393 | CUCUGUCUC UCUUAUGG | 3637 | CCAUAAGA CUGAUGAGGCCGUUAGGCCGAA AGACAGAG | 13044 |
| 4395 | CUGUCUCUC UUAUGGAG | 3638 | CUCCAUAA CUGAUGAGGCCGUUAGGCCGAA AGAGACAG | 13045 |
| 4397 | GUCUCUCUU AUGGAGGA | 3639 | UCCUCCAU CUGAUGAGGCCGUUAGGCCGAA AGAGAGAC | 13046 |
| 4398 | UCUCUCUUA UGGAGGAA | 3640 | UUCCUCCA CUGAUGAGGCCGUUAGGCCGAA AAGAGAGA | 13047 |
| 4445 | AAAAGGCUU UGGGAUGC | 3641 | GCAUCCCA CUGAUGAGGCCGUUAGGCCGAA AGCCUUUU | 13048 |
| 4446 | AAAGGCUUU GGGAUGCG | 3642 | CGCAUCCC CUGAUGAGGCCGUUAGGCCGAA AAGCCUUU | 13049 |
| 4456 | GGAUGCGUC CGUCCUGU | 3643 | ACAGGACG CUGAUGAGGCCGUUAGGCCGAA ACGCAUCC | 13050 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 4460 | GCGUCCGUC CUGUGGAG | 3644 | CUCCACAG CUGAUGAGGCCGUUAGGCCGAA ACGGACGC | 13051 |
| 4487 | AGGGGGCUC CGCUAUGC | 3645 | GCAUAGCG CUGAUGAGGCCGUUAGGCCGAA AGCCCCCU | 13052 |
| 4492 | GCUCCGCUA UGCCACUU | 3646 | AAGUGGCA CUGAUGAGGCCGUUAGGCCGAA AGCGGAGC | 13053 |
| 4500 | AUGCCACUU CAGUGACU | 3647 | AGUCACUG CUGAUGAGGCCGUUAGGCCGAA AGUGGCAU | 13054 |
| 4501 | UGCCACUUC AGUGACUU | 3648 | AAGUCACU CUGAUGAGGCCGUUAGGCCGAA AAGUGGCA | 13055 |
| 4509 | CAGUGACUU CUCACUCC | 3649 | GGAGUGAG CUGAUGAGGCCGUUAGGCCGAA AGUCACUG | 13056 |
| 4510 | AGUGACUUC UCACUCCU | 3650 | AGGAGUGA CUGAUGAGGCCGUUAGGCCGAA AAGUCACU | 13057 |
| 4512 | UGACUUCUC ACUCCUGG | 3651 | CCAGGAGU CUGAUGAGGCCGUUAGGCCGAA AGAAGUCA | 13058 |
| 4516 | UUCUCACUC CUGGCCUC | 3652 | GAGGCCAG CUGAUGAGGCCGUUAGGCCGAA AGUGAGAA | 13059 |
| 4524 | CCUGGCCUC CGCUGUUU | 3653 | AAACAGCG CUGAUGAGGCCGUUAGGCCGAA AGGCCAGG | 13060 |
| 4531 | UCCGCUGUU UCGGGCCC | 3654 | GGGCCCGA CUGAUGAGGCCGUUAGGCCGAA ACAGCGGA | 13061 |
| 4532 | CCGCUGUUU CGGGCCCC | 3655 | GGGGCCCG CUGAUGAGGCCGUUAGGCCGAA AACAGCGG | 13062 |
| 4533 | CGCUGUUUC GGGCCCCC | 3656 | GGGGGCCC CUGAUGAGGCCGUUAGGCCGAA AAACAGCG | 13063 |
| 4543 | GGCCCCCUU CCAAGAGG | 3657 | CCUCUUGG CUGAUGAGGCCGUUAGGCCGAA AGGGGGCC | 13064 |
| 4544 | GCCCCCUUC CAAGAGGU | 3658 | ACCUCUUG CUGAUGAGGCCGUUAGGCCGAA AAGGGGGC | 13065 |
| 4553 | CAAGAGGUA UCAGAGCA | 3659 | UGCUCUGA CUGAUGAGGCCGUUAGGCCGAA ACCUCUUG | 13066 |
| 4555 | AGAGGUAUC AGAGCAGA | 3660 | UCUGCUCU CUGAUGAGGCCGUUAGGCCGAA AUACCUCU | 13067 |
| 4577 | AGGGACGUU UCCUAGAC | 3661 | GUCUAGGA CUGAUGAGGCCGUUAGGCCGAA ACGUCCCU | 13068 |
| 4578 | GGGACGUUU CCUAGACC | 3662 | GGUCUAGG CUGAUGAGGCCGUUAGGCCGAA AACGUCCC | 13069 |
| 4579 | GGACGUUUC CUAGACCA | 3663 | UGGUCUAG CUGAUGAGGCCGUUAGGCCGAA AAACGUCC | 13070 |
| 4582 | CGUUUCCUA GACCAGGG | 3664 | CCCUGGUC CUGAUGAGGCCGUUAGGCCGAA AGGAAACG | 13071 |
| 4598 | GCACAUGUU CUCGGGAA | 3665 | UUCCCGAG CUGAUGAGGCCGUUAGGCCGAA ACAUGUGC | 13072 |
| 4599 | CACAUGUUC UCGGGAAC | 3666 | GUUCCCGA CUGAUGAGGCCGUUAGGCCGAA AACAUGUG | 13073 |
| 4601 | CAUGUUCUC GGGAACCA | 3667 | UGGUUCCC CUGAUGAGGCCGUUAGGCCGAA AGAACAUG | 13074 |
| 4614 | ACCACAGUU AAUCUUAA | 3668 | UUAAGAUU CUGAUGAGGCCGUUAGGCCGAA ACUGUGGU | 13075 |
| 4615 | CCACAGUUA AUCUUAAA | 3669 | UUUAAGAU CUGAUGAGGCCGUUAGGCCGAA AACUGUGG | 13076 |
| 4618 | CAGUUAAUC UUAAAUCU | 3670 | AGAUUUAA CUGAUGAGGCCGUUAGGCCGAA AUUAACUG | 13077 |
| 4620 | GUUAAUCUU AAAUCUUU | 3671 | AAAGAUUU CUGAUGAGGCCGUUAGGCCGAA AGAUUAAC | 13078 |
| 4621 | UUAAUCUUA AAUCUUUU | 3672 | AAAAGAUU CUGAUGAGGCCGUUAGGCCGAA AAGAUUAA | 13079 |
| 4625 | UCUUAAAUC UUUUCCCG | 3673 | CGGGAAAA CUGAUGAGGCCGUUAGGCCGAA AUUUAAGA | 13080 |
| 4627 | UUAAAUCUU UUCCCGGG | 3674 | CCCGGGAA CUGAUGAGGCCGUUAGGCCGAA AGAUUUAA | 13081 |
| 4628 | UAAAUCUUU UCCCGGGA | 3675 | UCCCGGGA CUGAUGAGGCCGUUAGGCCGAA AAGAUUUA | 13082 |
| 4629 | AAAUCUUUU CCCGGGAG | 3676 | CUCCCGGG CUGAUGAGGCCGUUAGGCCGAA AAAGAUUU | 13083 |
| 4630 | AAUCUUUUC CCGGGAGU | 3677 | ACUCCCGG CUGAUGAGGCCGUUAGGCCGAA AAAAGAUU | 13084 |
| 4639 | CCGGGAGUC UUCUGUUG | 3678 | CAACAGAA CUGAUGAGGCCGUUAGGCCGAA ACUCCCGG | 13085 |
| 4641 | GGGAGUCUU CUGUUGUC | 3679 | GACAACAG CUGAUGAGGCCGUUAGGCCGAA AGACUCCC | 13086 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 4642 | GGAGUCUUC UGUUGUCU | 3680 | AGACAACA CUGAUGAGGCCGUUAGGCCGAA AAGACUCC | 13087 |
| 4646 | UCUUCUGUU GUCUGUUU | 3681 | AAACAGAC CUGAUGAGGCCGUUAGGCCGAA ACAGAAGA | 13088 |
| 4649 | UCUGUUGUC UGUUUACC | 3682 | GGUAAACA CUGAUGAGGCCGUUAGGCCGAA ACAACAGA | 13089 |
| 4653 | UUGUCUGUU UACCAUCC | 3683 | GGAUGGUA CUGAUGAGGCCGUUAGGCCGAA ACAGACAA | 13090 |
| 4654 | UGUCUGUUU ACCAUCCA | 3684 | UGGAUGGU CUGAUGAGGCCGUUAGGCCGAA AACAGACA | 13092 |
| 4655 | GUCUGUUUA CCAUCCAA | 3685 | UUGGAUGG CUGAUGAGGCCGUUAGGCCGAA AAACAGAC | 13092 |
| 4660 | UUUACCAUC CAAAGCAU | 3686 | AUGCUUUG CUGAUGAGGCCGUUAGGCCGAA AUGGUAAA | 13093 |
| 4669 | CAAAGCAUA UUUAACAU | 3687 | AUGUUAAA CUGAUGAGGCCGUUAGGCCGAA AUGCUUUG | 13094 |
| 4671 | AAGCAUAUU UAACAUGU | 3688 | ACAUGUUA CUGAUGAGGCCGUUAGGCCGAA AUAUGCUU | 13095 |
| 4672 | AGCAUAUUU AACAUGUG | 3689 | CACAUGUU CUGAUGAGGCCGUUAGGCCGAA AAUAUGCU | 13096 |
| 4673 | GCAUAUUUA ACAUGUGU | 3690 | ACACAUGU CUGAUGAGGCCGUUAGGCCGAA AAAUAUGC | 13097 |
| 4682 | ACAUGUGUC AGUGGGGG | 3691 | CCCCCACU CUGAUGAGGCCGUUAGGCCGAA ACACAUGU | 13098 |
| 4698 | GUGGCGCUU GGCUUCUG | 3692 | CAGAAGCC CUGAUGAGGCCGUUAGGCCGAA AGCGCCAC | 13099 |
| 4703 | GCUUGGCUU CUGAGGCC | 3693 | GGCCUCAG CUGAUGAGGCCGUUAGGCCGAA AGCCAAGC | 13100 |
| 4704 | CUUGGCUUC UGAGGCCA | 3694 | UGGCCUCA CUGAUGAGGCCGUUAGGCCGAA AAGCCAAG | 13101 |
| 4720 | AGAGCCAUC AUCAGUUC | 3695 | GAACUGAU CUGAUGAGGCCGUUAGGCCGAA AUGGCUCU | 13102 |
| 4723 | GCCAUCAUC AGUUCCUC | 3696 | GAGGAACU CUGAUGAGGCCGUUAGGCCGAA AUGAUGGC | 13103 |
| 4727 | UCAUCAGUU CCUCUAGU | 3697 | ACUAGAGG CUGAUGAGGCCGUUAGGCCGAA ACUGAUGA | 13104 |
| 4728 | CAUCAGUUC CUCUAGUG | 3698 | CACUAGAG CUGAUGAGGCCGUUAGGCCGAA AACUGAUG | 13105 |
| 4731 | CAGUUCCUC UAGUGAGA | 3699 | UCUCACUA CUGAUGAGGCCGUUAGGCCGAA AGGAACUG | 13106 |
| 4733 | GUUCCUCUA GUGAGAUG | 3700 | CAUCUCAC CUGAUGAGGCCGUUAGGCCGAA AGAGGAAC | 13107 |
| 4745 | AGAUGCAUU GAGGUCAU | 3701 | AUGACCUC CUGAUGAGGCCGUUAGGCCGAA AUGCAUCU | 13108 |
| 4751 | AUUGAGGUC AUACCCAA | 3702 | UUGGGUAU CUGAUGAGGCCGUUAGGCCGAA ACCUCAAU | 13109 |
| 4754 | GAGGUCAUA CCCAAGCU | 3703 | AGCUUGGG CUGAUGAGGCCGUUAGGCCGAA AUGACCUC | 13110 |
| 4763 | CCCAAGCUU GCAGGCCU | 3704 | AGGCCUGC CUGAUGAGGCCGUUAGGCCGAA AGCUUGGG | 13111 |
| 4777 | CCUGACCUU CGCAUACU | 3705 | AGUAUGCG CUGAUGAGGCCGUUAGGCCGAA AGGUCAGG | 13112 |
| 4778 | CUGACCUUC GCAUACUG | 3706 | CAGUAUGC CUGAUGAGGCCGUUAGGCCGAA AAGGUCAG | 13113 |
| 4783 | CUUCGCAUA CUGCUCAC | 3707 | GUGAGCAG CUGAUGAGGCCGUUAGGCCGAA AUGCGAAG | 13114 |
| 4789 | AUACUGCUC ACGGGAG | 3708 | CUCCCCGU CUGAUGAGGCCGUUAGGCCGAA AGCAGUAU | 13115 |
| 4799 | CGGGGAGUU AAGUGGUC | 3709 | GACCACUU CUGAUGAGGCCGUUAGGCCGAA ACUCCCCG | 13116 |
| 4800 | GGGGAGUUA AGUGGUCC | 3710 | GGACCACU CUGAUGAGGCCGUUAGGCCGAA AACUCCCC | 13117 |
| 4807 | UAAGUGGUC CAGUUUGG | 3711 | CCAAACUG CUGAUGAGGCCGUUAGGCCGAA ACCACUUA | 13118 |
| 4812 | GGUCCAGUU UGGCCUAG | 3712 | CUAGGCCA CUGAUGAGGCCGUUAGGCCGAA ACUGGACC | 13119 |
| 4813 | GUCCAGUUU GGCCUAGU | 3713 | ACUAGGCC CUGAUGAGGCCGUUAGGCCGAA AACUGGAC | 13120 |
| 4819 | UUGGCCUAG UAAGGUU | 3714 | AACCUUAC CUGAUGAGGCCGUUAGGCCGAA AGGCCAAA | 13121 |
| 4822 | GGCCUAGUA AGGUUGCC | 3715 | GGCAACCU CUGAUGAGGCCGUUAGGCCGAA ACUAGGCC | 13122 |
| 4827 | AGUAAGGUU GCCUACUG | 3716 | CAGUAGGC CUGAUGAGGCCGUUAGGCCGAA ACCUUACU | 13123 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 4832 | GGUUGCCUA CUGAUGGG | 3717 | CCCAUCAG CUGAUGAGGCCGUUAGGCCGAA AGGCAACC | 13124 |
| 4843 | GAUGGGCUC AAAAGCCA | 3718 | UGGCUUUU CUGAUGAGGCCGUUAGGCCGAA AGCCCAUC | 13125 |
| 4855 | AGCCACAUU UAAACAG | 3719 | CUGUUUAA CUGAUGAGGCCGUUAGGCCGAA AUGUGGCU | 13126 |
| 4855 | GCCACAUUU UAAACAGG | 3720 | CCUGUUUA CUGAUGAGGCCGUUAGGCCGAA AAUGUGGC | 13127 |
| 4857 | CCACAUUUU AAACAGGU | 3721 | ACCUGUUU CUGAUGAGGCCGUUAGGCCGAA AAAUGUGG | 13128 |
| 4858 | CACAUUUUA AACAGGUU | 3722 | AACCUGUU CUGAUGAGGCCGUUAGGCCGAA AAAAUGUG | 13129 |
| 4866 | AAACAGGUU UAUCUCA | 3723 | UGAGAUAA CUGAUGAGGCCGUUAGGCCGAA ACCUGUUU | 13130 |
| 4867 | AACAGGUUU UAUCUCAA | 3724 | UUGAGAUA CUGAUGAGGCCGUUAGGCCGAA AACCUGUU | 13131 |
| 4868 | ACAGGUUUU AUCUCAAG | 3725 | CUUGAGAU CUGAUGAGGCCGUUAGGCCGAA AAACCUGU | 13132 |
| 4869 | CAGGUUUUA UCUCAAGU | 3726 | ACUUGAGA CUGAUGAGGCCGUUAGGCCGAA AAAACCUG | 13133 |
| 4871 | GGUUUUAUC UCAAGUAU | 3727 | AUACUUGA CUGAUGAGGCCGUUAGGCCGAA AUAAAACC | 13134 |
| 4873 | UUUUAUCUC AAGUAUUA | 3728 | UAAUACUU CUGAUGAGGCCGUUAGGCCGAA AGAUAAAA | 13135 |
| 4878 | UCUCAAGUA UUAAUAUA | 3729 | UAUAUUAA CUGAUGAGGCCGUUAGGCCGAA ACUUGAGA | 13136 |
| 4880 | UCAAGUAUU AAUAUAUA | 3730 | UAUAUAUU CUGAUGAGGCCGUUAGGCCGAA AUACUUGA | 13137 |
| 4881 | CAAGUAUUA AUAUAUAG | 3731 | CUAUAUAU CUGAUGAGGCCGUUAGGCCGAA AAUACUUG | 13138 |
| 4884 | GUAUUAAUA UAUAGACA | 3732 | UGUCUAUA CUGAUGAGGCCGUUAGGCCGAA AUUAAUAC | 13139 |
| 4886 | AUUAAUAUA UAGACAAG | 3733 | CUUGUCUA CUGAUGAGGCCGUUAGGCCGAA AUAUUAAU | 13140 |
| 4888 | UAAUAUAUA GACAAGAC | 3734 | GUCUUGUC CUGAUGAGGCCGUUAGGCCGAA AUAUAUUA | 13141 |
| 4900 | AAGACACUU AUGCAUUA | 3735 | UAAUGCAU CUGAUGAGGCCGUUAGGCCGAA AGUGUCUU | 13142 |
| 4901 | AGACACUUA UGCAUUAU | 3736 | AUAAUGCA CUGAUGAGGCCGUUAGGCCGAA AAGUGUCU | 13143 |
| 4907 | UUAUGCAUU AUCCUGUU | 3737 | AACAGGAU CUGAUGAGGCCGUUAGGCCGAA AUGCAUAA | 13144 |
| 4908 | UAUGCAUUA UCCUGUUU | 3738 | AAACAGGA CUGAUGAGGCCGUUAGGCCGAA AAUGCAUA | 13145 |
| 4910 | UGCAUUAUC CUGUUUUA | 3739 | UAAAACAG CUGAUGAGGCCGUUAGGCCGAA AUAAUGCA | 13146 |
| 4915 | UAUCCUGUU UUAUAUAU | 3740 | AUAUAUAA CUGAUGAGGCCGUUAGGCCGAA ACAGGAUA | 13147 |
| 4916 | AUCCUGUUU UAUAUAUC | 3741 | GAUAUAUA CUGAUGAGGCCGUUAGGCCGAA AACAGGAU | 13148 |
| 4917 | UCCUGUUUU AUAUAUCC | 3742 | GGAUAUAU CUGAUGAGGCCGUUAGGCCGAA AAACAGGA | 13149 |
| 4918 | CCUGUUUUA UAUAUCCA | 3743 | UGGAUAUA CUGAUGAGGCCGUUAGGCCGAA AAAACAGG | 13150 |
| 4920 | UGUUUUAUA UAUCCAAU | 3744 | AUUGGAUA CUGAUGAGGCCGUUAGGCCGAA AUAAAACA | 13151 |
| 4922 | UUUUAUAUA UCCAAUGA | 3745 | UCAUUGGA CUGAUGAGGCCGUUAGGCCGAA AUAUAAAA | 13152 |
| 4924 | UUAUAUAUC CAAUGAAU | 3746 | AUUCAUUG CUGAUGAGGCCGUUAGGCCGAA AUAUAUAA | 13153 |
| 4933 | CAAUGAAUA UAACUGGG | 3747 | CCCAGUUA CUGAUGAGGCCGUUAGGCCGAA AUUCAUUG | 13154 |
| 4935 | AUGAAUAUA ACUGGGGC | 3748 | GCCCCAGU CUGAUGAGGCCGUUAGGCCGAA AUAUUCAU | 13155 |
| 4948 | GGGCGAGUU AAGAGUCA | 3749 | UGACUCUU CUGAUGAGGCCGUUAGGCCGAA ACUCGCCC | 13156 |
| 4949 | GGCGAGUUA AGAGUCAU | 3750 | AUGACUCU CUGAUGAGGCCGUUAGGCCGAA AACUCGCC | 13157 |
| 4955 | UUAAGAGUC AUGGUCUA | 3751 | UAGACCAU CUGAUGAGGCCGUUAGGCCGAA ACUCUUAA | 13158 |
| 4961 | GUCAUGGUC UAGAAAAG | 3752 | CUUUUCUA CUGAUGAGGCCGUUAGGCCGAA ACCAUGAC | 13159 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 4963 | CAUGGUCUA GAAAAGGG | 3753 | CCCUUUUC CUGAUGAGGCCGUUAGGCCGAA AGACCAUG | 13160 |
| 4974 | AAAGGGGUU UCUCUGUA | 3754 | UACAGAGA CUGAUGAGGCCGUUAGGCCGAA ACCCCUUU | 13161 |
| 4975 | AAGGGGUUU CUCUGUAC | 3755 | GUACAGAG CUGAUGAGGCCGUUAGGCCGAA AACCCCUU | 13162 |
| 4976 | AGGGGUUUC UCUGUACC | 3756 | GGUACAGA CUGAUGAGGCCGUUAGGCCGAA AAACCCCU | 13163 |
| 4978 | GGGUUUCUC UGUACCCA | 3757 | UGGGUACA CUGAUGAGGCCGUUAGGCCGAA AGAAACCC | 13164 |
| 4982 | UUCUCUGUA CCCAAAUC | 3758 | GAUUUGGG CUGAUGAGGCCGUUAGGCCGAA ACAGAGAA | 13165 |
| 4990 | ACCCAAAUC GGGCUGGU | 3759 | ACCAGCCC CUGAUGAGGCCGUUAGGCCGAA AUUUGGGU | 13166 |
| 4999 | GGGCUGGUU GGACCAAG | 3760 | CUUGGUCC CUGAUGAGGCCGUUAGGCCGAA ACCAGCCC | 13167 |
| 5029 | AGAGUGGUU GUCCCAGC | 3761 | GCUGGGAC CUGAUGAGGCCGUUAGGCCGAA ACCACUCU | 13168 |
| 5032 | GUGGUUGUC CCAGCUAU | 3762 | AUAGCUGG CUGAUGAGGCCGUUAGGCCGAA ACAACCAC | 13169 |
| 5039 | UCCCAGCUA UAGUUACU | 3763 | AGUAACUA CUGAUGAGGCCGUUAGGCCGAA AGCUGGGA | 13170 |
| 5041 | CCAGCUAUA GUUACUAA | 3764 | UUAGUAAC CUGAUGAGGCCGUUAGGCCGAA AUAGCUGG | 13171 |
| 5044 | GCUAUAGUU ACUAAACU | 3765 | AGUUUAGU CUGAUGAGGCCGUUAGGCCGAA ACUAUAGC | 13172 |
| 5045 | CUAUAGUUA CUAAACUA | 3766 | UAGUUUAG CUGAUGAGGCCGUUAGGCCGAA AACUAUAG | 13173 |
| 5048 | UAGUUACUA AACUACUC | 3767 | GAGUAGUU CUGAUGAGGCCGUUAGGCCGAA AGUAACUA | 13174 |
| 5053 | ACUAAACUA CUCACCCA | 3768 | UGGGUGAG CUGAUGAGGCCGUUAGGCCGAA AGUUUAGU | 13175 |
| 5056 | AAACUACUC ACCCAAAG | 3769 | CUUUGGGU CUGAUGAGGCCGUUAGGCCGAA AGUAGUUU | 13176 |
| 5066 | CCCAAAGUU GGGACCUC | 3770 | GAGGUCCC CUGAUGAGGCCGUUAGGCCGAA ACUUUGGG | 13177 |
| 5074 | UGGGACCUC ACUGGCUU | 3771 | AAGCCAGU CUGAUGAGGCCGUUAGGCCGAA AGGUCCCA | 13178 |
| 5082 | CACUGGCUU CUCUUUAC | 3772 | GUAAAGAG CUGAUGAGGCCGUUAGGCCGAA AGCCAGUG | 13179 |
| 5083 | ACUGGCUUC UCUUUACU | 3773 | AGUAAAGA CUGAUGAGGCCGUUAGGCCGAA AAGCCAGU | 13180 |
| 5085 | UGGCUUCUC UUUACUUC | 3774 | GAAGUAAA CUGAUGAGGCCGUUAGGCCGAA AGAAGCCA | 13181 |
| 5087 | GCUUCUCUU UACUUCAU | 3775 | AUGAAGUA CUGAUGAGGCCGUUAGGCCGAA AGAGAAGC | 13182 |
| 5088 | CUUCUCUUU ACUUCAUC | 3776 | GAUGAAGU CUGAUGAGGCCGUUAGGCCGAA AAGAGAAG | 13183 |
| 5089 | UUCUCUUUA CUUCAUCA | 3777 | UGAUGAAG CUGAUGAGGCCGUUAGGCCGAA AAAGAGAA | 13184 |
| 5092 | UCUUUACUU CAUCAUGG | 3778 | CCAUGAUG CUGAUGAGGCCGUUAGGCCGAA AGUAAAGA | 13185 |
| 5093 | CUUUACUUC AUCAUGGA | 3779 | UCCAUGAU CUGAUGAGGCCGUUAGGCCGAA AAGUAAAG | 13186 |
| 5096 | UACUUCAUC AUGGAUUU | 3780 | AAAUCCAU CUGAUGAGGCCGUUAGGCCGAA AUGAAGUA | 13187 |
| 5103 | UCAUGGAUU UCACCAUC | 3781 | GAUGGUGA CUGAUGAGGCCGUUAGGCCGAA AUCCAUGA | 13188 |
| 5104 | CAUGGAUUU CACCAUCC | 3782 | GGAUGGUG CUGAUGAGGCCGUUAGGCCGAA AAUCCAUG | 13189 |
| 5105 | AUGGAUUUC ACCAUCCC | 3783 | GGGAUGGU CUGAUGAGGCCGUUAGGCCGAA AAAUCCAU | 13190 |
| 5111 | UUCACCAUC CCAAGGCA | 3784 | UGCCUUGG CUGAUGAGGCCGUUAGGCCGAA AUGGUGAA | 13191 |
| 5122 | AAGGCAGUC UGAGGA | 3785 | UCCUCUCA CUGAUGAGGCCGUUAGGCCGAA ACUGCCUU | 13192 |
| 5134 | GAGGAGCUA AAGAGUAU | 3786 | AUACUCUU CUGAUGAGGCCGUUAGGCCGAA AGCUCCUC | 13193 |
| 5141 | UAAAGAGUA UCAGCCCA | 3787 | UGGGCUGA CUGAUGAGGCCGUUAGGCCGAA ACUCUUUA | 13194 |
| 5143 | AAGAGUAUC AGCCCAUA | 3788 | UAUGGGCU CUGAUGAGGCCGUUAGGCCGAA AUACUCUU | 13195 |
| 5151 | CAGCCCAUA UUUAUUAA | 3789 | UUAAUAAA CUGAUGAGGCCGUUAGGCCGAA AUGGGCUG | 13196 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 5153 | GCCCAUAUU UAUUAAGC | 3790 | GCUUAAUA CUGAUGAGGCCGUUAGGCCGAA AUAUGGGC | 13197 |
| 5154 | CCCAUAUUU AUUAAGCA | 3791 | UGCUUAAU CUGAUGAGGCCGUUAGGCCGAA AAUAUGGG | 13198 |
| 5155 | CCAUAUUUA UUAAGCAC | 3792 | GUGCUUAA CUGAUGAGGCCGUUAGGCCGAA AAAUAUGG | 13199 |
| 5157 | AUAUUUAUU AAGCACUU | 3793 | AAGUGCUU CUGAUGAGGCCGUUAGGCCGAA AUAAAUAU | 13200 |
| 5158 | UAUUUAUUA AGCACUUU | 3794 | AAAGUGCU CUGAUGAGGCCGUUAGGCCGAA AAUAAAUA | 13201 |
| 5165 | UAAGCACUU UAUGCUCC | 3795 | GGAGCAUA CUGAUGAGGCCGUUAGGCCGAA AGUGCUUA | 13202 |
| 5166 | AAGCACUUU AUGCUCCU | 3796 | AGGAGCAU CUGAUGAGGCCGUUAGGCCGAA AAGUGCUU | 13203 |
| 5167 | AGCACUUUA UGCUCCUU | 3797 | AAGGAGCA CUGAUGAGGCCGUUAGGCCGAA AAAGUGCU | 13204 |
| 5172 | UUUAUGCUC CUUGGCAC | 3798 | GUGCCAAG CUGAUGAGGCCGUUAGGCCGAA AGCAUAAA | 13205 |
| 5175 | AUGCUCCUU GGCACAGC | 3799 | GCUGUGCC CUGAUGAGGCCGUUAGGCCGAA AGGAGCAU | 13206 |
| 5195 | UGAUGUGUA AUUUAUGC | 3800 | GCAUAAAU CUGAUGAGGCCGUUAGGCCGAA ACACAUCA | 13207 |
| 5198 | UGUGUAAUU UAUGCAAG | 3801 | CUUGCAUA CUGAUGAGGCCGUUAGGCCGAA AUUACACA | 13208 |
| 5199 | GUGUAAUUU AUGCAAGC | 3802 | GCUUGCAU CUGAUGAGGCCGUUAGGCCGAA AAUUACAC | 13209 |
| 5200 | UGUAAUUUA UGCAAGCU | 3803 | AGCUUGCA CUGAUGAGGCCGUUAGGCCGAA AAAUUACA | 13210 |
| 5209 | UGCAAGCUC CCUCUCCA | 3804 | UGGAGAGG CUGAUGAGGCCGUUAGGCCGAA AGCUUGCA | 13211 |
| 5213 | AGCUCCCUC UCCAGCUA | 3805 | UAGCUGGA CUGAUGAGGCCGUUAGGCCGAA AGGGAGCU | 13212 |
| 5215 | CUCCCUCUC CAGCUAGG | 3806 | CCUAGCUG CUGAUGAGGCCGUUAGGCCGAA AGAGGGAG | 13213 |
| 5221 | CUCCAGCUA GGACUCAG | 3807 | CUGAGUCC CUGAUGAGGCCGUUAGGCCGAA AGCUGGAG | 13214 |
| 5227 | CUAGGACUC AGGAUAUU | 3808 | AAUAUCCU CUGAUGAGGCCGUUAGGCCGAA AGUCCUAG | 13215 |
| 5233 | CUCAGGAUA UUAGUCAA | 3809 | UUGACUAA CUGAUGAGGCCGUUAGGCCGAA AUCCUGAG | 13216 |
| 5235 | CAGGAUAUU AGUCAAUG | 3810 | CAUUGACU CUGAUGAGGCCGUUAGGCCGAA AUAUCCUG | 13217 |
| 5236 | AGGAUAUUA GUCAAUGA | 3811 | UCAUUGAC CUGAUGAGGCCGUUAGGCCGAA AAUAUCCU | 13218 |
| 5239 | AUAUUAGUC AAUGAGCC | 3812 | GGCUCAUU CUGAUGAGGCCGUUAGGCCGAA ACUAAUAU | 10358 |
| 5250 | UGAGCCAUC AAAAGGAA | 3813 | UUCCUUUU CUGAUGAGGCCGUUAGGCCGAA AUGGCUCA | 13219 |
| 5273 | AAAACCUA UCUUAUUU | 3814 | AAAUAAGA CUGAUGAGGCCGUUAGGCCGAA AGGUUUUU | 13220 |
| 5275 | AAACCUAUC UUAUUUUC | 3815 | GAAAAUAA CUGAUGAGGCCGUUAGGCCGAA AUAGGUUU | 13221 |
| 5277 | ACCUAUCUU AUUUCAU | 3816 | AUGAAAAU CUGAUGAGGCCGUUAGGCCGAA AGAUAGGU | 13222 |
| 5278 | CCUAUCUUA UUUCAUC | 3817 | GAUGAAAA CUGAUGAGGCCGUUAGGCCGAA AAGAUAGG | 13223 |
| 5280 | UAUCUUAUU UUCAUCUG | 3818 | CAGAUGAA CUGAUGAGGCCGUUAGGCCGAA AUAAGAUA | 13224 |
| 5281 | AUCUUAUUU UCAUCUGU | 3819 | ACAGAUGA CUGAUGAGGCCGUUAGGCCGAA AAUAAGAU | 13225 |
| 5282 | UCUGAUGUG CAUCUGUG | 3820 | AACAGAUG CUGAUGAGGCCGUUAGGCCGAA AAAUAAGA | 13226 |
| 5283 | CUUAUUUUC AUCUGUUU | 3821 | AAACAGAU CUGAUGAGGCCGUUAGGCCGAA AAAAUAAG | 13227 |
| 5286 | AUGGUCAUC UGUUUCAU | 3822 | AUGAAACA CUGAUGAGGCCGUUAGGCCGAA AUGAAAAU | 13228 |
| 5290 | UCAUCUGUU UCAUACCU | 3823 | AGGUAUGA CUGAUGAGGCCGUUAGGCCGAA ACAGAUGA | 13229 |
| 5291 | CAUCUGUUU CAUACCUU | 3824 | AAGGUAUG CUGAUGAGGCCGUUAGGCCGAA AACAGAUG | 13230 |
| 5292 | AUCUGUGUC AUACCUUG | 3825 | CAAGGUAU CUGAUGAGGCCGUUAGGCCGAA AAACAGAU | 13231 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 5295 | UGUUUCAUA CCUUGUCU | 3826 | AGACAAGG CUGAUGAGGCCGUUAGGCCGAA AUGAAACA | 13232 |
| 5299 | UCAUACCUU GUCUGGGG | 3827 | CCCCAGAC CUGAUGAGGCCGUUAGGCCGAA AGGUAGGA | 13233 |
| 5302 | UACCUUGUC UGGGGUCU | 3828 | AGACCCCA CUGAUGAGGCCGUUAGGCCGAA ACAAGGUA | 13234 |
| 5309 | UCUGGGGUC UAAUGACG | 3829 | CGUCAUUA CUGAUGAGGCCGUUAGGCCGAA ACCCCAGA | 13235 |
| 5311 | UGGGGUCUA AUGACGAU | 3830 | AUCGUCAU CUGAUGAGGCCGUUAGGCCGAA AGACCCCA | 13236 |
| 5331 | AACAGGGUA GACAUGGG | 3831 | CCCAUGUC CUGAUGAGGCCGUUAGGCCGAA ACCCUGUU | 13237 |
| 5350 | GACAGGGUA GAAAAGGG | 3832 | CCCUUUUC CUGAUGAGGCCGUUAGGCCGAA ACCCUGUC | 13238 |
| 5367 | UGCCCGCUC UUUGGGGU | 3833 | ACCCCAAA CUGAUGAGGCCGUUAGGCCGAA AGCGGGCA | 13239 |
| 5369 | CCCGCUCUU UGGGGUCU | 3834 | AGACCCCA CUGAUGAGGCCGUUAGGCCGAA AGAGCGGG | 13240 |
| 5370 | CCGCUCUUU GGGGUCUA | 3835 | UAGACCCC CUGAUGAGGCCGUUAGGCCGAA AAGAGCGG | 13241 |
| 5376 | UUUGGGGUC UAGAGAUG | 3836 | CAUCUCUA CUGAUGAGGCCGUUAGGCCGAA ACCCCAAA | 13242 |
| 5378 | UGGGGUCUA GAGAUGAG | 3837 | CUCAUCUC CUGAUGAGGCCGUUAGGCCGAA AGACCCCA | 13243 |
| 5395 | CCCUGGGUC UCUAAAAU | 3838 | AUUUUAGA CUGAUGAGGCCGUUAGGCCGAA ACCCAGGG | 13244 |
| 5397 | CUGGGUCUC UAAAAUGG | 3839 | CCAUUUUA CUGAUGAGGCCGUUAGGCCGAA AGACCCAG | 13245 |
| 5399 | GGGUCUCUA AAAUGGCU | 3840 | AGCCAUUU CUGAUGAGGCCGUUAGGCCGAA AGAGACCC | 13246 |
| 5408 | AAAUGGCUC UCUUAGAA | 3841 | UUCUAAGA CUGAUGAGGCCGUUAGGCCGAA AGCCAUUU | 13247 |
| 5410 | AUGGCUCUC UUAGAAGU | 3842 | ACUUCUAA CUGAUGAGGCCGUUAGGCCGAA AGAGCCAU | 13248 |
| 5412 | GGCUCUCUU AGAAGUUG | 3843 | CAACUUCU CUGAUGAGGCCGUUAGGCCGAA AGAGAGCC | 13249 |
| 5413 | GCUCUCUUA GAAGUUGU | 3844 | ACAACUGC CUGAUGAGGCCGUUAGGCCGAA AAGAGAGC | 13250 |
| 5419 | UUAGAAGUU GUAUGUGC | 3845 | GCACAUAC CUGAUGAGGCCGUUAGGCCGAA ACUUCUAA | 13251 |
| 5422 | GAAGUUGUA UGUGCAAA | 3846 | UUUGCACA CUGAUGAGGCCGUUAGGCCGAA ACAACUUC | 13252 |
| 5432 | GUGCAAAUU AUGGUCUG | 3847 | CAGACCAG CUGAUGAGGCCGUUAGGCCGAA AUUUGCAC | 13253 |
| 5433 | UGCAAAUUA UGGUCUGU | 3848 | ACAGACCA CUGAUGAGGCCGUUAGGCCGAA AAUUUGCA | 13254 |
| 5438 | AUUAUGGUC UGUGUGCU | 3849 | AGCACACA CUGAUGAGGCCGUUAGGCCGAA ACCAUAAU | 13255 |
| 5447 | UGUGUGCUU AGGUCGUG | 3850 | CACGACCU CUGAUGAGGCCGUUAGGCCGAA AGCACACA | 13256 |
| 5448 | GUGUGCUUA GGUCGUGC | 3851 | GCACGACC CUGAUGAGGCCGUUAGGCCGAA AAGCACAC | 13257 |
| 5452 | GCUUAGGUC GUGCACAC | 3852 | GUGUGCAC CUGAUGAGGCCGUUAGGCCGAA ACCUAAGC | 13258 |
| 5475 | GAGCCGGUC ACAGCUGG | 3853 | CCAGCUGU CUGAUGAGGCCGUUAGGCCGAA ACCGGCUC | 13259 |
| 5497 | CGAUGAAUA GCUGCUUU | 3854 | AAAGCAGC CUGAUGAGGCCGUUAGGCCGAA AUUCAUCG | 13260 |
| 5504 | UAGCUGCUU UGGGAGAG | 3855 | CUCUCCCA CUGAUGAGGCCGUUAGGCCGAA AGCAGCUA | 13261 |
| 5505 | AGCUGCUUU GGGAGAGC | 3856 | GCUCUCCC CUGAUGAGGCCGUUAGGCCGAA AAGCAGCU | 13262 |
| 5524 | AGCAUGCUA GCCACUUA | 3857 | UAAGUGGC CUGAUGAGGCCGUUAGGCCGAA AGCAUGCU | 13263 |
| 5531 | UAGCCACUU AAUUCUCU | 3858 | AGAGAAUU CUGAUGAGGCCGUUAGGCCGAA AGUGGCUA | 13264 |
| 5532 | AGCCACUUA AUUCUCUG | 3859 | CAGAGAAU CUGAUGAGGCCGUUAGGCCGAA AAGUGGCU | 13265 |
| 5535 | CACUUAAUU CUCUGACC | 3860 | GGUCAGAG CUGAUGAGGCCGUUAGGCCGAA AUUAAGUG | 13266 |
| 5536 | ACUUAAUUC UCUGACCG | 3861 | CGGUCAGA CUGAUGAGGCCGUUAGGCCGAA AAUUAAGU | 13267 |
| 5538 | UUAAUUCUC UGACCGGG | 3862 | CCCGGUCA CUGAUGAGGCCGUUAGGCCGAA AGAAUUAA | 13268 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 5554 | GCCAGCAUC AUGGGUAC | 3863 | GUACCCAU CUGAUGAGGCCGUUAGGCCGAA AUGCUGGC | 13269 |
| 5561 | UCAUGGGUA CCUGCUCC | 3864 | GGAGCAGG CUGAUGAGGCCGUUAGGCCGAA ACCCAUGA | 13270 |
| 5568 | UACCUGCUC CCCUGUGU | 3865 | ACACAGGG CUGAUGAGGCCGUUAGGCCGAA AGCAGGUA | 13271 |
| 5577 | CCCUGUGUA CCCCAUCC | 3866 | GGAUGGGG CUGAUGAGGCCGUUAGGCCGAA ACACAGGG | 13272 |
| 5584 | UACCCCAUC CUUAAGGU | 3867 | ACCUUAAG CUGAUGAGGCCGUUAGGCCGAA AUGGGGUA | 13273 |
| 5587 | CCCAUCCUU AAGGUUUU | 3868 | AAAACCUU CUGAUGAGGCCGUUAGGCCGAA AGGAUGGG | 13274 |
| 5588 | CCAUCCUUA AGGUUUUC | 3869 | GAAAACCU CUGAUGAGGCCGUUAGGCCGAA AAGGAUGG | 13275 |
| 5593 | CUUAAGGUU UUCUGUCU | 3870 | AGACAGAA CUGAUGAGGCCGUUAGGCCGAA ACCUUAAG | 13276 |
| 5594 | UUAAGGUUU UCUGUCUG | 3871 | CAGACAGA CUGAUGAGGCCGUUAGGCCGAA AACCUUAA | 13277 |
| 5595 | UAAGGUUUU CUGUCUGA | 3872 | UCAGACAG CUGAUGAGGCCGUUAGGCCGAA AAACCUUA | 13278 |
| 5596 | AAGGUUUUC UGUCUGAU | 3873 | AUCAGACA CUGAUGAGGCCGUUAGGCCGAA AAAACCUU | 13279 |
| 5600 | UUUUCUGUC UGAUGAGA | 3874 | UCUCAUCA CUGAUGAGGCCGUUAGGCCGAA ACAGAAAA | 13280 |
| 5627 | AGUGCAAUC CCCACUGA | 3875 | UCAGUGGG CUGAUGAGGCCGUUAGGCCGAA AUUGCACU | 13281 |
| 5660 | CUGUGGCUC UUGGUGCA | 3876 | UGCACCAA CUGAUGAGGCCGUUAGGCCGAA AGCCACAG | 13282 |
| 5662 | GUGGCUCUU GGUGCACU | 3877 | AGUGCACC CUGAUGAGGCCGUUAGGCCGAA AGAGCCAC | 13283 |
| 5671 | GGUGCACUC ACCAGCCA | 3878 | UGGCUGGU CUGAUGAGGCCGUUAGGCCGAA AGUGCACC | 13284 |
| 5685 | CCAGGACUA GACAAGUA | 3879 | UACUUGUC CUGAUGAGGCCGUUAGGCCGAA AGUCCUGG | 13285 |
| 5693 | AGACAAGUA GGAAAGGG | 3880 | CCCUUUCC CUGAUGAGGCCGUUAGGCCGAA ACUUGUCU | 13286 |
| 5704 | AAAGGGCUU CUAGCCAC | 3881 | GUGGCUAG CUGAUGAGGCCGUUAGGCCGAA AGCCCUUU | 13287 |
| 5705 | AAGGGCUUC UAGCCACA | 3882 | UGUGGCUA CUGAUGAGGCCGUUAGGCCGAA AAGCCCUU | 13288 |
| 5707 | GGGCUUCUA GCCACACU | 3883 | AGUGUGGC CUGAUGAGGCCGUUAGGCCGAA AGAAGCCC | 13289 |
| 5731 | AAGAAAAUC AGGUAGGG | 3884 | CCCUACCU CUGAUGAGGCCGUUAGGCCGAA AUUUUCUU | 13290 |
| 5736 | AAUCAGGUA GGGCUGGC | 3885 | GCCAGCCC CUGAUGAGGCCGUUAGGCCGAA ACCUGAUU | 13291 |
| 5754 | AAAGACAUC UUUGUCCA | 3886 | UGGACAAA CUGAUGAGGCCGUUAGGCCGAA AUGUCUUU | 13292 |
| 5756 | AGACAUCUU UGUCCAUU | 3887 | AAUGGACA CUGAUGAGGCCGUUAGGCCGAA AGAUGUCU | 13293 |
| 5757 | GACAUCUUU GUCCAUUC | 3888 | GAAUGGAC CUGAUGAGGCCGUUAGGCCGAA AAGAUGUC | 13294 |
| 5760 | AUCUUUGUC CAUUCGCA | 3889 | UGCGAAUG CUGAUGAGGCCGUUAGGCCGAA ACAAAGAU | 13295 |
| 5764 | UUGUCCAUU CGCAAAAG | 3890 | CUUUUGCG CUGAUGAGGCCGUUAGGCCGAA AUGGACAA | 13296 |
| 5765 | UGUCCAUUC GCAAAAGC | 3891 | GCUUUUGC CUGAUGAGGCCGUUAGGCCGAA AAUGGACA | 13297 |
| 5775 | CAAAAGCUC UUGUCGGC | 3892 | GCCGACAA CUGAUGAGGCCGUUAGGCCGAA AGCUUUUG | 13298 |
| 5777 | AAAGCUCUU GUCGGCUG | 3893 | CAGCCGAC CUGAUGAGGCCGUUAGGCCGAA AGAGCUUU | 13299 |
| 5780 | GCUCUUGUC GGCUGCAG | 3894 | CUGCAGCC CUGAUGAGGCCGUUAGGCCGAA ACAAGAGC | 13300 |
| 5794 | CAGUGUGUA AGUCAGGC | 3895 | GCCUGACU CUGAUGAGGCCGUUAGGCCGAA ACACACUG | 13301 |
| 5798 | GUGUAAGUC AGGCGAUG | 3896 | CAUCGCCU CUGAUGAGGCCGUUAGGCCGAA ACUUACAC | 13302 |
| 5818 | CAGAGGCUA CCAGAGAA | 3897 | UUCUCUGG CUGAUGAGGCCGUUAGGCCGAA AGCCUCUG | 13303 |
| 5852 | CCUGAGGUU UCUCAUCC | 3898 | GGAUGAGA CUGAUGAGGCCGUUAGGCCGAA ACCUCAGG | 13304 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 5853 | CUGAGGUUU CUCAUCCA | 3899 | UGGAUGAG CUGAUGAGGCCGUUAGGCCGAA AACCUCAG | 13305 |
| 5854 | UGAGGUUUC UCAUCCAG | 3900 | CUGGAUGA CUGAUGAGGCCGUUAGGCCGAA AAACCUCA | 13306 |
| 5856 | AGGUUUCUC AUCCAGAU | 3901 | AUCUGGAU CUGAUGAGGCCGUUAGGCCGAA AGAAACCU | 13307 |
| 5859 | UUUCUCAUC CAGAUAUC | 3902 | GAUAUCUG CUGAUGAGGCCGUUAGGCCGAA AUGAGAAA | 13308 |
| 5865 | AUCCAGAUA UCCAGCAA | 3903 | UUGCUGGA CUGAUGAGGCCGUUAGGCCGAA AUCUGGAU | 13309 |
| 5867 | CCAGAUAUC CAGCAAUU | 3904 | AAUUGCUG CUGAUGAGGCCGUUAGGCCGAA AUAUCUGG | 13310 |
| 5875 | CCAGCAAUU GGGGGGUG | 3905 | CACCCCCC CUGAUGAGGCCGUUAGGCCGAA AUUGCUGG | 13311 |
| 5896 | AAGACCAUA GAUGGUCC | 3906 | GGACCAUC CUGAUGAGGCCGUUAGGCCGAA AUGGUCUU | 13312 |
| 5903 | UAGAUGGUC CUGUAUUA | 3907 | UAAUACAG CUGAUGAGGCCGUUAGGCCGAA ACCAUCUA | 13313 |
| 5908 | GGUCCUGUA UUAUUCCG | 3908 | CGGAAUAA CUGAUGAGGCCGUUAGGCCGAA ACAGGACC | 13314 |
| 5910 | UCCUGUAUU AUUCCGAU | 3909 | AUCGGAAU CUGAUGAGGCCGUUAGGCCGAA AUACAGGA | 13315 |
| 5911 | CCUGUAUUA UUCCGAUU | 3910 | AAUCGGAA CUGAUGAGGCCGUUAGGCCGAA AAUACAGG | 13316 |
| 5913 | UGUAUUAUU CCGAUUUU | 3911 | AAAAUCGG CUGAUGAGGCCGUUAGGCCGAA AUAAUACA | 13317 |
| 5914 | GUAUUAUUC CGAUUUUA | 3912 | UAAAAUCG CUGAUGAGGCCGUUAGGCCGAA AAUAAUAC | 13318 |
| 5919 | AUUCCGAUU UUAAUAAU | 3913 | AUUAUUAA CUGAUGAGGCCGUUAGGCCGAA AUCGGAAU | 13319 |
| 5920 | UUCCGAUUU UAAUAAUC | 3914 | GAUUAUUA CUGAUGAGGCCGUUAGGCCGAA AAUCGGAA | 13320 |
| 5921 | UCCGAUUUU AAUAAUCU | 3915 | AGAUUAUU CUGAUGAGGCCGUUAGGCCGAA AAAUCGGA | 13321 |
| 5922 | CCGAUUUUA AUAAUCUA | 3916 | UAGAUUAU CUGAUGAGGCCGUUAGGCCGAA AAAAUCGG | 13322 |
| 5925 | AUUUUAAUA AUCUAAUU | 3917 | AAUUAGAU CUGAUGAGGCCGUUAGGCCGAA AUUAAAAU | 13323 |
| 5928 | UUAAUAAUC UAAUUCGU | 3918 | ACGAAUUA CUGAUGAGGCCGUUAGGCCGAA AUUAUUAA | 13324 |
| 5930 | AAUAAUCUA AUUCGUGA | 3919 | UCACGAAU CUGAUGAGGCCGUUAGGCCGAA AGAUUAUU | 13325 |
| 5933 | AAUCUAAUU CGUGAUCA | 3920 | UGAUCACG CUGAUGAGGCCGUUAGGCCGAA AUUAGAUU | 13326 |
| 5934 | AUCUAAUUC GUGAUCAU | 3921 | AUGAUCAC CUGAUGAGGCCGUUAGGCCGAA AAUUAGAU | 13327 |
| 5940 | UUCGUGAUC AUUAAGAG | 3922 | CUCUUAAU CUGAUGAGGCCGUUAGGCCGAA AUCACGAA | 13328 |
| 5943 | GUGAUCAUU AAGAGACU | 3923 | AGUCUCUU CUGAUGAGGCCGUUAGGCCGAA AUGAUCAC | 13329 |
| 5944 | UGAUCAUUA AGAGACUU | 3924 | AAGUCUCU CUGAUGAGGCCGUUAGGCCGAA AAUGAUCA | 13330 |
| 5952 | AAGAGACUU UAGUAAAU | 3925 | AUUUACUA CUGAUGAGGCCGUUAGGCCGAA AGUCUCUU | 13331 |
| 5953 | AGAGACUUU AGUAAAUG | 3926 | CAUUUACU CUGAUGAGGCCGUUAGGCCGAA AAGUCUCU | 13332 |
| 5954 | GAGACUUUA GUAAAUGU | 3927 | ACAUUUAC CUGAUGAGGCCGUUAGGCCGAA AAAGUCUC | 13333 |
| 5957 | ACUUUAGUA AAUGUCCC | 3928 | GGGACAUU CUGAUGAGGCCGUUAGGCCGAA ACUAAAGU | 13334 |
| 5963 | GUAAAUGUC CCUUUUCC | 3929 | GGAAAAGG CUGAUGAGGCCGUUAGGCCGAA ACAUUUAC | 13335 |
| 5967 | AUGUCCCUU UUCCCACA | 3930 | UGUGGGAA CUGAUGAGGCCGUUAGGCCGAA AGGGACAU | 13336 |
| 5968 | UGUCCCUUU UCCCACAA | 3931 | UUGUGGGA CUGAUGAGGCCGUUAGGCCGAA AAGGGACA | 13337 |
| 5969 | GUCCCUUUU CCCACAAA | 3932 | UUUGUGGG CUGAUGAGGCCGUUAGGCCGAA AAAGGGAC | 13338 |
| 5970 | UCCCUUUUC CCACAAAA | 3933 | UUUUGUGG CUGAUGAGGCCGUUAGGCCGAA AAAAGGGA | 13339 |
| 5981 | ACAAAAGUA AAGAAAAG | 3934 | CUUUUCUU CUGAUGAGGCCGUUAGGCCGAA ACUUUUGU | 13340 |
| 5992 | GAAAAGCUA UCGGGAUU | 3935 | AAUCCCGA CUGAUGAGGCCGUUAGGCCGAA AGCUUUUC | 13341 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 5994 | AAAGCUAUC GGGAUUCU | 3936 | AGAAUCCC CUGAUGAGGCCGUUAGGCCGAA AUAGCUUU | 13342 |
| 6000 | AUCGGGAUU CUCUGGUU | 3937 | AACCAGAG CUGAUGAGGCCGUUAGGCCGAA AUCCCGAU | 13343 |
| 6001 | UCGGGAUUC UCUGGUUC | 3938 | GAACCAGA CUGAUGAGGCCGUUAGGCCGAA AAUCCCGA | 13344 |
| 6003 | GGGAUUCUC UGGUUCUG | 3939 | CAGAACCA CUGAUGAGGCCGUUAGGCCGAA AGAAUCCC | 13345 |
| 6008 | UCUCUGGUU CUGCUUAA | 3940 | UUAAGCAG CUGAUGAGGCCGUUAGGCCGAA ACCAGAGA | 13346 |
| 6009 | CUCUGGUUC UGCUUAAA | 3941 | UUUAAGCA CUGAUGAGGCCGUUAGGCCGAA AACCAGAG | 13347 |
| 6014 | GUUCUGCUU AAAGACUU | 3942 | AAGUCUUU CUGAUGAGGCCGUUAGGCCGAA AGCAGAAC | 13348 |
| 6015 | UUCUGCUUA AAGACUUA | 3943 | UAAGUCUU CUGAUGAGGCCGUUAGGCCGAA AAGCAGAA | 13349 |
| 6022 | UAAAGACUU AGCUUUGG | 3944 | CCAAAGCU CUGAUGAGGCCGUUAGGCCGAA AGUCUUUA | 13350 |
| 6023 | AAAGACUUA GCUUUGGA | 3945 | UCCAAAGC CUGAUGAGGCCGUUAGGCCGAA AAGUCUUU | 13351 |
| 6027 | ACUUAGCUU UGGAGCCU | 3946 | AGGCUCCA CUGAUGAGGCCGUUAGGCCGAA AGCUAAGU | 13352 |
| 6028 | CUUAGCUUU GGAGCCUA | 3947 | UAGGCUCC CUGAUGAGGCCGUUAGGCCGAA AAGCUAAG | 13353 |
| 6036 | UGGAGCCUA UGAAAGUU | 3948 | AACUUUCA CUGAUGAGGCCGUUAGGCCGAA AGGCUCCA | 13354 |
| 6044 | AUGAAAGUU GAUCAGCC | 3949 | GGCUGAUC CUGAUGAGGCCGUUAGGCCGAA ACUUUCAU | 13355 |

Where "X" represents stem II region of a HH ribozyme (Hertel et al., 1992 Nucleic Acids Res. 20 3252).
The length of stem II may be 2 base-pairs.
Underlined region can be any X sequence or linker, as described herein.

TABLE IX

Mouse flt1 VEGF Receptor-Hairpin Ribozyme and Substrate Sequence

| Pos | Substrate | Seq ID No | HP Ribozyme | Seq ID No |
|---|---|---|---|---|
| 33 | AUGGUCA GCU GCUGGGAC | 3950 | GUCCCAGC AGAA GACCAC ACCAGAGAAACACACGUUGUGGUACAUUACCUGGUA | 13356 |
| 36 | GUCAGCU GCU GGGACACC | 3951 | GGUGUCCC AGAA GCUGAC ACCAGAGAAACACACGUUGUGGUACAUUACCUGGUA | 13357 |
| 50 | CACCGCG GUC UUGCCUUA | 3952 | UAAGGCAA AGAA GCGGUG ACCAGAGAAACACACGUUGUGGUACAUUACCUGGUA | 13358 |
| 67 | ACGCGCU GCU CGGGUGUC | 3953 | GACACCCG AGAA GCGCGU ACCAGAGAAACACACGUUGUGGUACAUUACCUGGUA | 13359 |
| 79 | GGUGUCU GCU UCUCACAG | 3954 | CUGUGAGA AGAA GACACC ACCAGAGAAACACACGUUGUGGUACAUUACCUGGUA | 13360 |
| 166 | CAGGCCA GAC UCUCUUUC | 3955 | GAAAGAGA AGAA GGCCUG ACCAGAGAAACACACGUUGUGGUACAUUACCUGGUA | 13361 |
| 197 | GGAGGCA GCC CACUCAUG | 3956 | CAUGAGUG AGAA GCCUCC ACCAGAGAAACACACGUUGUGGUACAUUACCUGGUA | 13362 |
| 214 | GGUCUCU GCC CACGACCG | 3957 | GGGUCGUG AGAA GAGACC ACCAGAGAAACACACGUUGUGGUACAUUACCUGGUA | 13363 |
| 266 | CCCAUCG GCC UGUGGGAG | 3958 | CUCCCACA AGAA GAUGGG ACCAGAGAAACACACGUUGUGGUACAUUACCUGGUA | 13364 |
| 487 | GAAGACA GCU CAUCAUCC | 3959 | GGAUGAUG AGAA GUCUUC ACCAGAGAAACACACGUUGUGGUACAUUACCUGGUA | 13365 |
| 501 | AUCCCCU GCC GGGUGACG | 3960 | CGUCACCC AGAA GGGGAU ACCAGAGAAACACACGUUGUGGUACAUUACCUGGUA | 13366 |
| 566 | UACCCCU GAU GGGCAAAG | 3961 | CUUUGCCC AGAA GGGGUA ACCAGAGAAACACACGUUGUGGUACAUUACCUGGUA | 13367 |
| 640 | UAGGACU GCU GAACUGCG | 3962 | CGCAGUUC AGAA GUCCUA ACCAGAGAAACACACGUUGUGGUACAUUACCUGGUA | 13368 |
| 691 | ACUAUCU GAC CCAUCGGC | 3963 | GCCGAUGG AGAA GAUAGU ACCAGAGAAACACACGUUGUGGUACAUUACCUGGUA | 13369 |
| 703 | AUCGGCA GAC CAAUACAA | 3964 | UUGUAUUG AGAA GCCGAU ACCAGAGAAACACACGUUGUGGUACAUUACCUGGUA | 13370 |

TABLE IX-continued

Mouse flt1 VEGF Receptor-Hairpin Ribozyme and Substrate Sequence

| Pos | Substrate | Seq ID No | HP Ribozyme | Seq ID No |
|---|---|---|---|---|
| 736 | UACGCCC GCC GAGCCCAG | 3965 | CUGGGCUC AGAA GGCGUA ACCAGAGAAACACACGUUGUGGUACAUUACCUGGUA | 13371 |
| 754 | UGAGACU GCU CCACGGGC | 3966 | GCCCGUGG AGAA GUCUCA ACCAGAGAAACACACGUUGUGGUACAUUACCUGGUA | 13372 |
| 766 | ACGGGCA GAC UCUUGUCC | 3967 | GGACAAGA AGAA GCCCGU ACCAGAGAAACACACGUUGUGGUACAUUACCUGGUA | 13373 |
| 871 | GGCAGCG GAU UGACCGGA | 3968 | UCCGGUCA AGAA GCUGCC ACCAGAGAAACACACGUUGUGGUACAUUACCUGGUA | 13374 |
| 960 | UACACCU GUC GCGUGAAG | 3969 | CUUCACGC AGAA GGUGUA ACCAGAGAAACACACGUUGUGGUACAUUACCUGGUA | 13375 |
| 988 | CGUUCCA GUC UUUCAACA | 3970 | UGUUGAAA AGAA GGAACG ACCAGAGAAACACACGUUGUGGUACAUUACCUGGUA | 13376 |
| 1051 | GGAAGCA GCC GGUGCAGG | 3971 | CCUGCACC AGAA GCUUCC ACCAGAGAAACACACGUUGUGGUACAUUACCUGGUA | 13377 |
| 1081 | GAAGACG GUC CUAUCGGC | 3972 | GCCGAUAG AGAA GUCUUC ACCAGAGAAACACACGUUGUGGUACAUUACCUGGUA | 13378 |
| 1090 | CCUAUCG GCU GUCCAUGA | 3973 | UCAUGGAC AGAA GAUAGG ACCAGAGAAACACACGUUGUGGUACAUUACCUGGUA | 13379 |
| 1093 | AUCGGCU GUC CAUGAAAG | 3974 | CUUUCAUG AGAA GCCGAU ACCAGAGAAACACACGUUGUGGUACAUUACCUGGUA | 13380 |
| 1169 | GAAGUCU GCU CGCUAUUU | 3975 | AAAUAGCG AGAA GACUUC ACCAGAGAAACACACGUUGUGGUACAUUACCUGGUA | 13381 |
| 1315 | AACCUCA GAU CUACGAAA | 3976 | UUUCGUAG AGAA GAGGUU ACCAGAGAAACACACGUUGUGGUACAUUACCUGGUA | 13382 |
| 1363 | UCUAUCC GCU GGGCAGCA | 3977 | UGCUGCCC AGAA GAUAGA ACCAGAGAAACACACGUUGUGGUACAUUACCUGGUA | 13383 |
| 1604 | GGUGGCU GAC UCUCAGAC | 3978 | GUCUGAGA AGAA GCCACC ACCAGAGAAACACACGUUGUGGUACAUUACCUGGUA | 13384 |
| 1612 | ACUCUCA GAC CCCUGGAA | 3979 | UUCCAGGG AGAA GAGAGU ACCAGAGAAACACACGUUGUGGUACAUUACCUGGUA | 13385 |
| 1629 | AUCUACA GCU GCCGGGCC | 3980 | GGCCCGGC AGAA GUAGAU ACCAGAGAAACACACGUUGUGGUACAUUACCUGGUA | 13386 |
| 1632 | UACAGCU GCC GGGCCUUC | 3981 | GAAGCCCC AGAA GCUGUA ACCAGACAAACACACGUUGUGGUACAUUACCUGGUA | 13387 |
| 1688 | UGUCACA GAU GUGCCGAA | 3982 | UUCGGCAC AGAA GUGACA ACCAGAGAAACACACGUUCUGGUACAUUACCUCGUA | 13388 |
| 1730 | GAUGCCA GCC CAAGGAGA | 3983 | UCUCCUUC AGAA GGCAUC ACCACAGAAACACACGUUCUGGUACAUUACCUGGUA | 13389 |
| 1753 | UCAAACU CUC CUCUCUGG | 3984 | CCACACAG AGAA GUUUCA ACCAGAGUAACACGUUGUGGUACAUUACCUGGUA | 13390 |
| 2017 | CACACCU GCU UCAAAACC | 3985 | GGUUUUGA AGAA GGUGUG ACCAGAGAAACACACGUUGUGGUACAUUACCUGGUA | 13391 |
| 2101 | CGCCUCA GAU CACUUGGU | 3986 | ACCAAGUG AGAA GAGGCC ACCAGAGAAACACACGUUGUGGUACAUUACCUGGUA | 13392 |
| 2176 | GCACGCU GUU UAUUCAAA | 1441 | UUUCAAUA AGAA GCGUCC ACCAGAGAAACACACGUUGUGGUACAUUACCUGGUA | 10860 |
| 2258 | AACCGCA GCC UACCUCAC | 3987 | GUCAGGUA AGAA GCGCUU ACCAGAGAAACACACGUUGUGGUACAUUACCUGGUA | 13393 |
| 2305 | UGGAGCU GAU CACGCUCA | 3988 | UGAGCGUG AGAA GCUCCA ACCAGAGAAACACACGUUGUGGUACAUUACCUGGUA | 13394 |
| 2383 | UGAAGCG GUC UUCUUCCG | 3989 | CGGAAGAA AGAA GCUUCA ACCAGAGAAACACACGUUGUCCUACAUUACCUGGUA | 13395 |
| 2405 | AAACACA GAC UACCUGUC | 3990 | GACACGUA AGAA GUCUUU ACCAGAGAAACACACGUUGUGGUACAUUACCUGGUA | 13396 |
| 2432 | GGACCCA GAU GAAGUUCC | 1445 | GGAACUUC AGAA GGGUCC ACCAGAGAAACACACGUUGUGGUACAUUACCUGGUA | 10864 |
| 2464 | GUGAACG GCU GCCCUAUG | 3991 | CAUAGGCC AGAA GUUCAC ACCAGAGAAACACACGUUGUGGUACAUUACCUGGUA | 13397 |
| 2467 | AACGGCU GCC CUAUGAUC | 3992 | CAUCAUAG AGAA GCCGUU ACCAGAGAAACACACGUUGUGGUACAUUACCUGGUA | 13398 |
| 2592 | CCCACCU GCC GGACUGUG | 3993 | CACAGUCC AGAA GGUGCG ACCAGAGAAACACACCUUGUGGUACAUUACCUGGUA | 13399 |
| 2596 | CCUGCCG GAC UGUGGCUG | 3994 | CAGCCACA AGAA GGCACG ACCAGAGAAACACACCUUGUGGUACAUUACCUGGUA | 13400 |
| 2653 | AAGCUCU GAU GACCGAAC | 3995 | GUUCGGUC AGAA GAGCUC ACCAGAGAAACACACGUUGUGGUACAUUACCUGGUA | 13401 |
| 2743 | GGCCUCU GAU GGUGAUCG | 3996 | CGAUCACC AGAA GAGGCC ACCAGAGAAACACACGUUGUGGUACAUUACCUGGUA | 13402 |
| 2779 | GAAACCU GUC CAACUACC | 3997 | GGUAGUUG AGAA GGUUUC ACCAGAGAAACACACGUUGUGGUACAUUACCUGGUA | 13403 |
| 2814 | UUAUUCU GUC UCAACAAG | 3998 | CUUGUUGA AGAA GAAUAA ACCAGAGAAACACACGUUGUGGUACAUUACCUGGUA | 13404 |

TABLE IX-continued

Mouse flt1 VEGF Receptor-Hairpin Ribozyme and Substrate Sequence

| Pos | Substrate | Seq ID No | HP Ribozyme | Seq ID No |
|---|---|---|---|---|
| 2831 | GGACGCA GCC UUGCAUAU | 3999 | AUAUGCAA AGAA GCGUCC ACCAGAGAAACACACGUUCUGGUACAUUACCUGGUA | 13405 |
| 2895 | AACCCCC CCC UAGACAGU | 4000 | ACUGUCUA AGAA GGGCUU ACCAGAGAAACACACGUUCUGGUACAUUACCUGGUA | 13406 |
| 2913 | GUCAGCA GCU CAACUGUC | 4001 | GACACUUG AGAA GCUGAC ACCAGAGAAACACACGUUCUGGUACAUUACCUGGUA | 13407 |
| 2928 | GUCACCA GCU CCACCUUC | 4002 | GAACCUGG AGAA GGUGAC ACCAGAGAAACACACGUUCUGGUACAUUACCUGGUA | 13408 |
| 2934 | AGCUCCA GCU UCCCUGAA | 4003 | UUCAGGGA AGAA GGAGCU ACCAGAGAAACACACGUUCUGGUACAUUACCUGGUA | 13409 |
| 3001 | CCAAGCA GCC CCUCACCA | 4004 | UGGUCACC AGAA GCUUCG ACCAGAGAAACACACGUUGUGGUACAUUACCUGGUA | 13410 |
| 3022 | AACACCU GAU UUCCUACA | 4005 | UGUAGGAA AGAA GGUCUU ACCAGACAAACACACGUUGUGGUACAUUACCUGGUA | 13411 |
| 3033 | UCCUACA GUU UCCAAGUG | 4006 | CACUUCGA AGAA GUAGGA ACCAGACAAACACACGUUGUGGUACAUUACCUGGUA | 13412 |
| 3064 | ACUUUCU GUC CUCCACAA | 4007 | UUCUGGAG AGAA GAAACU ACCAGACAAACACACGUUGUGGUACAUUACCUGGUA | 13413 |
| 3179 | GAACCCU GAU UAUGUGAG | 4008 | CUCACAUA AGAA GGCUUC ACCAGACAAACACACGUUCUGGUACAUUACCUGGUA | 10876 |
| 3357 | UUCUGCA GCC GCCUGAAG | 4009 | CUUCAGGC AGAA GCAGAA ACCAGACAAACACACGUUCUGGUACAUUACCUGGUA | 13414 |
| 3360 | UGCAGCC GCC UGAAGGAA | 4010 | UUCCUUCA AGAA GCUGCA ACCAGACAAACACACGUUCUGGUACAUUACCUGGUA | 13415 |
| 3379 | GCAUGCG GAU GAGAACCC | 4011 | GGGUUCUC AGAA GCAUGC ACCAGACAAACACACGUUCUGGUACAUUACCUGGUA | 13416 |
| 3463 | GGCCCCG GUU UGCUGAAC | 4012 | GUUCAGCA AGAA GGGGCC ACCAGACAAACACACGUUCUGGUACAUUACCUGGUA | 13417 |
| 3496 | GUGACCU GCU UCAAGCCA | 4013 | UGGCUUGA AGAA GGUCAC ACCAGACAAACACACGUUCUGGUACAUUACCUGGUA | 13418 |
| 3553 | CCAUACU GAC UAGAAACA | 4014 | UGUUUCUA AGAA GUAUGG ACCAGACAAACACACGUUCUGGUACAUUACCUGGUA | 13419 |
| 3615 | AAGGACG CU UUGCAGAU | 4015 | AUCUGCAA AGAA GUCCUU ACCAGAGAAACACACGUUGUGGUACAUUACCUGGUA | 13420 |
| 3623 | CUUUGCA GAU CCACAUUU | 4016 | AAAUGUGG AGAA GCAAAG ACCAGAGAAACACACGUUGUGGUACAUUACCUGGUA | 13421 |
| 3650 | AAGCUCU GAU GAUGUGAG | 4017 | CUCACAUC AGAA GAGCUU ACCAGAGAAACACACGUUGUGGUACAUUACCUGGUA | 13422 |
| 3754 | ACUAUCA GCU GGACACUA | 4018 | UAGUGUCC AGAA GAUAGU ACCAGAGAAACACACGUUGUGGUACAUUACCUGGUA | 13423 |
| 3772 | GCACUCU GCU GGGCUCCC | 4019 | GGGAGCCC AGAA GAGUGC ACCAGAGAAACACACGUUGUGGUACAUUACCUGGUA | 13424 |
| 3796 | UGAAGCG GUU CACCUGGA | 4020 | UCCAGGUG AGAA GCUUCA ACCAGAGAAACACACGUUGUGGUACAUUACCUGGUA | 13425 |
| 3881 | ACUUUCC GAU CUGCCGAG | 4021 | CUCGGCAG AGAA GAAAGU ACCAGAGAAACACACGUUGUGGUACAUUACCUGGUA | 13426 |
| 3886 | CCGAUCU GCC GAGGCCCA | 4022 | UGGGCCUC AGAA GAUCGG ACCAGAGAAACACACGUUGUGGUACAUUACCUGGUA | 13427 |
| 3897 | AGGCCCA GCU UCUGCUUC | 4023 | GAAGCAGA AGAA GGGCCU ACCAGAGAAACACACGUUGUGGUACAUUACCUGGUA | 13428 |
| 3903 | AGCUUCU GCU UCUCCAGC | 4024 | GCUGGAGA AGAA GAAGCU ACCAGAGAAACACACGUUGUGGUACAUUACCUGGUA | 13429 |
| 3912 | UUCUCCA GCU GUGGCCAC | 4025 | GUGGCCAC AGAA GGAGAA ACCAGAGAAACACACGUUGUGGUACAUUACCUGGUA | 13430 |
| 3969 | GAGUCCU GCU GUUCUCCA | 4026 | UGGAGAAC AGAA GGACUC ACCAGAGAAACACACGUUGUGGUACAUUACCUGGUA | 13431 |
| 3972 | UCCUGCU GUU CUCCACCC | 4027 | GGGUGGAG AGAA GCAGGA ACCAGAGAAACACACGUUGUGGUACAUUACCUGGUA | 13432 |
| 3986 | ACCCCCA GAC UACAACUC | 4028 | GAGUUGUA AGAA GGGGGU ACCAGAGAAACACACGUUGUGGUACAUUACCUGGUA | 13433 |
| 4018 | CCUCCCC GCC CGCCUAAA | 4029 | UUUAGGCG AGAA GGGAGG ACCAGAGAAACACACGUUGUGGUACAUUACCUGGUA | 13434 |
| 4022 | CCCGCCC GCC UAAAGCUU | 4030 | AAGCUUUA AGAA GGCGGG ACCAGAGAAACACACGUUGUGGUACAUUACCUGGUA | 13435 |
| 4040 | CUCACCA GCC CCGACAAC | 4031 | GUUGUCGG AGAA GGUGAG ACCAGAGAAACACACGUUGUGGUACAUUACCUGGUA | 13436 |
| 4053 | ACAACCA GCC CCUGACAG | 4032 | CUGUCAGG AGAA GGUUGU ACCAGAGAAACACACGUUGUGGUACAUUACCUGGUA | 13437 |
| 4095 | CUAUUCC GCU CCACAGGA | 4033 | UCCUGUGG AGAA GAAUAG ACCAGAGAAACACACGUUGUGGUACAUUACCUGGUA | 13438 |
| 4110 | GGAGCCA GCU GCUUUUCG | 4034 | CGAAAAGC AGAA GGCUCC ACCAGAGAAACACACGUUGUGGUACAUUACCUGGUA | 13439 |
| 4113 | GCCAGCU GCU UUUCGUGA | 4035 | UCACGAAA AGAA GCUGGC ACCAGAGAAACACACGUUGUGGUACAUUACCUGGUA | 13440 |

TABLE IX-continued

Mouse flt1 VEGF Receptor-Hairpin Ribozyme and Substrate Sequence

| Pos | Substrate | Seq ID No | HP Ribozyme | Seq ID No |
|---|---|---|---|---|
| 4168 | UGUUGCU GUU UUGACUAA | 4036 | UUAGUCAA AGAA GCAACA ACCAGAGAAACACACGUUGUGGUACAUUACCUGGUA | 13441 |
| 4290 | GGCGACC GCC CGCCCACC | 4037 | GGUGGGCG AGAA GUCGCC ACCAGAGAAACACACGUUGUGGUACAUUACCUGGUA | 13442 |
| 4294 | ACCGCCC GCC CACCGGCC | 4038 | GGCCGGUG AGAA GGCGGU ACCAGAGAAACACACGUUGUGGUACAUUACCUGGUA | 13443 |
| 4329 | CCCUGCA GCU GUGGGACU | 4039 | AGUCCCAC AGAA GCAGGG ACCAGAGAAACACACGUUGUGGUACAUUACCUGGUA | 13444 |
| 4378 | AUGCACU GAC CUGGUCUG | 4040 | CAGACCAG AGAA GUCCAG ACCAGAGAAACACACGUUGUGGUACAUUACCUGGUA | 13445 |
| 4383 | CUGACCU GCU CUGUCUCU | 4041 | AGAGACAG AGAA GGUCAG ACCAGAGAAACACACGUUGUGGUACAUUACCUGGUA | 13446 |
| 4388 | CUGCUCU GUC UCUCUUAU | 4042 | AUAAGAGA AGAA GAGCAG ACCAGAGAAACACACGUUGUGGUACAUUACCUGGUA | 13447 |
| 4457 | UGCGUCC GUC CUGUGGAG | 4043 | CUCCACAG AGAA GACGCA ACCAGAGAAACACACGUUGUGGUACAUUACCUGGUA | 13448 |
| 4525 | GGCCUCC GCU GUUUCGGG | 4044 | CCCGAAAC AGAA GAGGCC ACCAGAGAAACACACGUUGUGGUACAUUACCUGGUA | 13449 |
| 4528 | CUCCGCU GUU UCGGGCCC | 4045 | GGGCCCGA AGAA GCGGAG ACCAGAGAAACACACGUUGUGGUACAUUACCUGGUA | 13450 |
| 4643 | GUCUUCU GUU GUCUGUUU | 4046 | AAACAGAC AGAA GAAGAC ACCAGAGAAACACACGUUGUGGUACAUUACCUGGUA | 13451 |
| 4650 | GUUGUCU GUU UACCAUCC | 4047 | GGAUGGUA AGAA GACAAC ACCAGAGAAACACACGUUGUGGUACAUUACCUGGUA | 13452 |
| 4724 | AUCAUCA GUU CCUCUAGU | 4048 | ACUAGAGG AGAA GAUGAG ACCAGAGAAACACACGUUGUGGUACAUUACCUGGUA | 13453 |
| 4771 | CAGGCCU GAC CUUCGCAU | 4049 | AUGCGAAG AGAA GGCCUG ACCAGAGAAACACACGUUGUGGUACAUUACCUGGUA | 13454 |
| 4785 | GCAUACU GCU CACGGGGA | 4050 | UCCCCGUG AGAA GUAUGC ACCAGAGAAACACACGUUGUGGUACAUUACCUGGUA | 13455 |
| 4809 | UGGUCCA GUU UGGCCUAG | 4051 | CUAGGCCA AGAA GGACCA ACCAGAGAAACACACGUUGUGGUACAUUACCUGGUA | 13456 |
| 4834 | GCCUACU GAU GGGCUCAA | 4052 | UUGAGCCC AGAA GUAGGC ACCAGAGAAACACACGUUGUGGUACAUUACCUGGUA | 13457 |
| 4912 | UUAUCCU GUU UUAUAUAU | 4053 | AUAUAUAA AGAA GGAUAA ACCAGAGAAACACACGUUGUGGUACAUUACCUGGUA | 13458 |
| 5119 | CAAGGCA GUC UGAGAGGA | 4054 | UCCUCUCA AGAA GCCUUG ACCAGAGAAACACACGUUGUGGUACAUUACCUGGUA | 13459 |
| 5144 | AGUAUCA GCC CAUAUUUA | 4055 | UAAAUAUG AGAA GAUACU ACCAGAGAAACACACGUUGUGGUACAUUACCUGGUA | 13460 |
| 5287 | UUCAUCU GUU UCAUACCU | 4056 | AGGUAUGA AGAA GAUGAA ACCAGAGAAACACACGUUGUGGUACAUUACCUGGUA | 13461 |
| 5363 | GGUGCCC GCU CUUUGGGG | 4057 | CCCCAAAG AGAA GGCACC ACCAGAGAAACACACGUUGUGGUACAUUACCUGGUA | 13462 |
| 5462 | CACACCU GCC GGAGCCGG | 4058 | CCGGCUCC AGAA GGUGUG ACCAGAGAAACACACGUUGUGGUACAUUACCUGGUA | 13463 |
| 5478 | GGUCACA GCU GGGCAGAC | 4059 | GUCUGCCC AGAA GUGACC ACCAGAGAAACACACGUUGUGGUACAUUACCUGGUA | 13464 |
| 5486 | CUGGGCA GAC GAUGAAUA | 4060 | UAUUCAUC AGAA GCCCAG ACCAGAGAAACACACGUUGUGGUACAUUACCUGGUA | 13465 |
| 5500 | AAUAGCU GCU UUGGGAGA | 4061 | UCUCCCAA AGAA GCUAUU ACCAGAGAAACACACGUUGUGGUACAUUACCUGGUA | 13466 |
| 5539 | AUUCUCU GAC CGGGCCAG | 4062 | CUGGCCCG AGAA GAGAAU ACCAGAGAAACACACGUUGUGGUACAUUACCUGGUA | 13467 |
| 5564 | GGUACCU GCU CCCCUGUG | 4063 | CACAGGGG AGAA GGUACC ACCAGAGAAACACACGUUGUGGUACAUUACCUGGUA | 13468 |
| 5597 | GUUUUCU GUC UGAUGAGA | 4064 | UCUCAUCA AGAA GAAAAC ACCAGAGAAACACACGUUGUGGUACAUUACCUGGUA | 13469 |
| 5601 | UCUGUCU GAU GAGACUGG | 4065 | CCAGUCUC AGAA GACAGA ACCAGAGAAACACACGUUGUGGUACAUUACCUGGUA | 13470 |
| 5639 | UGAGACA GCC UGCAGCCC | 4066 | GGGCUGCA AGAA GUCUCA ACCAGAGAAACACACGUUGUGGUACAUUACCUGGUA | 13471 |
| 5646 | GCCUGCA GCC CACUGUGG | 4067 | CCACAGUG AGAA GCAGGC ACCAGAGAAACACACGUUGUGGUACAUUACCUGGUA | 13472 |
| 5781 | CUUGUCG GCU GCAGUGUG | 4068 | CACACUGC AGAA GACAAG ACCAGAGAAACACACGUUGUGGUACAUUACCUGGUA | 13473 |
| 5829 | AGAAACG GAU GAGAACAG | 4069 | CUGUUCUC AGAA GUUUCU ACCAGAGAAACACACGUUGUGGUACAUUACCUGGUA | 13474 |
| 5842 | AACAGCA GCC UGAGGUUU | 4070 | AAACCUCA AGAA GCUGUU ACCAGAGAAACACACGUUGUGGUACAUUACCUGGUA | 13475 |
| 5915 | UUAUUCC GAU UUUAAUAA | 4071 | UUAUUAAA AGAA GAAUAA ACCAGAGAAACACACGUUGUGGUACAUUACCUGGUA | 13476 |

TABLE IX-continued

Mouse flt1 VEGF Receptor-Hairpin Ribozyme and Substrate Sequence

| Pos | Substrate | Seq ID No | HP Ribozyme | Seq ID No |
|---|---|---|---|---|
| 6010 | UGGUUCU GCU UAAAGACU | 4072 | AGUCUUUA AGAA GAACCA ACCAGAGAAACACACGUUGUGGUACAUUACCUGGUA | 13477 |

TABLE X

Homologous Hammerhead Ribozyme Target Sites Between Human flt-1 and KDR RNA

| nt. Position | flt-1 Target Sequence | Seq ID No | nt. Position | KDR Target Sequence | Seq ID No |
|---|---|---|---|---|---|
| 3388 | CCGGGAU A UUUAUAA | 4073 | 3151 | CCGGGAU A UUUAUAA | 4073 |
| 2174 | AAUGUAU A CACAGGG | 4074 | 3069 | AgUGUAU c CACAGGG | 4116 |
| 2990 | UCCAAAU A UGGAAAU | 4075 | 2756 | UGCAAAU u UGGAAAc | 4117 |
| 2693 | CUCCCUU A UGAUGCC | 4076 | 2459 | CUgCCUU A UGAUGCC | 4118 |
| 2981 | GUUGAAU A CUGCAAA | 4077 | 2747 | GUgGAAU u CUGCAAA | 4119 |
| 1359 | UAUGGUU A AAAGAUG | 4078 | 2097 | U9UGGUU u AAAGAUa | 4120 |
| 3390 | GGGAUAU U UAUAAGA | 4079 | 3153 | GGGAUAU U UAUAAag | 4121 |
| 3391 | GGAUAUU U AUAAGAA | 4080 | 3154 | GGAUAUU U AUAAagA | 4122 |
| 2925 | ACGUGGU U AACCUGC | 4081 | 2691 | AuGUGGU c AACCUuC | 4123 |
| 7140 | UAUUUCU A GUCAUGA | 4082 | 2340 | UAcUUCU u GUCAUCA | 4124 |
| 1785 | CAAUAAU A GAAGGAA | 4083 | 1515 | CucUAAU U GAAGGAA | 4125 |
| 2731 | GAGACUU A AACUGGG | 4084 | 768 | uuGACUU c AACUGGG | 4126 |
| 3974 | GAUGACU A CCAGGGC | 4085 | 1466 | GAgGACU u CCAGGGa | 4127 |
| 6590 | UUAAUGU A GAAAGAA | 4086 | 2603 | aaAAUGU u GAAAGAA | 4128 |
| 6705 | GCCAUUU A UGACAAA | 4087 | 3227 | aCaAUUU u UGACAgA | 4129 |
| 974 | GUCAAAU U ACUUAGA | 4088 | 147 | uUCAAAU U ACUUgcA | 4130 |
| 1872 | AUAAAGU U GGGACUG | 4089 | 1602 | ACAAAGU c GGGAgaG | 4131 |
| 2333 | ACUUGGU U UAAAAAC | 4090 | 1088 | AaaUGGU a UAAAAAu | 4132 |
| 2775 | AAGUGGU U CAAGCAU | 4091 | 1745 | AcaUGGU a CAAGCuU | 4133 |
| 3533 | UUCUCCU U AGGUGGG | 4092 | 3296 | UUuUCCU U AGGUGcu | 4134 |
| 3534 | UCUCCUU A GGUGGGU | 4093 | 3297 | UuUCCUU A GGUGcuU | 4135 |
| 3625 | GUACUCU A CUCCUGA | 4094 | 4054 | GagCUCU c CUCCUGu | 4136 |
| 1814 | AGCACCU U GGUUGUG | 4095 | 1059 | AGuACCU U GGUUacc | 4137 |
| 2744 | GGCAAAU C ACUUGGA | 4096 | 147 | uuCAAAU u ACUUGcA | 4130 |
| 2783 | CAAGCAU C AGCAUUU | 4097 | 796 | gAAGCAU C AGCAUaa | 4138 |
| 3613 | GAGAGCU C CUGAGGA | 4098 | 2968 | GgaAGCU C CUGAagA | 4139 |
| 4052 | AAGGCCU C GCUCAAG | 4099 | 1923 | ucuGCCU u GCUCAAG | 4140 |
| 5305 | UCUCCAU A UCAAAAC | 4100 | 456 | ggUCCAU u UCAAAuC | 4141 |
| 7155 | AUGUAUU U UGUAUAC | 4101 | 631 | gUcUAUU a UGUAcAu | 4142 |
| 1836 | CUAGAAU U UCUGGAA | 4102 | 1007 | aUgGAAU c UCUGGug | 4143 |

TABLE X-continued

Homologous Hammerhead Ribozyme Target Sites Between Human flt-1 and KDR RNA

| nt. Position | flt-1 Target Sequence | Seq ID No | nt. Position | KDR Target Sequence | Seq ID No |
|---|---|---|---|---|---|
| 2565 | CUCUCUU C UGGCUCC | 4103 | 2328 | uguUCUU C UGGCUaC | 4144 |
| 4250 | CUGUACU C CACCCCA | 4104 | 3388 | uUaUACU a CACCagA | 4145 |
| 7124 | ACAUGGU U UGGUCCU | 4105 | 3778 | cagUGGU a UGGUuCU | 4146 |
| 436 | AUGGUCU U UGCCUGA | 4106 | 1337 | AcGGUCU a UGCCauu | 4147 |
| 2234 | GCACCAU A CCUCCUG | 4107 | 1344 | augCCAU u CCUCCcc | 4148 |
| 2763 | GGGCUUU U GGAAAAG | 4108 | 990 | uuGCUUU U GGAAgUG | 4149 |
| 4229 | CCAGACU A CAACUCG | 4109 | 767 | auuGACU u CAACUgG | 4150 |
| 5301 | GUUUUCU C CAUAUCA | 4110 | 3307 | ugcUUCU C CAUAUCc | 4151 |
| 6015 | AGAAUGU A UGCCUCU | 4111 | 1917 | AcuAUGU c UGCCUug | 4152 |
| 6095 | AUUCCCU A GUGAGCC | 4112 | 1438 | AUaCCCU u GUGAaya | 4153 |
| 6236 | UGUUGUU C CUCUUCU | 4113 | 76 | UagUGUU u CUCUUga | 4154 |
| 5962 | GCUUCCU U UUAUCCA | 4114 | 3099 | auaUCCU c UUAUCgg | 4155 |
| 7629 | UAUAUAU U CUCUGCU | 4115 | 3096 | gAaAUAU c CUCUuaU | 4156 |

Lowercase letters are used to represent sequence variance between flt-1 and KDR RNA

TABLE XI

| Reagent | Equivalents | Amount | Wait Time* DNA | Wait Time* 2'-O-methyl | Wait Time* RNA |
|---|---|---|---|---|---|
| A. 2.5 μmol Synthesis Cycle ABI 394 Instrument | | | | | |
| Phosphoramidites | 6.5 | 163 μL | 45 sec | 2.5 min | 7.5 min |
| S-Ethyl Tetrazole | 23.8 | 238 μL | 45 sec | 2.5 min | 7.5 min |
| Acetic Anhydride | 100 | 233 μL | 5 sec | 5 sec | 5 sec |
| N-Methyl Imidazole | 186 | 233 μL | 5 sec | 5 sec | 5 sec |
| TCA | 176 | 2.3 mL | 21 sec | 21 sec | 21 sec |
| Iodine | 11.2 | 1.7 mL | 45 sec | 45 sec | 45 sec |
| Beaucage | 12.9 | 645 μL | 100 sec | 300 sec | 300 sec |
| Acetonitrile | NA | 6.67 mL | NA | NA | NA |
| B. 0.2 μmol Synthesis Cycle ABI 394 Instrument | | | | | |
| Phosphoramidites | 15 | 31 μL | 45 sec | 233 sec | 465 sec |
| S-Ethyl Tetrazole | 38.7 | 31 μL | 45 sec | 233 min | 465 sec |
| Acetic Anhydride | 655 | 124 μL | 5 sec | 5 sec | 5 sec |
| N-Methyl Imidazole | 1245 | 124 μL | 5 sec | 5 sec | 5 sec |
| TCA | 700 | 732 μL | 10 sec | 10 sec | 10 sec |
| Iodine | 20.6 | 244 μL | 15 sec | 15 sec | 15 sec |
| Beaucage | 7.7 | 232 μL | 100 sec | 300 sec | 300 sec |
| Acetonitrile | NA | 2.64 mL | NA | NA | NA |

| Reagent | Equivalents DNA/2'-O-methyl/Ribo | Amount DNA/2'-O-methyl/Ribo | Wait Time* DNA | Wait Time* 2'-O-methyl | Wait Time* Ribo |
|---|---|---|---|---|---|
| C. 0.2 μmol Synthesis Cycle 96 well Instrument | | | | | |
| Phosphoramidites | 22/33/66 | 40/60/120 μL | 60 sec | 180 sec | 360 sec |
| S-Ethyl Tetrazole | 70/105/210 | 40/60/120 μL | 60 sec | 180 min | 360 sec |
| Acetic Anhydride | 265/265/265 | 50/50/50 μL | 10 sec | 10 sec | 10 sec |
| N-Methyl Imidazole | 502/502/502 | 50/50/50 μL | 10 sec | 10 sec | 10 sec |
| TCA | 238/475/475 | 250/500/500 μL | 15 sec | 15 sec | 15 sec |
| Iodine | 6.8/6.8/6.8 | 80/80/80 μL | 30 sec | 30 sec | 30 sec |
| Beaucage | 34/51/51 | 80/120/120 | 100 sec | 200 sec | 200 sec |
| Acetonitrile | NA | 1150/1150/1150 μL | NA | NA | NA |

*Wait time does not include contact time during delivery.

TABLE XII

Ribozyme and attenuated control sequences and locations of modified nucleotides.

| Target Site* | RPI No. | Ribozyme Sequence†(5'–3') | Activity | Seq. ID No. |
|---|---|---|---|---|
| Flt-1358-amino | RPI 4118 | 5' $a_s u_s c_s u_s$uuu cUGAUGaggcgaaagccGaa AccauacB 3' | Active | 13478 |
| Flt-1358-amino (att.) | RPI 4581 | $a_s u_s c_s u_s$uuu cU<u>u</u>AUGaggcgaaagccGa<u>u</u> AccauacB | Attenuated | 13479 |
| Flt-1358-allyl | RPI 4159 | 5' $a_s u_s c_s U_s$uuu cUGAuGaggcgaaagccGaa AccauacB 3' | Active | 13480 |
| Flt-1358-allyl (att.) | RPI 4583 | $a_s u_s c_s u_s$uuu cU<u>u</u>AuGaggcgaaagccGa<u>u</u> AccauacB | Attenuated | 13481 |
| Flt-4229-amino | RPI 4131 | $g_s a_s g_s u_s$ug cUGAUGaggcgaaagccGaa AgucugB | Active | 13482 |
| Flt-4229-amino (att.) | RPI 4582 | $g_s a_s g_s u_s$ug cU<u>u</u>AUGaggcgaaagccGa<u>u</u> AgucugB | Attenuated | 13483 |
| Flt-4229-allyl | RPI 4172 | $g_s a_s g_s u_s$ug cUGAuGaggcgaaagccGaa AgucugB | Active | 13484 |
| Flt-4229-allyl (att.) | RPI 4584 | $g_s a_s g_s u_s$ug cU<u>U</u>AuGaggcgaaagccGa<u>u</u> AgucugB | Attenuated | 13485 |
| KDR-726-amino | RPI 4097 | $u_s a_s c_s a_s$auu cUGAUCaggcgaagccGaa AagacaaB | Active | 13486 |
| KDR-726-amino (att.) | RPI 4674 | $u_s a_s c_s a_s$auu cU<u>u</u>AUGaggcgaaagccGa<u>u</u> Aagacaab | Attenuated | 13487 |
| KDR-726-allyl | RPI 4138 | $u_s a_s c_s a_s$auu cUGAuGaggcgaaagccGaa AagacaaB | Active | 13488 |
| KDR-726allyl (att.) |  | $u_s a_s c_s a_s$auu cUuAuGaggcgaagccGau AagacaaB | Attenuated | 13489 |
| KDR-3950-amino | RPI 4110 | $c_s u_s g_s g_s$ag cUGAUGaggcgaaagccGaa AcacggB | Active | 13490 |
| KDR-3950-amino (att.) | RPI 4677 | $c_s u_s g_s g_s$ag cUuAUGaggcgaaagccGau AcacggB | Attenuated | 13491 |
| KDR-3950-allyl | RPI 4151 | $c_s u_s g_s g_s$ag cUcAuGaggcgaaagccGaa AcacggB | Active | 13492 |
| KDR-3950-allyl (att.) |  | $c_s u_s g_s g_s$ag cUuAuGaggcgaaagccGau AcacggB | Attenuated | 13493 | binding arm/catalytic core & stem II/binding arm

*Ribozyme target sites are named according to the cleavage position in human Flt-1 (EMBL accession no. X51602) or human KDR mRNA (EMBL accession no. L0497).
† Modifications are indicated as follows: 2'-O-methyl nucleotides, lowercase; ribonucleotides, uppercase G, A; inverted 3'-3'deoxyabasic, B. Two ribozyme motifs were tested[23]. For the $NH_2$-modified ribozymes, U indicates the two core positions where 2'-$NH_2$ uridines are present. U indicates 2'-C-allyl-uridine modification. The positions of four phosphorothioate linkages at the 5' end are indicated by a subscript "s". Changes in the attenuated controls are underlined. Nucleotides comprising the base paired region of stem II are in *italics*. A 3 bp stem II is shown above. Ribozymes or attenuated controls referred to in the text with a 4 bp stem II have one additional base pair such that the stem II/loop sequence is ggccgaaaggcc. (SEQ ID NO. 20823)

TABLE XIII

Ribozyme and attenuated control sequences with locations of modified nucleotides.

| Ribozyme | Sequence† (5'—3') | Activity | Seq ID Nos. |
|---|---|---|---|
| RPI.4610 (ANGIOZYME ™) | $g_s a_s g_s u_s$ug cUGAuGaggccgaaaggccGaa AgucugB | Active | 13494 |
| RPI.13141 | $g_s a_s g_s u_s$ug cUAGaGaggccgaaaggccGau AgucugB | BAC‡ | 13495 |
| RPI.13030 | $g_s a_s a_s g_s$gu cUAGuGaggccgaaaggccGau AugucB binding arm/core & stem II/binding arm | BAC* | 13496 |

†Modifications are indicated as follows: 2'-O-methyl nucleotides, lowercase; ribonucleotides, uppercase G, A; 2'-C-allyl uridine, U; inverted 3'-3' deoxyabasic, B. The positions of four phosphorothioate linkages at the 5' end are indicated by a subscript "s". Nucleotides comprising the base paired region of stem II are in *italics*. Nucleotide changes in the core of the attenuated controls are underlined. ANGIOZYME ribozyme is targeted to cleave site 4229 in human flt-1 RNA and is identical to Flt-4229-allyl ribozyme (Table XII) except that the ANGIOZYME has a stem II of length 4 bps.
‡BAc: Binding arm, Attenuated core Control.
*SAC: Scrambled arm, Attenuated core Control.

TABLE XIV

NCH Ribozyme and Target Sequences

| Pos | Target | Seq ID No | NCH Ribozyme | Seq ID No |
|---|---|---|---|---|
| 9 | GCGGACAC U CCUCUCGG | 4157 | CCGAGAGG CUGAUGAGGCCGUUAGGCCGAA IUGUCCGC | 13497 |
| 11 | GGACACUC C UCUCGGCU | 4158 | AGCCGAGA CUGAUGAGGCCGUUAGGCCGAA IAGUGUCC | 13498 |
| 12 | GACACUCC U CUCGGCUC | 4159 | GAGCCGAG CUGAUGAGGCCGUUAGGCCGAA IGAGUGUC | 13499 |
| 14 | CACUCCUC U CGGCUCCU | 4160 | AGGAGCCG CUGAUGAGGCCGUUAGGCCGAA IAGGAGUG | 13500 |
| 19 | CUCUCGGC U CCUCCCCG | 4161 | CGGGGAGG CUGAUGAGGCCGUUAGGCCGAA ICCGAGAG | 13501 |
| 21 | CUCGGCUC C UCCCCGGC | 4162 | GCCGGGGA CUGAUGAGGCCGUUAGGCCGAA IAGCCGAG | 13502 |
| 22 | UCGGCUCC U CCCCGGCA | 4163 | UGCCGGGG CUGAUGAGGCCGUUAGGCCGAA IGAGCCGA | 13503 |
| 24 | GGCUCCUC C CCGGCAGC | 4164 | GCUGCCGG CUGAUGAGGCCGUUAGGCCGAA IAGGAGCC | 13504 |
| 25 | GCUCCUCC C CGGCAGCG | 4165 | CGCUGCCG CUGAUGAGGCCGUUAGGCCGAA IGAGGAGC | 13505 |
| 26 | CUCCUCCC C GGCAGCGG | 4166 | CCGCUGCC CUGAUGAGGCCGUUAGGCCGAA IGGAGGAG | 13506 |
| 30 | UCCCCGGC A GCGGCGGC | 4167 | GCCGCCGC CUGAUGAGGCCGUUAGGCCGAA ICCGGGGA | 13507 |
| 42 | GCGGCGGC U CGGAGCGG | 4168 | CCGCUCCG CUGAUGAGGCCGUUAGGCCGAA ICCGCCGC | 13508 |
| 53 | GAGCGGGC U CCGGGGCU | 4169 | AGCCCCGG CUGAUGAGGCCGUUAGGCCGAA ICCCGCUC | 13509 |
| 55 | GCGGGCUC C GGGGCUCG | 4170 | CGAGCCCC CUGAUGAGGCCGUUAGGCCGAA IAGCCCGC | 13510 |
| 61 | UCCGGGGC U CGGGUGCA | 4171 | UGCACCCG CUGAUGAGGCCGUUAGGCCGAA ICCCCGGA | 13511 |
| 69 | UCGGGUGC A GCGGCCAG | 4172 | CUGGCCGC CUGAUGAGGCCGUUAGGCCGAA ICACCCGA | 13512 |
| 75 | GCAGCGGC C AGCGGGCC | 4173 | GGCCCGCU CUGAUGAGGCCGUUAGGCCGAA ICCGCUGC | 13513 |
| 76 | CAGCGGCC A GCGGGCCU | 4174 | AGGCCCGC CUGAUGAGGCCGUUAGGCCGAA IGCCGCUG | 13514 |
| 83 | CAGCGGGC C UGGCGGCG | 4175 | CGCCGCCA CUGAUGAGGCCGUUAGGCCGAA ICCCGCUG | 13515 |
| 84 | AGCGGGCC U GGCGGCGA | 4176 | UCGCCGCC CUGAUGAGGCCGUUAGGCCGAA IGCCCGCU | 13516 |
| 100 | AGGAUUAC C CGGGGAAG | 4177 | CUUCCCCG CUGAUGAGGCCGUUAGGCCGAA IUAAUCCU | 13517 |
| 101 | GGAUUACC C GGGGAAGU | 4178 | ACUUCCCC CUGAUGAGGCCGUUAGGCCGAA IGUAAUCC | 13518 |
| 117 | UGGUUGUC U CCUGGCUG | 4179 | CAGCCAGG CUGAUGAGGCCGUUAGGCCGAA IACAACCA | 13519 |
| 119 | GUUGUCUC C UGGCUGGA | 4180 | UCCAGCCA CUGAUGAGGCCGUUAGGCCGAA IAGACAAC | 13520 |
| 120 | UUGUCUCC U GGCUGGAG | 4181 | CUCCAGCC CUGAUGAGGCCGUUAGGCCGAA IGAGACAA | 13521 |
| 124 | CUCCUGGC U GGAGCCGC | 4182 | GCGGCUCC CUGAUGAGGCCGUUAGGCCGAA ICCAGGAG | 13522 |
| 130 | GCUGGAGC C GCGAGACG | 4183 | CGUCUCGC CUGAUGAGGCCGUUAGGCCGAA ICUCCAGC | 13523 |
| 144 | ACGGGCGC U CAGGCGC | 4184 | GCGCCCUG CUGAUGAGGCCGUUAGGCCGAA ICGCCCGU | 13524 |
| 146 | GGGCGCUC A GGCGCGG | 4185 | CCGCGCCC CUGAUGAGGCCGUUAGGCCGAA IAGCGCCC | 13525 |
| 158 | CGCGGGGC C GGCGGCGG | 4186 | CCGCCGCC CUGAUGAGGCCGUUAGGCCGAA ICCCCGCG | 13526 |
| 184 | GGACGGAC U CUGGCGGC | 4187 | GCCGCCAG CUGAUGAGGCCGUUAGGCCGAA IUCCGUCC | 13527 |
| 186 | ACGGACUC U GCGGCCG | 4188 | CGGCCGCC CUGAUGAGGCCGUUAGGCCGAA IAGUCCGU | 13528 |
| 193 | CUGGCGGC C GGGUCGUU | 4189 | AACGACCC CUGAUGAGGCCGUUAGGCCGAA ICCGCCAG | 13529 |
| 205 | UCGUUGGC C GGGGAGC | 4190 | GCUCCCCC CUGAUGAGGCCGUUAGGCCGAA ICCAACGA | 13530 |
| 220 | GCGCGGGC A CCGGGCGA | 4191 | UCGCCCGG CUGAUGAGGCCGUUAGGCCGAA ICCCGCGC | 13531 |
| 222 | GCGGGCAC C GGGCGAGC | 4192 | GCUCGCCC CUGAUGAGGCCGUUAGGCCGAA IUGCCCGC | 13532 |
| 231 | GGGCGAGC A GGCCGCGU | 4193 | ACGCGGCC CUGAUGAGGCCGUUAGGCCGAA ICUCGCCC | 13533 |

TABLE XIV-continued

NCH Ribozyme and Target Sequences

| Pos | Target | Seq ID No | NCH Ribozyme | Seq ID No |
|-----|--------|-----------|--------------|-----------|
| 235 | GAGCAGGC C GCGUCGCG | 4194 | CGCGACGC CUGAUGAGGCCGUUAGGCCGAA ICCUGCUC | 13534 |
| 245 | CGUCGCGC U CACCAUGG | 4195 | CCAUGGUG CUGAUGAGGCCGUUAGGCCGAA ICGCGACG | 13535 |
| 247 | UCGCGCUC A CCAUGGUC | 4196 | GACCAUGG CUGAUGAGGCCGUUAGGCCGAA IAGCGCGA | 13536 |
| 249 | GCGCUCAC C AUGGUCAG | 4197 | CUGACCAU CUGAUGAGGCCGUUAGGCCGAA IUGAGCGC | 13537 |
| 250 | CGCUCACC A UGGUCAGC | 4198 | GCUGACCA CUGAUGAGGCCGUUAGGCCGAA IGUGAGCG | 13538 |
| 256 | CCAUGGUC A GCUACUGG | 4199 | CCAGUAGC CUGAUGAGGCCGUUAGGCCGAA IACCAUGG | 13539 |
| 259 | UGGUCAGC U ACUGGGAC | 4200 | GUCCCAGU CUGAUGAGGCCGUUAGGCCGAA ICUGACCA | 13540 |
| 262 | UCAGCUAC U GGGACACC | 4201 | GGUGUCCC CUGAUGAGGCCGUUAGGCCGAA IUAGCUGA | 13541 |
| 268 | ACUGGGAC A CCGGGGUC | 4202 | GACCCCGG CUGAUGAGGCCGUUAGGCCGAA IUCCCAGU | 13542 |
| 270 | UGGGACAC C GCGGUCCU | 4203 | AGGACCCC CUGAUGAGGCCGUUAGGCCGAA IGUCCCA | 13543 |
| 277 | CCGGGGUC C UGCUGUGC | 4204 | GCACAGCA CUGAUGAGGCCGUUAGGCCGAA IACCCCGG | 13544 |
| 278 | CGGGGUCC U GCUGUGCG | 4205 | CGCACAGC CUGAUGAGGCCGUUAGGCCGAA IGACCCCG | 13545 |
| 281 | GGUCCUGC U GUGCGCGC | 4206 | GCGCGCAC CUGAUGAGGCCGUUAGGCCGAA ICAGGACC | 13546 |
| 290 | GUGCGCGC U GCUCAGCU | 4207 | AGCUGAGC CUGAUGAGGCCGUUAGCCCGAA ICGCGCAC | 13547 |
| 293 | CGCGCUGC U CAGCUGUC | 4208 | GACAGCUG CUGAUGAGGCCGUUAGGCCGAA ICAGCGCG | 13548 |
| 295 | CGCUGCUC A GCUGUCUG | 4209 | CAGACAGC CUGAUGAGGCCGUUAGGCCGAA IAGCAGCG | 13549 |
| 298 | UGCUCAGC U GUCUGCUU | 4210 | AAGCAGAC CUGAUGAGGCCGUUAGGCCGAA ICUGAGCA | 13550 |
| 302 | CAGCUGUC U GCUUCUCA | 4211 | UGAGAAGC CUGAUGAGGCCGUUAGCCCGAA IACAGCUG | 13551 |
| 305 | CUGUCUGC U UCUCACAG | 4212 | CUGUGAGA CUGAUGAGGCCGUUAGGCCGAA ICAGACAG | 13552 |
| 308 | UCUGCUUC U CACAGGAU | 4213 | AUCCUGUG CUGAUGAGGCCGUUAGGCCGAA IAAGCAGA | 13553 |
| 310 | UGCUUCUC A CAGGAUCU | 4214 | AGAUCCUG CUGAUGAGGCCGUUAGGCCGAA IAGAAGCA | 13554 |
| 312 | CUUCUCAC A GGAUCUAG | 4215 | CUAGAUCC CUGAUGAGGCCGUUAGGCCGAA IUGAGAAG | 13555 |
| 318 | ACAGGAUC U AGUUCAGG | 4216 | CCUGAACU CUGAUGAGGCCGUUAGGCCGAA IAUCCUGU | 13556 |
| 324 | UCUAGUUC A GGUUCAAA | 4217 | UUUGAACC CUGAUGAGGCCGUUAGGCCGAA IAACUAGA | 13557 |
| 330 | UCAGGUUC A AAAUUAAA | 4218 | UUUAAUUU CUGAUGAGGCCGUUAGGCCGAA IAACCUGA | 13558 |
| 344 | AAAAGAUC C UGAACUGA | 4219 | UCAGUUCA CUGAUGAGGCCGUUAGGCCGAA IAUCUUUU | 13559 |
| 345 | AAAGAUCC U GAACUGAG | 4220 | CUCAGUUC CUGAUGAGGCCGUUAGGCCGAA IGAUCUUU | 13560 |
| 350 | UCCUGAAC U GAGUUUAA | 4221 | UUAAACUC CUGAUGAGGCCGUUAGGCCGAA IUUCAGGA | 13561 |
| 364 | UAAAAGGC A CCCAGCAC | 4222 | GUGCUGGG CUGAUGAGGCCGUUAGGCCGAA ICCUUUUA | 13562 |
| 366 | AAAGGCAC C CAGCACAU | 4223 | AUGUGCUG CUGAUGAGGCCGUUAGGCCGAA IUGCCUUU | 13563 |
| 367 | AAGGCACC C AGCACAUC | 4224 | GAUGUGCU CUGAUGAGGCCGUUAGGCCGAA IGUGCCUU | 13564 |
| 368 | AGGCACCC A GCACAUCA | 4225 | UGAUGUGC CUGAUGAGGCCGUUAGGCCGAA IGGUGCCU | 13565 |
| 371 | CACCCAGC A CAUCAUGC | 4226 | GCAUGAUG CUGAUGAGGCCGUUAGGCCGAA ICUGGGUG | 13566 |
| 373 | CCCAGCAC A UCAUGCAA | 4227 | UUGCAUGA CUGAUGAGGCCGUUAGGCCGAA IUGCUGGG | 13567 |
| 376 | AGCACAUC A UGCAAGCA | 4228 | UGCUUGCA CUGAUGAGGCCGUUAGGCCGAA IAUGUGCU | 13568 |
| 380 | CAUCAUGC A AGCAGGCC | 4229 | GGCCUGCU CUGAUGAGGCCGUUAGGCCGAA ICAUGAUG | 13569 |
| 384 | AUGCAAGC A GGCCAGAC | 4230 | GUCUGGCC CUGAUGAGGCCGUUAGGCCGAA ICUUGCAU | 13570 |

TABLE XIV-continued

NCH Ribozyme and Target Sequences

| Pos | Target | Seq ID No | NCH Ribozyme | Seq ID No |
|---|---|---|---|---|
| 388 | AAGCAGGC C AGACACUG | 4231 | CAGUGUCU CUGAUGAGGCCGUUAGGCCGAA ICCUGCUU | 13571 |
| 389 | AGCAGGCC A GACACUGC | 4232 | GCAGUGUC CUGAUGAGGCCGUUAGGCCGAA IGCCUGCU | 13572 |
| 393 | GGCCAGAC A CUGCAUCU | 4233 | AGAUGCAG CUGAUGAGGCCGUUAGGCCGAA IUCUGGCC | 13573 |
| 395 | CCAGACAC U GCAUCUCC | 4234 | GGAGAUGC CUGAUGAGGCCGUUAGGCCGAA IUGUCUGG | 13574 |
| 398 | GACACUGC A UCUCCAAU | 4235 | AUUGGAGA CUGAUGAGGCCGUUAGGCCGAA ICAGUGUC | 13575 |
| 401 | ACUGCAUC U CCAAUGCA | 4236 | UGCAUUGG CUGAUGAGGCCGUUAGGCCGAA IAUGCAGU | 13576 |
| 403 | UGCAUCUC C AAUGCAGG | 4237 | CCUGCAUU CUGAUGAGGCCGUUAGGCCGAA IAGAUGCA | 13577 |
| 404 | GCAUCUCC A AUGCAGGG | 4238 | CCCUGCAU CUGAUGAGGCCGUUAGGCCGAA IGAGAUGC | 13578 |
| 409 | UCCAAUGC A GGGGGAA | 4239 | UUCCCCCC CUGAUGAGGCCGUUAGGCCGAA ICAUUGGA | 13579 |
| 420 | GGGGAAGC A GCCCAUAA | 4240 | UUAUGGGC CUGAUGAGGCCGUUAGGCCGAA ICUUCCCC | 13580 |
| 423 | GAAGCAGC C CAUAAAUG | 4241 | CAUUUAUG CUGAUGAGGCCGUUAGGCCGAA ICUGCUUC | 13581 |
| 424 | AAGCAGCC C AUAAAUGG | 4242 | CCAUUUAU CUGAUGAGGCCGUUAGGCCGAA IGCUGCUU | 13582 |
| 425 | AGCAGCCC A UAAAUGGU | 4243 | ACCAUUUA CUGAUGAGGCCGUUAGGCCGAA IGGCUGCU | 13583 |
| 435 | AAAUGGUC U UUGCCUGA | 4244 | UCAGGCAA CUGAUGAGGCCGUUAGGCCGAA IACCAUUU | 13584 |
| 440 | GUCUUUGC C UGAAAUGG | 4245 | CCAUUUCA CUGAUGAGGCCGUUAGGCCGAA ICAAAGAC | 13585 |
| 441 | UCUUUGCC U GAAAUGGU | 4246 | ACCAUUUC CUGAUGAGGCCGUUAGGCCGAA IGCAAAGA | 13586 |
| 470 | CGAAAGGC U GAGCAUAA | 4247 | UUAUGCUC CUGAUGAGGCCGUUAGGCCGAA ICCUUUCG | 13587 |
| 475 | GGCUGAGC A UAACUAAA | 4248 | UUUAGUUA CUGAUGAGGCCGUUAGGCCGAA ICUCAGCC | 13588 |
| 480 | AGCAUAAC U AAAUCUGC | 4249 | GCAGAUUU CUGAUGAGGCCGUUAGGCCGAA IUUAUGCU | 13589 |
| 486 | ACUAAAUC U GCCUGUGG | 4250 | CCACAGGC CUGAUGAGGCCGUUAGGCCGAA IAUUUAGU | 13590 |
| 489 | AAAUCUGC C UGUGGAAG | 4251 | CUUCCACA CUGAUGAGGCCGUUAGGCCGAA ICAGAUUU | 13591 |
| 490 | AAUCUGCC U GUGGAAGA | 4252 | UCUUCCAC CUGAUGAGGCCGUUAGGCCGAA IGCAGAUU | 13592 |
| 505 | GAAAUGGC A AACAAUUC | 4253 | GAAUUGUU CUGAUGAGGCCGUUAGGCCGAA ICCAUUUC | 13593 |
| 509 | UGGCAAAC A AUUCUGCA | 4254 | UGCAGAAU CUGAUGAGGCCGUUAGGCCGAA IUUUGCCA | 13594 |
| 514 | AACAAUUC U GCAGUACU | 4255 | AGUACUGC CUGAUGAGGCCGUUAGGCCGAA IAAUUGUU | 13595 |
| 517 | AAUUCUGC A GUACUUUA | 4256 | UAAAGUAC CUGAUGAGGCCGUUAGGCCGAA ICAGAAUU | 13596 |
| 522 | UGCAGUAC U UUAACCUU | 4257 | AAGGUUAA CUGAUGAGGCCGUUAGGCCGAA IACUGCA | 13597 |
| 528 | ACUUAAC C UUGAACAC | 4258 | CUGUUCAA CUGAUGAGGCCGUUAGGCCGAA IUUAAAGU | 13598 |
| 529 | CUUUAACC U UGAACACA | 4259 | UGUGUUCA CUGAUGAGGCCGUUAGGCCGAA IGUUAAAG | 13599 |
| 535 | CCUUGAAC A CAGCUCAA | 4260 | UUGAGCUG CUGAUGAGGCCGUUAGGCCGAA IUUCAAGG | 13600 |
| 537 | UUGAACAC A GCUCAAGC | 4261 | GCUUGAGC CUGAUGAGGCCGUUACGCCGAA IUGUUCAA | 13601 |
| 540 | AACACAGC U CAAGCAAA | 4262 | UUUGCUUG CUGAUGAGGCCGUUAGGCCGAA ICUGUGUU | 13602 |
| 542 | CACAGCUC A AGCAAACC | 4263 | GGUUUGCU CUGAUGAGGCCGUUAGGCCGAA IAGCUGUG | 13603 |
| 546 | GCUCAAGC A AACCACAC | 4264 | GUGUGGUU CUGAUCAGGCCGUUAGGCCGAA ICUUGAGC | 13604 |
| 550 | AAGCAAAC C ACACUGGC | 4265 | GCCAGUGU CUGAUGAGGCCGUUAGGCCGAA IUUUGCUU | 13605 |
| 551 | AGCAAACC A CACUGGCU | 4266 | AGCCAGUG CUGAUGAGGCCGUUAGGCCGAA IGUUUGCU | 13606 |
| 553 | CAAACCAC A CUGGCUUC | 4267 | GAAGCCAG CUGAUGAGGCCGUUAGGCCGAA IUGGUUUG | 13607 |

TABLE XIV-continued

NCH Ribozyme and Target Sequences

| Pos | Target | Seq ID No | NCH Ribozyme | Seq ID No |
|-----|--------|-----------|--------------|-----------|
| 555 | AACCACAC U GGCUUCUA | 4268 | UAGAAGCC CUGAUGAGGCCGUUAGGCCGAA IUGUGGUU | 13608 |
| 559 | ACACUGUC U UCUACAGC | 4269 | GCUGUAGA CUGAUGAGGCCGUUAGGCCGAA ICCAGUGU | 13609 |
| 562 | CUGGCUUC U ACAGCGC | 4270 | GCAGCUGU CUGAUGAGGCCGUUAGGCCGAA IAAGCCAG | 13610 |
| 565 | GCUUCUAC A GCUGCAAA | 4271 | UUUGCAGC CUGAUGAGGCCGUUAGGCCGAA IUAGAAGC | 13611 |
| 568 | UCUACAGC U GCAAAUAU | 4272 | AUAUUUGC CUGAUGAGGCCGUUAGGCCGAA ICUGUAGA | 13612 |
| 571 | ACAGCUGC A AAUAUCUA | 4273 | UAGAUAUU CUGAUGAGGCCGUUAGGCCGAA ICAGCUGU | 13613 |
| 578 | CAAAUAUC U AGCUGUAC | 4274 | GUACAGCU CUGAUGAGGCCGUUAGGCCGAA IAUAUUUG | 13614 |
| 582 | UAUCUAGC U GUACCUAC | 4275 | GUAGGUAC CUGAUGAGGCCGUUAGGCCGAA ICUAGAUA | 13615 |
| 587 | AGGUGUAC C UACUUCAA | 4276 | UUGAAGUA CUGAUGAGGCCGUUAGGCCGAA IUACAGCU | 13616 |
| 588 | GCUGUACC U ACUUCAAA | 4277 | UUUGAAGU CUGAUGAGGCCGUUAGGCCGAA IGUACAGC | 13617 |
| 591 | GUACCUAC U UCAAAGAA | 4278 | UUCUUUGA CUGAUGAGGCCGUUAGGCCGAA IAGGUAC | 13618 |
| 594 | CCUACUUC A AAGAAGAA | 4279 | UUCUUCUU CUGAUGAGGCCGUUAGGCCGAA IAAGUAGG | 13619 |
| 609 | AAGGAAAC A GAAUCUGC | 4280 | GCAGAUUC CUGAUGAGGCCGUUAGGCCGAA IUUUCCUU | 13620 |
| 615 | ACAGAAUC U GCAAUCUA | 4281 | UAGAUUGC CUGAUGAGGCCGUUAGGCCGAA IAUUCUGU | 13621 |
| 618 | GAAUCUGC A AUCUAUAU | 4282 | AUAUAGAU CUGAUGAGGCCGUUAGGCCGAA ICAGACUC | 13622 |
| 622 | CUGCAAUC U AUAUAUUU | 4283 | AAAUAUAU CUGAUGAGGCCGUUAGGCCGAA IAUUGCAG | 13623 |
| 642 | AGUGAUAC A GGUAGACC | 4284 | GGUCUACC CUGAUGAGGCCGUUAGGCCGAA IUAUCACU | 13624 |
| 650 | AGGUAGAC C UUUCGUAG | 4285 | CUACGAAA CUGAUGAGGCCGUUAGGCCGAA IUCUACCU | 13625 |
| 651 | GGUAGACC U UUCGUAGA | 4286 | UCUACGAA CUGAUGAGGCCGUUAGGCCGAA IGUCUACC | 13626 |
| 667 | AGAUGUAC A GUGAAAUC | 4287 | GAUUUCAC CUGAUGAGGCCGUUAGGCCGAA IUACAUCU | 13627 |
| 676 | GUGAAAUC C CGAAAUU | 4288 | AAUUUCGG CUGAUGAGGCCGUUAGGCCGAA IAUUUCAC | 13628 |
| 677 | UGAAAUCC C GAAAUUA | 4289 | UAAUUUCG CUGAUGAGGCCGUUAGGCCGAA IGAUUUCA | 13629 |
| 678 | GAAAUCCC C GAAAUUAU | 4290 | AUAAUUUC CUGAUGAGGCCGUUAGGCCGAA IGGAUUUC | 13630 |
| 689 | AAUUAUAC A CAUGACUG | 4291 | CAGUCAUG CUGAUGAGGCCGUUAGGCCGAA IUAUAAUU | 13631 |
| 691 | UUAUACAC A UGACUGAA | 4292 | UUCAGUCA CUGAUGAGGCCGUUAGGCCGAA IUGUAUAA | 13632 |
| 696 | CACAUGAC U GAAGGAAG | 4293 | CUUCCUUC CUGAUGAGGCCGUUAGGCCGAA ICAUGUG | 13633 |
| 710 | AAGGGAGC U CGUCAUUC | 4294 | GAAUGACG CUGAUGAGGCCGUUAGGCCGAA ICUCCCUU | 13634 |
| 715 | AGCUCGUC A UUCCCUGC | 4295 | GCAGGGAA CUGAUGAGGCCGUUAGGCCGAA IACGAGCU | 13635 |
| 719 | CGUCAUUC C CUGCCGGG | 4296 | CCCGGCAG CUGAUGAGGCCGUUAGGCCGAA IAAUGACG | 13636 |
| 720 | GUCAUUCC C UGCCGGGU | 4297 | ACCCGGCA CUGAUGAGGCCGUUAGGCCGAA IGAAUGAC | 13637 |
| 721 | UCAUUCCC U GCCGGGUU | 4298 | AACCCGGC CUGAUGAGGCCGUUAGGCCGAA IGGAAUGA | 13638 |
| 724 | UUCCCUGC C GGGUUACG | 4299 | CGUAACCC CUGAUGAGGCCGUUAGGCCGAA ICAGGGAA | 13639 |
| 735 | GUUACGUC A CCUAACAU | 4300 | AUGUUAGG CUGAUGAGGCCGUUAGGCCGAA IACGUAAC | 13640 |
| 737 | UACGUCAC C UAACAUCA | 4301 | UGAUGUUA CUGAUGAGGCCGUUAGGCCGAA IUGACGUA | 13641 |
| 738 | ACGUCACC U AACAUCAC | 4302 | GUGAUGUU CUGAUGAGGCCGUUAGGCCGAA IGUGACGU | 13642 |
| 742 | CACCUAAC A UCACUGUU | 4303 | AACAGUGA CUGAUGAGGCCGUUAGGCCGAA IUUAGGUG | 13643 |
| 745 | CUUACAUC A CUGUUACU | 4304 | AGUAACAG CUGAUGAGGCCGUUAGGCCGAA IAUGUUAG | 13644 |

TABLE XIV-continued

NCH Ribozyme and Target Sequences

| Pos | Target | Seq ID No | NCH Ribozyme | Seq ID No |
|-----|--------|-----------|--------------|-----------|
| 747 | AACAUCAC U GUUACUUU | 4305 | AAAGUAAC CUGAUGAGgccguuaggccGAA IUGAUGUU | 13645 |
| 753 | ACUGUGAC U UUAAAAAA | 4306 | UUUUUUAA CUGAUGAGgccguuaggccGAA IUAACAGU | 13646 |
| 767 | AAAGUUUC C ACUUGACA | 4307 | UGUCAAGU CUGAUGAGgccguuaggccGAA IAAACUUU | 13647 |
| 768 | AAGUUUCC A CUUGACAC | 4308 | GUGUCAAG CUGAUGAGgccguuaggccGAA IGAAACUU | 13648 |
| 770 | GUUUCCAC U UGACACUU | 4309 | AAGUGUCA CUGAUGAGgccguuaggccGAA IUGGAAAC | 13649 |
| 775 | CACUUGAC A CUUUGAUC | 4310 | GAUCAAAG CUGAUGAGgccguuaggccGAA IUCAAGUG | 13650 |
| 777 | CUUGACAC U UUGAUCCC | 4311 | GGGAUCAA CUGAUGAGgccguuaggccGAA IUGUCAAG | 13651 |
| 784 | CUUUGAUC C CUGAUGGA | 4312 | UCCAUCAG CUGAUGAGgccguuaggccGAA IAUCAAAG | 13652 |
| 785 | UUUGAUCC C UGAUGGAA | 4313 | UUCCAUCA CUGAUGAGgccguuaggccGAA IGAUCAAA | 13653 |
| 786 | UUGAUCCC U GAUGGAAA | 4314 | UUUCCAUC CUGAUGAGgccguuaggccGAA IGGAUCAA | 13654 |
| 799 | GAAAACGC A UAAUCUGG | 4315 | UCAGAUUA CUGAUGAGgccguuaggccGAA ICGUUUUC | 13655 |
| 805 | GCAUAAUC U GGGACAGU | 4316 | ACUGUCCC CUGAUGAGgccguuaggccGAA IAUUAUGC | 13656 |
| 811 | UCGGGAC A GUAGAAAG | 4317 | CUUUCUAC CUGAUGAGgccguuaggccGAA IUCCCAGA | 13657 |
| 823 | GAAAGGGC U UCAUCAUA | 4318 | UAUGAUGA CUGAUGAGgccguuaggccGAA ICCCUUUC | 13658 |
| 826 | AGGGCUUC A UCAUAUCA | 4319 | UGAUAUGA CUGAUGAGgccguuaggccGAA IAAGCCCU | 13659 |
| 829 | GCUUCAUC A UAUCAAAU | 4320 | AUUUGAUA CUGAUGAGgccguuaggccGAA IAUGAAGC | 13660 |
| 834 | AUCAUAUC A AAUGCAAC | 4321 | GUUGCAUU CUGAUGAGgccguuaggccGAA IAUAUGAU | 13661 |
| 840 | UCAAAUGC A ACGUACAA | 4322 | UUGUACGU CUGAUGAGgccguuaggccGAA ICAGUUGA | 13662 |
| 847 | CAACGUAC A AAGAAAUA | 4323 | UAUUUCUU CUGAUGAGgccguuaggccGAA IUAGGUUG | 13663 |
| 860 | AAUAGGGC U UCUGACCU | 4324 | AGGUCAGA CUGAUGAGgccguuaggccGAA ICCCUAUU | 13664 |
| 863 | AGGGCUUC U GACCUGUG | 4325 | CACAGGUC CUGAUGAGgccguuaggccGAA IAAGCCCU | 13665 |
| 867 | CUUCUGAC C UGUGAAGC | 4326 | GCUUCACA CUGAUGAGgccguuaggccGAA IUCAGAAG | 13666 |
| 868 | UUCUGACC U GUGAAGCA | 4327 | UGCUUCAC CUGAUGAGgccguuaggccGAA IGUCAGAA | 13667 |
| 876 | UGUGAAGC A ACAGUCAA | 4328 | UUGACUGU CUGAUGAGgccguuaggccGAA ICUUCACA | 13668 |
| 879 | GAAGCAAC A GUCAAUGG | 4329 | CCAUUGAC CUGAUGAGgccguuaggccGAA IUUGCUUC | 13669 |
| 883 | CAACAGUC A AUGGGCAU | 4330 | AUGCCCAU CUGAUGAGgccguuaggccGAA IACUGUUG | 13670 |
| 890 | CAAUGGGC A UUUGUAUA | 4331 | UAUACAAA CUGAUGAGgccguuaggccGAA ICCCAUUG | 13671 |
| 903 | UAUAAGAC A AACUAUCU | 4332 | AGAUAGUU CUGAUGAGgccguuaggccGAA IUCUUAUA | 13672 |
| 907 | AGACAAAC U AUCUCACA | 4333 | UGUGAGAU CUGAUGAGgccguuaggccGAA IUUUGUCU | 13673 |
| 911 | AAACUAUC U CACACAUC | 4334 | GAUGUGUG CUGAUGAGgccguuaggccGAA IAUAGUUU | 13674 |
| 913 | ACUAUCUC A CACAUCGA | 4335 | UCGAUGUG CUGAUGAGgccguuaggccGAA IAGAUAGU | 13675 |
| 915 | UAUCUCAC A CAUCGACA | 4336 | UGUCGAUG CUGAUGAGgccguuaggccGAA IUGAGAUA | 13676 |
| 917 | UCUCACAC A UCGACAAA | 4337 | UUUGUCGA CUGAUGAGgccguuaggccGAA IUGUGAGA | 13677 |
| 923 | ACAUCGAC A AACCAAUA | 4338 | UAUUGGUU CUGAUGAGgccguuaggccGAA IUCCAUGU | 13678 |
| 927 | CGACAAAC C AAUACAAU | 4339 | AUUGUAUU CUGAUGAGgccguuaggccGAA IUUUGUCG | 13679 |
| 928 | GACAAACC A AUACAAUC | 4340 | GAUUGUAU CUGAUGAGgccguuaggccGAA IGUUUGUC | 13680 |
| 933 | ACCAAUAC A AUCAUAGA | 4341 | UCUAUGAU CUGAUGAGgccguuaggccGAA IAUUGGUU | 13681 |

TABLE XIV-continued

NCH Ribozyme and Target Sequences

| Pos | Target | Seq ID No | NCH Ribozyme | Seq ID No |
|---|---|---|---|---|
| 937 | AUACAAUC A UAGAUGUC | 4342 | GACAUCUA CUGAUGAGGCCGUUAGGCCGAA IAUUGUAU | 13682 |
| 946 | UAGAUGUC C AAAUAAGC | 4343 | GCUUAUUU CUGAUGAGGCCGUUAGGCCGAA IACAUCUA | 13683 |
| 947 | AGAUGUCC A AAUAAGCA | 4344 | UGCUUAUU CUGAUGAGGCCGUUAGGCCGAA IGACAUCU | 13684 |
| 955 | AAAUAAGC A CACCACGC | 4345 | GCGUGGUG CUGAUGAGGCCGUUAGGCCGAA ICUUAUUU | 13685 |
| 957 | AUAAGCAC A CCACGCCC | 4346 | GGGCGUGG CUGAUGAGGCCGUUAGGCCGAA IUGCUUAU | 13686 |
| 959 | AAGCACAC C ACGCCCAG | 4347 | CUGGGCGU CUGAUGAGGCCGUUAGGCCGAA IUGUGCUU | 13687 |
| 960 | AGCACACC A CGCCCAGU | 4348 | ACUGGGCG CUGAUGAGGCCGUUAGGCCGAA IGUGUGCU | 13688 |
| 964 | CACCACGC C CAGUCAAA | 4349 | UUUGACUG CUGAUGAGGCCGUUAGGCCGAA ICGUGGUG | 13689 |
| 965 | ACCACGCC C AGUCAAAU | 4350 | AUUUGACU CUGAUGAGGCCGUUAGGCCGAA ICGUGGU | 13690 |
| 966 | CCACGCCC A GUCAAAUU | 4351 | AAUUUGAC CUGAUGAGGCCGUUAGGCCGAA IGGCGUGG | 13691 |
| 970 | GCCCAGUC A AAUUACUU | 4352 | AAGUAAUU CUGAUGAGGCCGUUAGGCCGAA IACUGGGC | 13692 |
| 977 | CAAAUUAC U UAGAGGCC | 4353 | GGCCUCUA CUGAUGAGGCCGUUAGGCCGAA IUAAUUUG | 13693 |
| 985 | UUAGAGGC C AUACUCUU | 4354 | AAGAGUAU CUGAUGAGGCCGUUAGGCCGAA ICCUCUAA | 13694 |
| 986 | UAGAGGCC A UACUCUUG | 4355 | CAAGAGUA CUGAUGAGGCCGUUAGGCCGAA IGCCUCUA | 13695 |
| 990 | GGCCAUAC U CUUGUCCU | 4356 | AGGACAAG CUGAUGAGGCCGUUAGGCCGAA IUAUGGCC | 13696 |
| 992 | CCAUACUC U UGUCCUCA | 4337 | UGAGGACA CUGAUGAGGCCGUUAGGCCGAA IAGUAUGG | 13697 |
| 997 | CUCUUGUC C UCAAUUGU | 4358 | ACAAUUGA CUGAUGAGGCCGUUAGGCCGAA IACAAGAG | 13698 |
| 998 | UCUUGUCC U CAAUUGUA | 4359 | UACAAUUG CUGAUGAGGCCGUUAGGCCGAA IGACAAGA | 13699 |
| 1000 | UUGUCCUC A AUUGUACU | 4360 | AGUACAAU CUGAUGAGGCCGUUAGGCCGAA IAGGACAA | 13700 |
| 1008 | AAUUGUAC U GCUACCAC | 4361 | GUGGUAGC CUGAUGAGGCCGUUAGGCCGAA IUACAAUU | 13701 |
| 1011 | UGUACUGC U ACCACUCC | 4362 | GGAGUGGU CUGAUGAGGCCGUUAGGCCGAA ICAGUACA | 13702 |
| 1014 | ACUGCUAC C ACUCCCUU | 4363 | AAGGGAGU CUGAUGAGGCCGUUAGGCCGAA IUAGCAGU | 13703 |
| 1015 | CUGCUACC A CUCCCUUG | 4364 | CAAGGGAG CUGAUGAGGCCGUUAGGCCGAA IGUAGCAG | 13704 |
| 1017 | GCUACCAC U CCCUUGAA | 4365 | UUCAAGGG CUGAUGAGGCCGUUAGGCCGAA IUGGUAGC | 13705 |
| 1019 | UACCACUC C CUUGAACA | 4366 | UGUUCAAG CUGAUGAGGCCGUUAGGCCGAA IAGUGGUA | 13706 |
| 1020 | ACCACUCC C UUGAACAC | 4367 | GUGUUCAA CUGAUGAGGCCGUUAGGCCGAA IGAGUGGU | 13707 |
| 1021 | CCACUCCC U UGAACACG | 4368 | CGUGUUCA CUGAUGAGGCCGUUAGGCCGAA IGGAGUGG | 13708 |
| 1027 | CCUUGAAC A CGAGAGUU | 4369 | AACUCUCG CUGAUGAGGCCGUUAGGCCGAA IUUCAAGG | 13709 |
| 1037 | GAGAGUUC A AAUGACCU | 4370 | AGGUCAUU CUGAUGAGGCCGUUAGGCCGAA IAACUCUC | 13710 |
| 1044 | CAAAUGAC C UGGAGUUA | 4371 | UAACUCCA CUGAUGAGGCCGUUAGGCCGAA IUCAUUUG | 13711 |
| 1045 | AAAUGACC U GGAGUUAC | 4372 | GUAACUCC CUGAUGAGGCCGUUAGGCCGAA IGUCAUUU | 13712 |
| 1054 | GGAGUUAC C CUGAUGAA | 4373 | UUCAUCAG CUGAUGAGGCCGUUAGGCCGAA IUAACUCC | 13713 |
| 1055 | GAGUUACC C UGAUGAAA | 4374 | UUUCAUCA CUGAUGAGGCCGUUAGGCCGAA IGUAACUC | 13714 |
| 1056 | AGUUACCC U GAUGAAAA | 4375 | UUUUCAUC CUGAUGAGGCCGUUAGGCCGAA IGGUAACU | 13715 |
| 1077 | AAGAGAGC U UCCGUAAG | 4376 | CUUACGGA CUGAUGAGGCCGUUAGGCCGAA ICUCUCUU | 13716 |
| 1080 | AGAGCUUC C GUAAGGCG | 4377 | CGCCUUAC CUGAUGAGGCCGUUAGGCCGAA IAAGCUCU | 13717 |
| 1099 | GAAUUGAC C AAAGCAAU | 4378 | AUUGCUUU CUGAUGAGGCCGUUAGGCCGAA IUCAAUUC | 13718 |

TABLE XIV-continued

NCH Ribozyme and Target Sequences

| Pos | Target | Seq ID No | NCH Ribozyme | Seq ID No |
|---|---|---|---|---|
| 1100 | AAUUGACC A AAGCAAUU | 4379 | AAUUGCUU CUGAUGAGGCCGUUAGGCCGAA IGUCAAUU | 13719 |
| 1105 | ACCAAAGC A AUUCCCAU | 4380 | AUGGGAAU CUGAUGAGGCCGUUAGGCCGAA ICUUUGGU | 13720 |
| 1110 | AGCAAUUC C CAUGCCAA | 4381 | UUGGCAUG CUGAUGAGGCCGUUAGGCCGAA IAAUUGCU | 13721 |
| 1111 | GCAAUUCC C AUGCCAAC | 4382 | GUUGGCAU CUGAUGAGGCCGUUAGGCCGAA IGAAUUGC | 13722 |
| 1112 | CAAUUCCC A UGCCAACA | 4383 | UGUUGGCA CUGAUGAGGCCGUUAGGCCGAA IGGAAUUG | 13723 |
| 1116 | UCCCAUGC C AACAUAUU | 4384 | AAUAUGUU CUGAUGAGGCCGUUAGGCCGAA ICAUGGGA | 13724 |
| 1117 | CCCAUGCC A ACAUAUUC | 4385 | GAAUAUGU CUGAUGAGGCCGUUAGGCCGAA IGCAUGGG | 13725 |
| 1120 | AUGCCAAC A UAUUCUAC | 4386 | GUAGAAUA CUGAUGAGGCCGUUAGGCCGAA IUUGGCAU | 13726 |
| 1126 | ACAUAUUC U ACAGUGUU | 4387 | AACACUGU CUGAUGAGGCCGUUAGGCCGAA IAAUAUGU | 13727 |
| 1129 | UAUUCUAC A GUGUUCUU | 4388 | AAGAACAC CUGAUGAGGCCGUUAGGCCGAA IUAGAAUA | 13728 |
| 1136 | CAGUGUUC U UACUAUUG | 4389 | CAAUAGUA CUGAUGAGGCCGUUAGGCCGAA IAACACUG | 13729 |
| 1140 | GUUCUUAC U AUUGACAA | 4390 | UUGUCAAU CUGAUGAGGCCGUUAGGCCGAA IUAAGAAC | 13730 |
| 1147 | CUAUUGAC A AAAUGCAG | 4391 | CUGCAUUU CUGAUGAGGCCGUUAGGCCGAA IUCAAUAG | 13731 |
| 1154 | CAAAAUGC A GAACAAAG | 4392 | CUUUGUUC CUGAUGAGGCCGUUAGGCCGAA ICAUUUUG | 13732 |
| 1159 | UGCAGAAC A AAGACAAA | 4393 | UUUGUCUU CUGAUGAGGCCGUUAGGCCGAA IUUCUGCA | 13733 |
| 1165 | ACAAAGAC A AAGGACUU | 4394 | AAGUCCUU CUGAUGAGGCCGUUAGGCCGAA IUCUUUGU | 13734 |
| 1172 | CAAAGGAC U UUAUACUU | 4395 | AAGUAUAA CUGAUGAGGCCGUUAGGCCGAA IUCCUCUG | 13735 |
| 1179 | CUUUAUAC U UGUCGUGU | 4396 | ACACGACA CUGAUGAGGCCGUUAGGCCGAA IUAUAAAG | 13736 |
| 1199 | GAGUGGAC C AUCAUCCA | 4397 | UGAAUGAU CUGAUGAGGCCGUUAGGCCGAA UUCCACUC | 13737 |
| 1200 | AGUGGACC A UCAUCCAA | 4398 | UUGAAUGA CUGAUGAGGCCGUUAGGCCGAA IGUCCACU | 13738 |
| 1203 | GGACCAUC A UUCAAAUC | 4399 | GAUUUGAA CUGAUGAGGCCGUUAGGCCGAA IAUGGUCC | 13739 |
| 1207 | CAUCAUUC A AAUCUGUU | 4400 | AACAGAUU CUGAUGAGGCCGUUAGGCCGAA IAAUGAUG | 13740 |
| 1212 | UUCAAAUC U GUUAACAC | 4401 | GUGUUAAC CUGAUGAGGCCGUUAGGCCGAA IAUUUGAA | 13741 |
| 1219 | CUGUUAAC A CCUCAGUG | 4402 | CACUGAGG CUGAUGAGGCCGUUAGGCCGAA IUUAACAG | 13742 |
| 1221 | GUUAACAC C UCAGUGCA | 4403 | UGCACUGA CUGAUGAGGCCGUUAGGCCGAA IUGUUAAC | 13743 |
| 1222 | UUAACACC U CAGUGCAU | 4404 | AUGCACUG CUGAUGAGGCCGUUAGGCCGAA IGUGUUAA | 13744 |
| 1224 | AACACCUC A GUGCAUAU | 4405 | AUAUGCAC CUGAUGAGGCCGUUAGGCCGAA IAGGUGUU | 13745 |
| 1229 | CUCAGUGC A UAUAUAUG | 4406 | CAUAUAUA CUGAUGAGGCCGUUAGGCCGAA ICACUGAG | 13746 |
| 1245 | GAUAAAGC A UUCAUCAC | 4407 | GUGAUGAA CUGAUGAGGCCGUUAGGCCGAA ICUUUAUC | 13747 |
| 1249 | AAGCAUUC A UCACUGUG | 4408 | CACAGUGA CUGAUGAGGCCGUUAGGCCGAA IAAUGCUU | 13748 |
| 1252 | CAUUCAUC A CUGUGAAA | 4409 | UUUCACAG CUGAUGAGGCCGUUAGGCCGAA IAUGAAUG | 13749 |
| 1254 | UUCAUCAC U GUGAAACA | 4410 | UGUUUCAC CUGAUGAGGCCGUUAGGCCGAA IUGAUGAA | 13750 |
| 1262 | UGUGAAAC A UCGAAAAC | 4411 | GUUUUCGA CUGAUGAGGCCGUUAGGCCGAA IUUUCACA | 13751 |
| 1271 | UCGAAAAC A GCAGGUGC | 4412 | GCACCUGC CUGAUGAGGCCGUUAGGCCGAA IUUUUCGA | 13752 |
| 1274 | AAAACAGC A GGUGCUUG | 4413 | CAAGCACC CUGAUGAGGCCGUUAGGCCGAA ICUGUUUU | 13753 |
| 1280 | GCAGGUGC U UGAAACCG | 4414 | CGGUUUCA CUGAUGAGGCCGUUAGGCCGAA ICACCUGC | 13754 |
| 1287 | CUUGAAAC C GUAGCUGG | 4415 | CCAGCUAC CUGAUGAGGCCGUUAGGCCGAA IUUUCAAG | 13755 |

TABLE XIV-continued

NCH Ribozyme and Target Sequences

| Pos | Target | Seq ID No | NCH Ribozyme | Seq ID No |
|---|---|---|---|---|
| 1293 | ACCGUAGC U GGCAAGCG | 4416 | CGCUUGCC CUGAUGAGGCCGUUAGGCCGAA ICUACGGU | 13756 |
| 1297 | UAGCUGGC A AGCGGUCU | 4417 | AGACCGCU CUGAUGAGGCCGUUAGGCCGAA ICCAGCUA | 13757 |
| 1305 | AAGCGGUC U UACCGGCU | 4418 | AGCCGGUA CUGAUGAGGCCGUUAGGCCGAA IACCGCUU | 13758 |
| 1309 | GGUCUUAC C GGCUCUCU | 4419 | AGAGAGCC CUGAUGAGGCCGUUAGGCCGAA IUAAGACC | 13759 |
| 1313 | UUACCGGC U CUCUAUGA | 4420 | UCAUAGAG CUGAUGAGGCCGUUAGGCCGAA ICCGGUAA | 13760 |
| 1315 | ACCGGCUC U CUAUGAAA | 4421 | UUUCAUAG CUGAUGAGGCCGUUAGGCCGAA IAGCCGGU | 13761 |
| 1317 | CGGCUCUC U AUGAAAGU | 4422 | ACUUUCAU CUGAUGAGGCCGUUAGGCCGAA IAGAGCCG | 13762 |
| 1332 | GUGAAGGC A UUUCCCUC | 4423 | GAGGGAAA CUGAUGAGGCCGUUAGGCCGAA ICCUUCAC | 13763 |
| 1337 | GGCAUUUC C CUCGCCGG | 4424 | CCGGCGAG CUGAUGAGGCCGUUAGGCCGAA IAAAUGCC | 13764 |
| 1338 | GCAUUUCC C UCGCCGGA | 4425 | UCCGGCGA CUGAUGAGGCCGUUAGGCCGAA IGAAAUGC | 13765 |
| 1339 | CAUUUCCC U CGCCGGAA | 4426 | UUCCGGCG CUGAUGAGGCCGUUAGGCCGAA IGCAAAUC | 13766 |
| 1343 | UCCCUCGC C GGAAGUUG | 4427 | CAACUUCC CUGAUGAGGCCGUUAGGCCGAA ICGAGGGA | 13767 |
| 1373 | UGGGUUAC C UGCGACUG | 4428 | CAGUCGCA CUGAUGAGGCCGUUAGGCCGAA IUAACCCA | 13768 |
| 1374 | GGGUUACC U GCGACUGA | 4429 | UCAGUCGC CUGAUGAGGCCGUUAGGCCGAA IGUAACCC | 13769 |
| 1380 | CCUGCGAC U GAGAAAUC | 4430 | GAUUUCUC CUGAUGAGGCCGUUAGGCCGAA ICGCAGG | 13770 |
| 1389 | GAGAAAUC U GCUCGCUA | 4431 | UAGCGAGC CUGAUGAGGCCGUUAGGCCGAA IAUUUCUC | 13771 |
| 1392 | AAAUCUGC U CGCUAUUU | 4432 | AAAUAGCG CUGAUGAGGCCGUUAGGCCGAA ICAGAUUU | 13772 |
| 1396 | CUGCUCGC U AUUUGACU | 4433 | AGUCAAAU CUGAUGAGGCCGUUAGGCCGAA ICGAGCAG | 13773 |
| 1404 | UAUUUGAC U CGUGGCUA | 4434 | UAGCCACG CUGAUGAGGCCGUUAGGCCGAA IUCAAAUA | 13774 |
| 1411 | CUCGUGGC U ACUCGUUA | 4435 | UAACGAGU CUGAUGAGGCCGUUAGGCCGAA ICCACGAG | 13775 |
| 1414 | GUGGCUAC U CGUUAAUU | 4436 | AAUUAACG CUGAUGAGGCCGUUAGGCCGAA IUAGCCAC | 13776 |
| 1426 | UAAUUAUC A AGGACGUA | 4437 | UACGUCCU CUGAUGAGGCCGUUAGGCCGAA IAUAAUUA | 13777 |
| 1437 | GACGUAAC U GAAGAGGA | 4438 | UCCUCUUC CUGAUGAGGCCGUUAGGCCGAA IUUACGUC | 13778 |
| 1449 | GAGGAUGC A GGGAAUUA | 4439 | UAAUUCCC CUGAUGAGGCCGUUAGGCCGAA ICAUCCUC | 13779 |
| 1461 | AAUUAUAC A AUCUUGCU | 4440 | AGCAAGAU CUGAUGAGGCCGUUAGGCCGAA IUAUAAUU | 13780 |
| 1465 | AUACAAUC U UGCUGAGC | 4441 | GCUCAGCA CUGAUGAGGCCGUUAGGCCGAA IAUUGUAU | 13781 |
| 1469 | AAUCUUGC U GAGCAUAA | 4442 | UUAUGCUC CUGAUGAGGCCGUUAGGCCGAA ICAAGAUU | 13782 |
| 1474 | UGCUGAGC A UAAAACAG | 4443 | CUGUUUUA CUGAUGAGGCCGUUAGGCCGAA ICUCAGCA | 13783 |
| 1481 | CAUAAAAC A GUCAAAUG | 4444 | CAUUUGAC CUGAUGAGGCCGUUAGGCCGAA IUUUUAUG | 13784 |
| 1485 | AAACAGUC A AAUGUGUU | 4445 | AACACAUU CUGAUGAGGCCGUUAGGCCGAA IACUGUUU | 13785 |
| 1501 | UUAAAAAC C UCACUGCC | 4446 | GGCAGUGA CUGAUGAGGCCGUUAGGCCGAA IUUUUUAA | 13786 |
| 1502 | UAAAAACC U CACUGCCA | 4447 | UGGCAGUG CUGAUGAGGCCGUUAGGCCGAA IGUUUUUA | 13787 |
| 1504 | AAAACCUC A CUGCCACU | 4448 | AGUGGCAG CUGAUGAGGCCGUUAGGCCGAA IAGGUUUU | 13788 |
| 1506 | AACCUCAC U GCCACUCU | 4449 | AGAGUGGC CUGAUGAGGCCGUUAGGCCGAA IUGAGGUU | 13789 |
| 1509 | CUCACUGC C ACUCUAAU | 4450 | AUUAGAGU CUGAUGAGGCCGUUAGGCCGAA ICAGUGAG | 13790 |
| 1510 | UCACUGCC A CUCUAAUU | 4451 | AAUUAGAG CUGAUGAGGCCGUUAGGCCGAA IGCAGUGA | 13791 |
| 1512 | ACUGCCAC U CUAAUUGU | 4452 | ACAAUUAG CUGAUGAGGCCGUUAGGCCGAA IUGGCAGU | 13792 |

TABLE XIV-continued

NCH Ribozyme and Target Sequences

| Pos | Target | Seq ID No | NCH Ribozyme | Seq ID No |
|-----|--------|-----------|--------------|-----------|
| 1514 | UGCCACUC U AAUUGUCA | 4453 | UGACAAUU CUGAUGAGGCCGUUAGGCCGAA IAGUGGCA | 13793 |
| 1522 | UAAUUGUC A AUGUGAAA | 4454 | UUUCACAU CUGAUGAGGCCGUUAGGCCGAA IACAAUUA | 13794 |
| 1532 | UGUGAAAC C CCAGAUUU | 4455 | AAAUCUGG CUGAUGAGGCCGUUAGGCCGAA IUUUCACA | 13795 |
| 1533 | GUGAAACC C CAGAUUUA | 4456 | UAAAUCUG CUGAUGAGGCCGUUAGGCCGAA IGUUUCAC | 13796 |
| 1534 | UGAAACCC C AGAUUUAC | 4457 | GUAAAUCU CUGAUGAGGCCGUUAGGCCGAA IGGUUUCA | 13797 |
| 1535 | GAAACCCC A GAUUUACG | 4458 | CGUAAAUC CUGAUGAGGCCGUUAGGCCGAA IGGGUUUC | 13798 |
| 1551 | GAAAAGGC C GUGUCAUC | 4459 | GAUGACAC CUGAUGAGGCCGUUAGGCCGAA ICCUUUUC | 13799 |
| 1557 | GCCGUGUC A UCGUUUCC | 4460 | GGAAACGA CUGAUGAGGCCGUUAGGCCGAA IACACGGC | 13800 |
| 1565 | AUCGUUUC C AGACCCGG | 4461 | CCGGGUCU CUGAUGAGGCCGUUAGGCCGAA IAAACGAU | 13801 |
| 1566 | UCGUUUCC A GACCCGGC | 4462 | GCCGGGUC CUGAUGAGGCCGUUAGGCCGAA IGAAACGA | 13802 |
| 1570 | UUCCAGAC C CGGCUCUC | 4463 | GAGAGCCG CUGAUGAGGCCGUUAGGCCGAA IUCUGGAA | 13803 |
| 1571 | UCCAGACC C GGCUCUCU | 4464 | AGAGAGCC CUGAUGAGGCCGUUAGGCCGAA IGUCUGGA | 13804 |
| 1575 | GACCCGGC U CUCUACCC | 4465 | GGGUAGAG CUGAUGAGGCCGUUAGGCCGAA ICCGGGUC | 13805 |
| 1577 | CCCGGCUC U CUACCCAC | 4466 | GUGGGUAG CUGAUGAGGCCGUUAGGCCGAA IAGCCGGG | 13806 |
| 1579 | CGGCUCUC U ACCCACUG | 4467 | CAGUGGGU CUGAUGAGGCCGUUAGGCCGAA IAGAGCCG | 13807 |
| 1582 | CUCUCUAC C CACUGGGC | 4468 | GCCCAGUG CUGAUGAGGCCGUUAGGCCGAA IUAGAGAG | 13808 |
| 1583 | UCUCUACC C ACUGGGCA | 4469 | UGCCCAGU CUGAUGAGGCCGUUAGGCCGAA IGUAGAGA | 13809 |
| 1584 | CUCUACCC A CUGGGCAG | 4470 | CUGCCCAG CUGAUGAGGCCGUUAGGCCGAA IGGUAGAG | 13810 |
| 1586 | CUACCCAC U GGGCAGCA | 4471 | UGCUGCCC CUGAUGAGGCCGUUAGGCCGAA IUGGGUAG | 13811 |
| 1591 | CACUGGGC A GCAGACAA | 4472 | UUGUCUGC CUGAUGAGGCCGUUAGGCCGAA ICCCAGUG | 13812 |
| 1594 | UGGGCAGC A GACAAAUC | 4473 | GAUUUGUC CUGAUGAGGCCGUUAGGCCGAA ICUGCCCA | 13813 |
| 1598 | CAGCAGAC A AAUCCUGA | 4474 | UCAGGAUU CUGAUGAGGCCGUUAGGCCGAA IUCUGCUG | 13814 |
| 1603 | GACAAAUC C UGACUUGU | 4475 | ACAAGUCA CUGAUGAGGCCGUUAGGCCGAA IAUUUGUC | 13815 |
| 1604 | ACAAAUCC U GACUUGUA | 4476 | UACAAGUC CUGAUGAGGCCGUUAGGCCGAA IGAUUUGU | 13816 |
| 1608 | AUCCUGAC U UGUACCGC | 4477 | GCGGUACA CUGAUGAGGCCGUUAGGCCGAA IUCAGGAU | 13817 |
| 1614 | ACUUGUAC C GCAUAUGG | 4478 | CCAUAUGC CUGAUGAGGCCGUUAGGCCGAA IUACAAGU | 13818 |
| 1617 | UGUACCGC A UAUGGUAU | 4479 | AUACCAUA CUGAUGAGGCCGUUAGGCCGAA ICGGUACA | 13819 |
| 1627 | AUGGUAUC C CUCAACCU | 4480 | AGGUUGAG CUGAUGAGGCCGUUAGGCCGAA IAUACCAU | 13820 |
| 1628 | UGGUAUCC C UCAACCUA | 4481 | UAGGUUGA CUGAUGAGGCCGUUAGGCCGAA IGAUACCA | 13821 |
| 1629 | GGUAUCCC U CAACCUAC | 4482 | GUAGGUUG CUGAUGAGGCCGUUAGGCCGAA IGGAUACC | 13822 |
| 1631 | UAUCCCUC A ACCUACAA | 4483 | UUGUAGGU CUGAUGAGGCCGUUAGGCCGAA IAGGGAUA | 13823 |
| 1634 | CCCUCAAC C UACAAUCA | 4484 | UGAUUGUA CUGAUGAGGCCGUUAGGCCGAA IUUGAGGG | 13824 |
| 1635 | CCUCAACC U ACAAUCAA | 4485 | UUGAUUGU CUGAUGAGGCCGUUAGGCCGAA IGUUGAGG | 13825 |
| 1638 | CAACCUAC A AUCAAGUG | 4486 | CACUUGAU CUGAUGAGGCCGUUAGGCCGAA IUAGGUUG | 13826 |
| 1642 | CUACAAUC A AGUGGUUC | 4487 | GAACCACU CUGAUGAGGCCGUUAGGCCGAA IAUUGUAG | 13827 |
| 1651 | AGUGGUUC U GGCACCCC | 4488 | GGGGUGCC CUGAUGAGGCCGUUAGGCCGAA IAACCACU | 13828 |
| 1655 | GUUCUGGC A CCCCUGUA | 4489 | UACAGGGG CUGAUGAGGCCGUUAGGCCGAA ICCAGAAC | 13829 |

TABLE XIV-continued

NCH Ribozyme and Target Sequences

| Pos | Target | Seq ID No | NCH Ribozyme | Seq ID No |
|---|---|---|---|---|
| 1657 | UCUGGCAC C CCUGUAAC | 4490 | GUUACAGG CUGAUGAGGCCGUUAGGCCGAA IUGCCAGA | 13830 |
| 1658 | CUGGCACC C CUGUAACC | 4491 | GGUUACAG CUGAUGAGGCCGUUAGGCCGAA IGUGCCAG | 13831 |
| 1659 | UGGCACCC C UGUAACCA | 4492 | UGGUUACA CUGAUGAGGCCGUUAGGCCGAA IGGUGCCA | 13832 |
| 1660 | GGCACCCC U GUAACCAU | 4493 | AUGGUUAC CUGAUGAGGCCGUUAGGCCGAA IGGGUGCC | 13833 |
| 1666 | CCUGUAAC C AUAAUCAU | 4494 | AUGAUUAU CUGAUGAGGCCGUUAGGCCGAA IUUACAGG | 13834 |
| 1667 | CUGUAACC A UAAUCAUU | 4495 | AAUGAUUA CUGAUGAGGCCGUUAGGCCGAA IGUUACAG | 13835 |
| 1673 | CCAUAAUC A UUCCGAAG | 4496 | CUUCGGAA CUGAUGAGGCCGUUAGGCCGAA IAUUAUGG | 13836 |
| 1677 | AAUCAUUC C GAAGCAAG | 4497 | CUUGCUUC CUGAUGAGGCCGUUAGGCCGAA IAAUGAUU | 13837 |
| 1683 | UCCGAAGC A AGGUGUGA | 4498 | UCACACCU CUGAUGAGGCCGUUAGGCCGAA ICUUCGGA | 13838 |
| 1693 | GGUGUGAC U UUEUUUCC | 4499 | GGAACAAA CUGAUGAGGCCGUUAGGCCGAA IUCACACC | 13839 |
| 1701 | UUUUGUUC C AAUAAUGA | 4500 | UCAUUAUU CUGAUGAGGCCGUUAGGCCGAA IAACAAAA | 13840 |
| 1702 | UUUGUUCC A AUAAUGAA | 4501 | UUCAUUAU CUGAUGAGGCCGUUAGGCCGAA IGAACAAA | 13841 |
| 1716 | GAAGAGUC C UUUAUCCU | 4502 | AGGAUAAA CUGAUGAGGCCGUUAGGCCGAA IACUCUUC | 13842 |
| 1717 | AAGAGUCC U UUAUCCUG | 4503 | CAGGAUAA CUGAUGAGGCCGUUAGGCCGAA IGACUCUU | 13843 |
| 1723 | CCUUUAUC C UGGAUGCU | 4504 | AGCAUCCA CUGAUGAGGCCGUUAGGCCGAA IAUAAAGG | 13844 |
| 1724 | CUUUAUCC U GGAUGCUG | 4505 | CAGCAUCC CUGAUGAGGCCGUUAGGCCGAA IGAUAAAG | 13845 |
| 1731 | CUGGAUGC U GACAGCAA | 4506 | UUGCUGUC CUGAUGAGGCCGUUAGGCCGAA ICAUCCAG | 13846 |
| 1735 | AUGCUGAC A GCAACAUG | 4507 | CAUGUUGC CUGAUGAGGCCGUUAGGCCGAA IUCAGCAU | 13847 |
| 1738 | CUGACAGC A ACAUGGGA | 4508 | UCCCAUGU CUGAUGAGGCCGUUAGGCCGAA ICUGUCAG | 13848 |
| 1741 | ACAGCAAC A UGGGAAAC | 4509 | GUUUCCCA CUGAUGAGGCCGUUAGGCCGAA IUUGCUGU | 13849 |
| 1750 | UGGGAAAC A GAAUUGAG | 4510 | CUCAAUUC CUGAUGAGGCCGUUAGGCCGAA IUUUCCCA | 13850 |
| 1762 | UUGAGAGC A UCACUCAG | 4511 | CUGAGUGA CUGAUGAGGCCGUUAGGCCGAA ICUCUCAA | 13851 |
| 1765 | AGAGCAUC A CUCAGCGC | 4512 | GCGCUGAG CUGAUGAGGCCGUUAGGCCGAA IAUGCUCU | 13852 |
| 1767 | AGGAUCAC U CAGCGCAU | 4513 | AUGCGCUG CUGAUGAGGCCGUUAGGCCGAA IUGAUGCU | 13853 |
| 1769 | CAUCACUC A GCGCAUGG | 4514 | CCAUGCGC CUGAUGAGGCCGUUAGGCCGAA IAGUGAUG | 13854 |
| 1774 | CUCAGCGC A UGGCAAUA | 4515 | UAUUGCCA CUGAUGAGGCCGUUAGGCCGAA ICGCUGAG | 13855 |
| 1779 | CGCAUGGC A AUAAUAGA | 4516 | UCUAUUAU CUGAUGAGGCCGUUAGGCCGAA ICCAUGCG | 13856 |
| 1806 | AAGAUGGU U AGCACCUU | 4517 | AAGGUGCU CUGAUGAGGCCGUUAGGCCGAA ICCAUCUU | 13857 |
| 1810 | UGGCUAGC A CCUUGGUU | 4518 | AACCAAGG CUGAUGAGGCCGUUAGGCCGAA ICUAGCCA | 13858 |
| 1812 | GCUAGCAC C UUGGUUGU | 4519 | ACAACCAA CUGAUGAGGCCGUUAGGCCGAA IUGCUAGC | 13859 |
| 1813 | CUAGCACC U UGGUUGUG | 4520 | CACAACCA CUGAUGAGGCCGUUAGGCCGAA IGUGCUAG | 13860 |
| 1824 | GUUGUGGC U GACUCUAG | 4521 | CUAGAGUC CUGAUGAGGCCGUUAGGCCGAA ICCACAAC | 13861 |
| 1828 | UGGCUGAC U CUAGAAUU | 4522 | AAUUCUAG CUGAUGAGGCCGUUAGGCCGAA IUCAGCCA | 13862 |
| 1830 | GCUGACUC U AGAAUUUC | 4523 | GAAAUUCU CUGAUGAGGCCGUUAGGCCGAA IAGUCAGC | 13863 |
| 1839 | AGAAUUUC U GGAAUCUA | 4524 | UAGAUUCC CUGAUGAGGCCGUUAGGCCGAA IAAAUUCU | 13864 |
| 1846 | CUGGAAUC U ACAUUUGC | 4525 | GCAAAUGU CUGAUGAGGCCGUUAGGCCGAA IAUUCCAG | 13865 |
| 1849 | GAAUCUAC A UUUGCAUA | 4526 | UAUGCAAA CUGAUGAGGCCGUUAGGCCGAA IUAGAUUC | 13866 |

TABLE XIV-continued

NCH Ribozyme and Target Sequences

| Pos | Target | Seq ID No | NCH Ribozyme | Seq ID No |
|---|---|---|---|---|
| 1855 | ACAUUUGC A UAGCUUCC | 4527 | GGAAGCUA CUGAUGAGGCCGUUAGGCCGAA ICAAAUGU | 13867 |
| 1860 | UGCAUAGC U UCCAAUAA | 4528 | UUAUUGGA CUGAUGAGGCCGUUAGGCCGAA ICUAUGCA | 13868 |
| 1863 | AUAGCUUC C AAUAAAGU | 4529 | ACUUUAUU CUGAUGAGGCCGUUAGGCCGAA IAAGCUAU | 13869 |
| 1864 | UAGCUUCC A AUAAAGUU | 4530 | AACUUUAU CUGAUGAGGCCGUUAGGCCGAA IGAAGCUA | 13870 |
| 1878 | GUUGGGAC U GUGGGAAG | 4531 | CUUCCCAC CUGAUGAGGCCGUUAGGCCGAA IUCCCAAC | 13871 |
| 1891 | GAAGAAAC A UAAGCUUU | 4532 | AAAGCUUA CUGAUGAGGCCGUUAGGCCGAA IUUUCUUC | 13872 |
| 1897 | ACAUAAGC U UUUAUAUC | 4533 | GAUAUAAA CUGAUGAGGCCGUUAGGCCGAA ICUUAUGU | 13873 |
| 1906 | UUUAUAUC A CAGAUGUG | 4534 | CACAUCUG CUGAUGAGGCCGUUAGGCCGAA IAUAUAAA | 13874 |
| 1908 | UAUAUCAC A GAUGUGCC | 4535 | GGCACAUC CUGAUGAGGCCGUUAGGCCGAA IUGAUAUA | 13875 |
| 1916 | AGAUGUGC C AAAUGGGU | 4536 | ACCCAUUU CUGAUGAGGCCGUUAGGCCGAA ICACAUCU | 13876 |
| 1917 | GAUGUGCC A AAUGGGUU | 4537 | AACCCAUU CUGAUGAGGCCGUUAGGCCGAA IGCACAUC | 13877 |
| 1928 | UGGGUUUC A UGUUAACU | 4538 | AGUUAACA CUGAUGAGGCCGUUAGGCCGAA IAAACCCA | 13878 |
| 1936 | AUGUUAAC U UGGAAAAA | 4539 | UUUUUCCA CUGAUGAGGCCGUUAGGCCGAA IUUAACAU | 13879 |
| 1949 | AAAAUGC C GACGGAAG | 4540 | CUUCCGUC CUGAUGAGGCCGUUAGGCCGAA ICAUUUUU | 13880 |
| 1966 | GAGAGGAC C UGAAACUG | 4541 | CAGUUUCA CUGAUGAGGCCGUUAGGCCGAA IUCCUCUC | 13881 |
| 1967 | AGAGGACC U GAAACUGU | 4542 | ACAGUUUC CUGAUGAGGCCGUUAGGCCGAA IGUCCUCU | 13882 |
| 1973 | CCUGAAAC U GUCUUGCA | 4543 | UGCAAGAC CUGAUGAGGCCGUUAGGCCGAA IUUUCAGG | 13883 |
| 1977 | AAACUGUC U UGCACAGU | 4544 | ACUGUGCA CUGAUGAGGCCGUUAGGCCGAA IACAGUUU | 13884 |
| 1981 | UGUCUUGC A CAGUUAAC | 4545 | GUUAACUG CUGAUGAGGCCGUUAGGCCGAA ICAAGACA | 13885 |
| 1983 | UCUUGCAC A GUUAACAA | 4546 | UUGUUAAC CUGAUGAGGCCGUUAGGCCGAA IUGCAAGA | 13886 |
| 1990 | CAGUUAAC A AGUUCUUA | 4547 | UAAGAACU CUGAUGAGGCCGUUAGGCCGAA IUUAACUG | 13887 |
| 1996 | ACAAGUUC U UAUACAGA | 4548 | UCUGUAUA CUGAUGAGGCCGUUAGGCCGAA IAACUUGU | 13888 |
| 2002 | UCUUAUAC A GAGACGUU | 4549 | AACGUCUC CUGAUGAGGCCGUUAGGCCGAA IUAUAAGA | 13889 |
| 2013 | GACGUUAC U UGGAUUUU | 4550 | AAAAUCCA CUGAUGAGGCCGUUAGGCCGAA IUAACGUC | 13890 |
| 2024 | GAUUUUAC U GCGGACAG | 4551 | CUGUCCGC CUGAUGAGGCCGUUAGGCCGAA IUAAAAUC | 13891 |
| 2031 | CUGCGGAC A GUUAAUAA | 4552 | UUAUUAAC CUGAUGAGGCCGUUAGGCCGAA IUCCGCAG | 13892 |
| 2041 | UUAAUAAC A GAACAAUG | 4553 | CAUUGUUC CUGAUGAGGCCGUUAGGCCGAA IUUAUUAA | 13893 |
| 2046 | AACAGAAC A AUGCACUA | 4554 | UAGUGCAU CUGAUGAGGCCGUUAGGCCGAA IUUCUGUU | 13894 |
| 2051 | AACAAUGC A CUACAGUA | 4555 | UACUGUAG CUGAUGAGGCCGUUAGGCCGAA ICAUUGUU | 13895 |
| 2053 | CAAUGCAC U ACAGUAUU | 4556 | AAUACUGU CUGAUGAGGCCGUUAGGCCGAA IUGCAUUG | 13896 |
| 2056 | UGCACUAC A GUAUUAGC | 4557 | GCUAAUAC CUGAUGAGGCCGUUAGGCCGAA IUAGUGCA | 13897 |
| 2065 | GUAUUAGC A AGCAAAAA | 4558 | UUUUUGCU CUGAUGAGGCCGUUAGGCCGAA ICUAAUAC | 13898 |
| 2069 | UAGCAAGC A AAAAUGG | 4559 | CCAUUUUU CUGAUGAGGCCGUUAGGCCGAA ICUUGCUA | 13899 |
| 2079 | AAAAUGGC C AUCACUAA | 4560 | UUAGUGAU CUGAUGAGGCCGUUAGGCCGAA ICCAUUUU | 13900 |
| 2080 | AAAUGGCC A UCACUAAG | 4561 | CUUAGUGA CUGAUGAGGCCGUUAGGCCGAA IGCCAUUU | 13901 |
| 2083 | UGGCCAUC A CUAAGGAG | 4562 | CUCCUUAG CUGAUGAGGCCGUUAGGCCGAA IAUGGCCA | 13902 |
| 2085 | GCCAUCAC U AAGGAGCA | 4563 | UGCUCCUU CUGAUGAGGCCGUUAGGCCGAA IUGAUGGC | 13903 |

TABLE XIV-continued

NCH Ribozyme and Target Sequences

| Pos | Target | Seq ID No | NCH Ribozyme | Seq ID No |
|---|---|---|---|---|
| 2093 | UAAGGAGC A CUCCAUCA | 4564 | UGAUGGAG CUGAUGAGGCCGUUAGGCCGAA ICUCCUUA | 13904 |
| 2095 | AGGAGCAC U CCAUCACU | 4565 | AGUGAUGG CUGAUGAGGCCGUUAGGCCGAA IUGCUCCU | 13905 |
| 2097 | GAGCACUC C AUCACUCU | 4566 | AGAGUGAU CUGAUGAGGCCGUUAGGCCGAA IAGUGCUC | 13906 |
| 2098 | AGCACUCC A UCACUCUU | 4567 | AAGAGUGA CUGAUGAGGCCGUUAGGCCGAA IGAGUGCU | 13907 |
| 2101 | ACUCCAUC A CUCUUAAU | 4568 | AUUAAGAG CUGAUGAGGCCGUUAGGCCGAA IAUGGAGU | 13908 |
| 2103 | UCCAUCAC U CUUAAUCU | 4569 | AGAUUAAG CUGAUGAGGCCGUUAGGCCGAA IUGAUGGA | 13909 |
| 2105 | CAUCACUC U UAAUCUUA | 4570 | UAAGAUUA CUGAUGAGGCCGUUAGGCCGAA IAGUGAUG | 13910 |
| 2111 | UCUUAAUC U UACCAUCA | 4571 | UGAUGGUA CUGAUGAGGCCGUUAGGCCGAA IAUUAAGA | 13911 |
| 2115 | AAUCUUAC C AUCAUGAA | 4572 | UUCAUGAU CUGAUGAGGCCGUUAGGCCGAA IUAAGAUU | 13912 |
| 2116 | AUCUUACC A UCAUGAAU | 4573 | AUUCAUGA CUGAUGAGGCCGUUAGGCCGAA IGUAAGAU | 13913 |
| 2119 | UUACCAUC A UGAAUGUU | 4574 | AACAUUCA CUGAUGAGGCCGUUAGGCCGAA IAUGGUAA | 13914 |
| 2130 | AAUGUUUC C CUGCAAGA | 4575 | UCUUGCAG CUGAUGAGGCCGUUAGGCCGAA IAAACAUU | 13915 |
| 2131 | AUGUUUCC C UGCAAGAU | 4576 | AUCUUGCA CUGAUGAGGCCGUUAGGCCGAA IGAAACAU | 13916 |
| 2132 | UGUUUCCC U GCAAGAUU | 4577 | AAUCUUGC CUGAUGAGGCCGUUAGGCCGAA IGGAAACA | 13917 |
| 2135 | UUCCCUGC A AGAUUCAG | 4578 | CUGAAUCU CUGAUGAGGCCGUUAGGCCGAA ICAGGGAA | 13918 |
| 2142 | CAAGAUUC A GGCACCUA | 4579 | UAGGUGCC CUGAUGAGGCCGUUAGGCCGAA IAAUCUUG | 13919 |
| 2146 | AUUCAGGC A CCUAUGCC | 4580 | GGCAUAGG CUGAUGAGGCCGUUAGGCCGAA ICCUGAAU | 13920 |
| 2148 | UCAGGCAC C UAUGCCUG | 4581 | CAGGCAUA CUGAUGAGGCCGUUAGGCCGAA IUGCCUGA | 13921 |
| 2149 | CAGGCACC U AUGCCUGC | 4582 | GCAGGCAU CUGAUGAGGCCGUUAGGCCGAA IGUGCCUG | 13922 |
| 2154 | ACCUAUGC C UGCAGAGC | 4583 | GCUCUGCA CUGAUGAGGCCGUUAGGCCGAA ICAUAGGU | 13923 |
| 2155 | CCUAUGCC U GCAGAGCC | 4584 | GGCUCUGC CUGAUGAGGCCGUUAGGCCGAA IGCAUAGG | 13924 |
| 2158 | AUGCCUGC A GAGCCAGG | 4585 | CCUGGCUC CUGAUGAGGCCGUUAGGCCGAA ICAGGCAU | 13925 |
| 2163 | UGCAGAGC C AGGAAUGU | 4586 | ACAUUCCU CUGAUGAGGCCGUUAGGCCGAA ICUCUGCA | 13926 |
| 2164 | GCAGAGCC A GGAAUGUA | 4587 | UACAUUCC CUGAUGAGGCCGUUAGGCCGAA IGCUCUGC | 13927 |
| 2176 | AUGUAUAC A CAGGGGAA | 4588 | UUCCCCUG CUGAUGAGGCCGUUAGGCCGAA IUAUACAU | 13928 |
| 2178 | GUAUACAC A GGGGAAGA | 4589 | UCUUCCCC CUGAUGAGGCCGUUAGGCCGAA IUGUAUAC | 13929 |
| 2191 | AAGAAAUC C UCCAGAAG | 4590 | CUUCUGGA CUGAUGAGGCCGUUAGGCCGAA IAUUUCUU | 13930 |
| 2192 | AGAAAUCC U CCAGAAGA | 4591 | UCUUCUGG CUGAUGAGGCCGUUAGGCCGAA IGAUUUCU | 13931 |
| 2194 | AAAUCCUC C AGAAGAAA | 4592 | UUUCUUCU CUGAUGAGGCCGUUAGGCCGAA IAGGAUUU | 13932 |
| 2195 | AAUCCUCC A GAAGAAAG | 4593 | CUUUCUUC CUGAUGAGGCCGUUAGGCCGAA IGAGGAUU | 13933 |
| 2211 | GAAAUUAC A AUCAGAGA | 4594 | UCUCUGAU CUGAUGAGGCCGUUAGGCCGAA IUAAUUUC | 13934 |
| 2215 | UUACAAUC A GAGAUCAG | 4595 | CUGAUCUC CUGAUGAGGCCGUUAGGCCGAA IAUUGUAA | 13935 |
| 2222 | CAGAGAUC A GGAAGCAC | 4596 | GUGCUUCC CUGAUGAGGCCGUUAGGCCGAA IAUCUCUG | 13936 |
| 2229 | CAGGAAGC A CCAUACCU | 4597 | AGGUAUGG CUGAUGAGGCCGUUAGGCCGAA ICUUCCUG | 13937 |
| 2231 | GGAAGCAC C AUACCUCC | 4598 | GGAGGUAU CUGAUGAGGCCGUUAGGCCGAA IUGCUUCC | 13938 |
| 2232 | GAAGCACC A UACCUCCU | 4599 | AGGAGGUA CUGAUGAGGCCGUUAGGCCGAA IGUGCUUC | 13939 |
| 2236 | CACCAUAC C UCCUGCGA | 4600 | UCGCAGGA CUGAUGAGGCCGUUAGGCCGAA IUAUGGUG | 13940 |

TABLE XIV-continued

NCH Ribozyme and Target Sequences

| Pos | Target | Seq ID No | NCH Ribozyme | Seq ID No |
|---|---|---|---|---|
| 2237 | ACCAUACC U CCUGCGAA | 4601 | UUCGCAGG CUGAUGAGGCCGUUAGGCCGAA IGUAUGGU | 13941 |
| 2239 | CAUACCUC C UGCGAAAC | 4602 | GUUUCGCA CUGAUGAGGCCGUUAGGCCGAA IAGGUAUG | 13942 |
| 2240 | AUACCUCC U GCGAAACC | 4603 | GGUUUCGC CUGAUGAGGCCGUUAGGCCGAA IGAGGUAU | 13943 |
| 2248 | UGCGAAAC C UCAGUGAU | 4604 | AUCACUGA CUGAUGAGGCCGUUAGGCCGAA IUUUCGCA | 13944 |
| 2249 | GCGAAACC U CAGUGAUC | 4605 | GAUCACUG CUGAUGAGGCCGUUAGGCCGAA IGUUUCGC | 13945 |
| 2251 | GAAACCUC A GUGAUCAC | 4606 | GUGAUCAC CUGAUGAGGCCGUUAGGCCGAA IAGGUUUC | 13946 |
| 2258 | CAGUGAUC A CACAGUGG | 4607 | CCACUGUG CUGAUGAGGCCGUUAGGCCGAA IAUCACUG | 13947 |
| 2260 | GUGAUCAC A CACUGGCC | 4608 | GGCCACUG CUGAUGAGGCCGUUAGGCCGAA IGAUCAC | 13948 |
| 2262 | GAUCACAC A GUGGCCAU | 4609 | AUGGCCAC CUGAUGAGGCCGUUAGGCCGAA IGUGAUC | 13949 |
| 2268 | ACAGUGGC C AUCAGCAG | 4610 | CUGCUGAU CUGAUGAGGCCGUUAGGCCGAA ICCACUGU | 13950 |
| 2269 | CAGUGGCC A UCAGCAGU | 4611 | ACUGCUGA CUGAUGAGGCCGUUAGGCCGAA IGCCACUG | 13951 |
| 2272 | UGGCCAUC A GCAGUUCC | 4612 | GGAACUGC CUGAUGAGGCCGUUAGGCCGAA IAUGGCCA | 13952 |
| 2275 | CCAUCAGC A GUUCCACC | 4613 | GGUGGAAC CUGAUGAGGCCGUUAGGCCGAA ICUGAUGG | 13953 |
| 2280 | AGCAGUUC C ACCACUUU | 4614 | AAAGUGGU CUGAUGAGGCCGUUAGGCCGAA IAACUGCU | 13954 |
| 2281 | GCAGUUCC A CCACUUUA | 4615 | UAAAGUGG CUGAUGAGGCCGUUAGGCCGAA IGAACUGC | 13955 |
| 2283 | AGUUCCAC C ACUUUAGA | 4616 | UCUAAAGU CUGAUGAGGCCGUUAGGCCGAA IUGGAACU | 13956 |
| 2284 | GUUCCACC A CUUUAGAC | 4617 | GUCUAAAG CUGAUGAGGCCGUUAGGCCGAA IGUGGAAC | 13957 |
| 2286 | UCCACCAC U UUAGACUG | 4618 | CAGUCUAA CUGAUGAGGCCGUUAGGCCGAA IUGGUGGA | 13958 |
| 2293 | CUUUAGAC U GUCAUGCU | 4619 | AGCAUGAC CUGAUGAGGCCGUUAGGCCGAA IUCUAAAG | 13959 |
| 2297 | AGACUGUC A UGCUAAUG | 4620 | CAUUAGCA CUGAUGAGGCCGUUAGGCCGAA IACAGUCU | 13960 |
| 2301 | UGUCAUGC U AAUGGUGU | 4621 | ACACCAUU CUGAUGAGGCCGUUAGGCCGAA ICAUGACA | 13961 |
| 2311 | AUGGUGUC C CCGAGCCU | 4622 | AGGCUCGG CUGAUGAGGCCGUUAGGCCGAA IACACCAU | 13962 |
| 2312 | UGGUGUCC C CGAGCCUC | 4623 | GAGGCUCG CUGAUGAGGCCGUUAGGCCGAA IGACACCA | 13963 |
| 2313 | GGUGUCCC C GAGCCUCA | 4624 | UGAGGCUC CUGAUGAGGCCGUUAGGCCGAA IGGACACC | 13964 |
| 2318 | CCCCGAGC C UCAGAUCA | 4625 | UGAUCUGA CUGAUGAGGCCGUUAGGCCGAA ICUCGGGG | 13965 |
| 2319 | CCCGAGCC U CAGAUCAC | 4626 | GUGAUCUG CUGAUGAGGCCGUUAGGCCGAA IGCUCGGG | 13966 |
| 2321 | CGAGCCUC A GAUCACUU | 4627 | AAGUGAUC CUGAUGAGGCCGUUAGGCCGAA IAGGCUCG | 13967 |
| 2326 | CUCAGAUC A CUUGGUUU | 4628 | AAACCAAG CUGAUGAGGCCGUUAGGCCGAA IAUCUGAG | 13968 |
| 2328 | CAGAUCAC U UGGUUUAA | 4629 | UUAAACCA CUGAUGAGGCCGUUAGGCCGAA IUGAUCUG | 13969 |
| 2341 | UUAAAAAC A ACCACAAA | 4630 | UUUGUGGU CUGAUGAGGCCGUUAGGCCGAA IUUUUUAA | 13970 |
| 2344 | AAAACAAC C ACAAAUA | 4631 | UAUUUGU CUGAUGAGGCCGUUAGGCCGAA IUUGUUUU | 13971 |
| 2345 | AAACAACC A CAAAUAC | 4632 | GUAUUUG CUGAUGAGGCCGUUAGGCCGAA IGUUGUUU | 13972 |
| 2347 | ACAACCAC A AAUACAA | 4633 | UUGUAUUU CUGAUGAGGCCGUUAGGCCGAA IGGUUGU | 13973 |
| 2354 | CAAAUAC A ACAAGAGC | 4634 | GCUCUUGU CUGAUGAGGCCGUUAGGCCGAA IAUUUUG | 13974 |
| 2357 | AAUACAAC A AGAGCCUG | 4635 | CAGGCUCU CUGAUGAGGCCGUUAGGCCGAA IUUGUAUU | 13975 |
| 2363 | ACAAGAGC C UGGAAUUA | 4636 | UAAUUCCA CUGAUGAGGCCGUUAGGCCGAA ICUCUUGU | 13976 |
| 2364 | CAAGAGCC U GGAAUUAU | 4637 | AUAAUUCC CUGAUGAGGCCGUUAGGCCGAA IGCUCUUG | 13977 |

TABLE XIV-continued

NCH Ribozyme and Target Sequences

| Pos | Target | Seq ID No | NCH Ribozyme | Seq ID No |
|---|---|---|---|---|
| 2381 | UUUAGGAC C AGGAAGCA | 4638 | UGCUUCCU CUGAUGAGGCCGUUAGGCCGAA IUCCUAAA | 13978 |
| 2382 | UUAGGACC A GGAAGCAG | 4639 | CUGCUUCC CUGAUGAGGCCGUUAGGCCGAA IGUCCUAA | 13979 |
| 2389 | CAGGAAGC A GCACGCUG | 4640 | CAGCGUGC CUGAUGAGGCCGUUAGGCCGAA ICUUCCUG | 13980 |
| 2392 | GAAGCAGC A CGCUGUUU | 4641 | AAACAGCG CUGAUGAGGCCGUUAGGCCGAA ICUGCUUC | 13981 |
| 2396 | CAGCACGC U GUUUAUUG | 4642 | CAAUAAAC CUGAUGAGGCCGUUAGGCCGAA ICGUGCUG | 13982 |
| 2413 | AAAGAGUC A CAGAAGAG | 4643 | CUCUUCUG CUGAUGAGGCCGUUAGGCCGAA IACUCUUU | 13983 |
| 2415 | AGAGUCAC A GAAGAGGA | 4644 | UCCUCUUC CUGAUGAGGCCGUUAGGCCGAA IUGACUCU | 13984 |
| 2434 | AAGGUGUC U AUCACUGC | 4645 | GCAGUGAU CUGAUGAGGCCGUUAGGCCGAA IACACCUU | 13985 |
| 2438 | UGUCUAUC A CUGCAAAG | 4646 | CUUUGCAG CUGAUGAGGCCGUUAGGCCGAA IAUAGACA | 13986 |
| 2440 | UCUAUCAC U GCAAAGCC | 4647 | GGCUUUGC CUGAUGAGGCCGUUAGGCCGAA IUGAUAGA | 13987 |
| 2443 | AUCACUGC A AAGCCACC | 4648 | GGUGGCUU CUGAUGAGGCCGUUAGGCCGAA ICAGUGAU | 13988 |
| 2448 | UGCAAAGC C ACCAACCA | 4649 | UGGUUGGU CUGAUGAGGCCGUUAGGCCGAA ICUUUGCA | 13989 |
| 2449 | GCAAAGCC A CCAACCAG | 4650 | CUGGUUGG CUGAUGAGGCCGUUAGGCCGAA IGCUUUGC | 13990 |
| 2451 | AAAGCCAC C AACCAGAA | 4651 | UUCUGGUU CUGAUGAGGCCGUUAGGCCGAA IUGGCUUU | 13991 |
| 2452 | AAGCCACC A ACCAGAAG | 4652 | CUUCUGGU CUGAUGAGGCCGUUAGGCCGAA IGUGGCUU | 13992 |
| 2455 | CCACCAAC C AGAAGGGC | 4653 | GCCCUUCU CUGAUGAGGCCGUUAGGCCGAA IUUGGUGG | 13993 |
| 2456 | CACCAACC A GAAGGGCU | 4654 | AGCCCUUC CUGAUGAGGCCGUUAGGCCGAA IGUUGGUG | 13994 |
| 2464 | AGAAGGGC U CUGUGGAA | 4655 | UUCCACAG CUGAUGAGGCCGUUAGGCCGAA ICCCUUCU | 13995 |
| 2466 | AAGGGCUC U GUGGAAAG | 4656 | CUUUCCAC CUGAUGAGGCCGUUAGGCCGAA IAGCCCUU | 13996 |
| 2478 | GAAAGUUC A GCAUACCU | 4657 | AGGUAUGC CUGAUGAGGCCGUUAGGCCGAA IAACUUUC | 13997 |
| 2481 | AGUUCAGC A UACCUCAC | 4658 | GUGAGGUA CUGAUGAGGCCGUUAGGCCGAA ICUGAACU | 13998 |
| 2485 | CAGCAUAC C UCACUGUU | 4659 | AACAGUGA CUGAUGAGGCCGUUAGGCCGAA IUAUGCUG | 13999 |
| 2486 | AGCAUACC U CACUGUUC | 4660 | GAACAGUG CUGAUGAGGCCGUUAGGCCGAA IGUAUGCU | 14000 |
| 2488 | CAUACCUC A CUGUUCAA | 4661 | UUGAACAG CUGAUGAGGCCGUUAGGCCGAA IAGGUAUG | 14001 |
| 2490 | UACCUCAC U GUUCAAGG | 4662 | CCUUGAAC CUGAUGAGGCCGUUAGGCCGAA IUGAGGUA | 14002 |
| 2495 | CACUGUUC A AGGAACCU | 4663 | AGGUUCCU CUGAUGAGGCCGUUAGGCCGAA IAACACUG | 14003 |
| 2502 | CAAGGAAC C UCGGACAA | 4664 | UUGUCCGA CUGAUGAGGCCGUUAGGCCGAA IUUCCUUG | 14004 |
| 2503 | AAGGAACC U CGGACAAG | 4665 | CUUGUCCG CUGAUGAGGCCGUUAGGCCGAA IGUUCCUU | 14005 |
| 2509 | CCUCGGAC A AGUCUAAU | 4666 | AUUAGACU CUGAUGAGGCCGUUAGGCCGAA IUCCGAGG | 14006 |
| 2514 | GACAAGUC U AAUCUGGA | 4667 | UCCAGAUU CUGAUGAGGCCGUUAGGCCGAA IACUUGUC | 14007 |
| 2519 | GUCUAAUC U GGAGCUGA | 4668 | UCAGCUCC CUGAUGAGGCCGUUAGGCCGAA IAUUAGAC | 14008 |
| 2525 | UCGGAGC U GAUCACUC | 4669 | GAGUGAUC CUGAUGAGGCCGUUAGGCCGAA ICUCCAGA | 14009 |
| 2530 | AGCUGAUC A CUCUAACA | 4670 | UGUUAGAG CUGAUGAGGCCGUUAGGCCGAA IAUCAGCU | 14010 |
| 2532 | CUGAUCAC U CUAACAUG | 4671 | CAUGUUAG CUGAUGAGGCCGUUAGGCCGAA IUGAUCAG | 14011 |
| 2534 | GAUCACUC U AACAUGCA | 4672 | UGCAUGUU CUGAUGAGGCCGUUAGGCCGAA IAGUGAUC | 14012 |
| 2538 | ACUCUAAC A UGCACCUG | 4673 | CAGGUGCA CUGAUGAGGCCGUUAGGCCGAA IUUAGAGU | 14013 |
| 2542 | UAACAUGC A CCUGUGUG | 4674 | CACACAGG CUGAUGAGGCCGUUAGGCCGAA ICAUGUUA | 14014 |

TABLE XIV-continued

NCH Ribozyme and Target Sequences

| Pos | Target | Seq ID No | NCH Ribozyme | Seq ID No |
|---|---|---|---|---|
| 2544 | ACAUGCAC C UGUGUGGC | 4675 | GCCACACA CUGAUGAGGCCGUUAGGCCGAA IUGCAUGU | 14015 |
| 2545 | CAUGCACC U GUGUGGCU | 4676 | AGCCACAC CUGAUGAGGCCGUUAGGCCGAA IGUGCAUG | 14016 |
| 2553 | UGUGUGGC U GCGACUCU | 4677 | AGAGUCGC CUGAUGAGGCCGUUAGGCCGAA ICCACACA | 14017 |
| 2559 | GCUGCGAC U CUCUUCUG | 4678 | CAGAAGAG CUGAUGAGGCCGUUAGGCCGAA IUCGCAGC | 14018 |
| 2561 | UGCGACUC U CUUCUGGC | 4679 | GCCAGAAG CUGAUGAGGCCGUUAGGCCGAA IAGUCGCA | 14019 |
| 2563 | CGACUCUC U UCUGGCUC | 4680 | GAGCCAGA CUGAUGAGGCCGUUAGGCCGAA IAGAGUCG | 14020 |
| 2566 | CUCUCUUC U GGCUCCUA | 4681 | UAGGAGCC CUGAUGAGGCCGUUAGGCCGAA IAAGAGAG | 14021 |
| 2570 | CUUCUGGC U CCUAUUAA | 4682 | UUAAUAGG CUGAUGAGGCCGUUAGGCCGAA ICCAGAAG | 14022 |
| 2572 | UCUGGCUC C UAUUAACC | 4683 | GGUUAAUA CUGAUGAGGCCGUUAGGCCGAA IAGCCAGA | 14023 |
| 2573 | CUGGCUCC U AUUAACCC | 4684 | GGGUUAAU CUGAUGAGGCCGUUAGGCCGAA IGAGCCAG | 14024 |
| 2580 | CUAUUAAC C CUCCUUAU | 4685 | AUAAGGAG CUGAUGAGGCCGUUAGGCCGAA IUUAAUAG | 14025 |
| 2581 | UAUUAACC C UCCUUAUC | 4686 | GAUAAGGA CUGAUGAGGCCGUUAGGCCGAA IGUUAAUA | 14026 |
| 2582 | AUUAACCC U CCUUAUCC | 4687 | GGAUAAGG CUGAUGAGGCCGUUAGGCCGAA IGGUUAAU | 14027 |
| 2584 | UAACCCUC C UUAUCCGA | 4688 | UCGGAUAA CUGAUGAGGCCGUUAGGCCGAA IAGGGUUA | 14028 |
| 2585 | AACCCUCC U UAUCCGAA | 4689 | UUCGGAUA CUGAUGAGGCCGUUAGGCCGAA IGAGGGUU | 14029 |
| 2590 | UCCUUAUC C GAAAAAUG | 4690 | CAUUUUUC CUGAUGAGGCCGUUAGGCCGAA IAUAAGGA | 14030 |
| 2607 | AAAAGGUC U UCUUCUGA | 4691 | UCAGAAGA CUGAUGAGGCCGUUAGGCCGAA IACCUUUU | 14031 |
| 2610 | AGGUCUUC U UCUGAAAU | 4692 | AUUUCAGA CUGAUGAGGCCGUUAGGCCGAA IAAGACCU | 14032 |
| 2613 | UCUUCUUC U GAAAUAAA | 4693 | UUUAUUUC CUGAUGAGGCCGUUAGGCCGAA IAAGAAGA | 14033 |
| 2625 | AUAAAGAC U GACUACCU | 4694 | AGGUAGUC CUGAUGAGGCCGUUAGGCCGAA IUCUUUAU | 14034 |
| 2629 | AGACUGAC U ACCAUCA | 4695 | UGAUAGGU CUGAUGAGGCCGUUAGGCCGAA IUCAGUCU | 14035 |
| 2632 | CUGACUAC C UAUCAAUU | 4696 | AAUUGAUA CUGAUGAGGCCGUUAGGCCGAA IUAGUCAG | 14036 |
| 2633 | UGACUACC U AUCAAUUA | 4697 | UAAUUGAU CUGAUGAGGCCGUUAGGCCGAA IGUAGUCA | 14037 |
| 2637 | UACCUAUC A AUUAUAAU | 4698 | AUUAUAAU CUGAUGAGGCCGUUAGGCCGAA IAUAGGUA | 14038 |
| 2650 | UAAUGGAC C CAGAUGAA | 4699 | UUCAUCUG CUGAUGAGGCCGUUAGGCCGAA IUCCAUUA | 14039 |
| 2651 | AAUGGACC C AGAUGAAG | 4700 | CUUCAUCU CUGAUGAGGCCGUUAGGCCGAA IGUCCAUU | 14040 |
| 2652 | AUGGACCC A GAUGAAGU | 4701 | ACUUCAUC CUGAUGAGGCCGUUAGGCCGAA IGGUCCAU | 14041 |
| 2663 | UGAAGUUC C UUGGAUG | 4702 | CAUCCAAA CUGAUGAGGCCGUUAGGCCGAA IAACUUCA | 14042 |
| 2664 | GAAGUUCC U UGGAUGA | 4703 | UCAUCCAA CUGAUGAGGCCGUUAGGCCGAA IGAACUUC | 14043 |
| 2675 | GGAUGAGC A GUGUGAGC | 4704 | GCUCACAC CUGAUGAGGCCGUUAGGCCGAA ICUCAUCC | 14044 |
| 2687 | UGAGCGGC U CCCUUAUG | 4705 | CAUAAGGG CUGAUGAGGCCGUUAGGCCGAA ICCGCUCA | 14045 |
| 2689 | AGCGGCUC C CUUAUGAU | 4706 | AUCAUAAG CUGAUGAGGCCGUUAGGCCGAA IAGCCGCU | 14046 |
| 2690 | GCGGCUCC C UUAUGAUG | 4707 | CAUCAUAA CUGAUGAGGCCGUUAGGCCGAA IGAGCCGC | 14047 |
| 2691 | CGGCUCCC U UAUGAUGC | 4708 | GCAUCAUA CUGAUGAGGCCGUUAGGCCGAA IGGAGCCG | 14048 |
| 2700 | UAUGAUGC C AGCAAGUG | 4709 | CACUUGCU CUGAUGAGGCCGUUAGGCCGAA ICAUCAUA | 14049 |
| 2701 | AUGAUGCC A GCAAGUGG | 4710 | CCACUUGC CUGAUGAGGCCGUUAGGCCGAA IGCAUCAU | 14050 |
| 2704 | AUGCCAGC A AGUGGGAG | 4711 | CUCCCACU CUGAUGAGGCCGUUAGGCCGAA ICUGGCAU | 14051 |

TABLE XIV-continued

NCH Ribozyme and Target Sequences

| Pos | Target | Seq ID No | NCH Ribozyme | Seq ID No |
|---|---|---|---|---|
| 2718 | GAGUUUGC C CGGGAGAG | 4712 | CUCUCCCG CUGAUGAGGCCGUUAGGCCGAA ICAAACUC | 14052 |
| 2719 | AGUUUGCC C GGGAGAGA | 4713 | UCUCUCCC CUGAUGAGGCCGUUAGGCCGAA IGCAAACU | 14053 |
| 2729 | GGAGAGAC U UAAACUGG | 4714 | CCAGUUUA CUGAUGAGGCCGUUAGGCCGAA IUCUCUCC | 14054 |
| 2735 | ACUUAAAC U GGGCAAAU | 4715 | AUUUGCCC CUGAUGAGGCCGUUAGGCCGAA IUUUAAGU | 14055 |
| 2740 | AACUGGGC A AAUCACUU | 4716 | AAGUGAUU CUGAUGAGGCCGUUAGGCCGAA ICCCAGUU | 14056 |
| 2745 | GGCAAAUC A CUUGGAAG | 4717 | CUUCCAAG CUGAUGAGGCCGUUAGGCCGAA IAUUUGCC | 14057 |
| 2747 | CAAAUCAC U UGGAAGAG | 4718 | CUCUUCCA CUGAUGAGGCCGUUAGGCCGAA IUGAUUUG | 14058 |
| 2760 | AGAGGGGC U UUUGGAAA | 4719 | UUUCCAAA CUGAUGAGGCCGUUAGGCCGAA ICCCCUCU | 14059 |
| 2777 | AGUGGUUC A AGCAUCAG | 4720 | CUGAUGCU CUGAUGAGGCCGUUAGGCCGAA IAACCACU | 14060 |
| 2781 | GUUCAAGC A UCAGCAUU | 4721 | AAUGCUGA CUGAUGAGGCCGUUAGGCCGAA ICUUGAAC | 14061 |
| 2784 | CAAGCAUC A GCAUUUGG | 4722 | CCAAAUGC CUGAUGAGGCCGUUAGGCCGAA IAUGCUUG | 14062 |
| 2787 | GCAUCAGC A UUUGGCAU | 4723 | AUGCCAAA CUGAUGAGGCCGUUAGGCCGAA ICUGAUGC | 14063 |
| 2794 | CAUUUGGC A UUAAGAAA | 4724 | UUUCUUAA CUGAUGAGGCCGUUAGGCCGAA ICCAAAUG | 14064 |
| 2805 | AAGAAAUC A CCUACGUG | 4725 | CACGUAGG CUGAUGAGGCCGUUAGGCCGAA IAUUUCUU | 14065 |
| 2807 | GAAAUCAC C UACGUGCC | 4726 | GGCACGUA CUGAUGAGGCCGUUAGGCCGAA IUGAUUUC | 14066 |
| 2808 | AAAUCACC U ACGUGCCG | 4727 | CGGCACGU CUGAUGAGGCCGUUAGGCCGAA IGUGAUUU | 14067 |
| 2815 | CUACGUGC C GGACUGUG | 4728 | CACAGUCC CUGAUGAGGCCGUUAGGCCGAA ICACGUAG | 14068 |
| 2820 | UGCCGGAC U GUGGCUGU | 4729 | ACAGCCAC CUGAUGAGGCCGUUAGGCCGAA IUCCGGCA | 14069 |
| 2826 | ACUGUGGC U GUGAAAAU | 4730 | AUUUUCAC CUGAUGAGGCCGUUAGGCCGAA ICCACAGU | 14070 |
| 2837 | GAAAAUGC U GAAAGAGG | 4731 | CCUCUUUC CUGAUGAGGCCGUUAGGCCGAA ICAUUUUC | 14071 |
| 2850 | GAGGGGGC C ACGGCCAG | 4732 | CUGGCCGU CUGAUGAGGCCGUUAGGCCGAA ICCCCCUC | 14072 |
| 2851 | AGGGGGCC A CGGCCAGC | 4733 | GCUGGCCG CUGAUGAGGCCGUUAGGCCGAA IGCCCCCU | 14073 |
| 2856 | GCCACGGC C AGCGAGUA | 4734 | UACUCGCU CUGAUGAGGCCGUUAGGCCGAA ICCGUGGC | 14074 |
| 2857 | CCACGGCC A GCGAGUAC | 4735 | GUACUCGC CUGAUGAGGCCGUUAGGCCGAA IGCCGUGG | 14075 |
| 2866 | GCGAGUAC A AAGCUCUG | 4736 | CAGAGCUU CUGAUGAGGCCGUUAGGCCGAA IUACUCGC | 14076 |
| 2871 | UACAAAGC U CUGAUGAC | 4737 | GUCAUCAG CUGAUGAGGCCGUUAGGCCGAA ICUUUGUA | 14077 |
| 2873 | CAAAGCUC U GAUGACUG | 4738 | CAGUCAUC CUGAUGAGGCCGUUAGGCCGAA IAGCUUUG | 14078 |
| 2880 | CUGAUGAC U GAGCUAAA | 4739 | UUUAGCUC CUGAUGAGGCCGUUAGGCCGAA IUCAUCAG | 14079 |
| 2885 | GACUGAGC U AAAAAUCU | 4740 | AGAUUUUU CUGAUGAGGCCGUUAGGCCGAA ICUCAGUC | 14080 |
| 2893 | UAAAAAUC U UGACCCAC | 4741 | GUGGGUCA CUGAUGAGGCCGUUAGGCCGAA IAUUUUUA | 14081 |
| 2898 | AUCUUGAC C CACAUUGG | 4742 | CCAAUGUG CUGAUGAGGCCGUUAGGCCGAA IUCAAGAU | 14082 |
| 2899 | UCUUGACC C ACAUUGGC | 4743 | GCCAAUGU CUGAUGAGGCCGUUAGGCCGAA IGUCAAGA | 14083 |
| 2900 | CUUGACCC A CAUUGGCC | 4744 | GGCCAAUG CUGAUGAGGCCGUUAGGCCGAA IGGUCAAG | 14084 |
| 2902 | UGACCCAC A UUGGCCAC | 4745 | GUGGCCAA CUGAUGAGGCCGUUAGGCCGAA IUGGGUCA | 14085 |
| 2908 | ACAUUGGC C ACCAUCUG | 4746 | CAGAUGGU CUGAUGAGGCCGUUAGGCCGAA ICCAAUGU | 14086 |
| 2909 | CAUUGGCC A CCAUCGA | 4747 | UCAGAUGG CUGAUGAGGCCGUUAGGCCGAA IGCCAAUG | 14087 |
| 2911 | UUGGCCAC C AUCUGAAC | 4748 | GUUCAGAU CUGAUGAGGCCGUUAGGCCGAA IUGGCCAA | 14088 |

TABLE XIV-continued

NCH Ribozyme and Target Sequences

| Pos | Target | Seq ID No | NCH Ribozyme | Seq ID No |
|---|---|---|---|---|
| 2912 | UGGCCACC A UCUGAACG | 4749 | CGUUCAGA CUGAUGAGGCCGUUAGGCCGAA IGUGGCCA | 14089 |
| 2915 | CCACCAUC U GAACGUGG | 4750 | CCACGUUC CUGAUGAGGCCGUUAGGCCGAA IAUGGUGG | 14090 |
| 2929 | UGGUUAAC C UGCUGGGA | 4751 | UCCCAGCA CUGAUGAGGCCGUUAGGCCGAA IUUAACCA | 14091 |
| 2930 | GGUUAACC U GCUGGGAG | 4752 | CUCCCAGC CUGAUGAGGCCGUUAGGCCGAA IGUUAACC | 14092 |
| 2933 | UAACCUGC U GGGAGCCU | 4753 | AGGCUCCC CUGAUGAGGCCGUUAGGCCGAA ICAGGUUA | 14093 |
| 2940 | CUGGGAGC C UGCACCAA | 4754 | UUGGUGCA CUGAUGAGGCCGUUAGGCCGAA ICUCCCAG | 14094 |
| 2941 | UGGGAGCC U GCACCAAG | 4755 | CUUGGUGC CUGAUGAGGCCGUUAGGCCGAA IGCUCCCA | 14095 |
| 2944 | GAGCCUGC A CCAAGCAA | 4756 | UUGCUUGG CUGAUGAGGCCGUUAGGCCGAA ICAGGCUC | 14096 |
| 2946 | GCCUGCAC C AAGCAAGG | 4757 | CCUUGCUU CUGAUGAGGCCGUUAGGCCGAA IUGCAGGC | 14097 |
| 2947 | CCUGCACC A AGCAAGGA | 4758 | UCCUUGCU CUGAUGAGGCCGUUAGGCCGAA IGUGCAGG | 14098 |
| 2951 | CACCAAGC A AGGAGGGC | 4759 | GCCCUCCU CUGAUGAGGCCGUUAGGCCGAA ICUUGGUG | 14099 |
| 2960 | AGGAGGGC C UCUGAUGG | 4760 | CCAUCAGA CUGAUGAGGCCGUUAGGCCGAA ICCCUCCU | 14100 |
| 2961 | GGAGGGCC U CUGAUGGU | 4761 | ACCAUCAG CUGAUGAGGCCGUUAGGCCGAA IGCCCUCC | 14101 |
| 2963 | AGGGCCUC U GAUGGUGA | 4762 | UCACCAUC CUGAUGAGGCCGUUAGGCCGAA IAGGCCCU | 14102 |
| 2983 | UUGAAUAC U GCAAAUAU | 4763 | AUAUUUGC CUGAUGAGGCCGUUAGGCCGAA IUAUUCAA | 14103 |
| 2986 | AAUACUGC A AAUAUGGA | 4764 | UCCAUAUU CUGAUGAGGCCGUUAGGCCGAA ICAGUAUU | 14104 |
| 2999 | UGGAAAUC U CUCCAACU | 4765 | AGUUGGAG CUGAUGAGGCCGUUAGGCCGAA IAUUUCCA | 14105 |
| 3001 | GAAAUCUC U CCAACUAC | 4766 | GUAGUUGG CUGAUGAGGCCGUUAGGCCGAA IAGAUUUC | 14106 |
| 3003 | AAUCUCUC C AACUACCU | 4767 | AGGUAGUU CUGAUGAGGCCGUUAGGCCGAA IAGAGAUU | 14107 |
| 3004 | AUCUCUCC A ACUACCUC | 4768 | GAGGUAGU CUGAUGAGGCCGUUAGGCCCAA IGAGAGAU | 14108 |
| 3007 | UCUCCAAC U ACCUCAAG | 4769 | CUUGAGGU CUGAUGAGGCCGUUAGGCCGAA IUUGGAGA | 14109 |
| 3010 | CCAACUAC C UCAAGAGC | 4770 | GCUCUUGA CUGAUGAGGCCGUUAGGCCGAA IUAGUUGG | 14110 |
| 3011 | CAACUACC U CAAGAGCA | 4771 | UGCUCUUG CUGAUGAGGCCGUUAGGCCGAA IGUAGUUG | 14111 |
| 3013 | ACUACCUC A AGAGCAAA | 4772 | UUUGCUCU CUGAUGAGGCCGUUAGGCCGAA IAGGUAGU | 14112 |
| 3019 | UCAAGAGC A AACGUGAC | 4773 | GUCACGUU CUGAUGAGGCCGUUAGGCCGAA ICUCUUGA | 14113 |
| 3028 | AACGUGAC U UAUUUUUU | 4774 | AAAAAAUA CUGAUGAGGCCGUUAGGCCGAA IUCACGUU | 14114 |
| 3038 | AUUUUUUU U CAACAAGG | 4775 | CCUUGUUG CUGAUGAGGCCGUUAGGCCGAA IAAAAAAU | 14115 |
| 3040 | UUUUUCUC A ACAAGGAU | 4776 | AUCCUUGU CUGAUGAGGCCGUUAGGCCGAA IAGAAAAA | 14116 |
| 3043 | UUCUCAAC A AGGAUGCA | 4777 | UGCAUCCU CUGAUGAGGCCGUUAGGCCGAA IUUGAGAA | 14117 |
| 3051 | AAGGAUGC A GCACUACA | 4778 | UGUAGUGC CUGAUGAGGCCGUUAGGCCGAA ICAUCCUU | 14118 |
| 3054 | GAUGCAGC A CUACACAU | 4779 | AUGUGUAG CUGAUGAGGCCGUUAGGCCGAA ICUGCAUC | 14119 |
| 3056 | UGCAGCAC U ACACAUGG | 4780 | CCAUGUGU CUGAUGAGGCCGUUAGGCCGAA IUGCUGCA | 14120 |
| 3059 | AGCACUAC A CAUGGAGC | 4781 | GCUCCAUG CUGAUGAGGCCGUUAGGCCGAA IUAGUGCU | 14121 |
| 3061 | CACUACAC A UGGAGCCU | 4782 | AGGCUCCA CUGAUGAGGCCGUUAGGCCGAA IGUAGUG | 14122 |
| 3068 | CAUGGAGC C UAAGAAAG | 4783 | CUUUCUUA CUGAUGAGGCCGUUAGGCCGAA ICUCCAUG | 14123 |
| 3069 | AUGGAGCC U AAGAAAGA | 4784 | UCUUUCUU CUGAUGAGGCCGUUAGGCCGAA IGCUCCAU | 14124 |
| 3089 | AAUGGAGC C AGGCCUGG | 4785 | CCAGGCCU CUGAUGAGGCCGUUAGGCCGAA ICUCCAUU | 14125 |

TABLE XIV-continued

NCH Ribozyme and Target Sequences

| Pos | Target | Seq ID No | NCH Ribozyme | Seq ID No |
|-----|--------|-----------|--------------|-----------|
| 3090 | AUGGAGCC A GGCCUGGA | 4786 | UCCAGGCC CUGAUGAGgccguuaggccGAA IGCUCCAU | 14126 |
| 3094 | AGCCAGGC C UGGAACAA | 4787 | UUGUUCCA CUGAUGAGgccguuaggccGAA ICCUGGCU | 14127 |
| 3095 | GCCAGGCC U GGAACAAG | 4788 | CUUGUUCC CUGAUGAGgccguuaggccGAA IGCCUGGC | 14128 |
| 3101 | CCUGGAAC A AGGCAAGA | 4789 | UCUUGCCU CUGAUGAGgccguuaggccGAA IUUCCAGG | 14129 |
| 3106 | AACAAGGC A AGAAACCA | 4790 | UGGUUUCU CUGAUGAGgccguuaggccGAA ICCUUGUU | 14130 |
| 3113 | CAAGAAAC C AAGACUAG | 4791 | CUAGUCUU CUGAUGAGgccguuaggccGAA IUUUCUUG | 14131 |
| 3114 | AAGAAACC A AGACUAGA | 4792 | UCUAGUCU CUGAUGAGgccguuaggccGAA IGUUUCUU | 14132 |
| 3119 | ACCAAGAC U AGAUAGCG | 4793 | CGCUAUCU CUGAUGAGgccguuaggccGAA IUCUUGGU | 14133 |
| 3130 | AUAGCGUC A CCAGCAGC | 4794 | GCUGCUGG CUGAUGAGgccguuaggccGAA IACGCUAU | 14134 |
| 3132 | AGCGUCAC C AGCAGCGA | 4795 | UCGCUGCU CUGAUGAGgccguuaggccGAA IUGACGCU | 14135 |
| 3133 | GCGUCACC A GCAGCAA | 4796 | UUCGCUGC CUGAUGAGgccguuaggccGAA IGUGACGC | 14136 |
| 3136 | UCACCAGC A GCGAAAGC | 4797 | GCUUUCGC CUGAUGAGgccguuaggccGAA ICUGGUGA | 14137 |
| 3145 | GCGAAAGC U UUGCGAGC | 4798 | GCUCGCAA CUGAUGAGgccguuaggccGAA ICUUUCGC | 14138 |
| 3154 | UUGCGAGC U CCGGCUUU | 4799 | AAAGCCGG CUGAUGAGgccguuaggccGAA ICUCGCAA | 14139 |
| 3156 | GCGAGCUC C GGCUUUCA | 4800 | UGAAAGCC CUGAUGAGgccguuaggccGAA IAGCUCGC | 14140 |
| 3160 | GCUCCGGC U UUCAGGAA | 4801 | UUCCUGAA CUGAUGAGgccguuaggccGAA ICCGGAGC | 14141 |
| 3164 | CGGCUUUC A GGAAGAUA | 4802 | UAUCUUCC CUGAUGAGgccguuaggccGAA IAAAGCCG | 14142 |
| 3179 | UAAAAGUC U GAGUGAUG | 4803 | CAUCACUC CUGAUGAGgccguuaggccGAA IACUUUUA | 14143 |
| 3207 | GAGGAUUC U GACGGUUU | 4804 | AAACCGUC CUGAUGAGgccguuaggccGAA IAAUCCUC | 14144 |
| 3217 | ACGGUUUC U ACAAGGAG | 4805 | CUCCUUGU CUGAUGAGgccguuaggccGAA IAAACCGU | 14145 |
| 3220 | GUUUCUAC A AGGAGCCC | 4806 | GGGCUCCU CUGAUGAGgccguuaggccGAA IUAGAAAC | 14146 |
| 3227 | CAAGGAGC C CAUCACUA | 4807 | UAGUGAUG CUGAUGAGgccguuaggccGAA ICUCCUUG | 14147 |
| 3228 | AAGGAGCC C AUCACUAU | 4808 | AUAGUGAU CUGAUGAGgccguuaggccGAA IGCUCCUU | 14148 |
| 3229 | AGGAGCCC A UCACUAUG | 4809 | CAUAGUGA CUGAUGAGgccguuaggccGAA IGGCUCCU | 14149 |
| 3232 | AGCCCAUC A CUAUGGAA | 4810 | UUCCAUAG CUGAUGAGgccguuaggccGAA IUGGGCU | 14150 |
| 3234 | CCCAUCAC U AUGGAAGA | 4811 | UCUUCCAU CUGAUGAGgccguuaggccGAA IUGAUGGG | 14151 |
| 3245 | GGAAGAUC U GAUUUCUU | 4812 | AAGAAAUC CUGAUGAGgccguuaggccGAA IAUCUUCC | 14152 |
| 3252 | CUGAUUUC U UACAGUUU | 4813 | AAACUGUA CUGAUGAGgccguuaggccGAA IAAAUCAG | 14153 |
| 3256 | UUUCUUAC A GUUUCAA | 4814 | UUGAAAAC CUGAUGAGgccguuaggccGAA IUAAGAAA | 14154 |
| 3263 | CAGUUUC A AGUGGCCA | 4815 | UGGCCACU CUGAUGAGgccguuaggccGAA IAAAACUG | 14155 |
| 3270 | CAAGUGGC C AGAGGCAU | 4816 | AUGCCUCU CUGAUGAGgccguuaggccGAA ICCACUUG | 14156 |
| 3271 | AAGUGGCC A GAGGCAUG | 4817 | CAUGCCUC CUGAUGAGgccguuaggccGAA IGCCACUU | 14157 |
| 3277 | CCAGAGGC A UGGAGUUC | 4818 | GAACUCCA CUGAUGAGgccguuaggccGAA ICCUCUGG | 14158 |
| 3286 | UGGAGUUC C UGUCUUCC | 4819 | GGAAGACA CUGAUGAGgccguuaggccGAA IAACUCCA | 14159 |
| 3287 | GGAGUUCC U GUCUUCCA | 4820 | UGGAAGAC CUGAUGAGgccguuaggccGAA IGAACUCC | 14160 |
| 3291 | UUCCUGUC U UCCAGAAA | 4821 | UUUCUGGA CUGAUGAGgccguuaggccGAA IACAGGAA | 14161 |
| 3294 | CUGUCUUC C AGAAAGUG | 4822 | CACUUUCU CUGAUGAGgccguuaggccGAA IAAGACAG | 14162 |

TABLE XIV-continued

NCH Ribozyme and Target Sequences

| Pos | Target | Seq ID No | NCH Ribozyme | Seq ID No |
|---|---|---|---|---|
| 3295 | UGUCUUCC A GAAAGUGC | 4823 | GCACUUUC CUGAUGAGGCCGUUAGGCCGAA IGAAGACA | 14163 |
| 3304 | GAAAGUGC A UUCAUCGG | 4824 | CCGAUGAA CUGAUGAGGCCGUUAGGCCGAA ICACUUUC | 14164 |
| 3308 | GUGCAUUC A UCGGGACC | 4825 | GGUCCCGA CUGAUGAGGCCGUUAGGCCGAA IAAUGCAC | 14165 |
| 3316 | AUCGGGAC C UGGCAGCG | 4826 | CGCUGCCA CUGAUGAGGCCGUUAGGCCGAA IUCCCGAU | 14166 |
| 3317 | UCGGGACC U GGCAGCGA | 4827 | UCGCUGCC CUGAUGAGGCCGUUAGGCCGAA IGUCCCGA | 14167 |
| 3321 | GACCUGGC A GCGAGAAA | 4828 | UUUCUCGC CUGAUGAGGCCGUUAGGCCGAA ICCAGGUC | 14168 |
| 3331 | CGAGAAAC A UUCUUUUA | 4829 | UAAAAGAA CUGAUGAGGCCGUUAGGCCGAA IUUUCUCG | 14169 |
| 3335 | AAACAUUC U UUUAUCUG | 4830 | CAGAUAAA CUGAUGAGGCCGUUAGGCCGAA IAAUGUUU | 14170 |
| 3342 | CUUUUAUC U GAGAACAA | 4831 | UUGUUCUC CUGAUGAGGCCGUUAGGCCGAA IAUAAAAG | 14171 |
| 3349 | CUGAGAAC A ACGUGGUG | 4832 | CACCACGU CUGAUGAGGCCGUUAGGCCGAA IUUCUCAG | 14172 |
| 3376 | AUUUUGGC C UUGCCCGG | 4833 | CCGGGCAA CUGAUGAGGCCGUUAGGCCGAA ICCAAAAU | 14173 |
| 3377 | UUUUGGCC U UGCCCGGG | 4834 | CCCGGGCA CUGAUGAGGCCGUUAGGCCGAA IGCCAAAA | 14174 |
| 3381 | GGCCUUGC C CGGGAUAU | 4835 | AUAUCCCG CUGAUGAGGCCGUUAGGCCGAA ICAAGGCC | 14175 |
| 3382 | GCCUUGCC C GGGAUAUU | 4836 | AAUAUCCC CUGAUGAGGCCGUUAGGCCGAA IGCAAGGC | 14176 |
| 3400 | AUAAGAAC C CCGAUUAU | 4837 | AUAAUCGG CUGAUGAGGCCGUUAGGCCGAA IUUCUUAU | 14177 |
| 3401 | UAAGAACC C CGAUUAUG | 4838 | CAUAAUCG CUGAUGAGGCCGUUAGGCCGAA IGUUCUUA | 14178 |
| 3402 | AAGAACCC C GAUUAUGU | 4839 | ACAUAAUC CUGAUGAGGCCGUUAGGCCGAA IGGUUCUU | 14179 |
| 3426 | GGAGAUAC U CGACUUCC | 4840 | GGAAGUCG CUGAUGAGGCCGUUAGGCCGAA IUAUCUCC | 14180 |
| 3431 | UACUCGAC U UCCUCUGA | 4841 | UCAGAGGA CUGAUGAGGCCGUUAGGCCGAA IUCGAGUA | 14181 |
| 3434 | UCGACUUC C UCUGAAAU | 4842 | AUUUCAGA CUGAUGAGGCCGUUAGGCCGAA IAAGUCGA | 14182 |
| 3435 | CGACUUCC U CUGAAAUG | 4843 | CAUUUCAG CUGAUGAGGCCGUUAGGCCGAA IGAAGUCG | 14183 |
| 3437 | ACUUCCUC U GAAAUGGA | 4844 | UCCAUUUC CUGAUGAGGCCGUUAGGCCGAA IAGGAAGU | 14184 |
| 3450 | UGGAUGGC U CCCGAAUC | 4845 | GAUUCGGG CUGAUGAGGCCGUUAGGCCGAA ICCAUCCA | 14185 |
| 3452 | CAUGGCUC C CGAAUCUA | 4846 | UAGAUUCG CUGAUGAGGCCGUUAGGCCGAA IAGCCAUC | 14186 |
| 3453 | AUGGCUCC C GAAUCUAU | 4847 | AUAGAUUC CUGAUGAGGCCGUUAGGCCGAA IGAGCCAU | 14187 |
| 3459 | CCCGAAUC U AUCUUUGA | 4848 | UCAAAGAU CUGAUGAGGCCGUUAGGCCGAA IAUUCGGG | 14188 |
| 3463 | AAUCUAUC U UUGACAAA | 4849 | UUUGUCAA CUGAUGAGGCCGUUAGGCCGAA IAUAGAUU | 14189 |
| 3469 | UCUUUGAC A AAUCUAC | 4850 | GUAGAUUU CUGAUGAGGCCGUUAGGCCGAA IUCAAAGA | 14190 |
| 3475 | ACAAAAUC U ACAGCACC | 4851 | GGUGCUGU CUGAUGAGGCCGUUAGGCCGAA IAUUUUGU | 14191 |
| 3478 | AAUCUAC A GCACCAAG | 4852 | CUUGGUGC CUGAUGAGGCCGUUAGGCCGAA IUAGAUUU | 14192 |
| 3481 | UCUACAGC A CCAAGAGC | 4853 | GCUCUUGG CUGAUGAGGCCGUUAGGCCGAA ICUGUAGA | 14193 |
| 3483 | UACAGCAC C AAGAGCGA | 4854 | UCGCUCUU CUGAUGAGGCCGUUAGGCCGAA IUGCUGUA | 14194 |
| 3484 | ACAGCACC A AGAGCGAC | 4855 | GUCGCUCU CUGAUGAGGCCGUUAGGCCGAA IGUGCUGU | 14195 |
| 3501 | GUGUGGUC U UACGGAGU | 4856 | ACUCCGUA CUGAUGAGGCCGUUAGGCCGAA IACCACAC | 14196 |
| 3515 | AGUAUUGC U GUGGGAAA | 4857 | UUUCCCAC CUGAUGAGGCCGUUAGGCCGAA ICAAUACU | 14197 |
| 3526 | GGGAAAUC U UCUCCUUA | 4858 | UAAGGAGA CUGAUGAGGCCGUUAGGCCGAA IAUUUCCC | 14198 |
| 3529 | AAAUCUUC U CCUUAGGU | 4859 | ACCUAAGG CUGAUGAGGCCGUUAGGCCGAA IAAGAUUU | 14199 |

TABLE XIV-continued

NCH Ribozyme and Target Sequences

| Pos | Target | Seq ID No | NCH Ribozyme | Seq ID No |
|---|---|---|---|---|
| 3531 | AUCUUCUC C UUAGGUGG | 4860 | CCACCUAA CUGAUGAGgccGUUAGGCCGAA IAGAAGAU | 14200 |
| 3532 | UCUUCUCC U UAGGUGGG | 4861 | CCCACCUA CUGAUGAGgccGUUAGGCCGAA IGAGAAGA | 14201 |
| 3543 | GGUGGGUC U CCAUACCC | 4862 | GGGUAUGG CUGAUGAGgccGUUAGGCCGAA IACCCACC | 14202 |
| 3545 | UGGGUCUC C AUACCCAG | 4863 | CUGGGUAU CUGAUGAGgccGUUAGGCCGAA IAGACCCA | 14203 |
| 3546 | GGGUCUCC A UACCCAGG | 4864 | CCUGGGUA CUGAUGAGgccGUUAGGCCGAA IGAGACCC | 14204 |
| 3550 | CUCCAUAC C CAGGAGUA | 4865 | UACUCCUG CUGAUGAGgccGUUAGGCCGAA IUAUGGAG | 14205 |
| 3551 | UCCAUACC C AGGAGUAC | 4866 | GUACUCCU CUGAUGAGgccGUUAGGCCGAA IGUAUGGA | 14206 |
| 3552 | CCAUACCC A GGAGUACA | 4867 | UGUACUCC CUGAUGAGgccGUUAGGCCGAA IGGUAUGG | 14207 |
| 3560 | AGGAGUAC A AAUGGAUG | 4868 | CAUCCAUU CUGAUGAGgccGUUAGGCCGAA IUACUCCU | 14208 |
| 3574 | AUGAGGAC U UUUGCAGU | 4869 | ACUGCAAA CUGAUGAGgccGUUAGGCCGAA IUCCUCAU | 14209 |
| 3580 | ACUUUUGC A GUCGCCUG | 4870 | CAGGCGAC CUGAUGAGgccGUUAGGCCGAA ICAAAAGU | 14210 |
| 3586 | GCAGUCGC C UGAGGGAA | 4871 | UUCCCUCA CUGAUGAGgccGUUAGGCCGAA ICGACUGC | 14211 |
| 3587 | CAGUCGCC U GAGGGAAG | 4872 | CUUCCCUC CUGAUGAGgccGUUAGGCCGAA IGCGACUG | 14212 |
| 3598 | GGGAAGGC A UGAGGAUG | 4873 | CAUCCUCA CUGAUGAGgccGUUAGGCCGAA ICCUUCCC | 14213 |
| 3612 | AUGAGAGC U CCUGAGUA | 4874 | UACUCAGG CUGAUGAGgccGUUAGGCCGAA ICUCUCAU | 14214 |
| 3614 | GAGAGCUC C UGAGUACU | 4875 | AGUACUCA CUGAUGAGgccGUUAGGCCGAA IAGCUCUC | 14215 |
| 3615 | AGAGCUCC U GAGUACUC | 4876 | GAGUACUC CUGAUGAGgccGUUAGGCCGAA IGAGCUCU | 14216 |
| 3622 | CUGAGUAC U CUACUCCU | 4877 | AGGAGUAG CUGAUGAGgccGUUAGGCCGAA IUACUCAG | 14217 |
| 3624 | GAGUACUC U ACUCCUGA | 4878 | UCAGGAGU CUGAUGAGgccGUUAGGCCGAA IAGUACUC | 14218 |
| 3627 | UACUCUAC U CCUGAAAU | 4879 | AUUUCAGG CUGAUGAGgccGUUAGGCCGAA IUAGAGUA | 14219 |
| 3629 | CUCUACUC C UGAAAUCU | 4880 | AGAUUUCA CUGAUGAGgccGUUAGGCCGAA IAGUAGAG | 14220 |
| 3630 | UCUACUCC U GAAAUCUA | 4881 | UAGAUUUC CUGAUGAGgccGUUAGGCCGAA IGAGUAGA | 14221 |
| 3637 | CUGAAAUC U AUCAGAUC | 4882 | GAUCUGAU CUGAUGAGgccGUUAGGCCGAA IAUUUCAG | 14222 |
| 3641 | AAUCUAUC A GAUCAUGC | 4883 | GCAUGAUC CUGAUGAGgccGUUAGGCCGAA IAUAGAUU | 14223 |
| 3646 | AUCAGAUC A UGCUGGAC | 4884 | GUCCAGCA CUGAUGAGgccGUUAGGCCGAA IAUCUGAU | 14224 |
| 3650 | GAUCAUGC U GGACUGCU | 4885 | AGCAGUCC CUGAUGAGgccGUUAGGCCGAA ICAUGAUC | 14225 |
| 3655 | UGCUGGAC U GCUGGCAC | 4886 | GUGCCAGC CUGAUGAGgccGUUAGGCCGAA IUCCAGCA | 14226 |
| 3658 | UGGACUGC U GGCACAGA | 4887 | UCUGUGCC CUGAUGAGgccGUUAGGCCGAA ICAGUCCA | 14227 |
| 3662 | CUGCUGGC A CAGAGACC | 4888 | GGUCUCUG CUGAUGAGgccGUUAGGCCGAA ICCAGCAG | 14228 |
| 3664 | GCUGGCAC A GAGACCCA | 4889 | UGGGUCUC CUGAUGAGgccGUUAGGCCGAA IUGCCAGC | 14229 |
| 3670 | ACAGAGAC C CAAAAGAA | 4890 | UUCUUUUG CUGAUGAGgccGUUAGGCCGAA IUCUCUGU | 14230 |
| 3671 | CAGAGACC C AAAAGAAA | 4891 | UUUCUUUU CUGAUGAGgccGUUAGGCCGAA IGUCUCUG | 14231 |
| 3672 | AGAGACCC A AAAGAAAG | 4892 | CUUUCUUU CUGAUGAGgccGUUAGGCCGAA IGGUCUCU | 14232 |
| 3683 | AGAAAGGC C AAGAUUUG | 4893 | CAAAUCUU CUGAUGAGgccGUUAGGCCGAA ICCUUUCU | 14233 |
| 3684 | GAAAGGCC A AGAUUUGC | 4894 | GCAAAUCU CUGAUGAGgccGUUAGGCCGAA IGCCUUUC | 14234 |
| 3693 | AGAUUUGC A GAACUUGU | 4895 | ACAAGUUC CUGAUGAGgccGUUAGGCCGAA ICAAAUCU | 14235 |
| 3698 | UGCAGAAC U UGUGGAAA | 4896 | UUUCCACA CUGAUGAGgccGUUAGGCCGAA IUUCUGCA | 14236 |

TABLE XIV-continued

NCH Ribozyme and Target Sequences

| Pos | Target | Seq ID No | NCH Ribozyme | Seq ID No |
|---|---|---|---|---|
| 3710 | GGAAAAAC U AGGUGAUU | 4897 | AAUCACCU CUGAUGAGGCCGUUAGGCCGAA IUUUUUCC | 14237 |
| 3722 | UGAUUUGC U UCAAGCAA | 4898 | UUCCACA CUGAUGAGGCCGUUAGGCCGAA ICAAAUCA | 14238 |
| 3725 | UUUGCUUC A AGCAAAUG | 4899 | CAUUUGCU CUGAUGAGGCCGUUAGGCCGAA IAAGCAAA | 14239 |
| 3729 | CUUCAAGC A AAUGUACA | 4900 | UGUACAUU CUGAUGAGGCCGUUAGGCCGAA ICUUGAAG | 14240 |
| 3737 | AAAUGUAC A ACAGGAUG | 4901 | CAUCCUGU CUGAUGAGGCCGUUAGGCCGAA IUACAUUU | 14241 |
| 3740 | UGUACAAC A GGAUGGUA | 4902 | UACCAUCC CUGAUGAGGCCGUUAGGCCGAA IUUGUACA | 14242 |
| 3754 | GUAAAGAC U ACAUCCCA | 4903 | UGGGAUGU CUGAUGAGGCCGUUAGGCCGAA IUCUUUAC | 14243 |
| 3757 | AAGACUAC A UCCCAAUC | 4904 | GAUUGGGA CUGAUGAGGCCGUUAGGCCGAA IAGUCUU | 14244 |
| 3760 | ACUACAUC C CAAUCAAU | 4905 | AUUGAUUG CUGAUGAGGCCGUUAGGCCGAA IAUGUAGU | 14245 |
| 3761 | CUACAUCC C AAUCAAUG | 4906 | CAUUGAUU CUGAUGAGGCCGUUAGGCCGAA IGAUGUAG | 14246 |
| 3762 | UACAUCCC A UACUGACA | 4907 | GCAUUGAU CUGAUGAGGCCGUUAGGCCGAA IGGAUGUA | 14247 |
| 3766 | UCCCAAUC A AUGCCAUA | 4908 | UAUGGCAU CUGAUGAGGCCGUUAGGCCGAA IAUUGGGA | 14248 |
| 3771 | AUCAAUGC C AUACUGAC | 4909 | GUCAGUAU CUGAUGAGGCCGUUAGGCCGAA ICAUUGAU | 14249 |
| 3772 | UCAAUGCC A UACUGACA | 4910 | UGUCAGUA CUGAUGAGGCCGUUAGGCCGAA IGCAUUGA | 14250 |
| 3776 | UGCCAUAC U GACAGGAA | 4911 | UUCCUGUC CUGAUGAGGCCGUUAGGCCGAA IUAUGGCA | 14251 |
| 3780 | AUACUGAC A GGAAAUAG | 4912 | CUAUUUCC CUGAUGAGGCCGUUAGGCCGAA IUCAGUAU | 14252 |
| 3798 | GGGUUUAC A UACUCAAC | 4913 | GUUGAGUA CUGAUGAGGCCGUUAGGCCGAA IUAAACCC | 14253 |
| 3802 | UUACAUAC U CAACUCCU | 4914 | AGGAGUUG CUGAUGAGGCCGUUAGGCCGAA IUAUGUAA | 14254 |
| 3804 | ACAUACUC A ACUCCUGC | 4915 | GCAGGAGU CUGAUGAGGCCGUUAGGCCGAA IAGUAUGU | 14255 |
| 3807 | UACUCAAC U CCUGCCUU | 4916 | AAGGCAGG CUGAUGAGGCCGUUAGGCCGAA IUUGAGUA | 14256 |
| 3809 | CUCAACUC C UGCCUUCU | 4917 | AGAAGGCA CUGAUGAGGCCGUUAGGCCGAA IAGUUGAG | 14257 |
| 3810 | UCAACUCC U GCCUUCUC | 4918 | GAGAAGGC CUGAUGAGGCCGUUAGGCCGAA IGAGUUGA | 14258 |
| 3813 | ACUCCUGC C UUCUUUGA | 4919 | UCAGAGAA CUGAUGAGGCCGUUAGGCCGAA ICAGGAGU | 14259 |
| 3814 | CUCCUGCC U UCUCUGAG | 4920 | CUCAGAGA CUGAUGAGGCCGUUAGGCCGAA IGCAGGAG | 14260 |
| 3817 | CUGCCUUC U CUGAGGAC | 4921 | GUCCUCAG CUGAUGAGGCCGUUAGGCCGAA IAAGGCAG | 14261 |
| 3819 | GCCUUCUC U GAGGACUU | 4922 | AAGUCCUC CUGAUGAGGCCGUUAGGCCGAA IAGAAGGC | 14262 |
| 3826 | CUGAGGAC U UCUUCAGG | 4923 | CUUGAAGA CUGAUGAGGCCGUUAGGCCGAA IUCCUCAG | 14263 |
| 3829 | AGGACUUC U UCAAGGAA | 4924 | UUCCUUGA CUGAUGAGGCCGUUAGGCCGAA IAAGUCCU | 14264 |
| 3832 | ACUUCUUC A AGGAAAGU | 4925 | ACUUUCCU CUGAUGAGGCCGUUAGGCCGAA IAAGAAGU | 14265 |
| 3846 | AGUAUUUC A GCUCCGAA | 4926 | UUCGGAGC CUGAUGAGGCCGUUAGGCCGAA IAAAUACU | 14266 |
| 3849 | AUUUCAGC U CCGAAGUU | 4927 | AACUUCGG CUGAUGAGGCCGUUAGGCCGAA ICUGAAAU | 14267 |
| 3851 | UUCAGCUC C GAAGUUUA | 4928 | UAAACUUC CUGAUGAGGCCGUUAGGCCGAA IAGCUGAA | 14268 |
| 3864 | UUUAAUUC A GGAAGCUC | 4929 | GAGCUUCC CUGAUGAGGCCGUUAGGCCGAA IAAUUAAA | 14269 |
| 3871 | CAGGAAGC U CUGAUGAU | 4930 | AUCAUCAG CUGAUGAGGCCGUUAGGCCGAA ICUUCCUG | 14270 |
| 3873 | GGAAGCUC U GAUGAUGU | 4931 | ACAUCAUC CUGAUGAGGCCGUUAGGCCGAA IAGCUUCC | 14271 |
| 3883 | AUGAUGUC A GAUAUGUA | 4932 | UACAUAUC CUGAUGAGGCCGUUAGGCCGAA IACAUCAU | 14272 |
| 3897 | GUAAAUGC U UUCAAGUU | 4933 | AACUUGAA CUGAUGAGGCCGUUAGGCCGAA ICAUUUAC | 14273 |

TABLE XIV-continued

NCH Ribozyme and Target Sequences

| Pos | Target | Seq ID No | NCH Ribozyme | Seq ID No |
|---|---|---|---|---|
| 3901 | AUGCUUUC A AGUUCAUG | 4934 | CAUGAACU CUGAUGAGGCCGUUAGGCCGAA IAAAGCAU | 14274 |
| 3907 | UCAAGUUC A UGAGCCUG | 4935 | CAGGCUCA CUGAUGAGGCCGUUAGGCCGAA IAACUUGA | 14275 |
| 3913 | UCAUGAGC C UGGAAAGA | 4936 | UCUUUCCA CUGAUGAGGCCGUUAGGCCGAA ICUCAUGA | 14276 |
| 3914 | CAUGAGCC U GGAAAGAA | 4937 | UUCUUUCC CUGAUGAGGCCGUUAGGCCGAA IGCUCAUG | 14277 |
| 3925 | AAAGAAUC A AAACCUUU | 4938 | AAAGGUUU CUGAUGAGGCCGUUAGGCCGAA IAUUCUUU | 14278 |
| 3930 | AUCAAAAC C UUUGAAGA | 4939 | UCUUCAAA CUGAUGAGGCCGUUAGGCCGAA IUUUUGAU | 14279 |
| 3931 | UCAAAACC U UUGAAGAA | 4940 | UUCUUCAA CUGAUGAGGCCGUUAGGCCGAA IGUUUUGA | 14280 |
| 3941 | UGAAGAAC U UUUACCGA | 4941 | UCGGUAAA CUGAUGAGGCCGUUAGGCCGAA IUUCUUCA | 14281 |
| 3947 | ACUUUUAC C GAAUGCCA | 4942 | UGGCAUUC CUGAUGAGGCCGUUAGGCCGAA IAAAAGU | 14282 |
| 3954 | CCGAAUGC C ACCUCCAU | 4943 | AUGGAGGU CUGAUGAGGCCGUUAGGCCGAA ICAUUCGG | 14283 |
| 3955 | CGAAUGCC A CCUCCAUG | 4944 | CAUGGAGG CUGAUGAGGCCGUUAGGCCGAA IGCAUUCG | 14284 |
| 3957 | AAUGCCAC C UCCAUGUU | 4945 | AACAUGGA CUGAUGAGGCCGUUAGGCCGAA IUGGCAUU | 14285 |
| 3958 | AUGCCACC U CCAUGUUU | 4946 | AAACAUGG CUGAUGAGGCCGUUAGGCCGAA IGUGGCAU | 14286 |
| 3960 | GCCACCUC C AUGUUUGA | 4947 | UCAAACAU CUGAUGAGGCCGUUAGGCCGAA IAGGUGGC | 14287 |
| 3961 | CCACCUCC A UGUUUGAU | 4948 | AUCAAACA CUGAUGAGGCCGUUAGGCCGAA IGAGGUGG | 14288 |
| 3973 | UUGAUGAC U ACCAGGGC | 4949 | GCCCUGGU CUGAUGAGGCCGUUAGGCCGAA IUCAUCAA | 14289 |
| 3976 | AUGACUAC C AGGGCGAC | 4950 | GUCGCCCU CUGAUGAGGCCGUUAGGCCGAA IUAGUCAU | 14290 |
| 3977 | UGACUACC A GGGCGACA | 4951 | UGUCGCCC CUGAUGAGGCCGUUAGGCCGAA IGUAGUCA | 14291 |
| 3985 | AGGGCGAC A GCAGCACU | 4952 | AGUGCUGC CUGAUGAGGCCGUUAGGCCGAA IUCGCCCU | 14292 |
| 3988 | GCGACAGC A GCACUCUG | 4953 | CAGAGUGC CUGAUGAGGCCGUUAGGCCGAA ICUGUCGC | 14293 |
| 3991 | ACAGCAGC A CUCUGUUG | 4954 | CAACAGAG CUGAUGAGGCCGUUAGGCCGAA ICUGCUGU | 14294 |
| 3993 | AGCAGCAC U CUGUUGGC | 4955 | GCCAACAG CUGAUGAGGCCGUUAGGCCGAA IUGCUGCU | 14295 |
| 3995 | CAGCACUC U GUUGGCCU | 4956 | AGGCCAAC CUGAUGAGGCCGUUAGGCCGAA IAGUGCUG | 14296 |
| 4002 | CUGUUGGC C UCUCCCAU | 4957 | AUGGGAGA CUGAUGAGGCCGUUAGGCCGAA ICCAACAG | 14297 |
| 4003 | UGUUGGCC U CUCCCAUG | 4958 | CAUGGGAG CUGAUGAGGCCGUUAGGCCGAA IGCCAACA | 14298 |
| 4005 | UUGGCCUC U CCCAUGCU | 4959 | AGCAUGGG CUGAUGAGGCCGUUAGGCCGAA IAGGCCAA | 14299 |
| 4007 | GGCCUCUC C CAUGCUGA | 4960 | UCAGCAUG CUGAUGAGGCCGUUAGGCCGAA IAGAGGCC | 14300 |
| 4008 | GCCUCUCC C AUGCUGAA | 4961 | UUCAGCAU CUGAUGAGGCCGUUAGGCCGAA IGAGAGGC | 14301 |
| 4009 | CCUCUCCC A UGCUGAAG | 4962 | CUUCAGCA CUGAUGAGGCCGUUAGGCCGAA IGGAGAGG | 14302 |
| 4013 | UCCCAUGC U GAAGCGCU | 4963 | AGCGCUUC CUGAUGAGGCCGUUAGGCCGAA ICAUGGGA | 14303 |
| 4021 | UGAAGCGC U UCACCUGG | 4964 | CCAGGUGA CUGAUGAGGCCGUUAGGCCGAA ICGCUUCA | 14304 |
| 4024 | AGCGCUUC A CCUGGACU | 4965 | AGUCCAGG CUGAUGAGGCCGUUAGGCCGAA IAAGCGCU | 14305 |
| 4026 | CGCUUCAC C UGGACUGA | 4966 | UCAGUCCA CUGAUGAGGCCGUUAGGCCGAA IUGAAGCG | 14306 |
| 4027 | GCUUCACC U GGACUGAC | 4967 | GUCAGUCC CUGAUGAGGCCGUUAGGCCGAA IGUGAAGC | 14307 |
| 4032 | ACCUGGAC U GACAGCAA | 4968 | UUGCUGUC CUGAUGAGGCCGUUAGGCCGAA IUCCAGGU | 14308 |
| 4036 | GGACUGAC A GCAAACCC | 4969 | GGGUUUGC CUGAUGAGGCCGUUAGGCCGAA ICAGUCC | 14309 |
| 4039 | CUGACAGC A AACCCAAG | 4970 | CUUGGGUU CUGAUGAGGCCGUUAGGCCGAA ICUGUCAG | 14310 |

TABLE XIV-continued

NCH Ribozyme and Target Sequences

| Pos | Target | Seq ID No | NCH Ribozyme | Seq ID No |
|---|---|---|---|---|
| 4043 | CAGCAAAC C CAAGGCCU | 4971 | AGGCCUUG CUGAUGAGGCCGUUAGGCCGAA IUUUGCUG | 14311 |
| 4044 | AGCAAACC C AAGGCCUC | 4972 | GAGGCCUU CUGAUGAGGCCGUUAGGCCGAA IGUUUGCU | 14312 |
| 4045 | GCAAACCC A AGGCCUCG | 4973 | CGAGGCCU CUGAUGAGGCCGUUAGGCCGAA IGGUUUGC | 14313 |
| 4050 | CCCAAGGC C UCGCUCAA | 4974 | UUGAGCGA CUGAUGAGGCCGUUAGGCCGAA ICCUUGGG | 14314 |
| 4051 | CCAAGGCC U CGCUCAAG | 4975 | CUUGAGCG CUGAUGAGGCCGUUAGGCCGAA IGCCUUGG | 14315 |
| 4055 | GGCCUCGC U CAAGAUUG | 4976 | CAAUCUUG CUGAUGAGGCCGUUAGGCCGAA ICGAGGCC | 14316 |
| 4057 | CCUCGCUC A AGAUUGAC | 4977 | GUCAAUCU CUGAUGAGGCCGUUAGGCCGAA IAGCGAGG | 14317 |
| 4066 | AGAUUGAC U UGAGAGUA | 4978 | UACUCUCA CUGAUGAGGCCGUUAGGCCGAA IUCAAUCU | 14318 |
| 4077 | AGAGUAAC C AGUAAAAG | 4979 | CUUUUACU CUGAUGAGGCCGUUAGGCCGAA IUUACUCU | 14319 |
| 4078 | GAGUAACC A GUAAAAGU | 4980 | ACUUUUAC CUGAUGAGGCCGUUAGGCCGAA IGUUACUC | 14320 |
| 4100 | GUCGGGGC U GUCUGAUG | 4981 | CAUCAGAC CUGAUGAGGCCGUUAGGCCGAA ICCCCGAC | 14321 |
| 4104 | GGGCUGUC U GAUGUCAG | 4982 | CUGACAUC CUGAUGAGGCCGUUAGGCCGAA IACAGCCC | 14322 |
| 4111 | CUGAUGUC A GCAGGCCC | 4983 | GGGCCUGC CUGAUGAGGCCGUUAGGCCGAA IACAUCAG | 14323 |
| 4114 | AUGUCAGC A GGCCCAGU | 4984 | ACUGGGCC CUGAUGAGGCCGUUAGGCCGAA ICUGACAU | 14324 |
| 4118 | CAGCAGGC C CAGUUUCU | 4985 | AGAAACUG CUGAUGAGGCCGUUAGGCCGAA ICCUGCUG | 14325 |
| 4119 | AGCAGGCC C AGUUUCUG | 4986 | CAGAAACU CUGAUGAGGCCGUUAGGCCGAA IGCCUGCU | 14326 |
| 4120 | GCAGGCCC A GUUUCUGC | 4987 | GCAGAAAC CUGAUGAGGCCGUUAGGCCGAA IGGCCUGC | 14327 |
| 4126 | CCAGUUUC U GCCAUUCC | 4988 | GGAAUGGC CUGAUGAGGCCGUUAGGCCGAA IAAACUGG | 14328 |
| 4129 | GUUUCUGC C AUUCCAGC | 4989 | GCUGGAAU CUGAUGAGGCCGUUAGGCCGAA ICAGAAAC | 14329 |
| 4130 | UUUCUGCC A UUCCAGCU | 4990 | AGCUGGAA CUGAUGAGGCCGUUAGGCCGAA IGCAGAAA | 14330 |
| 4134 | UGCCAUUC C AGCUGUGG | 4991 | CCACAGCU CUGAUGAGGCCGUUAGGCCGAA IAAUGGCA | 14331 |
| 4135 | GCCAUUCC A GCUGUGGG | 4992 | CCCACAGC CUGAUGAGGCCGUUAGGCCGAA IGAAUGGC | 14332 |
| 4138 | AUUCCAGC U GUGGGCAC | 4993 | GUGCCCAC CUGAUGAGGCCGUUAGGCCGAA ICUGGAAU | 14333 |
| 4145 | CUGUGGGC A CGUCAGCG | 4994 | CGCUGACG CUGAUGAGGCCGUUAGGCCGAA ICCCACAG | 14334 |
| 4150 | GGCACGUC A GCGAAGGC | 4995 | GCCUUCGC CUGAUGAGGCCGUUAGGCCGAA IACGUGCC | 14335 |
| 4159 | GCGAAGGC A AGCGCAGG | 4996 | CCUGCGCU CUGAUGAGGCCGUUAGGCCGAA ICCUUCGC | 14336 |
| 4165 | GCAAGCGC A GGUUCACC | 4997 | GGUGAACC CUGAUGAGGCCGUUAGGCCGAA ICGCUUGC | 14337 |
| 4171 | GCAGGUUC A CCUACGAC | 4998 | GUCGUAGG CUGAUGAGGCCGUUAGGCCGAA IAACCUGC | 14338 |
| 4173 | AGGUUCAC C UACGACCA | 4999 | UGGUCGUA CUGAUGAGGCCGUUAGGCCGAA IUGAACCU | 14339 |
| 4174 | GGUUCACC U ACGACCAC | 5000 | GUGGUCGU CUGAUGAGGCCGUUAGGCCGAA IGUGAACC | 14340 |
| 4180 | CCUACGAC C ACGCUGAG | 5001 | CUCAGCGU CUGAUGAGGCCGUUAGGCCGAA IUCGUAGG | 14341 |
| 4181 | CUACGACC A CGCUGAGC | 5002 | GCUCAGCG CUGAUGAGGCCGUUAGGCCGAA IGUCGUAG | 14342 |
| 4185 | GACCACGC U GAGCUGGA | 5003 | UCCAGCUC CUGAUGAGGCCGUUAGGCCGAA ICGUGGUC | 14343 |
| 4190 | CGCUGAGC U GGAAGGA | 5004 | UCCUUCC CUGAUGAGGCCGUUAGGCCGAA ICUCAGCG | 14344 |
| 4210 | UCGCGUGC U GCUCCCCG | 5005 | CGGGGAGC CUGAUGAGGCCGUUAGGCCGAA ICACGCGA | 14345 |
| 4213 | CGUGCUGC U CCCCGCCC | 5006 | GGGCGGGG CUGAUGAGGCCGUUAGGCCGAA ICAGCACG | 14346 |
| 4215 | UGCUGCUC C CCGCCCCC | 5007 | GGGGGCGG CUGAUGAGGCCGUUAGGCCGAA IAGCAGCA | 14347 |

TABLE XIV-continued

NCH Ribozyme and Target Sequences

| Pos | Target | Seq ID No | NCH Ribozyme | Seq ID No |
|---|---|---|---|---|
| 4216 | GCUGCUCC C CGCCCCA | 5008 | UGGGGGCG CUGAUGAGGCCGUUAGGCCGAA IGAGCAGC | 14348 |
| 4217 | CUGCUCCC C GCCCCAG | 5009 | CUGGGGGC CUGAUGAGGCCGUUAGGCCGAA IGGAGCAG | 14349 |
| 4220 | CUCCCCGC C CCAGACU | 5010 | AGUCUGG CUGAUGAGGCCGUUAGGCCGAA ICGGGGAG | 14350 |
| 4221 | UCCCCGCC C CAGACUA | 5011 | UAGUCUGG CUGAUGAGGCCGUUAGGCCGAA IGCGGGA | 14351 |
| 4222 | CCCCGCCC C CAGACUAC | 5012 | GUAGUCUG CUGAUGAGGCCGUUAGGCCGAA IGGCGGGG | 14352 |
| 4223 | CCCGCCCC C AGACUACA | 5013 | UGUAGUCU CUGAUGAGGCCGUUAGGCCGAA IGGGCGGG | 14353 |
| 4224 | CCGCCCCC A GACUACAA | 5014 | UUGUAGUC CUGAUGAGGCCGUUAGGCCGAA IGGGGCGG | 14354 |
| 4228 | CCCCAGAC U ACAACUCG | 5015 | CGAGUUGU CUGAUGAGGCCGUUAGGCCGAA IUCUGGGG | 14355 |
| 4231 | CAGACUAC A ACUCGGUG | 5016 | CACCGAGU CUGAUGAGGCCGUUAGGCCGAA IAGUCUG | 14356 |
| 4234 | ACUACAAC U CGGUGGUC | 5017 | GACCACCG CUGAUGAGGCCGUUAGGCCGAA IUUGUAGU | 14357 |
| 4243 | CGGUGGUC C UGUACUCC | 5018 | GGAGUACA CUGAUGAGGCCGUUAGGCCGAA IACCACCG | 14358 |
| 4244 | GGUGGUCC U GUACUCCA | 5019 | UGGAGUAC CUGAUGAGGCCGUUAGGCCGAA IGACCACC | 14359 |
| 4249 | UCCUGUAC U CCACCCCA | 5020 | UGGGGUGG CUGAUGAGGCCGUUAGGCCGAA IUACAGGA | 14360 |
| 4251 | CUGUACUC C ACCCCACC | 5021 | GGUGGGGU CUGAUGAGGCCGUUAGGCCGAA IAGUACAG | 14361 |
| 4252 | UGUACUCC A CCCCACCC | 5022 | GGGUGGGG CUGAUGAGGCCGUUAGGCCGAA IGAGUACA | 14362 |
| 4254 | UACUCCAC C CCACCCAU | 5023 | AUGGGUGG CUGAUGAGGCCGUUAGGCCGAA IUGGAGUA | 14363 |
| 4255 | ACUCCACC C CACCCAUC | 5024 | GAUGGGUG CUGAUGAGGCCGUUAGGCCGAA IGUGGAGU | 14364 |
| 4256 | CUCCACCC C ACCCAUCU | 5025 | AGAUGGGU CUGAUGAGGCCGUUAGGCCGAA IGGUGGAG | 14365 |
| 4257 | UCCACCCC A CCCAUCUA | 5026 | UAGAUGGG CUGAUGAGGCCGUUAGGCCGAA IGGGUGGA | 14366 |
| 4259 | CACCCCAC C CAUCUAGA | 5027 | UCUAGAUG CUGAUGAGGCCGUUAGGCCGAA IUGGGGUG | 14367 |
| 4260 | ACCCCACC C AUCUAGAG | 5028 | CUCUAGAU CUGAUGAGGCCGUUAGGCCGAA IGUGGGGU | 14368 |
| 4261 | CCCCACCC A UCUAGAGU | 5029 | ACUCUAGA CUGAUGAGGCCGUUAGGCCGAA IGGUGGGG | 14369 |
| 4264 | CACCCAUC U AGAGUUUG | 5030 | CAAACUCU CUGAUGAGGCCGUUAGGCCGAA IAUGGGUG | 14370 |
| 4275 | AGUUUGAC A CGAAGCCU | 5031 | AGGCUUCG CUGAUGAGGCCGUUAGGCCGAA IUCAAACU | 14371 |
| 4282 | CACGAAGC C UUAUUUCU | 5032 | AGAAAUAA CUGAUGAGGCCGUUAGGCCGAA ICUUCGUG | 14372 |
| 4283 | ACGAAGCC U UAUUUCUA | 5033 | UAGAAAUA CUGAUGAGGCCGUUAGGCCGAA IGCUUCGU | 14373 |
| 4290 | CUUAUUUC U AGAAGCAC | 5034 | GUGCUUCU CUGAUGAGGCCGUUAGGCCGAA IAAAUAAG | 14374 |
| 4297 | CUAGAAGC A CAUGUGUA | 5035 | UACACAUG CUGAUGAGGCCGUUAGGCCGAA ICUUCUAG | 14375 |
| 4299 | AGAAGCAC A UGUGUAUU | 5036 | AAUACACA CUGAUGAGGCCGUUAGGCCGAA IUGCUUCU | 14376 |
| 4313 | AUUUAUAC C CCAGGAA | 5037 | UUCCUGGG CUGAUGAGGCCGUUAGGCCGAA IUAUAAAU | 14377 |
| 4314 | UUUAUACC C CAGGAAA | 5038 | UUUCCUGG CUGAUGAGGCCGUUAGGCCGAA IGUAUAAA | 14378 |
| 4315 | UUAUACCC C CAGGAAAC | 5039 | GUUUCCUG CUGAUGAGGCCGUUAGGCCGAA IGGUAUAA | 14379 |
| 4316 | UAUACCCC C AGGAAACU | 5040 | AGUUUCCU CUGAUGAGGCCGUUAGGCCGAA IGGGUAUA | 14380 |
| 4317 | AUACCCCC A GGAAACUA | 5041 | UAGUUUCC CUGAUGAGGCCGUUAGGCCGAA IGGGGUAU | 14381 |
| 4324 | CAGGAAAC U AGCUUUUG | 5042 | CAAAAGCU CUGAUGAGGCCGUUAGGCCGAA IUUUCCUG | 14382 |
| 4328 | AAACUAGC U UUGCCAG | 5043 | CUGGCAAA CUGAUGAGGCCGUUAGGCCGAA ICUAGUUU | 14383 |
| 4334 | GCUUUUGC C AGUAUUAU | 5044 | AUAAUACU CUGAUGAGGCCGUUAGGCCGAA ICAAAAGC | 14384 |

TABLE XIV-continued

NCH Ribozyme and Target Sequences

| Pos | Target | Seq ID No | NCH Ribozyme | Seq ID No |
|---|---|---|---|---|
| 4335 | CUUUUGCC A GUAUUAUG | 5045 | CAUAAUAC CUGAUGAGgccGUUAGGCCGAA IGCAAAAG | 14385 |
| 4345 | UAUUAUGC A UAUAUAAG | 5046 | CUUAUAUA CUGAUGAGgccGUUAGGCCGAA ICAUAAUA | 14386 |
| 4359 | AAGUUUAC A CCUUUAUC | 5047 | GAUAAAGG CUGAUGAGgccGUUAGGCCGAA IUAAACUU | 14387 |
| 4361 | GUUUACAC C UUUAUCUU | 5048 | AAGAUAAA CUGAUGAGgccGUUAGGCCGAA IGUAAAC | 14388 |
| 4362 | UUUACACC U UAUCUUU | 5049 | AAAGAUAA CUGAUGAGgccGUUAGGCCGAA IGUGUAAA | 14389 |
| 4368 | CCUUUAUC U UUCCAUGG | 5050 | CCAUGGAA CUGAUGAGgccGUUAGGCCGAA IAUAAAGG | 14390 |
| 4372 | UAUCUUUC C AUGGGAGC | 5051 | GCUCCCAU CUGAUGAGgccGUUAGGCCGAA IAAAGAUA | 14391 |
| 4373 | AUCUUUCC A UGGGAGCC | 5052 | GGCUCCCA CUGAUGAGgccGUUAGGCCGAA IGAAAGAU | 14392 |
| 4381 | AUGGGAGC C AGCUGCUU | 5053 | AAGCAGCU CUGAUGAGgccGUUAGGCCGAA ICUCCCAU | 14393 |
| 4382 | UGGGAGCC A GCUGCUUU | 5054 | AAAGCAGC CUGAUGAGgccGUUAGGCCGAA IGCUCCCA | 14394 |
| 4385 | GAGCCAGC U GCUUUUG | 5055 | CAAAAGC CUGAUGAGgccGUUAGGCCGAA ICUGGCUC | 14395 |
| 4388 | CCAGCUGC U UUUGUGA | 5056 | UCACAAAA CUGAUGAGgccGUUAGGCCGAA ICAGCUGG | 14396 |
| 4412 | AAUAGUGC U UUUUUUU | 5057 | AAAAAAAA CUGAUGAGgccGUUAGGCCGAA ICACUAUU | 14397 |
| 4426 | UUUUUGAC U AACAAGAA | 5058 | UUCUUGUU CUGAUGAGgccGUUAGGCCGAA IUCAAAAA | 14398 |
| 4430 | UGACUAAC A AGAAUGUA | 5059 | UACAUUCU CUGAUGAGgccGUUAGGCCGAA IUUAGUCA | 14399 |
| 4441 | AAUGUAAC U CCAGAUAG | 5060 | CUAUCUGG CUGAUGAGgccGUUAGGCCGAA IUUACAUU | 14400 |
| 4443 | UGUAACUC C AGAUAGAG | 5061 | CUCUAUCU CUGAUGAGgccGUUAGGCCGAA IAGUUACA | 14401 |
| 4444 | GUAACUCC A GAUAGAGA | 5062 | UCUCUAUC CUGAUGAGgccGUUAGGCCGAA IGAGUUAC | 14402 |
| 4462 | AUAGUGAC A AGUGAAGA | 5063 | UCUUCACU CUGAUGAGgccGUUAGGCCGAA IUCACUAU | 14403 |
| 4473 | UGAAGAAC A CUACUGCU | 5064 | AGCAGUAG CUGAUGAGgccGUUAGGCCGAA IUUCUUCA | 14404 |
| 4475 | AAGAACAC U ACUGCUAA | 5065 | UUAGCAGU CUGAUGAGgccGUUAGGCCGAA IUGUUCUU | 14405 |
| 4478 | AACACUAC U GCUAAAUC | 5066 | GAUUUAGC CUGAUGAGgccGUUAGGCCGAA IUAGUGUU | 14406 |
| 4481 | ACUACUGC U AAAUCCUC | 5067 | GAGGAUUU CUGAUGAGgccGUUAGGCCGAA ICAGUAGU | 14407 |
| 4487 | GCUAAAUC C UCAUGUUA | 5068 | UACAUGA CUGAUGAGgccGUUAGGCCGAA IAUUUAGC | 14408 |
| 4488 | CUAAAUCC U CAUGUUAC | 5069 | GUAACAUG CUGAUGAGgccGUUAGGCCGAA IGAUUUAG | 14409 |
| 4490 | AAUCCUC A UGUUACUC | 5070 | GAGUAACA CUGAUGAGgccGUUAGGCCGAA IAGGAUUU | 14410 |
| 4497 | CAUGUUAC U CAGUGUUA | 5071 | UAACACUG CUGAUGAGgccGUUAGGCCGAA IUAACAUG | 14411 |
| 4499 | UGUUACUC A GUGUUAGA | 5072 | UCUAACAC CUGAUGAGgccGUUAGGCCGAA IAGUAACA | 14412 |
| 4514 | GAGAAAUC C UUCCUAAA | 5073 | UUUAGGAA CUGAUGAGgccGUUAGGCCGAA IAUUUCUC | 14413 |
| 4515 | AGAAAUCC U UCCUAAAC | 5074 | GUUUAGGA CUGAUGAGgccGUUAGGCCGAA IGAUUUCU | 14414 |
| 4518 | AAUCCUUC C UAAACCCA | 5075 | UUGGGUUA CUGAUGAGgccGUUAGGCCGAA IAAGGAUU | 14415 |
| 4519 | AUCCUUCC U AAACCCAA | 5076 | UUGGGUUU CUGAUGAGgccGUUAGGCCGAA IGAAGGAU | 14416 |
| 4524 | UCCUAAAC C CAAUGACU | 5077 | AGUCAUUG CUGAUGAGgccGUUAGGCCGAA IUUUAGGA | 14417 |
| 4525 | CCUAAACC C AAUGACUU | 5078 | AAGUCAUU CUGAUGAGgccGUUAGGCCGAA IGUUUAGG | 14418 |
| 4526 | CUAAACCC A AUGACUUC | 5079 | GAAGUCAU CUGAUGAGgccGUUAGGCCGAA IGGUUUAG | 14419 |
| 4532 | CCAAUGAC U UCCCUGCU | 5080 | AGCAGGGA CUGAUGAGgccGUUAGGCCGAA IUCAUUGG | 14420 |
| 4535 | AUGACUUC C CUGGUCCA | 5081 | UGGAGCAG CUGAUGAGgccGUUAGGCCGAA IAAGUCAU | 14421 |

TABLE XIV-continued

NCH Ribozyme and Target Sequences

| Pos | Target | Seq ID No | NCH Ribozyme | Seq ID No |
|---|---|---|---|---|
| 4536 | UGACUUCC C UGCUCCAA | 5082 | UUGGAGCA CUGAUGAG<u>GCCGUUAGGC</u>CGAA IGAAGUCA | 14422 |
| 4537 | GACUUCCC U GCUCCAAC | 5083 | GUUGGAGC CUGAUGAG<u>GCCGUUAGGC</u>CGAA IGGAAGUC | 14423 |
| 4540 | UUCCCUGC U CCAACCCC | 5084 | GGGGUUGG CUGAUGAG<u>GCCGUUAGGC</u>CGAA ICAGGGAA | 14424 |
| 4542 | CCCUGCUC C AACCCCCG | 5085 | CGGGGGUU CUGAUGAG<u>GCCGUUAGGC</u>CGAA IAGCAGGG | 14425 |
| 4543 | CCUGCUCC A ACCCCGC | 5086 | GCGGGGGU CUGAUGAG<u>GCCGUUAGGC</u>CGAA IGAGCAGG | 14426 |
| 4546 | GCUCCAAC C CCCGCCAC | 5087 | GUGGCGGG CUGAUGAG<u>GCCGUUAGGC</u>CGAA IUUGGAGC | 14427 |
| 4547 | CUCCAACC C CCGCCACC | 5088 | GGUGGCGG CUGAUGAG<u>GCCGUUAGGC</u>CGAA IGUUGGAG | 14428 |
| 4548 | UCCAACCC C CGCCACCU | 5089 | AGGUGGCG CUGAUGAG<u>GCCGUUAGGC</u>CGAA IGGUUGGA | 14429 |
| 4549 | CCAACCCC C GCCACCUC | 5090 | GAGGUGGC CUGAUGAG<u>GCCGUUAGGC</u>CGAA IGGGUUGG | 14430 |
| 4552 | ACCCCGC C ACCUCAGG | 5091 | CCUGAGGU CUGAUGAG<u>GCCGUUAGGC</u>CGAA ICGGGGGU | 14431 |
| 4553 | CCCCCGCC A CCUCAGGG | 5092 | CCCUGAGG CUGAUGAG<u>GCCGUUAGGC</u>CGAA IGCGGGGG | 14432 |
| 4555 | CCCGCCAC C UCAGGGCA | 5093 | UGCCCUGA CUGAUGAG<u>GCCGUUAGGC</u>CGAA IUGGCGGG | 14433 |
| 4556 | CCGCCACC U CAGGGCAC | 5094 | GUGCCCUG CUGAUGAG<u>GCCGUUAGGC</u>CGAA IGUGGCGG | 14434 |
| 4558 | GCCACCUC A GGGCACGC | 5095 | GCGUGCCC CUGAUGAG<u>GCCGUUAGGC</u>CGAA IAGGUGGC | 14435 |
| 4563 | CUCAGGGC A CGCAGGAC | 5096 | GUCCUGCG CUGAUGAG<u>GCCGUUAGGC</u>CGAA ICCCUGAG | 14436 |
| 4567 | GGGCACGC A GGACCAGU | 5097 | ACUGGUCC CUGAUGAG<u>GCCGUUAGGC</u>CGAA ICGUGCCC | 14437 |
| 4572 | CGCAGGAC C AGUUUGAU | 5098 | AUCAAACU CUGAUGAG<u>GCCGUUAGGC</u>CGAA IUCCUGCG | 14438 |
| 4573 | GCAGGACC A GUUUGAUU | 5099 | AAUCAAAC CUGAUGAG<u>GCCGUUAGGC</u>CGAA IGUCCUGG | 14439 |
| 4589 | UGAGGAGC U GCACUGAU | 5100 | AUCAGUGC CUGAUGAG<u>GCCGUUAGGC</u>CGAA ICUCCUCA | 14440 |
| 4592 | GGAGCUGC A CUGAUCAC | 5101 | GUGAUCAG CUGAUGAG<u>GCCGUUAGGC</u>CGAA ICAGCUCC | 14441 |
| 4594 | AGCUGCAC U GAUCACCC | 5102 | GGGUGAUC CUGAUGAG<u>GCCGUUAGGC</u>CGAA IUGCAGCU | 14442 |
| 4599 | CACUGAUC A CCCAAUGC | 5103 | GCAUUGGG CUGAUGAG<u>GCCGUUAGGC</u>CGAA IAUCAGUG | 14443 |
| 4601 | CUGAUCAC C CAAUGCAU | 5104 | AUGCAUUG CUGAUGAG<u>GCCGUUAGGC</u>CGAA IUGAUCAG | 14444 |
| 4602 | UGAUCACC C AAUGCAUC | 5105 | GAUGCAUU CUGAUGAG<u>GCCGUUAGGC</u>CGAA IGUGAUCA | 14445 |
| 4603 | GAUCACCC A AUGCAUCA | 5106 | UGAUGCAU CUGAUGAG<u>GCCGUUAGGC</u>CGAA IGGUGAUC | 14446 |
| 4608 | CCCAAUGC A UCACGUAC | 5107 | GUACGUGA CUGAUGAG<u>GCCGUUAGGC</u>CGAA ICAUUGGG | 14447 |
| 4611 | AAUGCAUC A CGUACCCC | 5108 | GGGGUACG CUGAUGAG<u>GCCGUUAGGC</u>CGAA IAUGCAUU | 14448 |
| 4617 | UCACGUAC C CCACUGGG | 5109 | CCCAGUGG CUGAUGAG<u>GCCGUUAGGC</u>CGAA IUACGUGA | 14449 |
| 4618 | CACGUACC C CACUGGGC | 5110 | GCCCAGUG CUGAUGAG<u>GCCGUUAGGC</u>CGAA IGUACGUG | 14450 |
| 4619 | ACGUACCC C ACUGGGCC | 5111 | GGCCCAGU CUGAUGAG<u>GCCGUUAGGC</u>CGAA IGGUACGU | 14451 |
| 4620 | CGUACCCC A CUGGGCCA | 5112 | UGGCCCAG CUGAUGAG<u>GCCGUUAGGC</u>CGAA IGGGUACG | 14452 |
| 4622 | UACCCCAC U GGGCCAGC | 5113 | GCUGGCCC CUGAUGAG<u>GCCGUUAGGC</u>CGAA IUGGGGUA | 14453 |
| 4627 | CACUGGGC C AGCCCUGC | 5114 | GCAGGGCU CUGAUGAG<u>GCCGUUAGGC</u>CGAA ICCCAGUG | 14454 |
| 4628 | ACUGGGCC A GCCCUGCA | 5115 | UGCAGGGC CUGAUGAG<u>GCCGUUAGGC</u>CGAA IGCCAGU | 14455 |
| 4631 | GGGCCAGC C CUGCAGCC | 5116 | GGCUGCAG CUGAUGAG<u>GCCGUUAGGC</u>CGAA ICUGGCCC | 14456 |
| 4632 | GGCCAGCC C UGCAGCCC | 5117 | GGGCUGCA CUGAUGAG<u>GCCGUUAGGC</u>CGAA IGCUGGCC | 14457 |
| 4633 | GCCAGCCC U GCAGCCCA | 5118 | UGGGCUGC CUGAUGAG<u>GCCGUUAGGC</u>CGAA IGGCUGGC | 14458 |

TABLE XIV-continued

NCH Ribozyme and Target Sequences

| Pos | Target | Seq ID No | NCH Ribozyme | Seq ID No |
|---|---|---|---|---|
| 4636 | AGCCCUGC A GCCCAAAA | 5119 | UUUUGGGC CUGAUGAGGCCGUUAGGCCGAA ICAGGGCU | 14459 |
| 4639 | CCUGCAGC C CAAAACCC | 5120 | GGGUUUUG CUGAUGAGGCCGUUAGGCCGAA ICUGCAGG | 14460 |
| 4640 | CUGCAGCC C AAAACCCA | 5121 | UGGGUUUU CUGAUGAGGCCGUUAGGCCGAA IGCUGCAG | 14461 |
| 4641 | UGCAGCCC A AAACCCAG | 5122 | CUGGGUUU CUGAUGAGGCCGUUAGGCCGAA IGGCUGCA | 14462 |
| 4646 | CCCAAAAC C CAGGGCAA | 5123 | UUGCCCUG CUGAUGAGGCCGUUAGGCCGAA IUUUUGGG | 14463 |
| 4647 | CCAAAACC C AGGGCAAC | 5124 | GUUGCCCU CUGAUGAGGCCGUUAGGCCGAA IGUUUUGG | 14464 |
| 4648 | CAAAACCC A GGGCAACA | 5125 | UGUUGCCC CUGAUGAGGCCGUUAGGCCGAA IGGUUUUG | 14465 |
| 4653 | CCCAGGGC A CAAGCCC | 5126 | GGGCUUGU CUGAUGAGGCCGUUAGGCCGAA ICCCUGGG | 14466 |
| 4656 | AGGGCAAC A AGCCCGUU | 5127 | AACGGGCU CUGAUGAGGCCGUUAGGCCGAA IUUGCCCU | 14467 |
| 4660 | CAACAAGC C CGUUAGCC | 5128 | GGCUAACG CUGAUGAGGCCGUUAGGCCGAA ICUUGUUG | 14468 |
| 4661 | AACAAGCC C GUUAGCCC | 5129 | GGGCUAAC CUGAUGAGGCCGUUAGGCCGAA IGCUUGUU | 14469 |
| 4668 | CCGUUAGC C CCAGGGGA | 5130 | UCCCCUGG CUGAUGAGGCCGUUAGGCCGAA ICUAACGG | 14470 |
| 4669 | CGUUAGCC C CAGGGGAU | 5131 | AUCCCCUG CUGAUGAGGCCGUUAGGCCGAA IGCUAACG | 14471 |
| 4670 | GUUAGCCC C AGGGGAUC | 5132 | GAUCCCCU CUGAUGAGGCCGUUAGGCCGAA IGGCUAAC | 14472 |
| 4671 | UUAGCCCC A GGGGAUCA | 5133 | UGAUCCCC CUGAUGAGGCCGUUAGGCCGAA IGGGCUAA | 14473 |
| 4679 | AGGGGAUC A CUGGCUGG | 5134 | CCAGCCAG CUGAUGAGGCCGUUAGGCCGAA IAUCCCCU | 14474 |
| 4681 | GGGAUCAC U GGCUGGCC | 5135 | GGCCAGCC CUGAUGAGGCCGUUAGGCCGAA IUGAUCCC | 14475 |
| 4685 | UCACUGGC U GGCCUGAG | 5136 | CUCAGGCC CUGAUGAGGCCGUUAGGCCGAA ICCAGUGA | 14476 |
| 4689 | UGGCUGGC C UGAGCAAC | 5137 | GUUGCUCA CUGAUGAGGCCGUUAGGCCGAA ICCAGCCA | 14477 |
| 4690 | GGCUGGCC U GAGCAACA | 5138 | UGUUGCUC CUGAUGAGGCCGUUAGGCCGAA IGCCAGCC | 14478 |
| 4695 | GCCUGAGC A ACAUCUCG | 5139 | CGAGAUGU CUGAUGAGGCCGUUAGGCCGAA ICUCAGGC | 14479 |
| 4698 | UGAGCAAC A UCUCGGGA | 5140 | UCCCGAGA CUGAUGAGGCCGUUAGGCCGAA IUUGCUCA | 14480 |
| 4701 | GCAACAUC U CGGGAGUC | 5141 | GACUCCCG CUGAUGAGGCCGUUAGGCCGAA IAUGUUGC | 14481 |
| 4710 | CGGGAGUC C UCUAGCAG | 5142 | CUGCUAGA CUGAUGAGGCCGUUAGGCCGAA IACUCCCG | 14482 |
| 4711 | GGGAGUCC U CUAGCAGG | 5143 | CCUGCUAG CUGAUGAGGCCGUUAGGCCGAA IGACUCCC | 14483 |
| 4713 | GAGUCCUC U AGCAGGCC | 5144 | GGCCUGCU CUGAUGAGGCCGUUAGGCCGAA IAGGACUC | 14484 |
| 4717 | CCUCUAGC A GGCCUAAG | 5145 | CUUAGGCC CUGAUGAGGCCGUUAGGCCGAA ICUAGAGG | 14485 |
| 4721 | UAGCAGGC C UAAGACAU | 5146 | AUGUCUUA CUGAUGAGGCCGUUAGGCCGAA ICCUGCUA | 14486 |
| 4722 | AGCAGGCC U AAGACAUG | 5147 | CAUGUCUU CUGAUGAGGCCGUUAGGCCGAA IGCCUGCU | 14487 |
| 4728 | CCUAAGAC A UGUGAGGA | 5148 | UCCUCACA CUGAUGAGGCCGUUAGGCCGAA IUCUUAGG | 14488 |
| 4754 | AAAAAAGC A AAAGCAA | 5149 | UUGCUUUU CUGAUGAGGCCGUUAGGCCGAA ICUUUUUU | 14489 |
| 4761 | CAAAAAGC A AGGGAGAA | 5150 | UUCUCCCU CUGAUGAGGCCGUUAGGCCGAA ICUUUUUG | 14490 |
| 4779 | AGAGAAAC C GGGAGAAG | 5151 | CUUCUCCC CUGAUGAGGCCGUUAGGCCGAA IUUUCUCU | 14491 |
| 4790 | GAGAAGGC A UGAGAAAG | 5152 | CUUUCUCA CUGAUGAGGCCGUUAGGCCGAA ICCUUCUC | 14492 |
| 4811 | UGAGACGC A CCAUGUGG | 5153 | CCACAUGG CUGAUGAGGCCGUUAGGCCGAA ICGUCUCA | 14493 |
| 4813 | AGACGCAC C AUGGGGC | 5154 | GCCCACAU CUGAUGAGGCCGUUAGGCCGAA IUGCGUCU | 14494 |
| 4814 | GACGCACC A UGUGGGCA | 5155 | UGCCCACA CUGAUGAGGCCGUUAGGCCGAA IGUGCGUC | 14495 |

TABLE XIV-continued

NCH Ribozyme and Target Sequences

| Pos | Target | Seq ID No | NCH Ribozyme | Seq ID No |
|---|---|---|---|---|
| 4822 | AUGUGGGC A CGGAGGGG | 5156 | CCCCUCCG CUGAUGAGGCCGUUAGGCCGAA ICCCACAU | 14496 |
| 4839 | GACGGGGC U CAGCAAUG | 5157 | CAUUGCUG CUGAUGAGGCCGUUAGGCCGAA ICCCCGUC | 14497 |
| 4841 | CGGGGCUC A GCAAUGCC | 5158 | GGCAUUGC CUGAUGAGGCCGUUAGGCCGAA IAGCCCCG | 14498 |
| 4844 | GGCUCAGC A AUGCCAUU | 5159 | AAUGGCAU CUGAUGAGGCCGUUAGGCCGAA ICUGAGCC | 14499 |
| 4849 | AGCAAUGC C AUUUCAGU | 5160 | ACUGAAAU CUGAUGAGGCCGUUAGGCCGAA ICAUUGCU | 14500 |
| 4850 | GCAAUGCC A UUUCAGUG | 5161 | CACUGAAA CUGAUGAGGCCGUUAGGCCGAA IGCAUUGC | 14501 |
| 4855 | GCCAUUUC A GUGGCUUC | 5162 | GAAGCCAC CUGAUGAGGCCGUUAGGCCGAA IAAAUGGC | 14502 |
| 4861 | UCAGUGGC U UCCCAGCU | 5163 | AGCUGGGA CUGAUGAGGCCGUUAGGCCGAA ICCACUGA | 14503 |
| 4864 | GUGGCUUC C CAGCUCUG | 5164 | CAGAGCUG CUGAUGAGGCCGUUAGGCCGAA IAAGCCAC | 14504 |
| 4865 | UGGCUUCC C AGCUCUGA | 5165 | UCAGAGCU CUGAUGAGGCCGUUAGGCCGAA IGAAGCCA | 14505 |
| 4866 | GGCUUCCC A GCUCUGAC | 5166 | GUCAGAGC CUGAUGAGGCCGUUAGGCCGAA IGGAAGCC | 14506 |
| 4869 | UUCCCAGC U CUGACCCU | 5167 | AGGGUCAG CUGAUGAGGCCGUUAGGCCGAA ICUGGGAA | 14507 |
| 4871 | CCCAGCUC U GACCCUUC | 5168 | GAAGGGUC CUGAUGAGGCCGUUAGGCCGAA IAGCUGGG | 14508 |
| 4875 | GCUCUGAC C CUUCUACA | 5169 | UGUAGAAG CUGAUGAGGCCGUUAGGCCGAA ICAGAGC | 14509 |
| 4876 | CUCUGACC C UUCUACAU | 5170 | AUGUAGAA CUGAUGAGGCCGUUAGGCCGAA IGUCAGAG | 14510 |
| 4877 | UCUGACCC U UCUACAUU | 5171 | AAUGUAGA CUGAUGAGGCCGUUAGGCCGAA IGGUCAGA | 14511 |
| 4880 | GACCCUUC U ACAUUUGA | 5172 | UCAAAUGU CUGAUGAGGCCGUUAGGCCGAA IAAGGGUC | 14512 |
| 4883 | CCUUCUAC A UUUGAGGG | 5173 | CCCUCAAA CUGAUGAGGCCGUUAGGCCGAA IUAGAAGG | 14513 |
| 4893 | UUGAGGGC C CAGCCAGG | 5174 | CCUGGCUG CUGAUGAGGCCGUUAGGCCGAA ICCCUCAA | 14514 |
| 4894 | UGAGGGCC C AGCCAGGA | 5175 | UCCUGGCU CUGAUGAGGCCGUUAGGCCGAA IGCCCUCA | 14515 |
| 4895 | GAGGGCCC A GCCAGGAG | 5176 | CUCCUGGC CUGAUGAGGCCGUUAGGCCGAA IGGCCCUC | 14516 |
| 4898 | GGCCCAGC C AGGAGCAG | 5177 | CUGCUCCU CUGAUGAGGCCGUUAGGCCGAA ICUGGGCC | 14517 |
| 4899 | GCCCAGCC A GGAGCAGA | 5178 | UCUGCUCC CUGAUGAGGCCGUUAGGCCGAA IGCUGGGC | 14518 |
| 4905 | CCAGGAGC A GAUGGACA | 5179 | UGUCCAUC CUGAUGAGGCCGUUAGGCCGAA ICUCCUGG | 14519 |
| 4913 | AGAUGGAC A GCGAUGAG | 5180 | CUCAUCGC CUGAUGAGGCCGUUAGGCCGAA IUCCAUCU | 14520 |
| 4927 | GAGGGGAC A UUUUCUGG | 5181 | CCAGAAAA CUGAUGAGGCCGUUAGGCCGAA IUCCCCUC | 14521 |
| 4933 | ACAUUUUC U GGAUUCUG | 5182 | CAGAAUCC CUGAUGAGGCCGUUAGGCCGAA IAAAAUGU | 14522 |
| 4940 | CUGGAUUC U GGGAGGCA | 5183 | UGCCUCCC CUGAUGAGGCCGUUAGGCCGAA IAAUCCAG | 14523 |
| 4948 | UGGGAGGC A AGAAAAGG | 5184 | CCUUUUCU CUGAUGAGGCCGUUAGGCCGAA ICCUCCCA | 14524 |
| 4959 | AAAAGGAC A AAUAUCUU | 5185 | AAGAUAUU CUGAUGAGGCCGUUAGGCCGAA IUCCUUUU | 14525 |
| 4966 | CAAAUAUC U UUUUGGA | 5186 | UCCAAAAA CUGAUGAGGCCGUUAGGCCGAA IAUAUUUG | 14526 |
| 4977 | UUUGGAAC U AAAGCAAA | 5187 | UUUGCUUU CUGAUGAGGCCGUUAGGCCGAA IUUCCAAA | 14527 |
| 4983 | ACUAAAGC A AAUUUUAG | 5188 | CUAAAAUU CUGAUGAGGCCGUUAGGCCGAA ICUUUAGU | 14528 |
| 4994 | UUUUAGAC C UUUACCUA | 5189 | UAGGUAAA CUGAUGAGGCCGUUAGGCCGAA ICUAAAA | 14529 |
| 4995 | UUUAGACC U UUACCUAU | 5190 | AUAGGUAA CUGAUGAGGCCGUUAGGCCGAA IGUCUAAA | 14530 |
| 5000 | ACCUUUAC C UAUGGAAG | 5191 | CUUCCAUA CUGAUGAGGCCGUUAGGCCGAA IUAAAGGU | 14531 |
| 5001 | CCUUUACC U AUGGAAGU | 5192 | ACUUCCAU CUGAUGAGGCCGUUAGGCCGAA IGUAAAGG | 14532 |

TABLE XIV-continued

NCH Ribozyme and Target Sequences

| Pos | Target | Seq ID No | NCH Ribozyme | Seq ID No |
|---|---|---|---|---|
| 5015 | AGUGGUUC U AUGUCCAU | 5193 | AUGGACAU CUGAUGAGGCCGUUAGGCCGAA IAACCACU | 14533 |
| 5021 | UCUAUGUC C AUUCUCAU | 5194 | AUGAGAAU CUGAUGAGGCCGUUAGGCCGAA IACAUAGA | 14534 |
| 5022 | CUAUGUCC A UUCUCAUU | 5195 | AAUGAGAA CUGAUGAGGCCGUUAGGCCGAA IGACAUAG | 14535 |
| 5026 | GUCCAUUC U CAUUCGUG | 5196 | CACGAAUG CUGAUGAGGCCGUUAGGCCGAA IAAUGGAC | 14536 |
| 5028 | CCAUUCUC A UUCGUGGC | 5197 | GCCACGAA CUGAUGAGGCCGUUAGGCCGAA IAGAAUGG | 14537 |
| 5037 | UUCGUGGC A UGUUUUGA | 5198 | UCAAAACA CUGAUGAGGCCGUUAGGCCGAA ICCACGAA | 14538 |
| 5054 | UUUGUAGC A CUGAGGGU | 5199 | ACCCUCAG CUGAUGAGGCCGUUAGGCCGAA ICUACAAA | 14539 |
| 5056 | UGUAGCAC U GAGGGUGG | 5200 | CCACCCUC CUGAUGAGGCCGUUAGGCCGAA IUGCUACA | 14540 |
| 5066 | AGGGUGGC A CUCAACUC | 5201 | GAGUUGAG CUGAUGAGGCCGUUAGGCCGAA ICCACCCU | 14541 |
| 5068 | GGUGGCAC U CAACUCUG | 5202 | CAGAGUUG CUGAUGAGGCCGUUAGGCCGAA IUGCCACC | 14542 |
| 5070 | UGGCACUC A ACUCUGAG | 5203 | CUCAGAGU CUGAUGAGGCCGUUAGGCCGAA IAGUGCCA | 14543 |
| 5073 | CACUCAAC U CUGAGCCC | 5204 | GGGCUCAG CUGAUGAGGCCGUUAGGCCGAA IUUGAGUG | 14544 |
| 5075 | CUCAACUC U GAGCCCAU | 5205 | AUGGGCUC CUGAUGAGGCCGUUAGGCCGAA IAGUUGAG | 14545 |
| 5080 | CUCUGAGC C CAUACUUU | 5206 | AAAGUAUG CUGAUGAGGCCGUUAGGCCGAA ICUCAGAG | 14546 |
| 5081 | UCUGAGCC C AUACUUUU | 5207 | AAAAGUAU CUGAUGAGGCCGUUAGGCCGAA IGCUCAGA | 14547 |
| 5082 | CUGAGCCC A UACUUUUG | 5208 | CAAAAGUA CUGAUGAGGCCGUUAGGCCGAA IGGCUCAG | 14548 |
| 5086 | GCCCAUAC U UUGGCUC | 5209 | GAGCCAAA CUGAUGAGGCCGUUAGGCCGAA IUAUGGGC | 14549 |
| 5093 | CUUUUGGC U CCUCUAGU | 5210 | ACUAGAGG CUGAUGAGGCCGUUAGGCCGAA ICCAAAAG | 14550 |
| 5095 | UUUGGCUC C UCUAGUAA | 5211 | UUACUAGA CUGAUGAGGCCGUUAGGCCGAA IAGCCAAA | 14551 |
| 5096 | UUGGCUCC U CUAGUAAG | 5212 | CUUACUAG CUGAUGAGGCCGUUAGGCCGAA IGAGCCAA | 14552 |
| 5098 | GGCUCCUC U AGUAAGAU | 5213 | AUCUUACU CUGAUGAGGCCGUUAGGCCGAA IAGGAGCC | 14553 |
| 5109 | UAAGAUGC A CUGAAAAC | 5214 | GUUUUCAG CUGAUGAGGCCGUUAGGCCGAA ICAUCUUA | 14554 |
| 5111 | AGAUGCAC U GAAAACUU | 5215 | AAGUUUUC CUGAUGAGGCCGUUAGGCCGAA IUGCAUCU | 14555 |
| 5118 | CUGAAAAC U UAGCCAGA | 5216 | UCUGGCUA CUGAUGAGGCCGUUAGGCCGAA IUUUUCAG | 14556 |
| 5123 | AACUUAGC C AGAGUUAG | 5217 | CUAACUCU CUGAUGAGGCCGUUAGGCCGAA ICUAAGUU | 14557 |
| 5124 | ACUUAGCC A GAGUUAGG | 5218 | CCUAACUC CUGAUGAGGCCGUUAGGCCGAA IGCUAAGU | 14558 |
| 5138 | AGGUUGUC U CCAGGCCA | 5219 | UGGCCUGG CUGAUGAGGCCGUUAGGCCGAA IACAACCU | 14559 |
| 5140 | GUUGUCUC C AGGCCAUG | 5220 | CAUGGCCU CUGAUGAGGCCGUUAGGCCGAA IAGACAAC | 14560 |
| 5141 | UUGUCUCC A GGCCAUGA | 5221 | UCAUGGCC CUGAUGAGGCCGUUAGGCCGAA IGAGACAA | 14561 |
| 5145 | CUCCAGGC C AUGAUGGC | 5222 | GCCAUCAU CUGAUGAGGCCGUUAGGCCGAA ICCUGGAG | 14562 |
| 5146 | UCCAGGCC A UGAUGGCC | 5223 | GGCCAUCA CUGAUGAGGCCGUUAGGCCGAA IGCCUGGA | 14563 |
| 5154 | AUGAUGGC C UUACACUG | 5224 | CAGUGUAA CUGAUGAGGCCGUUAGGCCGAA ICCAUCAU | 14564 |
| 5155 | UGAUGGCC U UACACUGA | 5225 | UCAGUGUA CUGAUGAGGCCGUUAGGCCGAA IGCCAUCA | 14565 |
| 5159 | GGCCUUAC A CUGAAAAU | 5226 | AUUUUCAG CUGAUGAGGCCGUUAGGCCGAA IUAAGGCC | 14566 |
| 5161 | CCUUACAC U GAAAAUGU | 5227 | ACAUUUUC CUGAUGAGGCCGUUAGGCCGAA IUGUAAGG | 14567 |
| 5171 | AAAAUGUC A CAUUCUAU | 5228 | AUAGAAUG CUGAUGAGGCCGUUAGGCCGAA ICAUUUUU | 14568 |
| 5173 | AAUGUCAC A UUCUAUUU | 5229 | AAAUAGAA CUGAUGAGGCCGUUAGGCCGAA IUGACAUU | 14569 |

TABLE XIV-continued

NCH Ribozyme and Target Sequences

| Pos | Target | Seq ID No | NCH Ribozyme | Seq ID No |
|---|---|---|---|---|
| 5177 | UCACAUUC U AUUUUGGG | 5230 | CCCAAAAU CUGAUGAGGCCGUUAGGCCGAA IAAUGUGA | 14570 |
| 5201 | AUAUAGUC C AGACACUU | 5231 | AAGUGUCU CUGAUGAGGCCGUUAGGCCGAA IACUAUAU | 14571 |
| 5202 | UAUAGUCC A GACACUUA | 5232 | UAAGUGUC CUGAUGAGGCCGUUAGGCCGAA IGACUAUA | 14572 |
| 5206 | GUCCAGAC A CUUAACUC | 5233 | GAGUUAAG CUGAUGAGGCCGUUAGGCCGAA IUCUGGAC | 14573 |
| 5208 | CCAGACAC U UAACUCAA | 5234 | UUGAGUUA CUGAUGAGGCCGUUAGGCCGAA IGUGUCUGG | 14574 |
| 5213 | CACUUAAC U CAAUUUCU | 5235 | AGAAAUUG CUGAUGAGGCCGUUAGGCCGAA IUUAAGUG | 14575 |
| 5215 | CUUAACUC A AUUUCUUG | 5236 | CAAGAAAU CUGAUGAGGCCGUUAGGCCGAA IAGUUAAG | 14576 |
| 5221 | UCAAUUUC U UGGUAUUA | 5237 | UAAUACCA CUGAUGAGGCCGUUAGGCCGAA IAAAUUGA | 14577 |
| 5233 | UAUUAUUC U GUUUUGCA | 5238 | UGCAAAAC CUGAUGAGGCCGUUAGGCCGAA IAAUAAUA | 14578 |
| 5241 | UGUUUUGC A CAGUUAGU | 5239 | ACUAACUG CUGAUGAGGCCGUUAGGCCGAA ICAAAACA | 14579 |
| 5243 | UUUUGCAC A GUUAGUUG | 5240 | CAACUAAC CUGAUGAGGCCGUUAGGCCGAA IUGCAAAA | 14580 |
| 5263 | AAGAAAGC U GAGAAGAA | 5241 | UUCUUCUC CUGAUGAGGCCGUUAGGCCGAA ICUUUCUU | 14581 |
| 5281 | GAAAAUGC A GUCCUGAG | 5242 | CUCAGGAC CUGAUGAGGCCGUUAGGCCGAA ICAUUUUC | 14582 |
| 5285 | AUGCAGUC C UGAGGAGA | 5243 | UCUCCUCA CUGAUGAGGCCGUUAGGCCGAA IACUGCAU | 14583 |
| 5286 | UGCAGUCC U GAGGAGAG | 5244 | CUCUCCUC CUGAUGAGGCCGUUAGGCCGAA IGACUGCA | 14584 |
| 5300 | GAGUUUUC U CCAUAUCA | 5245 | UGAUAUGG CUGAUGAGGCCGUUAGGCCGAA IAAAACUC | 14585 |
| 5302 | GUUUUCUC C AUAUCAAA | 5246 | UUUGAUAU CUGAUGAGGCCGUUAGGCCGAA IAGAAAAC | 14586 |
| 5303 | UUUUCUCC A UAUCAAAA | 5247 | UUUUGAUA CUGAUGAGGCCGUUAGGCCGAA IGAGAAAA | 14587 |
| 5308 | UCCAUAUC A AAACGAGG | 5248 | CCUCGUUU CUGAUGAGGCCGUUAGGCCGAA IAUAUGGA | 14588 |
| 5319 | ACGAGGGC U GAUGGAGG | 5249 | CCUCCAUC CUGAUGAGGCCGUUAGGCCGAA ICCCUCGU | 14589 |
| 5337 | AAAAGGUC A AUAAGGUC | 5250 | GACCUUAU CUGAUGAGGCCGUUAGGCCGAA IACCUUUU | 14590 |
| 5346 | AUAAGGUC A AGGGAAGA | 5251 | UCUUCCCU CUGAUGAGGCCGUUAGGCCGAA IACCUUAU | 14591 |
| 5356 | GGGAAGAC C CCGUCUCU | 5252 | AGAGACGG CUGAUGAGGCCGUUAGGCCGAA IUCUUCCC | 14592 |
| 5357 | GGAAGACC C CGUCUCUA | 5253 | UAGAGACG CUGAUGAGGCCGUUAGGCCGAA IGUCUUCC | 14593 |
| 5358 | GAAGACCC C GUCUCUAU | 5254 | AUAGAGAC CUGAUGAGGCCGUUAGGCCGAA IGGUCUUC | 14594 |
| 5362 | ACCCGUC U CUAUACCA | 5255 | UGGUAUAG CUGAUGAGGCCGUUAGGCCGAA IACGGGU | 14595 |
| 5364 | CCCGUCUC U AUACCAAC | 5256 | GUUGGUAU CUGAUGAGGCCGUUAGGCCGAA IAGACGGG | 14596 |
| 5369 | CUCUAUAC C AACCAAAC | 5257 | GUUUGGUU CUGAUGAGGCCGUUAGGCCGAA IUAUAGAG | 14597 |
| 5370 | UCUAUACC A ACCAAACC | 5258 | GGUUUGGU CUGAUGAGGCCGUUAGGCCGAA IGUAUAGA | 14598 |
| 5373 | AUACCAAC C AAACCAAU | 5259 | AUUGGUUU CUGAUGAGGCCGUUAGGCCGAA IUUGGUAU | 14599 |
| 5374 | UACCAACC A AACCAAUU | 5260 | AAUUGGUU CUGAUGAGGCCGUUAGGCCGAA IGUUGGUA | 14600 |
| 5378 | AACCAAAC C AAUUCACC | 5261 | GGUGAAUU CUGAUGAGGCCGUUAGGCCGAA IUUUGGUU | 14601 |
| 5379 | ACCAAACC A AUUCACCA | 5262 | UGGUGAAU CUGAUGAGGCCGUUAGGCCGAA IGUUUGGU | 14602 |
| 5384 | ACCAAUUC A CCAACACA | 5263 | UGUGUUGG CUGAUGAGGCCGUUAGGCCGAA IAAUUGGU | 14603 |
| 5386 | CAAUUCAC C AACACAGU | 5264 | ACUGUGUU CUGAUGAGGCCGUUAGGCCGAA IUGAAUUG | 14604 |
| 5387 | AAUUCACC A ACACAGUU | 5265 | AACUGUGU CUGAUGAGGCCGUUAGGCCGAA IGUGAAUU | 14605 |
| 5390 | UCACCAAC A CAGUUGGG | 5266 | CCCAACUG CUGAUGAGGCCGUUAGGCCGAA IUUGGUGA | 14606 |

TABLE XIV-continued

NCH Ribozyme and Target Sequences

| Pos | Target | Seq ID No | NCH Ribozyme | Seq ID No |
|---|---|---|---|---|
| 5392 | ACCAACAC A GUUGGGAC | 5267 | GUCCCAAC CUGAUGAGGCCGUUAGGCCGAA IUGUUGGU | 14607 |
| 5401 | GUUGGGAC C CAAAACAC | 5268 | GUGUUUUG CUGAUGAGGCCGUUAGGCCGAA IUCCCAAC | 14608 |
| 5402 | UUGGGACC C AAAACACA | 5269 | UGUGUUUU CUGAUGAGGCCGUUAGGCCGAA IGUCCCAA | 14609 |
| 5403 | UGGGACCC A AAACACAG | 5270 | CUGUGUUU CUGAUGAGGCCGUUAGGCCGAA IGGUCCCA | 14610 |
| 5408 | CCCAAAAC A CAGGAAGU | 5271 | ACUUCCUG CUGAUGAGGCCGUUAGGCCGAA IUUUUGGG | 14611 |
| 5410 | CAAAACAC A GGAAGUCA | 5272 | UGACUUCC CUGAUGAGGCCGUUAGGCCGAA IGUGUUUG | 14612 |
| 5418 | AGGAAGUC A GUCACGUU | 5273 | AACGUGAC CUGAUGAGGCCGUUAGGCCGAA IACUUCCU | 14613 |
| 5422 | AGUCAGUC A CGUUCCU | 5274 | AGGAAACG CUGAUGAGGCCGUUAGGCCGAA IACUGACU | 14614 |
| 5429 | CACGUUUC C UUUUCAUU | 5275 | AAUGAAAA CUGAUGAGGCCGUUAGGCCGAA IAAACGUG | 14615 |
| 5430 | ACGUUUCC U UUUCAUUU | 5276 | AAAUGAAA CUGAUGAGGCCGUUAGGCCGAA IGAAACGU | 14616 |
| 5435 | UCCUUUUC A UUUAAUGG | 5277 | CCAUUAAA CUGAUGAGGCCGUUAGGCCGAA IAAAAGGA | 14617 |
| 5450 | GGGAUUC C ACUAUCUC | 5278 | GAGAUAGU CUGAUGAGGCCGUUAGGCCGAA IAAUCCCC | 14618 |
| 5451 | GGGAUUCC A CUAUCCA | 5279 | UGAGAUAG CUGAUGAGGCCGUUAGGCCGAA IGAAUCCC | 14619 |
| 5453 | GAUUCCAC U AUCUCACA | 5280 | UGUGAGAU CUGAUGAGGCCGUUAGGCCGAA IUGGAAUC | 14620 |
| 5457 | CCACUAUC U CACACUAA | 5281 | UUAGUGUG CUGAUGAGGCCGUUAGGCCGAA IAUAGUGG | 14621 |
| 5459 | ACUAUCUC A CACUAAUC | 5282 | GAUUAGUG CUGAUGAGGCCGUUAGGCCGAA IAGAUAGU | 14622 |
| 5461 | UAUCUCAC A CUAAUCUG | 5283 | CAGACUAG CUGAUGAGGCCGUUAGGCCGAA IUGAGAUA | 14623 |
| 5463 | UCUCACAC U AAUCUGAA | 5284 | UUCAGAUU CUGAUGAGGCCGUUAGGCCGAA IUGUGAGA | 14624 |
| 5468 | CACUAAUC U GAAAGGAU | 5285 | AUCCUUUC CUGAUGAGGCCGUUAGGCCGAA IAUUAGUG | 14625 |
| 5487 | GGAAGAGC A UUAGCUGG | 5286 | CCAGCUAA CUGAUGAGGCCGUUAGGCCGAA ICUCUUCC | 14626 |
| 5493 | GCAUUAGC U GGCGCAUA | 5287 | UAUGCGCC CUGAUGAGGCCGUUAGGCCGAA ICUAAUGC | 14627 |
| 5499 | GCUGGCGC A UAUUAAGC | 5288 | GCUUAAUA CUGAUGAGGCCGUUAGGCCGAA ICGCCAGC | 14628 |
| 5508 | UAUUAAGC A CUUUAAGC | 5289 | GCUUAAAG CUGAUGAGGCCGUUAGGCCGAA ICUUAAUA | 14629 |
| 5510 | UUAAGCAC U UUAAGCUC | 5290 | GAGCUUAA CUGAUGAGGCCGUUAGGCCGAA IUGCUUAA | 14630 |
| 5517 | CUUUAAGC U CCUUGAGU | 5291 | ACUCAAGG CUGAUGAGGCCGUUAGGCCGAA ICUUAAAG | 14631 |
| 5519 | UUAAGCUC C UUGAGUAA | 5292 | UUACUCAA CUGAUGAGGCCGUUAGGCCGAA IAGCUUAA | 14632 |
| 5520 | UAAGCUCC U UGAGUAAA | 5293 | UUUACUCA CUGAUGAGGCCGUUAGGCCGAA IGAGCUUA | 14633 |
| 5550 | AUUUAUGC A AGGUAUUU | 5294 | AAAUACCU CUGAUGAGGCCGUUAGGCCGAA ICAUAAAU | 14634 |
| 5560 | GGUAUUUC U CCAGUUGG | 5295 | CCAACUGG CUGAUGAGGCCGUUAGGCCGAA IAAAUACC | 14635 |
| 5562 | UAUUUCUC C AGUUGGGA | 5296 | UCCCAACU CUGAUGAGGCCGUUAGGCCGAA IAGAAAUA | 14636 |
| 5563 | AUUUCUCC A GUUGGGAC | 5297 | GUCCCAAC CUGAUGAGGCCGUUAGGCCGAA IGAGAAAU | 14637 |
| 5572 | GUUGGGAC U CAGGAUAU | 5298 | AUACCUG CUGAUGAGGCCGUUAGGCCGAA IUCCCAAC | 14638 |
| 5574 | UGGGACUC A GGAUAUUA | 5299 | UAAUAUCC CUGAUGAGGCCGUUAGGCCGAA IAGUCCCA | 14639 |
| 5593 | UAAUGAGC C AUCACUAG | 5300 | CUAGUGAU CUGAUGAGGCCGUUAGGCCGAA ICUCAUUA | 14640 |
| 5594 | AAUGAGCC A UCACUAGA | 5301 | UCUAGUGA CUGAUGAGGCCGUUAGGCCGAA IGCUCAUU | 14641 |
| 5597 | GAGCCAUC A CUAGAAGA | 5302 | UCUUCUAG CUGAUGAGGCCGUUAGGCCGAA IAUGGCUC | 14642 |
| 5599 | GCCAUCAC U AGAAGAAA | 5303 | UUUCUUCU CUGAUGAGGCCGUUAGGCCGAA IUGAUGGC | 14643 |

TABLE XIV-continued

NCH Ribozyme and Target Sequences

| Pos | Target | Seq ID No | NCH Ribozyme | Seq ID No |
|---|---|---|---|---|
| 5611 | AGAAAAGC C CAUUUUCA | 5304 | UGAAAAUG CUGAUGAGGCCGUUAGGCCGAA ICUUUUCU | 14644 |
| 5612 | GAAAAGCC C AUUUUCAA | 5305 | UUGAAAAU CUGAUGAGGCCGUUAGGCCGAA IGCUUUUC | 14645 |
| 5613 | AAAAGCCC A UUUUCAAC | 5306 | GUUGAAAA CUGAUGAGGCCGUUAGGCCGAA IGGCUUUU | 14646 |
| 5619 | CCAUUUUC A ACUGCUUU | 5307 | AAAGCAGU CUGAUGAGGCCGUUAGGCCGAA IAAAAUGG | 14647 |
| 5622 | UUUUCAAC U GCUUUGAA | 5308 | UUCAAAGC CUGAUGAGGCCGUUAGGCCGAA IUUGAAAA | 14648 |
| 5625 | UCAACUGC U UUGAAACU | 5309 | AGUUUCAA CUGAUGAGGCCGUUAGGCCGAA ICAGUUGA | 14649 |
| 5633 | UUUGAAAC U UGCCUGGG | 5310 | CCCAGGCA CUGAUGAGGCCGUUAGGCCGAA IUUUCAAA | 14650 |
| 5637 | AAACUUGC C UGGGUCU | 5311 | AGACCCCA CUGAUGAGGCCGUUAGGCCGAA ICAAGUUU | 14651 |
| 5638 | AACUUGCC U GGGUCUG | 5312 | CAGACCCC CUGAUGAGGCCGUUAGGCCGAA IGCAAGUU | 14652 |
| 5645 | CUGGGGUC U GAGCAUGA | 5313 | UCAUGCUC CUGAUGAGGCCGUUAGGCCGAA IACCCCAG | 14653 |
| 5650 | GUCUGAGC A UGAUGGGA | 5314 | UCCCAUCA CUGAUGAGGCCGUUAGGCCGAA ICUCAGAC | 14654 |
| 5669 | AGGGAGAC A GGGUAGGA | 5315 | UCCUACCC CUGAUGAGGCCGUUAGGCCGAA IUCUCCCU | 14655 |
| 5686 | AAGGGCGC C UACUCUUC | 5316 | GAAGAGUA CUGAUGAGGCCGUUAGGCCGAA ICGCCCUU | 14656 |
| 5687 | AGGGCGCC U ACUCUUCA | 5317 | UGAAGAGU CUGAUGAGGCCGUUAGGCCGAA IGCGCCCU | 14657 |
| 5690 | GCGCCUAC U CUUCAGGG | 5318 | CCCUGAAG CUGAUGAGGCCGUUAGGCCGAA IUAGGCGC | 14658 |
| 5692 | GCCUACUC U UCAGGGUC | 5319 | GACCCUGA CUGAUGAGGCCGUUAGGCCGAA IAGUAGGC | 14659 |
| 5695 | UACUCUUC A GGGUCUAA | 5320 | UUAGACCC CUGAUGAGGCCGUUAGGCCGAA IAAGAGUA | 14660 |
| 5701 | UCAGGGUC U AAAGAUCA | 5321 | UGAUCUUU CUGAUGAGGCCGUUAGGCCGAA IACCCUGA | 14661 |
| 5709 | UAAAGAUC A AGUGGGCC | 5322 | GGCCCACU CUGAUGAGGCCGUUAGGCCGAA IAUCUUUA | 14662 |
| 5717 | AAGUGGGC C UUGGAUCG | 5323 | CGAUCCAA CUGAUGAGGCCGUUAGGCCGAA ICCCACUU | 14663 |
| 5718 | AGUGGGCC U UGGAUCGC | 5324 | GCGAUCCA CUGAUGAGGCCGUUAGGCCGAA IGCCCACU | 14664 |
| 5727 | UGGAUCGC U AAGCUGGC | 5325 | GCCAGCUU CUGAUGAGGCCGUUAGGCCGAA ICGAUCCA | 14665 |
| 5732 | CGCUAAGC U GGCUCUGU | 5326 | ACAGAGCC CUGAUGAGGCCGUUAGGCCGAA ICUUAGCG | 14666 |
| 5736 | AAGCUGGC U CUGUUUGA | 5327 | UCAAACAG CUGAUGAGGCCGUUAGGCCGAA ICCAGCUU | 14667 |
| 5738 | GCUGGCUC U GUUUGAUG | 5328 | CAUCAAAC CUGAUGAGGCCGUUAGGCCGAA IAGCCAGC | 14668 |
| 5748 | UUUGAUGC U AUUUAUGC | 5329 | GCAUAAAU CUGAUGAGGCCGUUAGGCCGAA ICAUCAAA | 14669 |
| 5757 | AUUUAUGC A AGUUAGGG | 5330 | CCCUAACU CUGAUGAGGCCGUUAGGCCGAA ICAUAAAU | 14670 |
| 5768 | UUAGGGUC U AUGUAUUU | 5331 | AAAUACAU CUGAUGAGGCCGUUAGGCCGAA IACCCUAA | 14671 |
| 5786 | GGAUGCGC C UACUCUUC | 5332 | GAAGAGUA CUGAUGAGGCCGUUAGGCCGAA ICGCAUCC | 14672 |
| 5787 | GAUGCGCC U ACUCUUCA | 5333 | UGAAGAGU CUGAUGAGGCCGUUAGGCCGAA IGCGCAUC | 14673 |
| 5790 | GCGCCUAC U CUUCAGGG | 5318 | CCCUGAAG CUGAUGAGGCCGUUAGGCCGAA IUAGGCGC | 14658 |
| 5792 | GCCUACUC U UCAGGGUC | 5319 | GACCCUGA CUGAUGAGGCCGUUAGGCCGAA IAGUAGGC | 14659 |
| 5795 | UACUCUUC A GGGUCUAA | 5320 | UUAGACCC CUGAUGAGGCCGUUAGGCCGAA IAAGAGUA | 14660 |
| 5801 | UCAGGGUC U AAAGAUCA | 5321 | UGAUCUUU CUGAUGAGGCCGUUAGGCCGAA IACCCUGA | 14661 |
| 5809 | UAAAGAUC A AGUGGGCC | 5322 | GGCCCACU CUGAUGAGGCCGUUAGGCCGAA IAUCUUUA | 14662 |
| 5817 | AAGUGGGC C UUGGAUCG | 5323 | CGAUCCAA CUGAUGAGGCCCUUAGGCCGAA ICCCACUU | 14663 |
| 5818 | AGUGGGCC U UGGAUCGC | 5324 | GCGAUCCA CUGAUGAGGCCGUUAGGCCGAA IGCCCACU | 14664 |

TABLE XIV-continued

NCH Ribozyme and Target Sequences

| Pos | Target | Seq ID No | NCH Ribozyme | Seq ID No |
|---|---|---|---|---|
| 5827 | UGGAUCGC U AAGCUGGC | 5325 | GCCAGCUU CUGAUGAGGCCGUUAGGCCGAA ICGAUCCA | 14665 |
| 5832 | CGCUAAGC U GGCUCUGU | 5326 | ACAGAGCC CUGAUGAGGCCGUUAGGCCGAA ICUUAGCG | 14666 |
| 5836 | AAGCUGGC U CUGUUUGA | 5327 | UCAAACAG CUGAUGAGGCCGUUACGCCGAA ICCAGCUU | 14667 |
| 5838 | GCUGGCUC U GUUUGAUG | 5328 | CAUCAAAC CUGAUGAGGCCGUUAGGCCGAA IAGCCAGC | 14668 |
| 5848 | UUUGAUGC U AUUUAUGC | 5329 | GCAUAAAU CUGAUGAGGCCCUUAGGCCGAA ICAUCAAA | 14669 |
| 5857 | AUUUAUGC A AGUUAGGG | 5330 | CCCUAACU CUGAUGAGGCCGUUAGGCCGAA ICAUAAAU | 14670 |
| 5868 | UUAGGGUC U AUGUAUUU | 5331 | AAAUACAU CUGAUGAGGCCGUUAGGCCGAA IACCCUAA | 14671 |
| 5885 | AGGAUGUC U GCACCUUC | 5334 | GAAGGUGC CUGAUGAGGCCGUUAGGCCGAA IACAUCCU | 14674 |
| 5888 | AUGUCUGC A CCUUCGC | 5335 | GCAGAAGG CUGAUGAGGCCCUUAGGCCGAA ICAGACAU | 14675 |
| 5890 | GUCUGCAC C UUCUGCAG | 5336 | CUGCAGAA CUGAUGAGGCCGUUAGGCCGAA IUGCAGAC | 14676 |
| 5891 | UCUGCACC U UCUGCAGC | 5337 | GCUGCAGA CUGAUGAGGCCGUUAGGCCGAA IGUGCAGA | 14677 |
| 5894 | GCACCUUC U GCAGCCAG | 5338 | CUGGCUGC CUGAUGAGGCCGUUAGGCCGAA IAAGGUGC | 14678 |
| 5897 | CCUUCUGC A GCCAGUCA | 5339 | UGACUGGC CUGAUGAGGCCGUUAGGCCGAA ICAGAAGG | 14679 |
| 5900 | UCUGCAGC C AGUCAGAA | 5340 | UUCUGACU CUGAUGAGGCCGUUAGGCCGAA ICUGCAGA | 14680 |
| 5901 | CUGCAGCC A GUCAGAAG | 5341 | CUUCUGAC CUGAUGAGGCCGUUAGGCCGAA IGCUGCAG | 14681 |
| 5905 | AGCCAGUC A GAAGCUGG | 5342 | CCAGCUUC CUGAUGAGGCCGUUAGGCCGAA IACUGGCU | 14682 |
| 5911 | UCAGAAGC U GGAGAGGC | 5343 | GCCUCUCC CUGAUGAGGCCGUUAGGCCGAA ICUUCUGA | 14683 |
| 5920 | GGAGAGGC A ACAGUGGA | 5344 | UCCACUGU CUGAUGAGGCCGUUAGGCCGAA ICCUCUCC | 14684 |
| 5923 | GAGGCAAC A GUGGAUUG | 5345 | CAAUCCAC CUGAUGAGGCCGUUAGGCCGAA IUUGCCUC | 14685 |
| 5933 | UGGAUUGC U GCUUCUUG | 5346 | CAAGAAGC CUGAUGAGGCCGUUAGGCCGAA ICAAUCCA | 14686 |
| 5936 | AUUGCUGC U UCUUGGGG | 5347 | CCCCAAGA CUGAUGAGGCCGUUAGGCCGAA ICAGCAAU | 14687 |
| 5939 | GCUGCUUC U UGGGGAGA | 5348 | UCUCCCCA CUGAUGAGGCCGUUAGGCCGAA IAAGCAGC | 14688 |
| 5957 | GAGUAUGC U UCCUUUUA | 5349 | UAAAAGGA CUGAUGAGGCCGUUAGGCCGAA ICAUACUC | 14689 |
| 5960 | UAUGCUUC C UUUUAUCC | 5350 | GGAUAAAA CUGAUGAGGCCGUUAGGCCGAA IAAGCAUA | 14690 |
| 5961 | AUGCUUCC U UUUAUCCA | 5351 | UGGAUAAA CUGAUGAGGCCGUUAGGCCGAA IGAAGCAU | 14691 |
| 5968 | CUUUUAUC C AUGUAAUU | 5352 | AAUUACAU CUGAUGAGGCCGUUAGGCCGAA IAUAAAAG | 14692 |
| 5969 | UUUUAUCC A UGUAAUUU | 5353 | AAAUUACA CUGAUGAGGCCGUUAGGCCGAA IGAUAAAA | 14693 |
| 5981 | AAUUUAAC U GUAGAACC | 5354 | GGUUCUAC CUGAUGAGGCCGUUAGGCCGAA IUUAAAUU | 14694 |
| 5989 | UGUAGAAC C UGAGCUCU | 5355 | AGAGCUCA CUGAUGAGGCCGUUACGCCGAA IUUCUACA | 14695 |
| 5990 | GUAGAACC U GAGCUCUA | 5356 | UAGAGCUC CUGAUGAGGCCGUUAGGCCGAA IGUUCUAC | 14696 |
| 5995 | ACCUGAGC U CUAAGUAA | 5357 | UUACUUAG CUGAUGAGGCCGUUAGGCCGAA ICUCAGGU | 14697 |
| 5997 | CUGAGCUC U AAGUAACC | 5358 | GGUUACUU CUGAUGAGGCCGUUAGGCCGAA IACCUCAG | 14698 |
| 6005 | UAAGUAAC C GAAGAAUG | 5359 | CAUUCUUC CUGAUGAGGCCGUUAGGCCGAA IUUACUUA | 14699 |
| 6019 | AUGUAUGC C UCUGUUCU | 5360 | AGAACAGA CUGAUGAGGCCGUUAGGCCGAA ICAUACAU | 14700 |
| 6020 | UGUAUGCC U CUGUUCUU | 5361 | AAGAACAG CUGAUGAGGCCGUUAGGCCGAA IGCAUACA | 14701 |
| 6022 | UAUGCCUC U GUUCUUAU | 5362 | AUAAGAAC CUGAUGAGGCCGUUAGGCCGAA IAGGCAUA | 14702 |
| 6027 | CUCUGUUC U UAUGUGCC | 5363 | GGCACAUA CUGAUGAGGCCGUUAGGCCGAA IAACAGAG | 14703 |

TABLE XIV-continued

NCH Ribozyme and Target Sequences

| Pos | Target | Seq ID No | NCH Ribozyme | Seq ID No |
|---|---|---|---|---|
| 6035 | UUAUGUGC C ACAUCCUU | 5364 | AAGGAUGU CUGAUGAGGCCGUUAGGCCGAA ICACAUAA | 14704 |
| 6036 | UAUGUGCC A CAUCCUUG | 5365 | CAAGGAUG CUGAUGAGGCCGUUAGGCCGAA IGCACAUA | 14705 |
| 6038 | UGUGCCAC A UCCUUGUU | 5366 | AACAAGGA CUGAUGAGGCCGUUAGGCCGAA IUGGCACA | 14706 |
| 6041 | GCCACAUC C UUGUUAA | 5367 | UUAAACAA CUGAUGAGGCCGUUAGGCCGAA IAUGUGGC | 14707 |
| 6042 | CCACAUCC U UGUUUAAA | 5368 | UUUAAACA CUGAUGAGGCCGUUAGGCCGAA ICAUGUGG | 14708 |
| 6054 | UUAAAGGC U CUCUGUAU | 5369 | AUACAGAG CUGAUGAGGCCGUUAGGCCGAA ICCUUUAA | 14709 |
| 6056 | AAAGGCUC U CUGUAUGA | 5370 | UCAUACAG CUGAUGAGGCCGUUAGGCCGAA IAGCCUUU | 14710 |
| 6058 | AGGCUCUC U GUAUGAAG | 5371 | CUUCAUAC CUGAUGAGGCCGUUAGGCCGAA IAGAGCCU | 14711 |
| 6076 | GAUGGGAC C GUCAUCAG | 5372 | CUGAUGAC CUGAUGAGGCCGUUAGGCCGAA IUCCCAUC | 14712 |
| 6080 | GGACCGUC A UCAGCACA | 5373 | UGUGCUGA CUGAUGAGGCCGUUAGGCCGAA IACGGUCC | 14713 |
| 6083 | CCGUCAUC A GCACAUUC | 5374 | GAAUGUGC CUGAUGAGGCCGUUAGGCCGAA IAUGACGG | 14714 |
| 6086 | UCAUCAGC A CAUUCCCU | 5375 | AGGGAAUG CUGAUGAGGCCGUUAGGCCGAA ICUGAUGA | 14715 |
| 6088 | AUCAGCAC A UUCCCUAG | 5376 | CUAGGGAA CUGAUGAGGCCGUUAGGCCGAA IUGCUGAU | 14716 |
| 6092 | GCACAUUC C CUAGUGAG | 5377 | CUCACUAG CUGAUGAGGCCGUUAGGCCGAA IAAUGUGC | 14717 |
| 6093 | CACAUUCC C UAGUGAGC | 5378 | GCUCACUA CUGAUGAGGCCGUUAGGCCGAA IGAAUGUG | 14718 |
| 6094 | ACAUUCCC U AGUGAGCC | 5379 | GGCUCACU CUGAUGAGGCCGUUAGGCCGAA IGGAAUGU | 14719 |
| 6102 | UAGUGAGC C UACUGGCU | 5380 | AGCCAGUA CUGAUGAGGCCGUUAGGCCGAA ICUCACUA | 14720 |
| 6103 | AGUGAGCC U ACUGGCUC | 5381 | GAGCCAGU CUGAUGAGGCCGUUAGGCCGAA IGCUCACU | 14721 |
| 6106 | GAGCCUAC U GGCUCCUG | 5382 | CAGGAGCC CUGAUGAGGCCGUUAGGCCGAA IUAGGCUC | 14722 |
| 6110 | CUACUGGC U CCUGGCAG | 5383 | CUGCCAGG CUGAUGAGGCCGUUAGGCCGAA ICCAGUAG | 14723 |
| 6112 | ACUGGCUC C UGGCAGCG | 5384 | CGCUGCCA CUGAUGAGGCCGUUAGGCCGAA IAGCCAGU | 14724 |
| 6113 | CUGGCUCC U GGCAGCGG | 5385 | CCGCUGCC CUGAUGAGGCCGUUAGGCCGAA IGAGCCAG | 14725 |
| 6117 | CUCCUGGC A GCGGCUUU | 5386 | AAAGCCGC CUGAUGAGGCCGUUAGGCCGAA ICCAGGAG | 14726 |
| 6123 | GCAGCGGC U UUGUGGA | 5387 | UCCACAAA CUGAUGAGGCCGUUAGGCCGAA ICCGCUGC | 14727 |
| 6136 | UGGAAGAC U CACUAGCC | 5388 | GGCUAGUG CUGAUGAGGCCGUUAGGCCGAA IUCUUCCA | 14728 |
| 6138 | GAAGACUC A CUAGCCAG | 5389 | CUGGCUAG CUGAUGAGGCCGUUAGGCCGAA IAGUCUUC | 14729 |
| 6140 | AGACUCAC U AGCCAGAA | 5390 | UUCUGGCU CUGAUGAGGCCGUUAGGCCGAA IUGAGUCU | 14730 |
| 6144 | UCACUAGC C AGAAGAGA | 5391 | UCUCUUCU CUGAUGAGGCCGUUAGGCCGAA ICUAGUGA | 14731 |
| 6145 | CACUAGCC A GAAGAGAG | 5392 | CUCUCUUC CUGAUGAGGCCGUUAGGCCGAA IGCUAGUG | 14732 |
| 6163 | AGUGGGAC A GUCCUCUC | 5393 | GAGAGGAC CUGAUGAGGCCGUUAGGCCGAA IUCCCACU | 14733 |
| 6167 | GGACAGUC C UCUCCACC | 5394 | GGUGGAGA CUGAUGAGGCCGUUAGGCCGAA IACUGUCC | 14734 |
| 6168 | GACAGUCC U CUCCACCA | 5395 | UGGUGGAG CUGAUGAGGCCGUUAGGCCGAA IGACUGUC | 14735 |
| 6170 | CAGUCCUC U CCACCAAG | 5396 | CUUGGUGG CUGAUGAGGCCGUUAGGCCGAA IAGGACUG | 14736 |
| 6172 | GUCCUCUC C ACCAAGAU | 5397 | AUCUUGGU CUGAUGAGGCCGUUAGGCCGAA IAGAGGAC | 14737 |
| 6173 | UCCUCUCC A CCAAGAUC | 5398 | GAUCUUGG CUGAUGAGGCCGUUAGGCCGAA IGAGAGGA | 14738 |
| 6175 | CUCUCCAC C AAGAUCUA | 5399 | UAGAUCUU CUGAUGAGGCCGUUAGGCCGAA IUGGAGAG | 14739 |
| 6176 | UCUCCACC A AGAUCUAA | 5400 | UUAGAUCU CUGAUGAGGCCGUUAGGCCGAA IGUGGAGA | 14740 |

TABLE XIV-continued

NCH Ribozyme and Target Sequences

| Pos | Target | Seq ID No | NCH Ribozyme | Seq ID No |
|---|---|---|---|---|
| 6182 | CCAAGAUC U AAAUCCAA | 5401 | UUGGAUUU CUGAUGAGGCCGUUAGGCCGAA IAUCUUGG | 14741 |
| 6188 | UCUAAAUC C AAACAAAA | 5402 | UUUUGUUU CUGAUGAGGCCGUUAGGCCGAA IAUUUAGA | 14742 |
| 6189 | CUAAAUCC A AACAAAAG | 5403 | CUUUUGUU CUGAUGAGGCCGUUAGGCCGAA IGAUUUAG | 14743 |
| 6193 | AUCCAAAC A AAGCAGG | 5404 | CCUGCUUU CUGAUGAGGCCGUUAGGCCGAA IUUUGGAU | 14744 |
| 6199 | ACAAAAGC A GGCUAGAG | 5405 | CUCUAGCC CUGAUGAGGCCGUUAGGCCGAA ICUUUUGU | 14745 |
| 6203 | AAGCAGGC U AGAGCCAG | 5406 | CUGGCUCU CUGAUGAGGCCGUUAGGCCGAA ICCUGCUU | 14746 |
| 6209 | GCUAGAGC C AGAAGAGA | 5407 | UCUCUUCU CUGAUGAGGCCGUUAGGCCGAA ICUCUAGC | 14747 |
| 6210 | CUAGAGCC A GAAGAGAG | 5408 | CUCUCUUC CUGAUGAGGCCGUUAGGCCGAA IGCUCUAG | 14748 |
| 6222 | GAGAGGAC A AAUCUUUG | 5409 | CAAAGAUU CUGAUGAGGCCGUUAGGCCGAA IUCCUCUC | 14749 |
| 6227 | GACAAAUC U UUGUUGUU | 5410 | AACAACAA CUGAUGAGGCCGUUAGGCCGAA IAUUGGUC | 14750 |
| 6237 | UGUUGUUC C UCUUCUUU | 5411 | AAAGAAGA CUGAUGAGGCCGUUAGGCCGAA IAACAACA | 14751 |
| 6238 | GUUGUUCC U CUUCUUUA | 5412 | UAAAGAAG CUGAUGAGGCCGUUAGGCCGAA IGAACAAC | 14752 |
| 6240 | UGUUCCUC U UCUUUACA | 5413 | UGUAAAGA CUGAUGAGGCCGUUAGGCCGAA IAGGAACA | 14753 |
| 6243 | UCCUCUUC U UUACACAU | 5414 | AUGUGUAA CUGAUGAGGCCGUUAGGCCGAA IAAGAGGA | 14754 |
| 6248 | UUCUUUAC A CAUACGCA | 5415 | UGCGUAUG CUGAUGAGGCCGUUAGGCCGAA IUAAAGAA | 14755 |
| 6250 | CUUUACAC A UACGCAAA | 5416 | UUUGCGUA CUGAUGAGGCCGUUAGGCCGAA IUGUAAAG | 14756 |
| 6256 | ACAUACGC A AACCACCU | 5417 | AGGUGGUU CUGAUGAGGCCGUUAGGCCGAA ICGUAUGU | 14757 |
| 6260 | ACGCAAAC C ACCUGUGA | 5418 | UCACAGGU CUGAUGAGGCCGUUAGGCCGAA IUUUGCGU | 14758 |
| 6261 | CGCAAACC A CCUGUGAC | 5419 | GUCACAGG CUGAUGAGGCCGUUAGGCCGAA IGUUUGCG | 14759 |
| 6263 | CAAACCAC C UGUGACAG | 5420 | CUGUCACA CUGAUGAGGCCGUUAGGCCGAA IUGGUUUG | 14760 |
| 6264 | AAACCACC U GUGACAGC | 5421 | GCUGUCAC CUGAUGAGGCCGUUAGGCCGAA IGUGGUUU | 14761 |
| 6270 | CCUGUGAC A GCUGGCAA | 5422 | UUGCCAGC CUGAUGAGGCCGUUAGGCCGAA IUCACAGG | 14762 |
| 6273 | GUGACAGC U GGCAAUUU | 5423 | AAAUUGCC CUGAUGAGGCCGUUAGGCCGAA ICUGUCAC | 14763 |
| 6277 | CAGCUGGC A AUUUUAUA | 5424 | UAUAAAAU CUGAUGAGGCCGUUAGGCCGAA ICCAGCUG | 14764 |
| 6290 | UAUAAAUC A GGUAACUG | 5425 | CAGUUACC CUGAUGAGGCCGUUAGGCCGAA IAUUUAUA | 14765 |
| 6297 | CAGGUAAC U GGAAGGAG | 5426 | CUCCUUCC CUGAUGAGGCCGUUAGGCCGAA IUUACCUG | 14766 |
| 6313 | GGUUAAAC U CAGAAAAA | 5427 | UUUUUCUG CUGAUGAGGCCGUUAGGCCGAA IUUUAACC | 14767 |
| 6315 | UUAAACUC A GAAAAAAG | 5428 | CUUUUUUC CUGAUGAGGCCGUUAGGCCGAA IAGUUUAA | 14768 |
| 6329 | AAGAAGAC C UCAGUCAA | 5429 | UUGACUGA CUGAUGAGGCCGUUAGGCCGAA IUCUUCUU | 14769 |
| 6330 | AGAAGACC U CAGUCAAA | 5430 | AUUGACUG CUGAUGAGGCCGUUAGGCCGAA IGUCUUCU | 14770 |
| 6332 | AAGACCUC A GUCAAUUC | 5431 | GAAUUGAC CUGAUGAGGCCGUUAGGCCGAA IAGGUCUU | 14771 |
| 6336 | CCUCAGUC A AUUCUCUA | 5432 | UAGAGAAU CUGAUGAGGCCGUUAGGCCGAA IACUGAGG | 14772 |
| 6341 | GUCAAUUC U CUACUUUU | 5433 | AAAAGUAG CUGAUGAGGCCGUUAGGCCGAA IAAUUGAC | 14773 |
| 6343 | CAAUUCUC U ACUUUUUU | 5434 | AAAAAAGU CUGAUGAGGCCGUUAGGCCGAA IAGAAUUG | 14774 |
| 6346 | UUCUCUAC U UUUUUUU | 5435 | AAAAAAAA CUGAUGAGGCCGUUAGGCCGAA IUAGAGAA | 14775 |
| 6363 | UUUUUUUC C AAAUCAGA | 5436 | UCUGAUUU CUGAUGAGGCCGUUAGGCCGAA IAAAAAAA | 14776 |
| 6364 | UUUUUUCC A AAUCAGAU | 5437 | AUCUGAUU CUGAUGAGGCCGUUAGGCCGAA IGAAAAAA | 14777 |

TABLE XIV-continued

NCH Ribozyme and Target Sequences

| Pos | Target | Seq ID No | NCH Ribozyme | Seq ID No |
|---|---|---|---|---|
| 6369 | UCCAAAUC A GAUAAUAG | 5438 | CUAUUAUC CUGAUGAGGCCGUUAGGCCGAA IAUUUGGA | 14778 |
| 6379 | AUAAUAGC C CAGCAAAU | 5439 | AUUUGCUG CUGAUGAGGCCGUUAGGCCGAA ICUAUUAU | 14779 |
| 6380 | UAAUAGCC C AGCAAAUA | 5440 | UAUUUGCU CUGAUGAGGCCGUUAGGCCGAA IGCUAUUA | 14780 |
| 6381 | AAUAGCCC A GCAAAUAG | 5441 | CUAUUUGC CUGAUGAGGCCGUUAGGCCGAA IGGCUAUU | 14781 |
| 6384 | AGCCCAGC A AAUAGUGA | 5442 | UCACUAUU CUGAUGAGGCCGUUAGGCCGAA ICUGGGCU | 14782 |
| 6397 | GUGAUAAC A AAUAAAAC | 5443 | GUUUUAUU CUGAUGAGGCCGUUAGGCCGAA IUUAUCAC | 14783 |
| 6406 | AAUAAAAC C UUAGCUGU | 5444 | ACAGCUAA CUGAUGAGGCCGUUAGGCCGAA IUUUUAUU | 14784 |
| 6407 | AUAAAACC U UAGCUGUU | 5445 | AACAGCUA CUGAUGAGGCCGUUAGGCCGAA IGUUUUAU | 14785 |
| 6412 | ACCUUAGC U GUUCAUGU | 5446 | ACAUGAAC CUGAUGAGGCCGUUAGGCCGAA ICUAAGGU | 14786 |
| 6417 | AGCUGUUC A UGUCUUGA | 5447 | UCAAGACA CUGAUGAGGCCGUUAGGCCGAA IAACAGCU | 14787 |
| 6422 | UUCAUGUC U UGAUUUCA | 5448 | UGAAAUCA CUGAUGAGGCCGUUAGGCCGAA IACAUGAA | 14788 |
| 6430 | UUGAUUUC A AUAAUUAA | 5449 | UUAAUUAU CUGAUGAGGCCGUUAGGCCGAA IAAAUCAA | 14789 |
| 6442 | AUUAAUUC U UAAUCAUU | 5450 | AAUGAUUA CUGAUGAGGCCGUUAGGCCGAA IAAUUAAU | 14790 |
| 6448 | UCUUAAUC A UUAAGAGA | 5451 | UCUCUUAA CUGAUGAGGCCGUUAGGCCGAA IAUUAAGA | 14791 |
| 6458 | UAAGAGAC C AUAAUAAA | 5452 | UUUAUUAU CUGAUGAGGCCGUUAGGCCGAA IUCUCUUA | 14792 |
| 6459 | AAGAGACC A UAAUAAAU | 5453 | AUUUAUUA CUGAUGAGGCCGUUAGGCCGAA IGUCUCUU | 14793 |
| 6470 | AUAAAUAC U CCUUUUCA | 5454 | UGAAAAGG CUGAUGAGGCCGUUAGGCCGAA IUAUUUAU | 14794 |
| 6472 | AAAUACUC C UUUUCAAG | 5455 | CUUGAAAA CUGAUGAGGCCGUUAGGCCGAA IAGUAUUU | 14795 |
| 6473 | AAUACUCC U UUUCAAGA | 5456 | UCUUGAAA CUGAUGAGGCCGUUAGGCCGAA IGAGUAUU | 14796 |
| 6478 | UCCUUUUC A AGAGAAAA | 5457 | UUUUCUCU CUGAUGAGGCCGUUAGGCCGAA IAAAAGGA | 14797 |
| 6489 | AGAAAAGC A AACCAUU | 5458 | AAUGGUUU CUGAUGAGGCCGUUAGGCCGAA ICUUUUCU | 14798 |
| 6494 | AGCAAAAC C AUUAGAAU | 5459 | AUUCUAAU CUGAUGAGGCCGUUAGGCCGAA IUUUUGCU | 14799 |
| 6495 | GCAAAACC A UUAGAAUU | 5460 | AAUUCUAA CUGAUGAGGCCGUUAGGCCGAA IGUUUUGC | 14800 |
| 6509 | AUUGUUAC U CAGCUCCU | 5461 | AGGAGCUG CUGAUGAGGCCGUUAGGCCGAA IUAACAAU | 14801 |
| 6511 | UGUUACUC A GCUCCUUC | 5462 | GAAGGAGC CUGAUGAGGCCGUUAGGCCGAA IAGUAACA | 14802 |
| 6514 | UACUCAGC U CCUUCAAA | 5463 | UUUGAAGG CUGAUGAGGCCGUUAGGCCGAA ICUGAGUA | 14803 |
| 6516 | CUCAGCUC C UUCAAACU | 5464 | AGUUUGAA CUGAUGAGCCCGUUAGGCCGAA IAGCUGAG | 14804 |
| 6517 | UCAGCUCC U UCAAACUC | 5465 | GAGUUUGA CUGAUGAGGCCGUUAGGCCGAA IGAGOUGA | 14805 |
| 6520 | GCUCCUUC A AACUCAGG | 5466 | CCUGAGUU CUGAUGAGGCCGUUAGGCCGAA IAAGGAGC | 14806 |
| 6524 | CUUCAAAC U CAGGUUUG | 5467 | CAAACCUG CUGAUGAGGCCGUUAGGCCGAA IUUUGAAG | 14807 |
| 6526 | UCAAACUC A GGUUUGUA | 5468 | UACAAACC CUGAUGAGGCCGUUAGGCCGAA IAGUUUGA | 14808 |
| 6537 | UUUGUAGC A UACAUGAG | 5469 | CUCAUGUA CUGAUGAGGCCGUUAGGCCGAA ICUACAAA | 14809 |
| 6541 | UAGCAUAC A UGAGUCCA | 5470 | UGGACUCA CUGAUGAGGCCGUUAGGCCGAA IUAUGCUA | 14810 |
| 6548 | CAUGAGUC C AUCCAUCA | 5471 | UGAUGGAU CUGAUGAGGCCGUUAGGCCGAA IACUCAUG | 14811 |
| 6549 | AUGAGUCC A UCCAUCAG | 5472 | CUGAUGGA CUGAUGAGGCCGUUAGGCCGAA IGACUCAU | 14812 |
| 6552 | AGUCCAUC C AUCAGUCA | 5473 | UGACUGAU CUGAUGAGGCCGUUAGGCCGAA IAUGGACU | 14813 |
| 6553 | GUCCAUCC A UCAGUCAA | 5474 | UUGACUGA CUGAUGAGGCCGUUAGGCCGAA IGAUGGAC | 14814 |

TABLE XIV-continued

NCH Ribozyme and Target Sequences

| Pos | Target | Seq ID No | NCH Ribozyme | Seq ID No |
|---|---|---|---|---|
| 6556 | CAUCCAUC A GUCAAAGA | 5475 | UCUUUGAC CUGAUGAGgccguuaggcCGAA IAUGGAUG | 14815 |
| 6560 | CAUCAGUC A AAGAAUGG | 5476 | CCAUUCUU CUGAUGAGgccguuaggcCGAA IACUGAUG | 14816 |
| 6572 | AAUGGUUC C AUCUGGAG | 5477 | CUCCAGAU CUGAUGAGgccguuaggcCGAA IAACCAUU | 14817 |
| 6573 | AUGGUUCC A UCUGGAGU | 5478 | ACUCCAGA CUGAUGAGgccguuaggcCGAA IGAACCAU | 14818 |
| 6576 | GUUCCAUC U GGAGUCUU | 5479 | AAGACUCC CUGAUGAGgccguuaggcCGAA IAUGGAAC | 14819 |
| 6583 | CUGGAGUC U UAAUGUAG | 5480 | CUACAUUA CUGAUGAGgccguuaggcCGAA IACUCCAG | 14820 |
| 6608 | AUGGAGAC U UGUAAUAA | 5481 | UUAUUACA CUGAUGAGgccguuaggcCGAA IUCUCCAU | 14821 |
| 6622 | UAAUGAGC U AGUUACAA | 5482 | UUGUAACU CUGAUGAGgccguuaggcCGAA ICUCAUUA | 14822 |
| 6629 | CUAGUUAC A AAGUGCUU | 5483 | AAGCACUU CUGAUGAGgccguuaggcCGAA IUAACUAG | 14823 |
| 6636 | CAAAGUGC U UGUUCAUU | 5484 | AAUGAACA CUGAUGAGgccguuaggcCGAA ICACUUUG | 14824 |
| 6642 | GCUUGUUC A UUAAAAUA | 5485 | UAUUUUAA CUGAUGAGgccguuaggcCGAA IAACAAGC | 14825 |
| 6653 | AAAAUAGC A CUGAAAAU | 5486 | AUUUUCAG CUGAUGAGgccguuaggcCGAA ICUAUUUU | 14826 |
| 6655 | AAUAGCAC U GAAAAUUG | 5487 | CAAUUUUC CUGAUGAGgccguuaggcCGAA IUGCUAUU | 14827 |
| 6668 | AUUGAAAC A UGAAUUAA | 5488 | UUAAUUCA CUGAUGAGgccguuaggcCGAA IUUUCAAU | 14828 |
| 6678 | GAAUUAAC U GAUAAUAU | 5489 | AUAUUAUC CUGAUGAGgccguuaggcCGAA IUUAAUUC | 14829 |
| 6689 | UAAUAUUC C AAUCACAU | 5490 | AAAUGAUU CUGAUGAGgccguuaggcCGAA IAAUAUUA | 14830 |
| 6690 | AAUAUUCC A AUCAUUUG | 5491 | CAAAUGAU CUGAUGAGgccguuaggcCGAA IGAAUAUU | 14831 |
| 6694 | UUCCAAUC A UUUGCCAU | 5492 | AUGGCAAA CUGAUGAGgccguuaggcCGAA IAUUGGAA | 14832 |
| 6700 | UCAUUUGC C AUUUAUGA | 5493 | UCAUAAAU CUGAUGAGgccguuaggcCGAA ICAAAUGA | 14833 |
| 6701 | CAUUUGCC A UUUAUGAC | 5494 | GUCAUAAA CUGAUGAGgccguuaggcCGAA IGCAAAUG | 14834 |
| 6710 | UUUAUGAC A AAAAUGGU | 5495 | ACCAUUUU CUGAUGAGgccguuaggcCGAA IUCAUAAA | 14835 |
| 6723 | UGGUUGGC A CUAACAAA | 5496 | UUUGUUAG CUGAUGAGgccguuaggcCGAA ICCAACCA | 14836 |
| 6725 | GUUGGCAC U AACAAAGA | 5497 | UCUUUGUU CUGAUGAGgccguuaggcCGAA IUGCCAAC | 14837 |
| 6729 | GCACUAAC A AAGAACGA | 5498 | UCGUUCUU CUGAUGAGgccguuaggcCGAA IUUAGUGC | 14838 |
| 6740 | GAACGAGC A CUUCCUUU | 5499 | AAAGGAAG CUGAUGAGgccguuaggcCGAA ICUCGUUC | 14839 |
| 6742 | ACGAGCAC U UCCUUUCA | 5500 | UGAAAGGA CUGAUGAGgccguuaggcCGAA IUGCUCGU | 14840 |
| 6745 | AGCACUUC C UUUCAGAG | 5501 | CUCUGAAA CUGAUGAGgccguuaggcCGAA IAAGUGCU | 14841 |
| 6746 | GCACUUCC U UUCAGAGU | 5502 | ACUCUGAA CUGAUGAGgccguuaggcCGAA IGAAGUGC | 14842 |
| 6750 | UUCCUUUC A GAGUUUCU | 5503 | AGAAACUC CUGAUGAGgccguuaggcCGAA IAAAGGAA | 14843 |
| 6758 | AGAGUUUC U GAGAUAAU | 5504 | AUUAUCUC CUGAUGAGgccguuaggcCGAA IAAACUCU | 14844 |
| 6778 | CGUGGAAC A GUCUGGGU | 5505 | ACCCAGAC CUGAUGAGgccguuaggcCGAA IUUCCACG | 14845 |
| 6782 | GAACAGUC U GGGUGGAA | 5506 | UUCCACCC CUGAUGAGgccguuaggcCGAA IACUGUUC | 14846 |
| 6797 | AAUGGGGC U GAAACCAU | 5507 | AUGGUUUC CUGAUGAGgccguuaggcCGAA ICCCCAUU | 14847 |
| 6803 | GCUGAAAC C AUGUGCAA | 5508 | UUGCACAU CUGAUGAGgccguuaggcCGAA IUUUCAGC | 14848 |
| 6804 | CUGAAACC A UGUGCAAG | 5509 | CUUGCACA CUGAUGAGgccguuaggcCGAA IGUUUCAG | 14849 |
| 6810 | CCAUGUGC A AGUCUGUG | 5510 | CACAGACU CUGAUGAGgccguuaggcCGAA ICACAUGG | 14850 |
| 6815 | UGCAAGUC U GUGUCUUG | 5511 | CAAGACAC CUGAUGAGgccguuaggcCGAA IACUUGCA | 14851 |

TABLE XIV-continued

NCH Ribozyme and Target Sequences

| Pos | Target | Seq ID No | NCH Ribozyme | Seq ID No |
|---|---|---|---|---|
| 6821 | UCUGUGUC U UGUCAGUC | 5512 | GACUGACA CUGAUGAGGCCGUUAGGCCGAA IACACAGA | 14852 |
| 6826 | GCUUUGUC A GUCCAAGA | 5513 | UCUUGGAC CUGAUGAGGCCGUUAGGCCGAA IACAAGAC | 14853 |
| 6830 | UGUCAGUC C AAGAAGUG | 5514 | CACUUCUU CUGAUGAGGCCGUUAGGCCGAA IACUGACA | 14854 |
| 6831 | GUCAGUCC A AGAAGUGA | 5515 | UCACUUCU CUGAUGAGGCCGUUAGGCCGAA IGACUGAC | 14855 |
| 6841 | GAAGUGAC A CCGAGAUG | 5516 | CAUCUCGG CUGAUGAGGCCGUUAGGCCGAA IUCACUUC | 14856 |
| 6843 | AGUGACAC C GAGAUGUU | 5517 | AACAUCUC CUGAUGAGGCCGUUAGGCCGAA IUGUCACU | 14857 |
| 6864 | UUAGGGAC C CGUGCCUU | 5518 | AAGGCACG CUGAUGAGGCCGUUAGGCCGAA IUCCCUAA | 14858 |
| 6865 | UAGGGACC C GUGCCUUG | 5519 | CAAGGCAC CUGAUGAGGCCGUUAGGCCGAA IGUCCCUA | 14859 |
| 6870 | ACCCGUGC C UUGUUUCC | 5520 | GGAAACAA CUGAUGAGGCCGUUAGGCCGAA ICACGGGU | 14860 |
| 6871 | CCCGUGCC U UGUUUCCU | 5521 | AGGAAACA CUGAUGAGGCCGUUAGGCCGAA IGCACGGG | 14861 |
| 6878 | CUUGUUUC C UAGCCCAC | 5522 | GUGGGCUA CUGAUGAGGCCGUUAGGCCGAA IAAACAAG | 14862 |
| 6879 | UUGUUUCC U AGCCCACA | 5523 | UGUGGGCU CUGAUGAGGCCGUUAGGCCGAA IGAAACAA | 14863 |
| 6883 | UUCCUAGC C CACAAGAA | 5524 | UUCUUGUG CUGAUGAGGCCGUUAGGCCGAA ICUAGGAA | 14864 |
| 6884 | UCCUAGCC C ACAAGAAU | 5525 | AUUCUUGU CUGAUGAGGCCGUUAGGCCGAA IGCUAGGA | 14865 |
| 6885 | CCUAGCCC A CAAGAAUG | 5526 | CAUUCUUG CUGAUGAGGCCGUUAGGCCGAA IGGCUAGG | 14866 |
| 6887 | UAGCCCAC A AGAAUGCA | 5527 | UGCAUUCU CUGAUGAGGCCGUUAGGCCGAA IUGGGCUA | 14867 |
| 6895 | AAGAAUGC A AACAUCAA | 5528 | UUGAUGUU CUGAUGAGGCCGUUAGGCCGAA ICAUUCUU | 14868 |
| 6899 | AUGCAAAC A UCAAACAG | 5529 | CUGUUUGA CUGAUGAGGCCGUUAGGCCGAA IUUUGCAU | 14869 |
| 6902 | CAAACAUC A AACAGAUA | 5530 | UAUCUGUU CUGAUGAGGCCGUUAGGCCGAA IAUGUUUG | 14870 |
| 6906 | CAUCAAAC A GAUACUCG | 5531 | CGAGUAUC CUGAUGAGGCCGUUAGGCCGAA IUUUGAUG | 14871 |
| 6912 | ACAGAUAC U CGCUAGCC | 5532 | GGCUAGCG CUGAUGAGGCCGUUAGGCCGAA IUAUCUGU | 14872 |
| 6916 | AUACUCGC U AGCCUCAU | 5533 | AUGAGGCU CUGAUGAGGCCGUUAGGCCGAA ICGAGUAU | 14873 |
| 6920 | UCGCUAGC C UCAUUUAA | 5534 | UUAAAUGA CUGAUGAGGCCGUUAGGCCGAA ICUAGCGA | 14874 |
| 6921 | CGCUAGCC U CAUUUAAA | 5535 | UUUAAAUG CUGAUGAGGCCGUUAGGCCGAA IGCUAGCG | 14875 |
| 6923 | CUAGCCUC A UUUAAAUU | 5536 | AAUUUAAA CUGAUGAGGCCGUUAGGCCGAA IAGGCUAG | 14876 |
| 6949 | AGGAGUGC A UCUUUGGC | 5537 | GCCAAAGA CUGAUGAGGCCGUUAGGCCGAA ICACUCCU | 14877 |
| 6952 | AGUGCAUC U UUGGCCGA | 5538 | UCGGCCAA CUGAUGAGGCCGUUAGGCCGAA IAUGCACU | 14878 |
| 6958 | UCUUUGGC C GACAGUGG | 5539 | CCACUGUC CUGAUGAGGCCGUUAGGCCGAA ICCAAAGA | 14879 |
| 6962 | UGGCCGAC A GUGGUGUA | 5540 | UACACCAC CUGAUGAGGCCGUUAGGCCGAA IUCGGCCA | 14880 |
| 6973 | GGUGUAAC U GUGUGUGU | 5541 | ACACACAC CUGAUGAGGCCGUUAGGCCGAA IUUACACC | 14881 |
| 7041 | UUUUGUGC A UAACUAUU | 5542 | AAUAGUUA CUGAUGAGGCCGUUAGGCCGAA ICACAAAA | 14882 |
| 7046 | UGCAUAAC U AUUUAAGG | 5543 | CCUUAAAU CUGAUGAGGCCGUUAGGCCGAA IUUAUGCA | 14883 |
| 7059 | AAGGAAAC U GGAAUUUU | 5544 | AAAAUUCC CUGAUGAGGCCGUUAGGCCGAA IUUUCCUU | 14884 |
| 7076 | AAAGUUAC U UUUAUACA | 5545 | UGUAUAAA CUGAUGAGGCCGUUAGGCCGAA IUAACUUU | 14885 |
| 7084 | UUUUAUAC A AACCAAGA | 5546 | UCUUGGUU CUGAUGAGGCCGUUAGGCCGAA IUAUAAAA | 14886 |
| 7088 | AUACAAAC C AAGAAUAU | 5547 | AUAUUCUU CUGAUGAGGCCGUUAGGCCGAA IUUUGUAU | 14887 |
| 7089 | UACAAACC A AGAAUAUA | 5548 | UAUAUUCU CUGAUGAGGCCGUUAGGCCGAA IGUUUGUA | 14888 |

TABLE XIV-continued

NCH Ribozyme and Target Sequences

| Pos | Target | Seq ID No | NCH Ribozyme | Seq ID No |
|---|---|---|---|---|
| 7101 | AUAUAUGC U ACAGAUAU | 5549 | AUAUCUGU CUGAUGAGGCCGUUAGGCCGAA ICAUAUAU | 14889 |
| 7104 | UAUGCUAC A GAUAUAAG | 5550 | CUUAUAUC CUGAUGAGGCCGUUAGGCCGAA IUAGCAUA | 14890 |
| 7115 | UAUAAGAC A GACAUGGU | 5551 | ACCAUGUC CUGAUGAGGCCGUUAGGCCGAA IUCUUAUA | 14891 |
| 7119 | AGACAGAC A UGGUUUGG | 5552 | CCAAACCA CUGAUGAGGCCGUUAGGCCGAA IUCUGUCU | 14892 |
| 7130 | GUUUGGUC C UAUAUUUC | 5553 | GAAAUAUA CUGAUGAGGCCGUUAGGCCGAA IACCAAAC | 14893 |
| 7131 | UUUGGUCC U AUAUUUCU | 5554 | AGAAAUAU CUGAUGAGGCCGUUAGGCCGAA IGACCAAA | 14894 |
| 7139 | UAUAUUUC U AGCAUGA | 5555 | UCAUGACU CUGAUGAGGCCGUUAGGCCGAA IAAAUAUA | 14895 |
| 7144 | UUCUAGUC A UGAUGAAU | 5556 | AUUCAUCA CUGAUGAGGCCGUUAGGCCGAA IACUAGAA | 14896 |
| 7166 | UUGUAUAC C AUCUUCAU | 5557 | AUGAAGAU CUGAUGAGGCCGUUAGGCCGAA IUAUACAA | 14897 |
| 7167 | UGUAUACC A UCUUCAUA | 5558 | UAUGAAGA CUGAUGAGGCCGUUAGGCCGAA IGUAUACA | 14898 |
| 7170 | AUACCAUC U UCAUAUAA | 5559 | UUAUAUGA CUGAUGAGGCCGUUAGGCCGAA IAUGGUAU | 14899 |
| 7173 | CCAUCUUC A UAUAAUAU | 5560 | AUAUUAUA CUGAUGAGGCCGUUAGGCCGAA IAAGAUGG | 14900 |
| 7184 | UAAUAUAC U UAAAAAUA | 5561 | UAUUUUUA CUGAUGAGGCCGUUAGGCCGAA IUAUAUUA | 14901 |
| 7197 | AAUAUUUC U UAAUUGGG | 5562 | CCCAAUUA CUGAUGAGGCCGUUAGGCCGAA IAAAUAUU | 14902 |
| 7220 | AAUCGUAC C AACUUAAU | 5563 | AUUAAGUU CUGAUGAGGCCGUUAGGCCGAA IUACGAUU | 14903 |
| 7221 | AUCGUACC A ACUUAAUU | 5564 | AAUUAAGU CUGAUGAGGCCGUUAGGCCGAA IGUACGAU | 14904 |
| 7224 | GUACCAAC U UAAUUGAU | 5565 | AUCAAUUA CUGAUGAGGCCGUUAGGCCGAA IUUGGUAC | 14905 |
| 7237 | UGAUAAAC U UGGCAACU | 5566 | AGUUGCCA CUGAUGAGGCCGUUAGGCCGAA ICUUAUCA | 14906 |
| 7242 | AACUUGGC A ACUGCUUU | 5567 | AAAGCAGU CUCAUGAGGCCGUUAGGCCGAA ICCAAGUU | 14907 |
| 7245 | UUGGCAAC U GCUUUUAU | 5568 | AUAAAAGC CUGAUGAGGCCGUUAGGCCGAA IUUGCCAA | 14908 |
| 7248 | GCAACUGC U UUUAUGUU | 5569 | AACAUAAA CUGAUGAGGCCGUUAGGCCGAA ICAGUUGC | 14909 |
| 7258 | UUAUGUUC U GUCUCCUU | 5570 | AAGGAGAC CUGAUGAGGCCGUUAGGCCGAA IAACAUAA | 14910 |
| 7262 | GUUCUGUC U CCUUCCAU | 5571 | AUGGAAGG CUGAUGAGGCCGUUAGGCCGAA IACAGAAC | 14911 |
| 7264 | UCUGUCUC C UUCCAUAA | 5572 | UUAUGGAA CUGAUGAGGCCGUUAGGCCGAA IAGACAGA | 14912 |
| 7265 | CUGUCUCC U UCCAUAAA | 5573 | UUUAUGGA CUGAUGAGGCCGUUAGGCCGAA IGAGACAG | 14913 |
| 7268 | UCUCCUUC C AUAAAUUU | 5574 | AAAUUUAU CUGAUGAGGCCGUUAGGCCGAA IAAGGAGA | 14914 |
| 7269 | CUCCUUCC A UAAAUUUU | 5575 | AAAAUUUA CUGAUGAGGCCGUUAGGCCGAA IGAAGGAG | 14915 |
| 7280 | AAUUUUUC A AAAUACUA | 5576 | UAGUAUUU CUGAUGAGGCCGUUAGGCCGAA IAAAAAUU | 14916 |
| 7287 | CAAAAUAC U AAUUCAAC | 5577 | GUUGAAUU CUGAUGAGGCCGUUAGGCCGAA IUAUUUUG | 14917 |
| 7293 | ACUAAUUC A ACAAAGAA | 5578 | UUCUUUGU CUGAUGAGGCCGUUAGGCCGAA IAAUUAGU | 14918 |
| 7296 | AAUUCAAC A AGAAAAA | 5579 | UUUUUCUU CUGAUGAGGCCGUUAGGCCGAA IUUGAAUU | 14919 |
| 7307 | GAAAAGC U CUUUUUUU | 5580 | AAAAAAG CUGAUGAGGCCGUUAGGCCGAA ICUUUUUC | 14920 |
| 7309 | AAAGCUC U UUUUUUC | 5581 | GAAAAAAA CUGAUGAGGCCGUUAGGCCGAA IAGCUUUU | 14921 |
| 7318 | UUUUUUUC C UAAAAUAA | 5582 | UUAUUUUA CUGAUGAGGCCGUUAGGCCGAA IAAAAAAA | 14922 |
| 7319 | UUUUUUCC U AAAUAAA | 5583 | UUUAUUUU CUGAUGAGGCCGUUAGGCCGAA IGAAAGAA | 14923 |
| 7329 | AAUAAAC U CAAAUUUA | 5584 | UAAAUUUG CUGAUGAGGCCGUUAGGCCGAA IUUUAUUU | 14924 |
| 7331 | AUAAACUC A AAUUUAUC | 5585 | GAUAAAUU CUGAUGAGGCCGUUAGGCCGAA IAGUUUAU | 14925 |

TABLE XIV-continued

NCH Ribozyme and Target Sequences

| Pos | Target | Seq ID No | NCH Ribozyme | Seq ID No |
|---|---|---|---|---|
| 7340 | AAUUUAUC C UUGUUUAG | 5586 | CUAAACAA CUGAUGAGgccguuaggCCGAA IAUAAAUU | 14926 |
| 7341 | AUUUAUCC U UGUUUAGA | 5587 | UCUAAACA CUGAUGAGgccguuaggCCGAA IGAUAAAU | 14927 |
| 7352 | UUUAGAGC A GAGAAAAA | 5588 | UUUUUCUC CUGAUGAGgccguuaggCCGAA ICUCUAAA | 14928 |
| 7372 | AGAAAAAC U UUGAAAUG | 5589 | CAUUUCAA CUGAUGAGgccguuaggCCGAA IUUUUUCU | 14929 |
| 7384 | AAAUGGUC U CAAAAAAU | 5590 | AUUUUUUG CUGAUGAGgccguuaggCCGAA IACCAUUU | 14930 |
| 7386 | AUGGUCUC A AAAAUUG | 5591 | CAAUUUUU CUGAUGAGgccguuaggCCGAA IAGACCAU | 14931 |
| 7396 | AAAAUUGC U AAAUAUUU | 5592 | AAAUAUUU CUGAUGAGgccguuaggCCGAA ICAAUUUU | 14932 |
| 7407 | AUAUUUUC A AUGGAAAA | 5593 | UUUUCCAU CUGAUGAGgccguuaggCCGAA IAAAAUAU | 14933 |
| 7417 | UGGAAAAC U AAAUGUUA | 5594 | UAACAUUU CUGAUGAGgccguuaggCCGAA IUUUUCCA | 14934 |
| 7433 | AGUUUAGC U GAUUGUAU | 5595 | AUACAAUC CUGAUGAGgccguuaggCCGAA ICUAAACU | 14935 |
| 7455 | UUUCGAAC C UUUCACUU | 5596 | AAGUGAAA CUGAUGAGgccguuaggCCGAA IUUCGAAA | 14936 |
| 7456 | UUCGAACC U UUCACUUU | 5597 | AAAGUGAA CUGAUGAGgccguuaggCCGAA IGUUCGAA | 14937 |
| 7460 | AACCUUUC A CUUUUUGU | 5598 | ACAAAAAG CUGAUGAGgccguuaggCCGAA IAAAGGUU | 14938 |
| 7462 | CCUUUCAC U UUUUGUUU | 5599 | AAACAAAA CUGAUGAGgccguuaggCCGAA IGAAAGG | 14939 |
| 7478 | UGUUUUAC C UAUUUCAC | 5600 | GUGAAAUA CUGAUGAGgccguuaggCCGAA IUAAAACA | 14940 |
| 7479 | GUUUUACC U AUUUCACA | 5601 | UGUGAAAU CUGAUGAGgccguuaggCCGAA IGUAAAAC | 14941 |
| 7485 | CCUAUUUC A CAACUGUG | 5602 | CACAGUUG CUGAUGAGgccguuaggCCGAA IAAAUAGG | 14942 |
| 7487 | UAUUUCAC A ACUGUGUA | 5603 | UACACAGU CUGAUGAGgccguuaggCCGAA IUGAAAUA | 14943 |
| 7490 | UUCACAAC U GUGUAAAU | 5604 | AUUUACAC CUGAUGAGgccguuaggCCGAA IUUGUGAA | 14944 |
| 7502 | UAAAUUGC C AAUAAUUC | 5605 | GAAUUAUU CUGAUGAGgccguuaggCCGAA ICAAUUUA | 14945 |
| 7503 | AAAUUGCC A AUAAUUCC | 5606 | GGAAUUAU CUGAUGAGgccguuaggCCGAA IGCAAUUU | 14946 |
| 7511 | AAUAAUUC C UGUCCAUG | 5607 | CAUGGACA CUGAUGAGgccguuaggCCGAA IAAUUAUU | 14947 |
| 7512 | AUAAUUCC U GUCCAUGA | 5608 | UCAUGGAC CUGAUGAGgccguuaggCCGAA IGAAUUAU | 14948 |
| 7516 | UUCCUGUC C AUGAAAAU | 5609 | AUUUUCAU CUGAUGAGgccguuaggCCGAA IACAGGAA | 14949 |
| 7517 | UCCUGUCC A UGAAAAUG | 5610 | CAUUUUCA CUGAUGAGgccguuaggCCGAA IGACAGGA | 14950 |
| 7527 | GAAAAUGC A AAUUAUCC | 5611 | GGAUAAUU CUGAUGAGgccguuaggCCGAA ICAUUUUC | 14951 |
| 7535 | AAAUUAUC C AGUGUAGA | 5612 | UCUACACU CUGAUGAGgccguuaggCCGAA IAUAAUUU | 14952 |
| 7536 | AAUUAUCC A GUGUAGAU | 5613 | AUCUACAC CUGAUGAGgccguuaggCCGAA IGAUAAUU | 14953 |
| 7554 | UAUUUGAC C AUCACCCU | 5614 | AGGGUGAU CUGAUGAGgccguuaggCCGAA IUCAAAUA | 14954 |
| 7555 | AUUUGACC A UCACCCUA | 5615 | UAGGGUGA CUGAUGAGgccguuaggCCGAA IGUCAAAU | 14955 |
| 7558 | UGACCAUC A CCCUAUGG | 5616 | CCAUAGGG CUGAUGAGgccguuaggCCGAA IAUGGUCA | 14956 |
| 7560 | ACCAUCAC C CUAUGGAU | 5617 | AUCCAUAG CUGAUGAGgccguuaggCCGAA IUGAUGGU | 14957 |
| 7561 | CCAUCACC C UAUGGAUA | 5618 | UAUCCAUA CUGAUGAGgccguuaggCCGAA IGUGAUGG | 14958 |
| 7562 | CAUCACCC U AUGGAUAU | 5619 | AUAUCCAU CUGAUGAGgccguuaggCCGAA IGGUGAUG | 14959 |
| 7575 | AUAUUGGC U AGUUUGC | 5620 | GCAAAACU CUGAUGAGgccguuaggCCGAA ICCAAUAU | 14960 |
| 7584 | AGUUUUGC C UUUAUUAA | 5621 | UUAAUAAA CUGAUGAGgccguuaggCCGAA ICAAACU | 14961 |
| 7585 | GUUUUGCC U UUAUUAAG | 5622 | CUUAAUAA CUGAUGAGgccguuaggCCGAA IGCAAACU | 14962 |

TABLE XIV-continued

NCH Ribozyme and Target Sequences

| Pos | Target | Seq ID No | NCH Ribozyme | Seq ID No |
|---|---|---|---|---|
| 7595 | UAUUAAGC A AAUUCAUU | 5623 | AAUGAAUU CUGAUGAGGCCGUUAGGCCGAA ICUUAUA | 14963 |
| 7601 | GCAAAUUC A UUUCAGCC | 5624 | GGCUGAAA CUGAUGAGGCCGUUAGGCCGAA IAAUUUGC | 14964 |
| 7606 | UUCAUUUC A GCCUGAAU | 5625 | AUUCAGGC CUGAUGAGGCCGUUAGGCCGAA IAAAUGAA | 14965 |
| 7609 | AUUUCAGC C UGAAUGUC | 5626 | GACAUUCA CUGAUGAGGCCGUUAGGCCGAA ICUGAAAU | 14966 |
| 7610 | UUUCAGCC U GAAUGUCU | 5627 | AGACAUUC CUGAUGAGGCCGUUAGGCCGAA IGCUGAAA | 14967 |
| 7618 | UGAAUGUC U GCCUAUAU | 5628 | AUAUAGGC CUGAUGAGGCCGUUAGGCCGAA IACAUUCA | 14968 |
| 7621 | AUGUCUGC C UAUAUAUU | 5629 | AAUAUAUA CUGAUGAGGCCGUUAGGCCGAA ICAGACAU | 14969 |
| 7622 | UGUCUGCC U AUAUAUUC | 5630 | GAAUAUAU CUGAUGAGGCCGUUAGGCCGAA IGCAGACA | 14970 |
| 7631 | AUAUAUUC U CUGCUCUU | 5631 | AAGAGCAG CUGAUGAGGCCGUUAGGCCGAA IAAUAUAU | 14971 |
| 7633 | AUAUUCUC U GCUCUUUG | 5632 | CAAAGAGC CUGAUGAGGCCGUUAGGCCGAA IAGAAUAU | 14972 |
| 7636 | UUCUCUGC U CUUUGUAU | 5633 | AUACAAAG CUGAUGAGGCCGUUAGGCCGAA ICAGAGAA | 14973 |
| 7638 | CUCUGCUC U UUGUAUUC | 5634 | GAAUACAA CUGAUGAGGCCGUUAGGCCGAA IAGCAGAG | 14974 |
| 7647 | UUGUAUUC U CCUUUGAA | 5635 | UUCAAAGG CUGAUGAGGCCGUUAGGCCGAA IAAUACAA | 14975 |
| 7649 | GUAUUCUC C UUUGAACC | 5636 | GGUUCAAA CUGAUGAGGCCGUUAGGCCGAA IAGAAUAC | 14976 |
| 7650 | UAUUCUCC U UUGAACCC | 5637 | GGGUUCAA CUGAUGAGGCCGUUAGGCCGAA IGAGAAUA | 14977 |
| 7657 | CUUUGAAC C CGUUAAAA | 5638 | UUUUAACG CUGAUGAGGCCGUUAGGCCGAA IUUCAAAG | 14978 |
| 7658 | UUUGAACC C GUUAAAAC | 5639 | GUUUUAAC CUGAUGAGGCCGUUAGGCCGAA IGUUCAAA | 14979 |
| 7667 | GUUAAAAC A UCCUGUGG | 5640 | CCACAGGA CUGAUGAGGCCGUUAGGCCGAA IUUUUAAC | 14980 |
| 7670 | AAAACAUC C UGUGGCAC | 5641 | GUGCCACA CUGAUGAGGCCGUUAGGCCGAA IAUGUUUU | 14981 |
| 7671 | AAACAUCC U GUGGCACU | 5642 | AGUGCCAC CUGAUGAGGCCGUUAGGCCGAA IGAUGUUU | 14982 |

Core Sequence = CUGAUGAG GCCGUUAGGC CGAA (SEQ ID NO. 20827).
Underlined region can be any X sequence or linker, as described herein.
"I" represents Inosine.

TABLE XV

G-Cleaver Ribozyme and Target Sequences

| Pos | Target | Seq ID No | Ribozyme Sequence | Seq ID No |
|---|---|---|---|---|
| 67 | GGGCUCGGGU G CAGCG | 5643 | CGCUG UGAUG GCAUGCACUAUGC GCG ACCCGAGCCC | 14983 |
| 91 | GCCUGGCGGC G AGGAU | 5644 | AUCCU UGAUG GCAUGCACUAUGC GCG GCCGCCAGGC | 14984 |
| 114 | GGAAGUGGUU G UCUCC | 5645 | GGAGA UGAUG GCAUGCACUAUGC GCG AACCACUUCC | 14985 |
| 131 | GGCUGGAGCC G CGAGA | 5646 | UCUCG UGAUG GCAUGCACUAUGC GCG GCUCCAGCC | 14986 |
| 133 | CUGGAGCCGC G AGACG | 5647 | CGUCU UGAUG GCAUGCACUAUGC GCG GCGGCUCCAG | 14987 |
| 142 | CGAGACGGGC G CUCAG | 5648 | CUGAG UGAUG GCAUGCACUAUGC GCG GCCCGUCUCG | 14988 |
| 151 | CGCUCAGGGC G CGGGG | 5649 | CCCCG UGAUG GCAUGCACUAUGC GCG GCCCUGAGCG | 14989 |
| 168 | CGGCGGCGGC G AACGA | 5650 | UCGUU UGAUG GCAUGCACUAUGC GCG GCCGCCGCCG | 14990 |
| 172 | GGCGGCGAAC G AGAGG | 5651 | CCUCU UGAUG GCAUGCACUAUGC GCG GUUCGCCGCC | 14991 |
| 214 | CCGGGGGAGC G CGGGC | 5652 | GCCCG UGAUG GCAUGCACUAUGC GCG GCUCCCCCGG | 14992 |
| 227 | GGCACCGGGC G AGCAG | 5653 | CUGCU UGAUG GCAUGCACUAUGC GCG GCCCGGUGCC | 14993 |

TABLE XV-continued

G-Cleaver Ribozyme and Target Sequences

| Pos | Target | Seq ID No | Ribozyme Sequence | Seq ID No |
|-----|--------|-----------|-------------------|-----------|
| 236 | CGAGCAGGCC G CGUCG | 5654 | CGACG UGAUG GCAUGCACUAUGC GCG GGCCUGCUCG | 14994 |
| 241 | AGGCCGCGUC G CGCUC | 5655 | GAGCG UGAUG GCAUGCACUAUGC GCG GACGCGGCCU | 14995 |
| 243 | GCCGCGUCGC G CUCAC | 5656 | GUGAG UGAUG GCAUGCACUAUGC GCG GCGACGCGGC | 14996 |
| 279 | CCGGGGUCCU G CUGUG | 5657 | CACAG UGAUG GCAUGCACUAUGC GCG AGGACCCCGG | 14997 |
| 282 | GGGUCCUGCU G UGCGC | 5658 | GCGCA UGAUG GCAUGCACUAUGC GCG AGCAGGACCC | 14998 |
| 284 | GUCCUGCUGU G CGCGC | 5659 | GCGCG UGAUG GCAUGCACUAUGC GCG ACAGCAGGAC | 14999 |
| 286 | CCUGCUGUGC G CGCUG | 5660 | CAGCG UGAUG GCAUGCACUAUGC GCG GCACAGCAGG | 15000 |
| 288 | UGCUGUGCGC G CUGCU | 5661 | AGCAG UGAUG GCAUGCACUAUGC GCG GCGCACAGCA | 15001 |
| 291 | UGUGCGCGCU G CUCAG | 5662 | CUGAG UGAUG GCAUGCACUAUGC GCG AGCGCGCACA | 15002 |
| 299 | CUGCUCAGCU G UCUGC | 5663 | GCAGA UGAUG GCAUGCACUAUGC GCG AGCUGAGCAG | 15003 |
| 303 | UCAGCUGUCU G CUUCU | 5664 | AGAAG UGAUG GCAUGCACUAUGC GCG AGACAGCUGA | 15004 |
| 346 | AAAAGAUCCU G AACUG | 5665 | CAGUU UGAUG GCAUGCACUAUGC GCG AGGAUCUUUU | 15005 |
| 351 | AUCCUGAACU G AGUUU | 5666 | AAACU UGAUG GCAUGCACUAUGC GCG AGUUCAGGAU | 15006 |
| 378 | AGCACAUCAU G CAAGC | 5667 | GCUUG UGAUG GCAUGCACUAUGC GCG AUGAUGUGCU | 15007 |
| 396 | GCCAGACACU G CAUCU | 5668 | AGAUG UGAUG GCAUGCACUAUGC GCG AGUGUCUGGC | 15008 |
| 407 | CAUCUCCAAU G CAGGG | 5669 | CCCUG UGAUG GCAUGCACUAUGC GCG AUUGGAGAUG | 15009 |
| 438 | AAUGGUCUUU G CCUGA | 5670 | UCAGG UGAUG GCAUGCACUAUGC GCG AAAGACCAUU | 15010 |
| 442 | GUCUUUGCCU G AAAUG | 5671 | CAUUU UGAUG GCAUGCACUAUGC GCG AGGCAAAGAC | 15011 |
| 450 | CUGAAAUGGU G AGUAA | 5672 | UUACU UGAUG GCAUGCACUAUGC GCG ACCAUUUCAG | 15012 |
| 463 | UAAGGAAAGC G AAAGG | 5673 | CCUUU UGAUG GCAUGCACUAUGC GCG GCUUUCCUUA | 15013 |
| 471 | GCGAAAGGCU G AGCAU | 5674 | AUGCU UGAUG GCAUGCACUAUGC GCG AGCCUUUCGC | 15014 |
| 487 | AACUAAAUCU G CCUGU | 5675 | ACAGG UGAUG GCAUGCACUAUGC GCG AGAUUUAGUU | 15015 |
| 491 | AAAUCUGCCU G UGGAA | 5676 | UUCCA UGAUG GCAUGCACUAUGC GCG AGGCAGAUUU | 15016 |
| 515 | AAACAAUUCU G CAGUA | 5677 | UACUG UGAUG GCAUGCACUAUGC GCG AGAAUUGUUU | 15017 |
| 531 | CUUUAACCUU G AACAC | 5678 | GUGUU UGAUG GCAUGCACUAUGC GCG AAGGUUAAAG | 15018 |
| 569 | UUCUACAGCU G CAAAU | 5679 | AUUUG UGAUG GCAUGCACUAUGC GCG AGCUGUAGAA | 15019 |
| 583 | AUAUCUAGCU G UACCU | 5680 | AGGUA UGAUG GCAUGCACUAUGC GCG AGCUAGAUAU | 15020 |
| 616 | AACAGAAUCU G CAAUC | 5681 | GAUUG UGAUG GCAUGCACUAUGC GCG AGAUUCUGUU | 15021 |
| 637 | AUUUAUUAGU G AUACA | 5682 | UGUAU UGAUG GCAUGCACUAUGC GCG ACUAAUAAAU | 15022 |
| 663 | UCGUAGAGAU G UACAG | 5683 | CUGUA UGAUG GCAUGCACUAUGC GCG AUCUCUACGA | 15023 |
| 670 | GAUGUACAGU G AAAUC | 5684 | GAUUU UGAUG GCAUGCACUAUGC GCG ACUGUACAUC | 15024 |
| 679 | UGAAAUCCCC G AAAUU | 5685 | AAUUU UGAUG GCAUGCACUAUGC GCG GGGGAUUUCA | 15025 |
| 693 | UUAUACACAU G ACUGA | 5686 | UCAGU UGAUG GCAUGCACUAUGC GCG AUGUGUAUAA | 15026 |
| 697 | ACACAUGACU G AAGGA | 5687 | UCCUU UGAUG GCAUGCACUAUGC GCG AGUCAUGUGU | 15027 |
| 722 | GUCAUUCCCU G CCGGG | 5688 | CCCGG UGAUG GCAUGCACUAUGC GCG AGGGAAUGAC | 15028 |
| 748 | UAACAUCACU G UUACU | 5689 | AGUAA UGAUG GCAUGCACUAUGC GCG AGUGAUGUUA | 15029 |
| 772 | GUUCCACUU G ACACU | 5690 | AGUGU UGAUG GCAUGCACUAUGC GCG AAGUGGAAAC | 15030 |

TABLE XV-continued

G-Cleaver Ribozyme and Target Sequences

| Pos | Target | Seq ID No | Ribozyme Sequence | Seq ID No |
|---|---|---|---|---|
| 780 | UUGACACUUU G AUCCC | 5691 | GCGAU UGAUG GCAUGCACUAUGC GCG AAAGUGUCAA | 15031 |
| 787 | UUUGAUCCCU G AUGGA | 5692 | UCCAU UGAUG GCAUGCACUAUGC GCG AGGGAUCAAA | 15032 |
| 797 | GAUGGAAAAC G CAUAA | 5693 | UUAUC UGAUG GCAUGCACUAUGC GCG GUUUUCCAUC | 15033 |
| 838 | CAUAUCAAAU G CAACG | 5694 | CGUUG UGAUG GCAUGCACUAUGC GCG AUUUGAUAUG | 15034 |
| 864 | UAGGGCUUCU G ACCUG | 5695 | CAGGU UGAUG GCAUGCACUAUGC GCG AGAAGCCCUA | 15035 |
| 869 | CUUCUGACCU G UGAAG | 5696 | CUUCA UGAUG GCAUGCACUAUGC GCG AGGUCAGAAG | 15036 |
| 871 | UCUGACCUGU G AAGCA | 5697 | UGCUU UGAUG GCAUGCACUAUGC GCG ACAGGUCAGA | 15037 |
| 894 | AUGGGCAUUU G UAUAA | 5698 | UUAUA UGAUG GCAUGCACUAUGC GCG AAAUGCCCAU | 15038 |
| 920 | CUCACACAUC G ACAAA | 5699 | UUUGU UGAUG GCAUGCACUAUCC GCG GAUGUGUGAG | 15039 |
| 943 | AAUCAUAGAU G UCCAA | 5700 | UUGGA UGAUG GCAUGCACUAUGC GCG AUCUAUGAUU | 15040 |
| 962 | AGCACACCAC G CCCAG | 5701 | CUGGG UGAUG GCAUGCACUAUGC GCG GUGGUGUGCU | 15041 |
| 994 | CCAUACUCUU G UCCUC | 5702 | GAGGA UGAUG GCAUGCACUAUGC GCG AAGAGUAUGG | 15042 |
| 1004 | GUCCUCAAUU G UACUG | 5703 | CAGUA UGAUG GCAUGCACUAUGC GCG AAUUGAGGAC | 15043 |
| 1009 | CAAUUGUACU G CUACC | 5704 | GGUAG UGAUG GCAUGCACUAUGC GCG AGUACAAUUG | 15044 |
| 1023 | CCACUCCCUU G AACAC | 5705 | GUGUU UGAUG GCAUGCACUAUGC GCG AAGGGAGUGG | 15045 |
| 1029 | CCUUGAACAC G AGAGU | 5706 | ACUCU UGAUG GCAUGCACUAUGC GCG GUGUUCAAGG | 15046 |
| 1041 | GAGUUCAAAU G ACCUG | 5707 | CAGGU UGAUG GCAUGCACUAUGC GCG AUUUGAACUC | 15047 |
| 1057 | GAGUUACCCU G AUGAA | 5708 | UUCAU UGAUG GCAUGCACUAUGC GCG AGGGUAACUC | 15048 |
| 1060 | UUACCCUGAU G AAAAA | 5709 | UUUUU UGAUG GCAUGCACUAUGC GCG AUCAGGGUAA | 15049 |
| 1088 | UCCGUAAGGC G ACGAA | 5710 | UUCGU UGAUG GCAUGCACUAUGC GCG GCCUUACGGA | 15050 |
| 1091 | GUAAGGCGAC G AAUUG | 5711 | CAAUU UGAUG GCAUGCACUAUGC GCG GUCGCCUUAC | 15051 |
| 1096 | GCGACGAAUU G ACCAA | 5712 | UUGGU UGAUG GCAUGCACUAUGC GCG AAUUCGUCGC | 15052 |
| 1114 | CAAUUCCCAU G CCAAC | 5713 | GUUGG UGAUG GCAUGCACUAUGC GCG AUGGGAAUUG | 15053 |
| 1132 | AUUCUACAGU G UUCUU | 5714 | AAGAA UGAUG GCAUGCACUAUGC GCG ACUGUAGAAU | 15054 |
| 1144 | UCUUACUAUU G ACAAA | 5715 | UUUGU UGAUG GCAUGCACUAUGC GCG AAUAGUAAGA | 15055 |
| 1152 | UUGACAAAAU G CAGAA | 5716 | UUCUG UGAUG GCAUGCACUAUGC GCG AUUUUGUCAA | 15056 |
| 1181 | CUUUAUACUU G UCGUG | 5717 | CACGA UGAUG GCAUGCACUAUGC GCG AAGUAUAAAG | 15057 |
| 1186 | UACUUGUCGU G UAAGG | 5718 | CCUUA UGAUG GCAUGCACUAUGC GCG ACGACAAGUA | 15058 |
| 1213 | AUUCAAAUCU G UUAAC | 5719 | GUUAA UGAUG GCAUGCACUAUGC GCG AGAUUUGAAU | 15059 |
| 1227 | ACACCUCAGU G CAUAU | 5720 | AUAUG UGAUG GCAUGCACUAUGC GCG ACUGAGGUGU | 15060 |
| 1237 | GCAUAUAUAU G AUAAA | 5721 | UUUAU UGAUG GCAUGCACUAUGC GCG AUAUAUAUGC | 15061 |
| 1255 | AUUCAUCACU G UGAAA | 5722 | UUUCA UGAUG GCAUGCACUAUGC GCG AGUGAUGAAU | 15062 |
| 1257 | UCAUCACUGU G AAACA | 5723 | UGUUU UGAUG GCAUGCACUAUGC GCG ACAGUGAUGA | 15063 |
| 1265 | GUGAAACAUC G AAAAC | 5724 | GUUUU UGAUG GCAUGCACUAUGC GCG GAUGUUUCAC | 15064 |
| 1278 | AACAGCAGGU G CUUGA | 5725 | UCAAG UGAUG GCAUGCACUAUGC GCG ACCUGCUGUU | 15065 |
| 1282 | GCAGGUGCUU G AAACC | 5726 | GGUUU UGAUG GCAUGCACUAUGC GCG AAGCACCUGC | 15066 |
| 1320 | GGCUCUCUAU G AAAGU | 5727 | ACUUU UGAUG GCAUGCACUAUGC GCG AUAGAGAGCC | 15067 |

TABLE XV-continued

G-Cleaver Ribozyme and Target Sequences

| Pos | Target | Seq ID No | Ribozyme Sequence | Seq ID No |
|---|---|---|---|---|
| 1326 | CUAUGAAAGU G AAGGC | 5728 | GCCUU UGAUG GCAUGCACUAUGC GCG ACUUUCAUAG | 15068 |
| 1341 | CAUUUCCCUC G CCGGA | 5729 | UCCGG UGAUG GCAUGCACUAUGC GCG GAGGGAAAUG | 15069 |
| 1351 | GCCGGAAGUU G UAUGG | 5730 | CCAUA UGAUG GCAUGCACUAUGC GCG AACUUCCGGC | 15070 |
| 1375 | UGGGUUACCU G CGACU | 5731 | AGUCG UGAUG GCAUGCACUAUGC GCG AGGUAACCCA | 15071 |
| 1377 | GGUUACCUGC G ACUGA | 5732 | UCAGU UGAUG GCAUGCACUAUGC GCG GCAGGUAACC | 15072 |
| 1381 | ACCUGCGACU G AGAAA | 5733 | UUUCU UGAUG GCAUGCACUAUGC GCG AGUCGCAGGU | 15073 |
| 1390 | UGAGAAAUCU G CUCGC | 5734 | GCGAG UGAUG GCAUGCACUAUGC GCG AGAUUUCUCA | 15074 |
| 1394 | AAAUCUGCUC G CUAUU | 5735 | AAUAG UGAUG GCAUGCACUAUGC GCG GAGCAGAUUU | 15075 |
| 1401 | CUCGCUAUUU G ACUCG | 5736 | CGAGU UGAUG GCAUGCACUAUGC GCG AAAUAGCGAG | 15076 |
| 1438 | GGACGUAACU G AAGAG | 5737 | CUCUU UGAUG GCAUGCACUAUGC GCG AGUUACGUCC | 15077 |
| 1447 | UGAAGAGGAU G CAGGG | 5738 | CCCUG UGAUG GCAUGCACUAUGC GCG AUCCUCUUCA | 15078 |
| 1467 | AUACAAUCUU G CUGAG | 5739 | CUCAG UGAUG GCAUGCACUAUGC GCG AAGAUUGUAU | 15079 |
| 1470 | CAAUCUUGCU G AGCAU | 5740 | AUGCU UGAUG GCAUGCACUAUGC GCG AGCAAGAUUG | 15080 |
| 1489 | ACAGUCAAAU G UGUUU | 5741 | AAACA UGAUG GCAUGCACUAUGC GCG AUUUGACUGU | 15081 |
| 1491 | AGUCAAAUGU G UUUAA | 5742 | UUAAA UGAUG GCAUGCACUAUGC GCG ACAUUUGACU | 15082 |
| 1507 | AAACCUCACU G CCACU | 5743 | AGUGG UGAUG GCAUGCACUAUGC GCG AGUGAGGUUG | 15083 |
| 1519 | CACUCUAAUU G UCAAU | 5744 | AUUGA UGAUG GCAUGCACUAUGC GCG AAUUAGAGUG | 15084 |
| 1525 | AAUUGUCAAU G UGAAA | 5745 | UGUCA UGAUG GCAUGCACUAUGC GCG AUUGACAAUU | 15085 |
| 1527 | UUGUCAAUGU G AAACC | 5746 | GGUUU UGAUG GCAUGCACUAUGC GCG ACAUUGACAA | 15086 |
| 1543 | CCAGAUUUAC G AAAAG | 5747 | CUUUU UGAUG GCAUGCACUAUGC GCG GUAAAUCUGG | 15087 |
| 1554 | AAAAGGCCGU G UCAUC | 5748 | GAUGA UGAUG GCAUGCACUAUGC GCG ACGGCCUUUU | 15088 |
| 1605 | GACAAAUCCU G ACUUG | 5749 | CAAGU UGAUG GCAUGCACUAUGC GCG AGGAUUUGUC | 15089 |
| 1610 | AUCCUGACUU G UACCG | 5750 | CGGUA UGAUG GCAUGCACUAUGC GCG AAGUCAGGAU | 15090 |
| 1615 | GACUUGUACC G CAUAU | 5751 | AUAUG UGAUG GCAUGCACUAUGC GCG GGUACAAGUC | 15091 |
| 1661 | UGGCACCCCU G UAACC | 5752 | GGUUA UGAUG GCAUGCACUAUGC GCG AGGGGUGCCA | 15092 |
| 1678 | UAAUCAUUCC G AAGCA | 5753 | UGCUU UGAUG GCAUGCACUAUGC GCG GGAAUGAUUA | 15093 |
| 1688 | GAAGCAAGGU G UGACU | 5754 | AGUCA UGAUG GCAUGCACUAUGC GCG ACCUUGCUUC | 15094 |
| 1690 | AGCAAGGUGU G ACUUU | 5755 | AAAGU UGAUG GCAUGCACUAUGC GCG ACACCUUGCU | 15095 |
| 1697 | UGUGACUUUU G UUCCA | 5756 | UGGAA UGAUG GCAUGCACUAUGC GCG AAAAGUCACA | 15096 |
| 1708 | UUCCAAUAAU G AAGAG | 5757 | CUCUU UGAUG GCAUGCACUAUGC GCG AUUAUUGGAA | 15097 |
| 1729 | UAUCCUGGAU G CUGAC | 5758 | GUCAG UGAUG GCAUGCACUAUGC GCG AUCCAGGAUA | 15098 |
| 1732 | CCUGGAUGCU G ACAGC | 5759 | GCUGU UGAUG GCAUGCACUAUGC GCG AGCAUCCAGG | 15099 |
| 1756 | AAACAGAAUU G AGAGC | 5760 | GCUCU UGAUG GCAUGCACUAUGC GCG AAUUCUGUUU | 15100 |
| 1772 | AUCACUCAGC G CAUGG | 5761 | CCAUG UGAUG GCAUGCACUAUGC GCG GCUGAGUGAU | 15101 |
| 1819 | CACCUGGGUU G UGGCU | 5762 | AGCCA UGAUG GCAUGCACUAUGC GCG AACCAAGGUG | 15102 |
| 1825 | GGUUGUGGCU G ACUCU | 5763 | AGAGU UGAUG GCAUGCACUAUGC GCG AGCCACAACC | 15103 |
| 1853 | AUCUACAUUU G CAUAG | 5764 | CUAUG UGAUG GCAUGCACUAUGC GCG AAAUGUAGAU | 15104 |

TABLE XV-continued

G-Cleaver Ribozyme and Target Sequences

| Pos | Target | Seq ID No | Ribozyme Sequence | Seq ID No |
|---|---|---|---|---|
| 1879 | AGUUGGGACU G UGGGA | 5765 | UCCCA UGAUG GCAUGCACUAUGC GCG AGUCCCAACU | 15105 |
| 1912 | UAUCACAGAU G UGCCA | 5766 | UGGCA UGAUG GCAUGCACUAUGC GCG AUCUGUGAUA | 15106 |
| 1914 | UCACAGAUGU G CCAAA | 5767 | UUUGG UGAUG GCAUGCACUAUGC GCG ACAUCUGUGA | 15107 |
| 1930 | UGGGUUUCAU G UUAAC | 5768 | GUUAA UGAUG GCAUGCACUAUGC GCG AUGAAACCCA | 15108 |
| 1947 | UGGAAAAAAU G CCGAC | 5769 | GUCGG UGAUG GCAUGCACUAUGC GCG AUUUUUUCCA | 15109 |
| 1950 | AAAAAAUGCC G ACGGA | 5770 | UCCGU UGAUG GCAUGCACUAUGC GCG GGCAUUUUUU | 15110 |
| 1968 | GAGAGGACCU G AAACU | 5771 | AGUUU UGAUG GCAUGCACUAUGC GCG AGGUCCUCUC | 15111 |
| 1974 | ACCUGAAACU G UCUUG | 5772 | CAAGA UGAUG GCAUGCACUAUGC GCG AGUUUCAGGU | 15112 |
| 1979 | AAACUGUCUU G CACAG | 5773 | CUGUG UGAUG GCAUGCACUAUGC GCG AAGACAGUUU | 15113 |
| 2025 | GGAUUUUACU G CGGAC | 5774 | GUCCG UGAUG GCAUGCACUAUGC GCG AGUAAAAUCC | 15114 |
| 2049 | ACAGAACAAU G CACUA | 5775 | UAGUG UGAUG GCAUGCACUAUGC GCG AUUGUUCUGU | 15115 |
| 2121 | UUACCAUCAU G AAUGU | 5776 | ACAUU UGAUG GCAUGCACUAUGC GCG AUGAUGGUAA | 15116 |
| 2125 | CAUCAUGAAU G UUUCC | 5777 | GGAAA UGAUG GCAUGCACUAUGC GCG AUUCAUGAUG | 15117 |
| 2133 | AUGUUUCCCU G CAAGA | 5778 | UCUUG UGAUG GCAUGCACUAUGC GCG AGGGAAACAU | 15118 |
| 2152 | AGGCACCUAU G CCUGC | 5779 | GCAGG UGAUG GCAUGCACUAUGC GCG AUAGGUGCCU | 15119 |
| 2156 | ACCUAUGCCU G CAGAG | 5780 | CUCUG UGAUG GCAUGCACUAUGC GCG AGGGAUAGGU | 15120 |
| 2170 | AGCCAGGAAU G UAUAC | 5781 | GUAUA UGAUG GCAUGCACUAUGC GCG AUUCCUGGCU | 15121 |
| 2241 | CAUACCUCCU G CGAAA | 5782 | UUUCG UGAUG GCAUGCACUAUGC GCG AGGAGGUAUG | 15122 |
| 2243 | UACCUCCUGC G AAACC | 5783 | GGUUU UGAUG GCAUGCACUAUGC GCG GCAGGAGGUA | 15123 |
| 2254 | AAACCUCAGU G AUCAC | 5784 | GUGAU UGAUG GCAUGCACUAUGC GCG ACUGAGGUUU | 15124 |
| 2294 | ACUUAGACU G UCAUG | 5785 | CAUGA UGAUG GCAUGCACUAUGC GCG AGUCUAAAGU | 15125 |
| 2299 | AGACUGUCAU G CUAAU | 5786 | AUUAG UGAUG GCAUGCACUAUGC GCG AUGACAGUCU | 15126 |
| 2308 | UGCUAAUGGU G UCCCC | 5787 | GGGGA UGAUG GCAUGCACUAUGC GCG ACCAUUAGCA | 15127 |
| 2314 | UGGUGUCCCC G AGCCU | 5788 | AGGCU UGAUG GCAUGCACUAUGC GCG GGGGACACCA | 15128 |
| 2394 | GAAGCAGCAC G CUGUU | 5789 | AACAG UGAUG GCAUGCACUAUGC GCG GUGCUGCUUC | 15129 |
| 2397 | GCAGCACGCU G UUUAU | 5790 | AUAAA UGAUG GCAUGCACUAUGC GCG AGCGUGCUGC | 15130 |
| 2404 | GCUGUUUAUU G AAAGA | 5791 | UCUUU UGAUG GCAUGCACUAUGC GCG AAUAAACAGC | 15131 |
| 2425 | AGAAGAGGAU G AAGGU | 5792 | ACCUU UGAUG GCAUGCACUAUGC GCG AUCCUCUUCU | 15132 |
| 2431 | GGAUGAAGGU G UCUAU | 5793 | AUAGA UGAUG GCAUGCACUAUGC GCG ACCUUCAUCC | 15133 |
| 2441 | GUCUAUCACU G CAAAG | 5794 | CUUUG UGAUG GCAUGCACUAUGC GCG AGUGAUAGAC | 15134 |
| 2467 | GAAGGGCUCU G UGGAA | 5795 | UUCCA UGAUG GCAUGCACUAUGC GCG AGAGCCCUUC | 15135 |
| 2491 | AUACCUCACU G UUCAA | 5796 | UUGAA UGAUG GCAUGCACUAUGC GCG AGUGAGGUAU | 15136 |
| 2526 | AUCUGGAGCU G AUCAC | 5797 | GUGAU UGAUG GCAUGCACUAUGC GCG AGCUCCAGAU | 15137 |
| 2540 | ACUCUAACAU G CACCU | 5798 | AGGUG UGAUG GCAUGCACUAUGC GCG AUGUUAGAGU | 15138 |
| 2546 | ACAUGCACCU G UGGG | 5799 | CCACA UGAUG GCAUGCACUAUGC GCG AGGUGCAUGU | 15139 |
| 2548 | AUGCACCUGU G GGCU | 5800 | AGCCA UGAUG GCAUGCACUAUGC GCG ACAGGUGCAU | 15140 |
| 2554 | CUGUGUGGCU G CGACU | 5801 | AGUCG UGAUG GCAUGCACUAUGC GCG AGCCACACAG | 15141 |

TABLE XV-continued

G-Cleaver Ribozyme and Target Sequences

| Pos | Target | Seq ID No | Ribozyme Sequence | Seq ID No |
|---|---|---|---|---|
| 2556 | GUGUGGCUGC G ACUCU | 5802 | AGAGU UGAUG GCAUGCACUAUGC GCG GCAGCCACAC | 15142 |
| 2591 | CUCCUUAUCC G AAAAA | 5803 | UUUUU UGAUG GCAUGCACUAUGC GCG GGAUAAGGAG | 15143 |
| 2598 | UCCGAAAAAU G AAAAG | 5804 | CUUUU UGAUG GCAUGCACUAUGC GCG AUUUUCGGA | 15144 |
| 2614 | GUCUUCUUCU G AAAUA | 5805 | UAUUU UGAUG GCAUGCACUAUGC GCG AGAAGAAGAC | 15145 |
| 2626 | AAUAAAGACU G ACUAC | 5806 | GUAGU UGAUG GCAUGCACUAUGC GCG AGUCUUUAUU | 15146 |
| 2656 | GGACCCAGAU G AAGUU | 5807 | AACUU UGAUG GCAUGCACUAUGC GCG AUCUGGGUCC | 15147 |
| 2671 | UCCUUUGGAU G AGCAG | 5808 | CUGCU UGAUG GCAUGCACUAUGC GCG AUCCAAAGGA | 15148 |
| 2678 | GAUGAGCAGU G UGAGC | 5809 | GCUCA UGAUG GCAUGCACUAUGC GCG ACUGCUCAUC | 15149 |
| 2680 | UGAGCAGUGU G AGCGG | 5810 | CCGCU UGAUG GCAUGCACUAUGC GCG ACACUGCUCA | 15150 |
| 2695 | GCUCCCUUAU G AUGCC | 5811 | GGCAU UGAUG GCAUGCACUAUGC GCG AUAAGGGAGC | 15151 |
| 2698 | CCCUUAUGAU G CCAGC | 5812 | GCUGG UGAUG GCAUGCACUAUGC GCG AUCAUAAGGG | 15152 |
| 2716 | GUGGGAGUUU G CCCGG | 5813 | CCGGG UGAUG GCAUGCACUAUGC GCG AAACUCCCAC | 15153 |
| 2813 | UCACCUACGU G CCGGA | 5814 | UCCGG UGAUG GCAUGCACUAUGC GCG ACGUAGGUGA | 15154 |
| 2821 | GUGCCGGACU G UGGCU | 5815 | AGCCA UGAUG GCAUGCACUAUGC GCG AGUCCGGCAC | 15155 |
| 2827 | GACUGUGGCU G UGAAA | 5816 | UUUCA UGAUG GCAUGCACUAUGC GCG AGCCACAGUC | 15156 |
| 2829 | CUGUGGCUGU G AAAAU | 5817 | AUUUU UGAUG GCAUGCACUAUGC GCG ACAGCCACAG | 15157 |
| 2835 | CUGUGAAAAU G CUGAA | 5818 | UUCAG UGAUG GCAUGCACUAUGC GCG AUUUUCACAG | 15158 |
| 2838 | UGAAAAUGCU G AAAGA | 5819 | UCUUU UGAUG GCAUGCACUAUGC GCG AGCAUUUUCA | 15159 |
| 2860 | CACGGCCAGC G AGUAC | 5820 | GUACU UGAUG GCAUGCACUAUGC GCG GCUGGCCGUG | 15160 |
| 2874 | ACAAAGCUCU G AUGAC | 5821 | GUCAU UGAUG GCAUGCACUAUGC GCG AGAGCUUUGU | 15161 |
| 2877 | AAGCUCUGAU G ACUGA | 5822 | UCAGU UGAUG GCAUGCACUAUGC GCG AUCAGAGCUU | 15162 |
| 2881 | UCUGAUGACU G AGCUA | 5823 | UAGCU UGAUG GCAUGCACUAUGC GCG AGUCAUCAGA | 15163 |
| 2895 | UAAAAAUCUU G ACCCA | 5824 | UGGGU UGAUG GCAUGCACUAUGC GCG AAGAUUUUUA | 15164 |
| 2916 | GCCACCAUCU G AACGU | 5825 | ACGUU UGAUG GCAUGCACUAUGC GCG AGAUGGUGGC | 15165 |
| 2931 | UGGUUAACCU G CUGGG | 5826 | CCCAG UGAUG GCAUGCACUAUGC GCG AGGUUAACCA | 15166 |
| 2942 | CUGGGAGCCU G CACCA | 5827 | UGGUG UGAUG GCAUGCACUAUGC GCG AGGCUCCCAG | 15167 |
| 2964 | GAGGGCCUCU G AUGGU | 5828 | ACCAU UGAUG GCAUGCACUAUGC GCG AGAGGCCCUC | 15168 |
| 2970 | CUCUGAUGGU G AUUGU | 5829 | ACAAU UGAUG GCAUGCACUAUGC GCG ACCAUCAGAG | 15169 |
| 2974 | GAUGGUGAUU G UUGAA | 5830 | UUCAA UGAUG GCAUGCACUAUGC GCG AAUCACCAUC | 15170 |
| 2977 | GGUGAUUGUU G AAUAC | 5831 | GUAUU UGAUG GCAUGCACUAUGC GCG AACAAUCACC | 15171 |
| 2984 | GUUGAAUACU G CAAAU | 5832 | AUUUG UGAUG GCAUGCACUAUGC GCG AGUAUUCAAC | 15172 |
| 3025 | GAGCAAACGU G ACUUA | 5833 | UAAGU UGAUG GCAUGCACUAUGC GCG ACGUUUGCUC | 15173 |
| 3049 | CAACAAGGAU G CAGCA | 5834 | UGCUG UGAUG GCAUGCACUAUGC GCG AUCCUUGUUG | 15174 |
| 3139 | CACCAGCAGC G AAAGC | 5835 | GCUUU UGAUG GCAUGCACUAUGC GCG GCUGCUGGUG | 15175 |
| 3148 | CGAAAGCUUU G CGAGC | 5838 | GCUCG UGAUG GCAUGCACUAUGC GCG AAAGCUUUCG | 15176 |
| 3150 | AAAGCUUUGC G AGCUC | 5837 | GAGCU UGAUG GCAUGCACUAUGC GCG GCAAAGCUUU | 15177 |
| 3180 | AUAAAAGUCU G AGUGA | 5838 | UCACU UGAUG GCAUGCACUAUGC GCG AGACUUUUAU | 15178 |

TABLE XV-continued

G-Cleaver Ribozyme and Target Sequences

| Pos | Target | Seq ID No | Ribozyme Sequence | Seq ID No |
|---|---|---|---|---|
| 3184 | AAGUCUGAGU G AUGUU | 5839 | AACAU UGAUG GCAUGCACUAUGC GCG ACUCAGACUU | 15179 |
| 3187 | UCUGAGUGAU G UUGAG | 5840 | CUCAA UGAUG GCAUGCACUAUGC GCG AUCACUCAGA | 15180 |
| 3190 | GAGUGAUGUU G AGGAA | 5841 | UUCCU UGAUG GCAUGCACUAUGC GCG AACAUCACUC | 15181 |
| 3208 | GGAGGAUUCU G ACGGU | 5842 | ACCGU UGAUG GCAUGCACUAUGC GCG AGAAUCCUCC | 15182 |
| 3246 | UGGAAGAUCU G AUUUC | 5843 | GAAAU UGAUG GCAUGCACUAUGC GCG AGAUCUUCCA | 15183 |
| 3288 | UGGAGUUCCU G UCUUC | 5844 | GAAGA UGAUG GCAUGCACUAUGC GCG AGGAACUCCA | 15184 |
| 3302 | UCCAGAAAGU G CAUUC | 5845 | GAAUG UGAUG GCAUGCACUAUGC GCG ACUUUCUGGA | 15185 |
| 3324 | ACCUGGCAGC G AGAAA | 5846 | UUUCU UGAUG GCAUGCACUAUGC GCG GCUGCCAGGU | 15186 |
| 3343 | UCUUUUAUCU G AGAAC | 5847 | GUUCU UGAUG GCAUGCACUAUGC GCG AGAUAAAAGA | 15187 |
| 3357 | ACAACGUGGU G AAGAU | 5848 | AUCUU UGAUG GCAUGCACUAUGC GCG ACCACGUUGU | 15188 |
| 3365 | GUGAGAUUU G UGAUU | 5849 | AAUCA UGAUG GCAUGCACUAUGC GCG AAAUCUUCAC | 15189 |
| 3367 | GAAGAUUUGU G AUUUU | 5850 | AAAAU UGAUG GCAUGCACUAUGC GCG ACAAAUCUUC | 15190 |
| 3379 | UUUUGGCCUU G CCCGG | 5851 | CCGGG UGAUG GCAUGCACUAUGC GCG AAGGCCAAAA | 15191 |
| 3403 | UAAGAACCCC G AUUAU | 5852 | AUAAU UGAUG GCAUGCACUAUGC GCG GGGUUCUUA | 15192 |
| 3409 | CCCCGAUUAU G UGAGA | 5853 | UCUCA UGAUG GCAUGCACUAUGC GCG AUAAUCGGGG | 15193 |
| 3411 | CCGAUUAUGU G AGAAA | 5854 | UUUCU UGAUG GCAUGCACUAUGC GCG ACAUAAUCGG | 15194 |
| 3428 | GGAGAUACUC G ACUUC | 5855 | GAAGU UGAUG GCAUGCACUAUGC GCG GAGUAUCUCC | 15195 |
| 3438 | GACUUCCUCU G AAAUG | 5856 | CAUUU UGAUG GCAUGCACUAUGC GCG AGAGGAAGUC | 15196 |
| 3454 | GAUGGCUCCC G AAUCU | 5857 | AGAUU UGAUG GCAUGCACUAUGC GCG GGGAGCCAUC | 15197 |
| 3466 | AUCUAUCUUU G ACAAA | 5858 | UUUGU UGAUG GCAUGCACUAUGC GCG AAAGAUAGAU | 15198 |
| 3490 | CACCAAGAGC G ACGUG | 5859 | CACGU UGAUG GCAUGCACUAUGC GCG GCUCUUGGUG | 15199 |
| 3495 | AGAGCGACGU G UGGUC | 5860 | GACCA UGAUG GCAUGCACUAUGC GCG ACGUGCCUCU | 15200 |
| 3513 | ACGGAGUAUU G CUGUG | 5861 | CACAG UGAUG GCAUGCACUAUGC GCG AAUACUCCGU | 15201 |
| 3516 | GAGUAUUGCU G UGGGA | 5862 | UCCCA UGAUG GCAUGCACUAUGC GCG AGCAAUACUC | 15202 |
| 3568 | ACAAAUGGAU G AGGAC | 5863 | GUCCU UGAUG GCAUGCACUAUGC GCG AUCCAUUUGU | 15203 |
| 3578 | GAGGACUUUU G CAGUC | 5864 | GACUG UGAUG GCAUGCACUAUGC GCG AAAAGUCCUC | 15204 |
| 3584 | UUUUGCAGUC G CCUGA | 5865 | UCAGG UGAUG GCAUGCACUAUGC GCG GACUGCAAAA | 15205 |
| 3588 | GCAGUCGCCU G AGGGA | 5866 | UCCCU UGAUG GCAUGCACUAUGC GCG AGGCGACUGC | 15206 |
| 3600 | GGGAAGGCAU G AGGAU | 5867 | AUCCU UGAUG GCAUGCACUAUGC GCG AUGCCUUCCC | 15207 |
| 3606 | GCAUCAGGAU G AGAGC | 5868 | GCUCU UGAUG GCAUGCACUAUGC GCG AUCCUGAUGC | 15208 |
| 3616 | GAGAGCUCCU G AGUAC | 5869 | CUACU UGAUG GCAUGCACUAUGC GCG AGGAGCUCUC | 15209 |
| 3631 | CUCUACUCCU G AAAUC | 5870 | GAUUU UGAUG GCAUGCACUAUGC GCG AGGAGUAGAG | 15210 |
| 3648 | AUCAGAUCAU G CUGGA | 5871 | UCCAG UGAUG GCAUGCACUAUGC GCG AUGAUCUGAU | 15211 |
| 3656 | AUGCUGGACU G CUGGC | 5872 | GCCAG UGAUG GCAUGCACUAUGC GCG AGUCCAGCAU | 15212 |
| 3691 | GCCAAGAUUU G CAGAA | 5873 | UUCUG UGAUG GCAUGCACUAUGC GCG AAAUCUUGGC | 15213 |
| 3700 | UGCAGAACUU G UGGAA | 5874 | UUCCA UGAUG GCAUGCACUAUGC GCG AAGUUCUGCA | 15214 |
| 3715 | AAAACUAGGU G AUUUG | 5875 | CAAAU UGAUG GCAUGCACUAUGC GCG ACCAGUUUU | 15215 |

TABLE XV-continued

G-Cleaver Ribozyme and Target Sequences

| Pos | Target | Seq ID No | Ribozyme Sequence | Seq ID No |
|---|---|---|---|---|
| 3720 | UAGGUGAUUU G CUUCA | 5876 | UGAAG UGAUG GCAUGCACUAUGC GCG AAAUCACCUA | 15216 |
| 3733 | UCAAGCAAAU G UACAA | 5877 | UUGUA UGAUG GCAUGCACUAUGC GCG AUUUGCUUGA | 15217 |
| 3769 | CCCAAUCAAU G CCAUA | 5878 | UAUGG UGAUG GCAUGCACUAUGC GCG AUUGAUUGGG | 15218 |
| 3777 | AUGCCAUACU G ACAGG | 5879 | CCUGU UGAUG GCAUGCACUAUGC GCG AGUAUGGCAU | 15219 |
| 3811 | CUCAACUCCU G CCUUC | 5880 | GAAGG UGAUG GCAUGCACUAUGC GCG AGGAGUUGAG | 15220 |
| 3820 | UGCCUUCUCU G AGGAC | 5881 | GUCCU UGAUG GCAUGCACUAUGC GCG AGAGAAGGCA | 15221 |
| 3852 | UUUCAGCUCC G AAGUU | 5882 | AACUU UGAUG GCAUGCACUAUGC GCG GGAGCUGAAA | 15222 |
| 3874 | AGGAAGCUCU G AUGAU | 5883 | AUCAU UGAUG GCAUGCACUAUGC GCG AGAGCUUCCU | 15223 |
| 3877 | AAGCUCUGAU G AUGUC | 5884 | GACAU UGAUG GCAUGCACUAUGC GCG AUCAGAGCUU | 15224 |
| 3880 | CUCUGAUGAU G UCAGA | 5885 | UCUGA UGAUG GCAUGCACUAUGC GCG AUCAUCAGAG | 15225 |
| 3889 | UGUCAGAUAU G UAAAU | 5886 | AUUUA UGAUG GCAUGCACUAUGC GCG AUAUCUGACA | 15226 |
| 3895 | AUAUGUAAAU G CUUUC | 5887 | GAAAG UGAUG GCAUGCACUAUGC GCG AUUUACAUAU | 15227 |
| 3909 | UCAAGUUCAU G AGCCU | 5888 | AGGCU UGAUG GCAUGCACUAUGC GCG AUGAACUUGA | 15228 |
| 3934 | CAAAACCUUU G AAGAA | 5889 | UUCUU UGAUG GCAUGCACUAUGC GCG AAAGGUUUUG | 15229 |
| 3948 | AACUUUUACC G AAUGC | 5890 | GCAUU UGAUG GCAUGCACUAUGC GCG GGUAAAAGUU | 15230 |
| 3952 | UUUACCGAAU G CCACC | 5891 | GGUGG UGAUG GCAUGCACUAUGC GCG AUUCGGUAAA | 15231 |
| 3963 | CCACCUCCAU G UUUGA | 5892 | UCAAA UGAUG GCAUGCACUAUGC GCG AUGGAGGUGG | 15232 |
| 3967 | CUCCAUGUUU G AUGAC | 5893 | GUCAU UGAUG GCAUGCACUAUGC GCG AAACAUGGAG | 15233 |
| 3970 | CAUGUUUGAU G ACUAC | 5894 | GUAGU UGAUG GCAUGCACUAUGC GCG AUCAAACAUG | 15234 |
| 3982 | CUACCAGGGC G ACAGC | 5895 | GCUGU UGAUG GCAUGCACUAUGC GCG GCCCUGGUAG | 15235 |
| 3996 | GCAGCACUCU G UUGGC | 5896 | GCCAA UGAUG GCAUGCACUAUGC GCG AGAGUGCUGC | 15236 |
| 4011 | CCUCUCCCAU G CUGAA | 5897 | UUCAG UGAUG GCAUGCACUAUGC GCG AUGGGAGAGG | 15237 |
| 4014 | CUCCCAUGCU G AAGCG | 5898 | CGCUU UGAUG GCAUGCACUAUGC GCG AGCAUGGGAG | 15238 |
| 4019 | AUGCUGAAGC G CUUCA | 5899 | UGAAG UGAUG GCAUGCACUAUGC GCG GCUUCAGCAU | 15239 |
| 4033 | CACCUGGACU G ACAGC | 5900 | GCUGU UGAUG GCAUGCACUAUGC GCG AGUCCAGGUG | 15240 |
| 4053 | CCAAGGCCUC G CUCAA | 5901 | UUGAG UGAUG GCAUGCACUAUGC GCG GAGGCCUUGG | 15241 |
| 4063 | GCUCAAGAUU G ACUUG | 5902 | CAAGU UGAUG GCAUGCACUAUGC GCG AAUCUUGAGC | 15242 |
| 4068 | AGAUUGACUU G AGAGU | 5903 | ACUCU UGAUG GCAUGCACUAUGC GCG AAGUCAAUCU | 15243 |
| 4101 | AGUCGGGGCU G UCUGA | 5904 | UCAGA UGAUG GCAUGCACUAUGC GCG AGCCCCGACU | 15244 |
| 4105 | GGGGCUGUCU G AUGUC | 5905 | GACAU UGAUG GCAUGCACUAUGC GCG AGACAGCCCC | 15245 |
| 4108 | GCUGUCUGAU G UCAGC | 5906 | GCUGA UGAUG GCAUGCACUAUGC GCG AUCAGACAGC | 15246 |
| 4127 | CCCAGUUUCU G CCAUU | 5907 | AAUGG UGAUG GCAUGCACUAUGC GCG AGAAACUGGG | 15247 |
| 4139 | CAUUCCAGCU G UGGGC | 5908 | GCCCA UGAUG GCAUGCACUAUGC GCG AGCUGGAAUG | 15248 |
| 4153 | GCACGUCAGC G AAGGC | 5909 | GCCUU UGAUG GCAUGCACUAUGC GCG GCUGACGUGC | 15249 |
| 4163 | GAAGGCAAGC G CAGGU | 5910 | ACCUG UGAUG GCAUGCACUAUGC GCG GCUUGCCUUC | 15250 |
| 4177 | GUUCACCUAC G ACCAC | 5911 | GUGGU UGAUG GCAUGCACUAUGC GCG GUAGGUGAAC | 15251 |
| 4183 | CUACGACCAC G CUGAG | 5912 | CUCAG UGAUG GCAUGCACUAUGC GCG GUGGUCGUAG | 15252 |

TABLE XV-continued

G-Cleaver Ribozyme and Target Sequences

| Pos | Target | Seq ID No | Ribozyme Sequence | Seq ID No |
|-----|--------|-----------|-------------------|-----------|
| 4186 | CGACCACGCU G AGCUG | 5913 | CAGCU UGAUG GCAUGCACUAUGC GCG AGCGUGGUCG | 15253 |
| 4204 | AAGGAAAAUC G CGUGC | 5914 | GCACG UGAUG GCAUGCACUAUGC GCG GAUUUUCCUU | 15254 |
| 4208 | AAAAUCGCGU G CUGCU | 5915 | AGCAG UGAUG GCAUGCACUAUGC GCG ACGCGAUUUU | 15255 |
| 4211 | AUCGCGUGCU G CUCCC | 5916 | GGGAG UGAUG GCAUGCACUAUGC GCG AGCACGCGAU | 15256 |
| 4218 | GCUGCUCCCC G CCCCC | 5917 | GGGGG UGAUG GCAUGCACUAUGC GCG GGGGAGCAGC | 15257 |
| 4245 | CGGUGGUCCU G UACUC | 5918 | GAGUA UGAUG GCAUGCACUAUGC GCG AGGACCACCG | 15258 |
| 4272 | UCUAGAGUUU G ACACG | 5919 | CGUGU UGAUG GCAUGCACUAUGC GCG AAACUCUAGA | 15259 |
| 4277 | AGUUUGACAC G AAGCC | 5920 | GGCUU UGAUG GCAUGCACUAUGC GCG GUGUCAAACU | 15260 |
| 4301 | AGAAGCACAU G UGUAU | 5921 | AUACA UGAUG GCAUGCACUAUGC GCG AUGUGCUUCU | 15261 |
| 4303 | AAGCACAUGU G UAUUU | 5922 | AAAUA UGAUG GCAUGCACUAUGC GCG ACAUGUGCUU | 15262 |
| 4332 | ACUAGCUUUU G CCAGU | 5923 | ACUGG UGAUG GCAUGCACUAUGC GCG AAAAGCUAGU | 15263 |
| 4343 | CCAGUAUUAU G CAUAU | 5924 | AUAUG UGAUG GCAUGCACUAUGC GCG AUAAUACUGG | 15264 |
| 4386 | GGAGCCAGCU G CUUUU | 5925 | AAAAG UGAUG GCAUGCACUAUGC GCG AGCUGGCUCC | 15265 |
| 4393 | GCUGCUUUUU G UGAUU | 5926 | AAUCA UGAUG GCAUGCACUAUGC GCG AAAAAGCAGC | 15266 |
| 4395 | UGCUUUUUGU G AUUUU | 5927 | AAAAU UGAUG GCAUGCACUAUGC GCG ACAAAAAGCA | 15267 |
| 4410 | UUUUAAUAGU G CUUUU | 5928 | AAAAG UGAUG GCAUGCACUAUGC GCG ACUAUUAAAA | 15268 |
| 4423 | UUUUUUUUUU G ACUAA | 5929 | UUAGU UGAUG GCAUGCACUAUGC GCG AAAAAAAAAA | 15269 |
| 4436 | UAACAAGAAU G UAACU | 5930 | AGUUA UGAUG GCAUGCACUAUGC GCG AUUCUUGUUA | 15270 |
| 4459 | GAGAAAUAGU G ACAAG | 5931 | CUUGU UGAUG GCAUGCACUAUGC GCG ACUAUUUCUC | 15271 |
| 4466 | AGUGACAAGU G AAGAA | 5932 | UUCUU UGAUG GCAUGCACUAUGC GCG ACUUGUCACU | 15272 |
| 4479 | GAACACUACU G CUAAA | 5933 | UUUAG UGAUG GCAUGCACUAUGC GCG AGUAGUGUC | 15273 |
| 4492 | AAAUCCUCAU G UUACU | 5934 | AGUAA UGAUG GCAUGCACUAUGC GCG AUGAGGAUUU | 15274 |
| 4502 | GUUACUCAGU G UUAGA | 5935 | UCUAA UGAUG GCAUGCACUAUGC GCG ACUGAGUAAC | 15275 |
| 4529 | UAAACCCAAU G ACUUC | 5936 | GAAGU UGAUG GCAUGCACUAUGC GCG AUUGGGUUUA | 15276 |
| 4538 | UGACUUCCCU G CUCCA | 5937 | UGGAG UGAUG GCAUGCACUAUGC GCG AGGGAAGUCA | 15277 |
| 4550 | UCCAACCCCC G CCACC | 5938 | GGUGG UGAUG GCAUGCACUAUGC GCG GGGGGUUGGA | 15278 |
| 4565 | CUCAGGGCAC G CAGGA | 5939 | UCCUG UGAUG GCAUGCACUAUGC GCG GUGCCCUGAG | 15279 |
| 4578 | GGACCAGUUU G AUUGA | 5940 | UCAAU UGAUG GCAUGCACUAUGC GCG AAACUGGUCC | 15280 |
| 4582 | CAGUUUGAUU G AGGAG | 5941 | CUCCU UGAUG GCAUGCACUAUGC GCG AAUCAAACUG | 15281 |
| 4590 | UUGAGGAGCU G CACUG | 5942 | CAGUG UGAUG GCAUGCACUAUGC GCG AGCUCCUCAA | 15282 |
| 4595 | GAGCUGCACU G AUCAC | 5943 | GUGAU UGAUG GCAUGCACUAUGC GCG AGUGCAGCUC | 15283 |
| 4606 | AUCACCCAAU G CAUCA | 5944 | UGAUG UGAUG GCAUGCACUAUGC GCG AUUGGGUGAU | 15284 |
| 4634 | GGCCAGCCCU G CAGCC | 5945 | GGCUG UGAUG GCAUGCACUAUGC GCG AGGGCUGGCC | 15285 |
| 4691 | UGGCUGGCCU G AGCAA | 5946 | UUGCU UGAUG GCAUGCACUAUGC GCG AGGCCAGCCA | 15286 |
| 4730 | CCUAAGACAU G UGAGG | 5947 | CCUCA UGAUG GCAUGCACUAUGC GCG AUGUCUUAGG | 15287 |
| 4732 | UAAGACAUGU G AGGAG | 5948 | CUCCU UGAUG GCAUGCACUAUGC GCG ACAUGUCUUA | 15288 |
| 4792 | GAGAAGGCAU G AGAAA | 5949 | UUUCU UGAUG GCAUGCACUAUGC GCG AUGCCUUCUC | 15289 |

TABLE XV-continued

G-Cleaver Ribozyme and Target Sequences

| Pos | Target | Seq ID No | Ribozyme Sequence | Seq ID No |
|---|---|---|---|---|
| 4804 | GAAAGAAUUU G AGACG | 5950 | CGUCU UGAUG GCAUGCACUAUGC GCG AAAUUCUUUC | 15290 |
| 4809 | AAUUUGAGAC G CACCA | 5951 | UGGUG UGAUG GCAUGCACUAUGC GCG GUCUCAAAUU | 15291 |
| 4816 | GACGCACCAU G UGGGC | 5952 | GCCCA UGAUG GCAUGCACUAUGC GCG AUGGUGCGUC | 15292 |
| 4847 | GCUCAGCAAU G CCAUU | 5953 | AAUGG UGAUG GCAUGCACUAUGC GCG AUUGCUGAGC | 15293 |
| 4872 | UCCCAGCUCU G ACCCU | 5954 | AGGGU UGAUG GCAUGCACUAUGC GCG AGAGCUGGGA | 15294 |
| 4887 | UUCUACAUUU G AGGGC | 5955 | GCCCU UGAUG GCAUGCACUAUGC GCG AAAUGUAGAA | 15295 |
| 4916 | GAUGGACAGC G AUGAG | 5956 | CUCAU UGAUG GCAUGCACUAUGC GCG GCUGUCCAUC | 15296 |
| 4919 | GGACAGCGAU G AGGGG | 5957 | CCCCU UGAUG GCAUGCACUAUGC GCG AUCGCUGUCC | 15297 |
| 5018 | GUGGUUCUAU G UCCAU | 5958 | AUGGA UGAUG GCAUGCACUAUGC GCG AUAGAACCAC | 15298 |
| 5039 | UUCGUGGCAU G UUUUG | 5959 | CAAAA UGAUG GCAUGCACUAUGC GCG AUGCCACGAA | 15299 |
| 5044 | GGCAUGUUUU G AUUUG | 5960 | CAAAU UGAUG GCAUGCACUAUGC GCG AAAACAUGCC | 15300 |
| 5049 | GUUUUGAUUU G UAGCA | 5961 | UGCUA UGAUG GCAUGCACUAUGC GCG AAAUCAAAAC | 15301 |
| 5057 | UUGUAGCACU G AGGGU | 5962 | ACCCU UGAUG GCAUGCACUAUGC GCG AGUGCUACAA | 15302 |
| 5076 | ACUCAACUCU G AGCCC | 5963 | GGCCU UGAUG GCAUGCACUAUGC GCG AGAGUUGAGU | 15303 |
| 5107 | CUAGUAAGAU G CACUG | 5964 | CAGUG UGAUG GCAUGCACUAUGC GCG AUCUUACUAG | 15304 |
| 5112 | AAGAUGCACU G AAAAC | 5965 | GUUUU UGAUG GCAUGCACUAUGC GCG AGUGCAUCUU | 15305 |
| 5135 | GAGUUAGGUU G UCUCC | 5966 | GGAGA UGAUG GCAUGCACUAUGC GCG AACCUAACUC | 15306 |
| 5148 | UCCAGGCCAU G AUGGC | 5967 | GCCAU UGAUG GCAUGCACUAUGC GCG AUGGCCUGGA | 15307 |
| 5162 | GCCUUACACU G AAAAU | 5968 | AUUUU UGAUG GCAUGCACUAUGC GCG AGUGUAAGGC | 15308 |
| 5168 | CACUGAAAAU G UCACA | 5969 | UGUGA UGAUG GCAUGCACUAUGC GCG AUUUUCAGUG | 15309 |
| 5234 | GUAUUAUUCU G UUUUG | 5970 | CAAAA UGAUG GCAUGCACUAUGC GCG AGAAUAAUAC | 15310 |
| 5239 | AUUCUGUUUU G CACAG | 5971 | CUGUG UGAUG GCAUGCACUAUGC GCG AAAACAGAAU | 15311 |
| 5251 | ACAGUUAGUU G UGAAA | 5972 | UUUCA UGAUG GCAUGCACUAUGC GCG AACUAACUGU | 15312 |
| 5253 | AGUUAGUUGU G AAAGA | 5973 | UCUUU UGAUG GCAUGCACUAUGC GCG ACAACUAACU | 15313 |
| 5264 | AAAGAAAGCU G AGAAG | 5974 | CUUCU UGAUG GCAUGCACUAUGC GCG AGCUUUCUUU | 15314 |
| 5273 | UGAGAAGAAU G AAAAU | 5975 | AUUUU UGAUG GCAUGCACUAUGC GCG AUUCUUCUCA | 15315 |
| 5279 | GAAUGAAAAU G CAGUC | 5976 | GACUG UGAUG GCAUGCACUAUGC GCG AUUUUCAUUC | 15316 |
| 5287 | AUGCAGUCCU G AGGAG | 5977 | CUCCU UGAUG GCAUGCACUAUGC GCG AGGACUGCAU | 15317 |
| 5313 | AUAUCAAAAC G AGGGC | 5978 | GCCCU UGAUG GCAUGCACUAUGC GCG GUUUUGAUAU | 15318 |
| 5320 | AACGAGGGCU G AUGGA | 5979 | UCCAU UGAUG GCAUGCACUAUGC GCG AGCCCUCGUU | 15319 |
| 5469 | ACACUAAUCU G AAAGG | 5980 | CCUUU UGAUG GCAUGCACUAUGC GCG AGAUUAGUGU | 15320 |
| 5477 | CUGAAAGGAU G UGGAA | 5981 | UUCCA UGAUG GCAUGCACUAUGC GCG AUCCUUUCAG | 15321 |
| 5497 | AUUAGCUGGC G CAUAU | 5982 | AUAUG UGAUG GCAUGCACUAUGC GCG GCCAGCUAAU | 15322 |
| 5522 | UAAGCUCCUU G AGUAA | 5983 | UUACU UGAUG GCAUGCACUAUGC GCG AAGGAGCUUA | 15323 |
| 5539 | AAGGUGGUAU G UAAUU | 5984 | AAUUA UGAUG GCAUGCACUAUGC GCG AUACCACCUU | 15324 |
| 5548 | UGUAAUUUAU G CAAGG | 5985 | CCUUG UGAUG GCAUGCACUAUGC GCG AUAAAUUACA | 15325 |
| 5589 | AUUAGUUAAU G AGCCA | 5986 | UGGCU UGAUG GCAUGCACUAUGC GCG AUUAACUAAU | 15326 |

TABLE XV-continued

G-Cleaver Ribozyme and Target Sequences

| Pos | Target | Seq ID No | Ribozyme Sequence | Seq ID No |
|---|---|---|---|---|
| 5623 | AUUUUCAACU G CUUUG | 5987 | CAAAG UGAUG GCAUGCACUAUGC GCG AGUUGAAAAU | 15327 |
| 5628 | CAACUGCUUU G AAACU | 5988 | AGUUU UGAUG GCAUGCACUAUGC GCG AAAGCAGUUG | 15328 |
| 5635 | UUUGAAACUU G CCUGG | 5989 | CCAGG UGAUG GCAUGCACUAUGC GCG AAGUUUCAAA | 15329 |
| 5646 | CCUGGGGUCU G AGCAU | 5990 | AUGCU UGAUG GCAUGCACUAUGC GCG AGACCCCAGG | 15330 |
| 5652 | GUCUGAGCAU G AUGGG | 5991 | CCCAU UGAUG GCAUGCACUAUGC GCG AUGCUCAGAC | 15331 |
| 5684 | AGGAAAGGGC G CCUAC | 5992 | GUAGG UGAUG GCAUGCACUAUGC GCG GCCCUUUCCU | 15332 |
| 5725 | GCCUUGGAUC G CUAAG | 5993 | CUUAG UGAUG GCAUGCACUAUGC GCG GAUCCAAGGC | 15333 |
| 5739 | AGCUGGCUCU G UUUGA | 5994 | UCAAA UGAUG GCAUGCACUAUGC GCG AGAGCCAGCU | 15334 |
| 5743 | GGCUCUGUUU G AUGCU | 5995 | AGCAU UGAUG GCAUGCACUAUGC GCG AAACAGAGCC | 15335 |
| 5746 | UCUGUUUGAU G CUAUU | 5996 | AAUAG UGAUG GCAUGCACUAUGC GCG AUCAAACAGA | 15336 |
| 5755 | UGCUAUUUAU G CAAGU | 5997 | ACUUG UGAUG GCAUGCACUAUGC GCG AUAAAUAGCA | 15337 |
| 5771 | UAGGGUCUAU G UAUUU | 5998 | AAAUA UGAUG GCAUGCACUAUGC GCG AUAGACCCUA | 15338 |
| 5782 | UAUUUAGGAU G CGCCU | 5999 | AGGCG UGAUG GCAUGCACUAUGC GCG AUCCUAAAUA | 15339 |
| 5784 | UUUAGGAUGC G CCUAC | 6000 | GUAGG UGAUG GCAUGCACUAUGC GCG GCAUCCUAAA | 15340 |
| 5825 | GCCUUGGAUC G CUAAG | 5993 | CUUAG UGAUG GCAUGCACUAUGC GCG GAUCCAAGGC | 15333 |
| 5839 | AGCUGGCUCU G UUUGA | 5994 | UCAAA UGAUG GCAUGCACUAUGC GCG AGAGCCAGCU | 15334 |
| 5843 | GGCUCUGUUU G AUGCU | 5995 | AGCAU UGAUG GCAUGCACUAUGC GCG AAACAGAGCC | 15335 |
| 5846 | UCUGUUUGAU G CUAUU | 5996 | AAUAG UGAUG GCAUGCACUAUGC GCG AUCAAACAGA | 15336 |
| 5855 | UGCUAUUUAU G CAAGU | 5997 | ACUUG UGAUG GCAUGCACUAUGC GCG AUAAAUAGCA | 15337 |
| 5871 | UAGGGUCUAU G UAUUU | 5998 | AAAUA UGAUG GCAUGCACUAUGC GCG AUAGACCCUA | 15338 |
| 5882 | UAUUUAGGAU G UCUGC | 6001 | GCAGA UGAUG GCAUGCACUAUGC GCG AUCCUAAAUA | 15341 |
| 5886 | UAGGAUGUCU G CACCU | 6002 | AGGUG UGAUG GCAUGCACUAUGC GCG AGACAUCCUA | 15342 |
| 5895 | UGCACCUUCU G CAGCC | 6003 | GCCUG UGAUG GCAUGCACUAUGC GCG AGAAGGUGCA | 15343 |
| 5931 | ACAGUGGAUU G CUGCU | 6004 | AGCAG UGAUG GCAUGCACUAUGC GCG AAUCCACUGU | 15344 |
| 5934 | GUGGAUUGCU G CUUCU | 6005 | AGAAG UGAUG GCAUGCACUAUGC GCG AGCAAUCCAC | 15345 |
| 5955 | AGAAGAGUAU G CUUCC | 6006 | GGAAG UGAUG GCAUGCACUAUGC GCG AUACUCUUCU | 15346 |
| 5971 | UUUUAUCCAU G UAAUU | 6007 | AAUUA UGAUG GCAUGCACUAUGC GCG AUGGAUAAAA | 15347 |
| 5982 | UAAUUUAACU G UAGAA | 6008 | UUCUA UGAUG GCAUGCACUAUGC GCG AGUUAAAUUA | 15348 |
| 5991 | UGUAGAACCU G AGCUC | 6009 | GAGCU UGAUG GCAUGCACUAUGC GCG AGGUUCUACA | 15349 |
| 6006 | CUAAGUAACC G AAGAA | 6010 | UUCUU UGAUG GCAUGCACUAUGC GCG GGUUACUUAG | 15350 |
| 6013 | ACCGAAGAAU G UAUGC | 6011 | GCAUA UGAUG GCAUGCACUAUGC GCG AUUCUUCGGU | 15351 |
| 6017 | AAGAAUGUAU G CCUCU | 6012 | AGAGG UGAUG GCAUGCACUAUGC GCG AUACAUUCUU | 15352 |
| 6023 | GUAUGCCUCU G UUCUU | 6013 | AAGAA UGAUG GCAUGCACUAUGC GCG AGAGGCAUAC | 15353 |
| 6031 | CUGUUCUAU G UGCCA | 6014 | UGGCA UGAUG GCAUGCACUAUGC GCG AUAAGAACAG | 15354 |
| 6033 | GUUCUUAUGU G CCACA | 6015 | UGUGG UGAUG GCAUGCACUAUGC GCG ACAUAAGAAC | 15355 |
| 6044 | CCACAUCCUU G UUUAA | 6016 | UUAAA UGAUG GCAUGCACUAUGC GCG AAGGAUGUGG | 15356 |
| 6059 | AAGGCUCUCU G UAUGA | 6017 | UCAUA UGAUG GCAUGCACUAUGC GCG AGAGAGCCUU | 15357 |

TABLE XV-continued

G-Cleaver Ribozyme and Target Sequences

| Pos | Target | Seq ID No | Ribozyme Sequence | Seq ID No |
|---|---|---|---|---|
| 6063 | CUCUCUGUAU G AAGAG | 6018 | CUCUU UGAUG GCAUGCACUAUGC GCG AUACAGAGAG | 15358 |
| 6098 | AUUCCCUAGU G AGCCU | 6019 | AGGCU UGAUG GCAUGCACUAUGC GCG ACUAGGGAAU | 15359 |
| 6127 | AGCGGCUUUU G UGGAA | 6020 | UUCCA UGAUG GCAUGCACUAUGC GCG AAAAGCCGCU | 15360 |
| 6230 | ACAAAUCUUU G UUGUU | 6021 | AACAA UGAUG GCAUGCACUAUGC GCG AAAGAUUUCU | 15361 |
| 6233 | AAUCUUUGUU G UUCCU | 6022 | AGGAA UGAUG GCAUGCACUAUGC GCG AACAAAGAUU | 15362 |
| 6254 | UUACACAUAC G CAAAC | 6023 | GUUUG UGAUG GCAUGCACUAUGC GCG GUAUGUGUAA | 15363 |
| 6265 | CAAACCACCU G UGACA | 6024 | UGUCA UGAUG GCAUGCACUAUGC GCG AGGUGGUUUG | 15364 |
| 6267 | AACCACCUGU G ACAGC | 6025 | GCUGU UGAUG GCAUGCACUAUGC GCG ACAGGUGGUU | 15265 |
| 6391 | AGCAAAUAGU G AUAAC | 6026 | GUUAU UGAUG GCAUGCACUAUGC GCG ACUAUUUGCU | 15366 |
| 6413 | AACCUUAGCU G UUCAU | 6027 | AUGAA UGAUG GCAUGCACUAUGC GCG AGCUAAGGUU | 15367 |
| 6419 | AGCUGUUCAU G UCUUG | 6028 | CAAGA UGAUG GCAUGCACUAUGC GCG AUGAACAGCU | 15368 |
| 6424 | UUCAUGUCUU G AUUUC | 6029 | GAAAU UGAUG GCAUGCACUAUGC GCG AAGACAUGAA | 15369 |
| 6504 | CAUUAGAAUU G UUACU | 6030 | AGUAA UGAUG GCAUGCACUAUGC GCG AAUUCUAAUG | 15370 |
| 6532 | ACUCAGGUUU G UAGCA | 6031 | UGCUA UGAUG GCAUGCACUAUGC GCG AAACCUGAGU | 15371 |
| 6543 | UAGCAUACAU G AGUCC | 6032 | GGACU UGAUG GCAUGCACUAUGC GCG AUGUAUGCUA | 15372 |
| 6588 | GAGUCUUAAU G UAGAA | 6033 | UUCUA UGAUG GCAUGCACUAUGC GCG AUUAAGACUC | 15373 |
| 6610 | AUGGAGACUU G UAAUA | 6034 | UAUUA UGAUG GCAUGCACUAUGC GCG AAGUCUCCAU | 15374 |
| 6618 | UUGUAAUAAU G AGCUA | 6035 | UAGCU UGAUG GCAUGCACUAUGC GCG AUUAUUACAA | 15375 |
| 6634 | GUUACAAAGU G CUUGU | 6036 | ACAAG UGAUG GCAUGCACUAUGC GCG ACUUUGUAAC | 15376 |
| 6638 | CAAAGUGCUU G UUCAU | 6037 | AUGAA UGAUG GCAUGCACUAUGC GCG AAGCACUUUG | 15377 |
| 6656 | AAAUAGCACU G AAAAU | 6038 | AUUUU UGAUG GCAUGCACUAUGC GCG AGUGCUAUUU | 15378 |
| 6663 | ACUGAAAAUU G AAACA | 6039 | UGUUU UGAUG GCAUGCACUAUGC GCG AAUUUUCAGU | 15379 |
| 6670 | AUUGAAACAU G AAUUA | 6040 | UAAUU UGAUG GCAUGCACUAUGC GCG AUGUUUCAAU | 15380 |
| 6679 | UGAAUUAACU G AUAAU | 6041 | AUUAU UGAUG GCAUGCACUAUGC GCG AGUUAAUUCA | 15381 |
| 6698 | CCAAUCAUUU G CCAUU | 6042 | AAUGG UGAUG GCAUGCACUAUGC GCG AAAUGAUUGG | 15382 |
| 6707 | UGCCAUUUAU G ACAAA | 6043 | UUUGU UGAUG GCAUGCACUAUGC GCG AUAAAUGGCA | 15383 |
| 6736 | AACAAAGAAC G AGCAC | 6044 | GUGCU UGAUG GCAUGCACUAUGC GCG GUUCUUUGUU | 15384 |
| 6759 | CAGAGUUUCU G AGAUA | 6045 | UAUCU UGAUG GCAUGCACUAUGC GCG AGAAACUCUG | 15385 |
| 6767 | CUGAGAUAAU G UACGU | 6046 | ACGUA UGAUG GCAUGCACUAUGC GCG AUUAUCUCAG | 15386 |
| 6798 | GAAUGGGGCU G AAACC | 6047 | GGUUU UGAUG GCAUGCACUAUGC GCG AGCCCCAUUC | 15387 |
| 6806 | CUGAAACCAU G UGCAA | 6048 | UUGCA UGAUG GCAUGCACUAUGC GCG AUGGUUUCAG | 15388 |
| 6808 | GAAACCAUGU G CAAGU | 6049 | ACUUG UGAUG GCAUGCACUAUGC GCG ACAUGGUUUC | 15389 |
| 6816 | GUGCAAGUCU G UGUCU | 6050 | AGACA UGAUG GCAUGCACUAUGC GCG AGACUUGCAC | 15390 |
| 6818 | GCAAGUCUGU G UCUUG | 6051 | CAAGA UGAUG GCAUGCACUAUGC GCG ACAGACUUGC | 15391 |
| 6823 | UCUGUGUCUU G UCAGU | 6052 | ACUGA UGAUG GCAUGCACUAUGC GCG AAGACACAGA | 15392 |
| 6838 | UCCAAGAAGU G ACACC | 6053 | GGUGU UGAUG GCAUGCACUAUGC GCG ACUUCUUGGA | 15393 |
| 6844 | AAGUGACACC G AGAUG | 6054 | CAUCU UGAUG GCAUGCACUAUGC GCG GGUGUCACUU | 15394 |

TABLE XV-continued

G-Cleaver Ribozyme and Target Sequences

| Pos | Target | Seq ID No | Ribozyme Sequence | Seq ID No |
|---|---|---|---|---|
| 6849 | ACACCGAGAU G UUAAU | 6055 | AUUAA UGAUG GCAUGCACUAUGC GCG AUCUCGGUGU | 15395 |
| 6868 | AGGGACCCGU G CCUUG | 6056 | CAAGG UGAUG GCAUGCACUAUGC GCG ACGGGUCCCU | 15396 |
| 6873 | CCCGUGCCUU G UUUCC | 6057 | GGAAA UGAUG GCAUGCACUAUGC GCG AAGGCACGGG | 15397 |
| 6893 | CCACAAGAAU G CAAAC | 6058 | GUUUG UGAUG GCAUGCACUAUGC GCG AUUCUUGUGG | 15398 |
| 6914 | ACAGAUACUC G CUAGC | 6059 | GCUAG UGAUG GCAUGCACUAUGC GCG GAGUAUCUGU | 15399 |
| 6932 | CAUUUAAAUU G AUUAA | 6060 | UUAAU UGAUG GCAUGCACUAUGC GCG AAUUUAAAUG | 15400 |
| 6947 | AAGGAGGAGU G CAUCU | 6061 | AGAUG UGAUG GCAUGCACUAUGC GCG ACUCCUCCUU | 15401 |
| 6959 | AUCUUUGGCC G ACAGU | 6062 | ACUGU UGAUG GCAUGCACUAUGC GCG GGCCAAAGAU | 15402 |
| 6968 | CGACAGUGGU G UAACU | 6063 | AGUUA UGAUG GCAUGCACUAUGC GCG ACCACUGUCG | 15403 |
| 6974 | UGGUGUAACU G UGUGU | 6064 | ACACA UGAUG GCAUGCACUAUGC GCG AGUUACACCA | 15404 |
| 6976 | GUGUAACUGU G UGUGU | 6065 | ACACA UGAUG GCAUGCACUAUGC GCG ACAGUUACAC | 15405 |
| 6978 | GUAACUGUGU G UGUGU | 6066 | ACACA UGAUG GCAUGCACUAUGC GCG ACACAGUUAC | 15406 |
| 6980 | AACUGUGUGU G UGUGU | 6067 | ACACA UGAUG GCAUGCACUAUGC GCG ACACACAGUU | 15407 |
| 6982 | CUGUGUGUGU G UGUGU | 6068 | ACACA UGAUG GCAUGCACUAUGC GCG ACACACACAG | 15408 |
| 6984 | GUGUGUGUGU G UGUGU | 6069 | ACACA UGAUG GCAUGCACUAUGC GCG ACACACACAC | 15409 |
| 6986 | GUGUGUGUGU G UGUGU | 6069 | ACACA UGAUG GCAUGCACUAUGC GCG ACACACACAC | 15409 |
| 6988 | GUGUGUGUGU G UGUGU | 6069 | ACACA UGAUG GCAUGCACUAUGC GCG ACACACACAC | 15409 |
| 6990 | GUGUGUGUGU G UGUGU | 6069 | ACACA UGAUG GCAUGCACUAUGC GCG ACACACACAC | 15409 |
| 6992 | GUGUGUGUGU G UGUGU | 6069 | ACACA UGAUG GCAUGCACUAUGC GCG ACACACACAC | 15409 |
| 6994 | GUGUGUGUGU G UGUGU | 6069 | ACACA UGAUG GCAUGCACUAUGC GCG ACACACACAC | 15409 |
| 6996 | GUGUGUGUGU G UGUGU | 6069 | ACACA UGAUG GCAUGCACUAUGC GCG ACACACACAC | 15409 |
| 6998 | GUGUGUGUGU G UGUGU | 6069 | ACACA UGAUG GCAUGCACUAUGC GCG ACACACACAC | 15409 |
| 7000 | GUGUGUGUGU G UGUGU | 6069 | ACACA UGAUG GCAUGCACUAUGC GCG ACACACACAC | 15409 |
| 7002 | GUGUGUGUGU G UGUGU | 6069 | ACACA UGAUG GCAUGCACUAUGC GCG ACACACACAC | 15409 |
| 7004 | GUGUGUGUGU G UGUGU | 6069 | ACACA UGAUG GCAUGCACUAUGC GCG ACACACACAC | 15409 |
| 7006 | GUGUGUGUGU G UGUGU | 6069 | ACACA UGAUG GCAUGCACUAUGC GCG ACACACACAC | 15409 |
| 7008 | GUGUGUGUGU G UGUGU | 6069 | ACACA UGAUG GCAUGCACUAUGC GCG ACACACACAC | 15409 |
| 7010 | GUGUGUGUGU G UGUGG | 6070 | CCACA UGAUG GCAUGCACUAUGC GCG ACACACACAC | 15410 |
| 7012 | GUGUGUGUGU G UGGGU | 6071 | ACCCA UGAUG GCAUGCACUAUGC GCG ACACACACAC | 15411 |
| 7018 | GUGUGUGGGU G UGGGU | 6072 | ACCCA UGAUG GCAUGCACUAUGC GCG ACCCACACAC | 15412 |
| 7024 | GGGUGUGGGU G UAUGU | 6073 | ACAUA UGAUG GCAUGCACUAUGC GCG ACCCACACCC | 19413 |
| 7028 | GUGGGUGUAU G UGUGU | 6074 | ACACA UGAUG GCAUGCACUAUGC GCG AUACCCCAC | 15414 |
| 7030 | GGGUGUAUGU G UGUUU | 6075 | AAACA UGAUG GCAUGCACUAUGC GCG ACAUACACCC | 15415 |
| 7032 | GUGUAUGUGU G UUUUG | 6076 | CAAAA UGAUG GCAUGCACUAUGC GCG ACACAUACAC | 15416 |
| 7037 | UGUGUGUUUU G UGCAU | 6077 | AUGCA UGAUG GCAUGCACUAUGC GCG AAAACACACA | 15417 |
| 7039 | UGUGUUUUGU G CAUAA | 6078 | UUAUG UGAUG GCAUGCACUAUGC GCG ACAAAACACA | 15418 |
| 7099 | AAGAAUAUAU G CUACA | 6079 | UGUAG UGAUG GCAUGCACUAUGC GCG AUAUAUUCUU | 15419 |

TABLE XV-continued

G-Cleaver Ribozyme and Target Sequences

| Pos | Target | Seq ID No | Ribozyme Sequence | Seq ID No |
|---|---|---|---|---|
| 7146 | UUCUAGUCAU G AUGAA | 6080 | UUCAU UGAUG GCAUGCACUAUGC GCG AUGACUAGAA | 15420 |
| 7149 | UAGUCAUGAU G AAUGU | 6081 | ACAUU UGAUG GCAUGCACUAUGC GCG AUCAUGACUA | 15421 |
| 7153 | CAUGAUGAAU G UAUUU | 6082 | AAAUA UGAUG GCAUGCACUAUGC GCG AUUCAUCAUG | 15422 |
| 7160 | AAUGUAUUUU G UAUAC | 6083 | GUAUA UGAUG GCAUGCACUAUGC GCG AAAAUACAUU | 15423 |
| 7210 | AUUGGGAUUU G UAAUC | 6084 | GAUUA UGAUG GCAUGCACUAUGC GCG AAAUCCCAAU | 15424 |
| 7230 | CAACUUAAUU G AUAAA | 6085 | UUUAU UGAUG GCAUGCACUAUGC GCG AAUUAAGUUG | 15425 |
| 7246 | CUUGGCAACU G CUUUU | 6086 | AAAAG UGAUG GCAUGCACUAUGC GCG AGUUGCCAAG | 15426 |
| 7254 | CUGCUUUUAU G UUCUG | 6087 | CAGAA UGAUG GCAUGCACUAUGC GCG AUAAAAGCAG | 15427 |
| 7259 | UUUAUGUUCU G UCUCC | 6088 | GGAGA UGAUG GCAUGCACUAUGC GCG AGAACAUAAA | 15428 |
| 7343 | AUUUAUCCUU G UUUAC | 6089 | CUAAA UGAUG GCAUGCACUAUGC GCG AAGGAUAAAU | 15429 |
| 7375 | GAAAAACUUU G AAAUG | 6090 | CAUUU UGAUG GCAUGCACUAUGC GCG AAAGUUUUUC | 15430 |
| 7394 | UCAAAAAAUU G CUAAA | 6091 | UUUAG UGAUG GCAUGCACUAUGC GCG AAUUUUUGA | 15431 |
| 7422 | AAAACUAAAU G UUAGU | 6092 | ACUAA UGAUG GCAUGCACUAUGC GCG AUUUAGUUUU | 15432 |
| 7434 | UAGUUUAGCU G AUUGU | 6093 | ACAAU UGAUG GCAUGCACUAUGC GCG AGCUAAACUA | 15433 |
| 7438 | UUAGCUGAUU G UAUGG | 6094 | CCAUA UGAUG GCAUGCACUAUGC GCG AAUCAGCUAA | 15434 |
| 7451 | UGGGGUUUUC G AACCU | 6095 | AGGUU UGAUG GCAUGCACUAUGC GCG GAAAACCCCA | 15435 |
| 7467 | UUCACUUUUU G UUUGU | 6096 | ACAAA UGAUG GCAUGCACUAUGC GCG AAAAAGUGAA | 15436 |
| 7471 | CUUUUUGUUU G UUUUA | 6097 | UAAAA UGAUG GCAUGCACUAUGC GCG AAACAAAAAG | 15437 |
| 7491 | UUUCACAACU G UGUAA | 6098 | UUACA UGAUG GCAUGCACUAUGC GCG AGUUGUGAAA | 15438 |
| 7493 | UCACAACUGU G UAAAU | 6099 | AUUUA UGAUG GCAUGCACUAUGC GCG ACAGUUGUGA | 15439 |
| 7500 | UGUGUAAAUU G CCAAU | 6100 | AUUGG UGAUG GCAUGCACUAUGC GCG AAUUUACACA | 15440 |
| 7513 | AAUAAUUCCU G UCCAU | 6101 | AUGGA UGAUG GCAUGCACUAUGC GCG AGGAAUUAUU | 15441 |
| 7519 | UCCUGUCCAU G AAAAU | 6102 | AUUUU UGAUG GCAUGCACUAUGC GCG AUGGACAGGA | 15442 |
| 7525 | CCAUGAAAAU G CAAAU | 6103 | AUUUG UGAUG GCAUGCACUAUGC GCG AUUUUCAUGG | 15443 |
| 7539 | AUUAUCCAGU G UAGAU | 6104 | AUCUA UGAUG GCAUGCACUAUGC GCG ACUGGAUAAU | 15444 |
| 7551 | AGAUAUAUUU G ACCAU | 6105 | AUGGU UGAUG GCAUGCACUAUGC GCG AAAUAUAUCU | 15445 |
| 7582 | GGCUAGUUUU G CCUUU | 6106 | AAAGG UGAUG GCAUGCACUAUGC GCG AAAACUAGCC | 15446 |
| 7611 | AUUUCAGCCU G AAUGU | 6107 | ACAUU UGAUG GCAUGCACUAUGC GCG AGGCUGAAAU | 15447 |
| 7615 | CAGCCUGAAU G UCUGC | 6108 | GCAGA UGAUG GCAUGCACUAUGC GCG AUUCAGGCUG | 15448 |
| 7619 | CUGAAUGUCU G CCUAU | 6109 | AUAGG UGAUG GCAUGCACUAUGC GCG AGACAUUCAG | 15449 |
| 7634 | UAUAUUCUCU G CUCUU | 6110 | AAGAG UGAUG GCAUGCACUAUGC GCG AGAGAAUAUA | 15450 |
| 7641 | UCUGCUCUUU G UAUUC | 6111 | GAAUA UGAUG GCAUGCACUAUGC GCG AAAGAGCAGA | 15451 |
| 7653 | AUUCUCCUUU G AACCC | 6112 | GGGUU UGAUG GCAUGCACUAUGC GCG AAAGGAGAAU | 15452 |
| 7672 | AAAACAUCCU G UGGCA | 6113 | UGCCA UGAUG GCAUGCACUAUGC GCG AGGAUGUUUU | 15453 |

TABLE XVI

Human KDR NCH Ribozyme and Target Sequences

| Pos | Target | Seq ID No | Ribozyme Sequence | Seq ID No. |
|---|---|---|---|---|
| 11 | CAAGGUGC U GCUGGCCG | 6114 | CGGCCAGC CUGAUGAGGCCGUUAGGCCGAA ICACCUUG | 15454 |
| 14 | GGUGCUGC U GGCCGUCG | 6115 | CGACGGCC CUGAUGAGGCCGUUAGGCCGAA ICAGCACC | 15455 |
| 18 | CUGCUGGC C GUCGCCCU | 6116 | AGGGCGAC CUGAUGAGGCCGUUAGGCCGAA ICCAGCAG | 15456 |
| 24 | GCCGUCGC C CUGUGGCU | 6117 | AGCCACAG CUGAUGAGGCCGUUAGGCCGAA ICGACGGC | 15457 |
| 25 | CCGUCGCC C UGUGGCUC | 6118 | GAGCCACA CUGAUGAGGCCGUUAGGCCGAA IGCGACGG | 15458 |
| 26 | CGUCGCCC U GUGGCUCU | 6119 | AGAGCCAC CUGAUGAGGCCGUUAGGCCGAA IGGCGACG | 15459 |
| 32 | CCUGUGGC U CUGCGUGG | 6120 | CCACGCAG CUGAUGAGGCCGUUAGGCCGAA ICCACAGG | 15460 |
| 34 | UGUGGCUC U GCGUGGAG | 6121 | CUCCACGC CUGAUGAGGCCGUUAGGCCGAA IAGCCACA | 15461 |
| 45 | GUGGAGAC C CGGGCCGC | 6122 | GCGGCCCG CUGAUGAGGCCGUUAGGCCGAA IUCUCCAC | 15462 |
| 46 | UGGAGACO C GGGCCGCC | 6123 | GGCGGCCC CUGAUGAGGCCGUUAGGCCGAA IGUCUCCA | 15463 |
| 51 | ACCCGGGC C GCCUCUGU | 6124 | ACAGAGGC CUGAUGAGGCCGUUAGGCCGAA ICCCGGGU | 15464 |
| 54 | CGGGCCGC C UCUGUGGG | 6125 | CCCACAGA CUGAUGAGGCCGUUAGGCCGAA ICGGCCCG | 15465 |
| 55 | GGGCCGCC U CUGUGGGU | 6126 | ACCCACAG CUGAUGAGGCCGUUAGGCCGAA IGCGGCCC | 15466 |
| 57 | GCCGCCUC U GUGGGUUU | 6127 | AAACCCAC CUGAUGAGGCCGUUAGGCCGAA IAGGCGGC | 15467 |
| 68 | GGGUUUGC C UAGUGUUU | 6128 | AAACACUA CUGAUGAGGCCGUUAGGCCGAA ICAAACCC | 15468 |
| 69 | GGUUUGCC U AGUGUUUC | 6129 | GAAACACU CUGAUGAGGCCGUUAGGCCGAA IGCAAACC | 15469 |
| 78 | AGUGUUUC U CUUGAUCU | 6130 | AGAUCAAG CUGAUGAGGCCGUUAGGCCGAA IAAACACU | 15470 |
| 80 | UGUUUCUC U UGAUCUGC | 6131 | GCAGAUCA CUGAUGAGGCCGUUAGGCCGAA IAGAAACA | 15471 |
| 86 | UCIUGAUC U GCCCAGGC | 6132 | GCCUGGGC CUGAUGAGGCCGUUAGGCCGAA IAUCAAGA | 15472 |
| 89 | UGAUCUGC C CAGUCUCA | 6133 | UGAGCCUG CUGAUGAGGCCGUUAGGCCGAA ICAGAUCA | 15473 |
| 90 | GAUCUGCC C AGGCUCAG | 6134 | CUGAGCCU CUGAUGAGGCCGUUAGGCCGAA IGCAGAUC | 15474 |
| 91 | AUCUGCCC A GGCUCAGC | 6135 | GCUGAGCC CUGAUGAGGCCGUUAGGCCGAA IGGCAGAU | 15475 |
| 95 | GCCCAGGC U CAGCAUAC | 6136 | GUAUGCUG CUGAUGAGGCCGUUAGGCCGAA ICCUGGGC | 15476 |
| 97 | CCAGGCUC A GCAUACAA | 6137 | UUGUAUGC CUGAUGAGGCCGUUAGGCCGAA IAGCCUGG | 15477 |
| 100 | GGCUCAGC A UACAAAAA | 6138 | UUUUUGUA CUGAUGAGGCCGUUAGGCCGAA ICUGAGCC | 15478 |
| 104 | CAGCAUAC A AAAAGACA | 6139 | UGUCUUUU CUGAUGAGGCCGUUAGGCCGAA IUAUGCUG | 15479 |
| 112 | AAAAAGAC A UACUUACA | 6140 | UGUAAGUA CUGAUGAGGCCGUUAGGCCGAA IUCUUUUU | 15480 |
| 116 | AGACAUAC U UACAAUUA | 6141 | UAAUUGUA CUGAUGAGGCCGUUAGGCCGAA IUAUGUCU | 15481 |
| 120 | AUACUUAC A AUUAAGGC | 6142 | GCCUUAAU CUGAUGAGGCCGUUAGGCCGAA IUAAGUAU | 15482 |
| 129 | AUUAAGGC U AAUACAAC | 6143 | GUUGUAUU CUGAUGAGGCCGUUAGGCCGAA ICCUUAAU | 15483 |
| 135 | GCUAAUAC A ACUCUUCA | 6144 | UGAAGAGU CUGAUGAGGCCGUUAGGCCGAA IUAUUAGC | 15484 |
| 138 | AAUACAAC U CUUCAAAU | 6145 | AUUUGAAG CUGAUGAGGCCGUUAGGCCGAA IUUGUAUU | 15485 |
| 140 | UACAACUC U UCAAAUUA | 6146 | UAAUUUGA CUGAUGAGGCCGUUAGGCCGAA IAGUUGUA | 15486 |
| 143 | AACUCUUC A AAUUACUU | 6147 | AAGUAAUU CUGAUGAGGCCGUUAGGCCGAA IAAGAGUU | 15487 |
| 150 | CAAAUUAC U UGCAGGGG | 6148 | CCCCUGCA CUGAUGAGGCCGUUAGGCCGAA IUAAUUUG | 15488 |
| 154 | UUACUUGC A GGGGACAG | 6149 | CUGUCCCC CUGAUGAGGCCGUUAGGCCGAA ICAAGUAA | 15489 |
| 161 | CAGGGGAC A GAGGGACU | 6150 | AGUCCCUC CUGAUGAGGCCGUUAGGCCGAA IUCCCCUG | 15490 |

TABLE XVI-continued

Human KDR NCH Ribozyme and Target Sequences

| Pos | Target | Seq ID No | Ribozyme Sequence | Seq ID No. |
|---|---|---|---|---|
| 169 | AGAGGGAC U UGGACUGG | 6151 | CCAGUCCA CUGAUGAGgccguuaggCCGAA IUCCCUCU | 15491 |
| 175 | ACUUGGAC U GGCUUUGG | 6152 | CCAAAGCC CUGAUGAGgccguuaggCCGAA IUCCAAGU | 15492 |
| 179 | GGACUGGC U JUGGCCCA | 6153 | UGGGCCAA CUGAUGAGgccguuaggCCGAA ICCAGUCC | 15493 |
| 185 | GCUUUGGC C CAAUAAUC | 6154 | GAUUAUUG CUGAUGAGgccguuaggCCGAA ICCAAAGC | 15494 |
| 186 | CUUUGGCC C AAUAAUCA | 6155 | UGAUUAUU CUGAUGAGgccguuaggCCGAA IGCCAAAG | 15495 |
| 187 | UUUGGCCC A AUAAUCAG | 6156 | CUGAUUAU CUGAUGAGgccguuaggCCGAA IGGCCAAA | 15496 |
| 194 | CAAUAAUC A GAGUGGCA | 6157 | UGCCACUC CUGAUGAGgccguuaggCCGAA IAUUAUUG | 15497 |
| 202 | AGAGUGGC A GUGAGCAA | 6158 | UUGCUCAC CUGAUGAGgccguuaggCCGAA ICCACUCU | 15498 |
| 209 | CAGUGAGC A AAGGGUGG | 6159 | CCACCCUU CUGAUGAGgccguuaggCCGAA ICUCACUG | 15499 |
| 225 | GAGGUGAC U GAGUGCAG | 6160 | CUGCACUC CUGAUGAGgccguuaggCCGAA IUCACCUC | 15500 |
| 232 | CUGAGUGC A GCGAUGGC | 6161 | GCCAUCGC CUGAUGAGgccguuaggCCGAA ICACUCAG | 15501 |
| 241 | GCGAUGGC C UCUUCUGU | 6162 | ACAGAAGA CUGAUGAGgccguuaggCCGAA ICCAUCGC | 15502 |
| 242 | CGAUGGCC U CUUCUGUA | 6163 | UACAGAAG CUGAUGAGgccguuaggCCGAA IGCCAUCG | 15503 |
| 244 | AUGGCCUC U UCUGUAAG | 6164 | CUUACAGA CUGAUGAGgccguuaggCCGAA IAGGCCAU | 15504 |
| 247 | GCCUCUUC U GUAAGACA | 6165 | UGUCUUAC CUGAUGAGgccguuaggCCGAA IAAGAGGC | 15505 |
| 255 | UGUAAGAC A CUCACAAU | 6166 | AUUGUGAG CUGAUGAGgccguuaggCCGAA IUCUUACA | 15506 |
| 257 | UAAGACAC U CACAAUUC | 6167 | GAAUUGUG CUGAUGAGgccguuaggCCGAA IUGUCUUA | 15507 |
| 259 | AGACACUC A CAAUUCCA | 6168 | UGGAAUUG CUGAUGAGgccguuaggCCGAA IAGUGUCU | 15508 |
| 261 | ACACUCAC A AUUCCAAA | 6169 | UUUGGAAU CUGAUGAGgccguuaggCCGAA IUGAGUGU | 15509 |
| 266 | CACAAUUC C AAAAGUGA | 6170 | UCACUUEU CUGAUGAGgccguuaggCCGAA IAAUUGUG | 15510 |
| 267 | ACAAUUCC A AAAGUGAU | 6171 | AUCACUUU CUGAUGAGgccguuaggCCGAA IGAAUUGU | 15511 |
| 286 | GAAAUGAC A CUGGAGCC | 6172 | GGCUCCAG CUGAUGAGgccguuaggCCGAA IUCAUUUC | 15512 |
| 288 | AAUGACAC U GGAGCCUA | 6173 | UAGGCUCC CUGAUGAGgccguuaggCCGAA IUGUCAUU | 15513 |
| 294 | ACUGGAGC C UACAAGUG | 6174 | CACUUGUA CUGAUGAGgccguuaggCCGAA ICUCCAGU | 15514 |
| 295 | CUGGAGCC U ACAAGUGC | 6175 | GCACUUGU CUGAUGAGgccguuaggCCGAA IGCUCCAG | 15515 |
| 298 | GAGCCUAC A AGUGCUUC | 6176 | GAAGCACU CUGAUGAGgccguuaggCCGAA IUAGGCUC | 15516 |
| 304 | ACAAGUGC U UCUACCGG | 6177 | CCGGUAGA CUGAUGAGgccguuaggCCGAA ICACUUGU | 15517 |
| 307 | AGUGCUUC U ACCGGGAA | 6178 | UUCCCGGU CUGAUGAGgccguuaggCCGAA IAAGCACU | 15518 |
| 310 | GCUUCUAC C GGGAAACU | 6179 | AGUUUCCC CUGAUGAGgccguuaggCCGAA IUAGAAGC | 15519 |
| 318 | CGGGAAAC U GACUUGGC | 6180 | GCCAAGUC CUGAUGAGgccguuaggCCGAA IUUUCCCG | 15520 |
| 322 | AAACUGAC U UGGCCUCG | 6181 | CGAGGCCA CUGAUGAGgccguuaggCCGAA IUCAGUUU | 15521 |
| 327 | GACUUGGC C UCGGUCAU | 6182 | AUGACCGA CUGAUGAGgccguuaggCCGAA ICCAAGUC | 15522 |
| 328 | ACUUGGCC U CGGUCAUU | 6183 | AAUGACCG CUGAUGAGgccguuaggCCGAA IGCCAAGU | 15523 |
| 334 | CCUCGGUC A UUUAUGUC | 6184 | GACAUAAA CUGAUGAGgccguuaggCCGAA IACCGAGG | 15524 |
| 343 | UUUAUGUC U AUGUUCAA | 6185 | UUGAACAU CUGAUGAGgccguuaggCCGAA IACAUAAA | 15525 |
| 350 | CUAUGUUC A AGAUUACA | 6186 | UGUAAUCU CUGAUGAGgccguuaggCCGAA IAACAUAG | 15526 |
| 358 | AAGAUUAC A GAUCUCCA | 6187 | UGGAGAUC CUGAUGAGgccguuaggCCGAA IUAAUCUU | 15527 |

TABLE XVI-continued

Human KDR NCH Ribozyme and Target Sequences

| Pos | Target | Seq ID No | Ribozyme Sequence | Seq ID No. |
|---|---|---|---|---|
| 363 | UACAGAUC U CCAUUUAU | 6188 | AUAAAUGG CUGAUGAGGCCGUUAGGCCGAA IAUCUGUA | 15528 |
| 365 | CAGAUCUC C AUUUAUUG | 6189 | CAAUAAAU CUGAUGAGGCCGUUAGGCCGAA IAGAUCUG | 15529 |
| 366 | AGAUCUCC A UUUAUUGC | 6190 | GCAAUAAA CUGAUGAGGCCGUUAGGCCGAA IGAGAUCU | 15530 |
| 375 | UUUAUUGC U UCUGUUAG | 6191 | CUAACAGA CUGAUGAGGCCGUUAGGCCGAA ICAAUAAA | 15531 |
| 378 | AUUGCUUC U GUUAGUGA | 6192 | UCACUAAC CUGAUGAGGCCGUUAGGCCGAA IAAGCAAU | 15532 |
| 388 | UUAGUGAC C AACAUGGA | 6193 | UCCAUGUU CUGAUGAGGCCGUUAGGCCGAA IUCACUAA | 15533 |
| 389 | UAGUGACC A ACAUGGAG | 6194 | CUCCAUGU CUGAUGAGGCCGUUAGGCCGAA IGUCACUA | 15534 |
| 392 | UGACCAAC A UGGAGUCG | 6195 | CGACUCCA CUGAUGAGGCCGUUAGGCCGAA IUUGGUCA | 15535 |
| 406 | UCGUGUAC A UUACUGAG | 6196 | CUCAGUAA CUGAUGAGGCCGUUAGGCCGAA IACACGA | 15536 |
| 411 | UACAUUAC U GAGAACAA | 6197 | UUGUUCUC CUGAUGAGGCCGUUAGGCCGAA IUAAUGUA | 15537 |
| 418 | CUGAGAAC A AAAACAAA | 6198 | UUUGUUUU CUGAUGAGGCCGUUAGGCCGAA IUUCUCAG | 15538 |
| 424 | ACAAAAAC A AAACUGUG | 6199 | CACAGUUU CUGAUGAGGCCGUUAGGCCGAA IUUUUUGU | 15539 |
| 429 | AACAAAAC U GUGGUGAU | 6200 | AUCACCAC CUGAUGAGGCCGUUAGGCCGAA IUUUUGUU | 15540 |
| 440 | GGUGAUUC C AUGUCUCG | 6201 | CGAGACAU CUGAUGAGGCCGUUAGGCCGAA IAAUCACC | 15541 |
| 441 | GUGAUUCC A UGUCUCGG | 6202 | CCGAGACA CUGAUGAGGCCGUUAGGCCGAA IGAAUCAC | 15542 |
| 446 | UCCAUGUC U CGGGUCCA | 6203 | UGGACCCG CUGAUGAGGCCGUUAGGCCGAA IACAUGGA | 15543 |
| 453 | CUCGGGUC C AUUUCAAA | 6204 | UUUGAAAU CUGAUGAGGCCGUUAGGCCGAA IACCCGAG | 15544 |
| 454 | UCGGGUCC A UUUCAAAU | 6205 | AUUUGAAA CUGAUGAGGCCGUUAGGCCGAA IGACCCGA | 15545 |
| 459 | UCCAUUUC A AAUCUCAA | 6206 | UUGAGAUU CUGAUGAGGCCGUUAGGCCGAA IAAAUGGA | 15546 |
| 464 | UUCAAAUC U CAACGUGU | 6207 | ACACGUUG CUGAUGAGGCCGUUAGGCCGAA IAUUUGAA | 15547 |
| 466 | CAAAUCUC A ACGUGUCA | 6208 | UGACACGU CUGAUGAGGCCGUUAGGCCGAA IAGAUUUG | 15548 |
| 474 | AACGUGUC A CUUUGUGC | 6209 | GCACAAAG CUGAUGAGGCCGUUAGGCCGAA IACACGUU | 15549 |
| 476 | CGUGUCAC U UUGUGCAA | 6210 | UUGCACAA CUGAUGAGGCCGUUAGGCCGAA IUGACACG | 15550 |
| 483 | CUUUGUGC A AGAUACCC | 6211 | GGGUAUCU CUGAUGAGGCCGUUAGGCCGAA ICACAAAG | 15551 |
| 490 | CAAGAUAC C CAGAAAAG | 6212 | CUUUUCUG CUGAUGAGGCCGUUAGGCCGAA ICAUCCUG | 15552 |
| 491 | AAGAUACC C AGAAAAGA | 6213 | UCUUUUCU CUGAUGAGGCCGUUAGGCCGAA IGUAUCUU | 15553 |
| 492 | AGAUACCC A GAAAAGAG | 6214 | CUCUUUUC CUGAUGAGGCCGUUAGGCCGAA IGGUAUCU | 15554 |
| 509 | AUUUGUUC C UGAUGGUA | 6215 | UACCAUCA CUGAUGAGGCCGUUAGGCCGAA IAACAAAU | 15555 |
| 510 | UUUGUUCC U GAUGGUAA | 6216 | UUACCAUC CUGAUGAGGCCGUUAGGCCGAA IGAACAAA | 15556 |
| 520 | AUGGUAAC A GAAUUUCC | 6217 | GGAAAUUC CUGAUGAGGCCGUUAGGCCGAA IUUACCAU | 15557 |
| 528 | AGAAUUUC C UGGGACAG | 6218 | CUGUCCCA CUGAUGAGGCCGUUAGGCCGAA IAAAUUCU | 15558 |
| 529 | GAAUUUCC U GGGACAGC | 6219 | GCUGUCCC CUGAUGAGGCCGUUAGGCCGAA IGAAAUUC | 15559 |
| 535 | CCUGGGAC A GCAAGAAG | 6220 | CUUCUUGC CUGAUGAGGCCGUUAGGCCGAA IUCCCAGG | 15560 |
| 538 | GGGACAGC A AGAAGGGC | 6221 | GCCCUUCU CUGAUGAGGCCGUUAGGCCGAA ICUGUCCC | 15561 |
| 547 | AGAAGGGC U UUACUAUU | 6222 | AAUAGUAA CUGAUGAGGCCGUUAGGCCGAA ICCCUUCU | 15562 |
| 552 | GGCUUUAC U AUUCCCAG | 6223 | CUGGGAAU CUGAUGAGGCCGUUAGGCCGAA IUAAAGCC | 15563 |
| 557 | UACUAUUC C CAGCUACA | 6224 | UGUAGCUG CUGAUGAGGCCGUUAGGCCGAA IAAUAGUA | 15564 |

TABLE XVI-continued

Human KDR NCH Ribozyme and Target Sequences

| Pos | Target | Seq ID No | Ribozyme Sequence | Seq ID No. |
|---|---|---|---|---|
| 558 | ACUAUUCC C AGCUACAU | 6225 | AUGUAGCU CUGAUGAGGCCGUUAGGCCGAA IGAAUAGU | 15565 |
| 559 | CUAUUCCC A GCUACAUG | 6226 | CAUGUAGC CUGAUGAGGCCGUUAGGCCGAA IGGAAUAG | 15566 |
| 562 | UUCCCAGC U ACAUGAUC | 6227 | GAUCAUGU CUGAUGAGGCCGUUAGGCCGAA ICUGGGAA | 15567 |
| 565 | CCAGCUAC A UGAUCAGC | 6228 | GCUGAUCA CUGAUGAGGCCGUUAGGCCGAA IUAGCUGG | 15568 |
| 571 | ACAUGAUC A GCUAUGCU | 6229 | AGCAUAGC CUGAUGAGGCCGUUAGGCCGAA IAUCAUGU | 15569 |
| 574 | UGAUCAGC U AUGCUGGC | 6230 | GCCAGCAU CUGAUGAGGCCGUUAGGCCGAA ICUGAUCA | 15570 |
| 579 | AGCUAUGC U GGCAUGGU | 6231 | ACCAUGCC CUGAUGAGGCCGUUAGGCCGAA ICAUAGCU | 15571 |
| 583 | AUGCUGGC A UGGUCUUC | 6232 | GAAGACCA CUGAUGAGGCCGUUAGGCCGAA ICCAGCAU | 15572 |
| 589 | GCAUGGUC U UCUGUGAA | 6233 | UUCACAGA CUGAUGAGGCCGUUAGGCCGAA IACCAUGC | 15573 |
| 592 | UGGUCUUC U GUGAAGCA | 6234 | UGCUUCAC CUGAUGAGGCCGUUAGGCCGAA IAAGACCA | 15574 |
| 600 | UGUGAAGC A AAAAUUAA | 6235 | UUAAUUUU CUGAUGAGGCCGUUAGGCCGAA ICUUCACA | 15575 |
| 622 | AAAGUUAC C AGUCUAUU | 6236 | AAUAGACU CUGAUGAGGCCGUUAGGCCGAA IUAACUUU | 15576 |
| 623 | AAGUUACC A GUCUAUUA | 6237 | UAAUAGAC CUGAUGAGGCCGUUAGGCCGAA IGUAACUU | 15577 |
| 627 | UACCAGUC U AUUAUGUA | 6238 | UACAUAAU CUGAUGAGGCCGUUAGGCCGAA IACUGGUA | 15578 |
| 637 | UUAUGUAC A UAGUUGUC | 6239 | GACAACUA CUGAUGAGGCCGUUAGGCCGAA IUACAUAA | 15579 |
| 677 | UGUGGUUC U GAGUCCGU | 6240 | ACGGACUC CUGAUGAGGCCGUUAGGCCGAA IAACCACA | 15580 |
| 683 | UCUGAGUC C GUCUCAUG | 6241 | CAUGAGAC CUGAUGAGGCCGUUAGGCCGAA IACUCAGA | 15581 |
| 687 | AGUCCGUC U CAUGGAAU | 6242 | AUUCCAUG CUGAUGAGGCCGUUAGGCCGAA IACGGACU | 15582 |
| 689 | UCCGUCUC A UGGAAUUG | 6243 | CAAUUCCA CUGAUGAGGCCGUUAGGCCGAA IAGACGGA | 15583 |
| 701 | AAUUGAAC U AUCUGUUG | 6244 | CAACAGAU CUGAUGAGGCCGUUAGGCCGAA IUUCAAUU | 15584 |
| 705 | GAACUAUC U GUUGGAGA | 6245 | UCUCCAAC CUGAUGAGGCCGUUAGGCCGAA IAUAGUUC | 15585 |
| 719 | AGAAAGC U UGUCUUAA | 6246 | UUAAGACA CUGAUGAGGCCGUUAGGCCGAA ICUUUUCU | 15586 |
| 724 | AGCUUGUC U UAAAUUGU | 6247 | ACAAUUUA CUGAUGAGGCCGUUAGGCCGAA IACAAGCU | 15587 |
| 735 | AAUUGUAC A GCAAGAAC | 6248 | GUUCUUGC CUGAUGAGGCCGUUAGGCCGAA IUACAAUU | 15588 |
| 738 | UGUACAGC A AGAACUGA | 6249 | UCAGUUCU CUGAUGAGGCCGUUAGGCCGAA ICUGUACA | 15589 |
| 744 | GCAAGAAC U GAACUAAA | 6250 | UUUAGUUC CUGAUGAGGCCGUUAGGCCGAA IUUCUUGC | 15590 |
| 749 | AACUGAAC U AAAUGUGG | 6251 | CCACAUUU CUGAUGAGGCCGUUAGGCCGAA IUUCAGUU | 15591 |
| 766 | GGAUUGAC U UCAACGG | 6252 | CCAGUUGA CUGAUGAGGCCGUUAGGCCGAA IUCAAUCC | 15592 |
| 769 | UUGACUUC A ACGGGAA | 6253 | UUCCCAGU CUGAUGAGGCCGUUAGGCCGAA IAAGUCAA | 15593 |
| 772 | ACUUCAAC U GGGAAUAC | 6254 | GUAUUCCC CUGAUGAGGCCGUUAGGCCGAA IUUGAAGU | 15594 |
| 781 | GGGAAUAC C UUCUUCG | 6255 | CGAAGAAG CUGAUGAGGCCGUUAGGCCGAA IAUUCCC | 15595 |
| 782 | GGAAUACC C UUCUUCGA | 6256 | UCGAAGAA CUGAUGAGGCCGUUAGGCCGAA IGUAUUCC | 15596 |
| 783 | GAAUACCC U UCUUCGAA | 6257 | UUCGAAGA CUGAUGAGGCCGUUAGGCCGAA IGGUAUUC | 15597 |
| 786 | UACCCUUC U UCGAAGCA | 6258 | UGCUUCGA CUGAUGAGGCCGUUAGGCCGAA IAAGGGUA | 15598 |
| 794 | UUCGAAGC A UCAGCAUA | 6259 | UAUGCUGA CUGAUGAGGCCGUUAGGCCGAA ICUUCGAA | 15599 |
| 797 | GAAGCAUC A GCAUAAGA | 6260 | UCUUAUGC CUGAUGAGGCCGUUAGGCCGAA IAUGCUUC | 15600 |
| 800 | GCAUCAGC A UAAGAAAC | 6261 | GUUUCUUA CUGAUGAGGCCGUUAGGCCGAA ICUGAUGC | 15601 |

TABLE XVI-continued

Human KDR NCH Ribozyme and Target Sequences

| Pos | Target | Seq ID No | Ribozyme Sequence | Seq ID No. |
|---|---|---|---|---|
| 809 | UAAGAAAC U UGUAAACC | 6262 | GGUUUACA CUGAUGAGGCCGUUAGGCCGAA IUUUCUUA | 15602 |
| 817 | UUGUAAAC C CAGACCUA | 6263 | UAGGUCUC CUGAUGAGGCCGUUAGGCCGAA IUUUACAA | 15603 |
| 823 | ACCGAGAC C UAAAAACC | 6264 | GGUUUUUA CUGAUGAGGCCGUUAGGCCGAA IUCUCGGU | 15604 |
| 824 | CCGAGACC U AAAAACCC | 6265 | GGGUUUUU CUGAUGAGGCCGUUAGGCCGAA IGUCUCGG | 15605 |
| 831 | CUAAAAAC C CAGUCUGG | 6266 | CCAGACUG CUGAUGAGGCCGUUAGGCCGAA IUUUUUAG | 15606 |
| 832 | UAAAAACC C AGUCUGGG | 6267 | CCCAGACU CUGAUGAGGCCGUUAGGCCGAA IGUUUUUA | 15607 |
| 833 | AAAAACCC A GUCUGGGA | 6268 | UCCCAGAC CUGAUGAGGCCGUUAGGCCGAA IGGUUUUU | 15608 |
| 837 | ACCCAGUC U GGGAGUGA | 6269 | UCACUCCC CUGAUGAGGCCGUUAGGCCGAA IACUGGGU | 15609 |
| 865 | UUUUGAGC A CCUUAACU | 6270 | AGUUAAGG CUGAUGAGGCCGUUAGGCCGAA ICUCAAAA | 15610 |
| 867 | UUGAGCAC C UUAACUAU | 6271 | AUAGUUAA CUGAUGAGGCCGUUAGGCCGAA IUGCUCAA | 15611 |
| 868 | UGAGCACC U UAACUAUA | 6272 | UAUAGUUA CUGAUGAGGCCGUUAGGCCGAA IGUGCUCA | 15612 |
| 873 | ACCUUAAC U AUAGAUGG | 6273 | CCAUCUAU CUGAUGAGGCCGUUAGGCCGAA IUUAAGGU | 15613 |
| 888 | GGUGUAAC C CGGAGUGA | 6274 | UCACUCCG CUGAUGAGGCCGUUAGGCCGAA IUUACACC | 15614 |
| 889 | GUGUAACC C CGAGUGAC | 6275 | GUCACUCC CUGAUGAGGCCGUUAGGCCGAA IGUUACAC | 15615 |
| 898 | GGAGUGAC C AAGGAUUG | 6276 | CAAUCCUU CUGAUGAGGCCGUUAGGCCGAA IUCACUCC | 15616 |
| 899 | GAGUGACC A AGGAUUGU | 6277 | ACAAUCCU CUGAUGAGGCCGUUAGGCCGAA ICUCACUC | 15617 |
| 910 | GAUUGUAC A CCUGUGCA | 6278 | UGCACAGG CUGAUGAGGCCGUUAGGCCGAA IUACAAUC | 15618 |
| 912 | UUGUACAC C UGUGCAGC | 6279 | GCUGCACA CUGAUGAGGCCGUUAGGCCGAA IUGUACAA | 15619 |
| 913 | UGUACACC U GUGCAGCA | 6280 | UGCUGCAC CUGAUCAGGCCGUUAGGCCGAA IGUGUACA | 15620 |
| 918 | ACCUGUGC A GCAUCCAG | 6281 | CUGGAUGC CUGAUGAGGCCGUUAGGCCGAA ICACAGGU | 15621 |
| 921 | UGUGCAGC A UCCAGUGG | 6282 | CCACUGGA CUGAUGAGGCCGUUAGGCCGAA ICUGCACA | 15622 |
| 924 | GCAGCAUC C AGUGGGCU | 6283 | AGCCCACU CUGAUGAGGCCGUUAGGCCGAA IAUGCUGC | 15623 |
| 925 | CAGCAUCC A GUGGGCUG | 6284 | CAGCCCAC CUGAUGAGGCCGUUAGGCCGAA IGAUGCUG | 15624 |
| 932 | CAGUGGGC U GAUGACCA | 6285 | UGGUCAUC CUGAUGAGGCCGUUAGGCCGAA ICCCACUG | 15625 |
| 939 | CUGAUGAC C AAGAAGAA | 6286 | UUCUUCUU CUGAUGAGGCCGUUAGGCCGAA IUCAUCAG | 15626 |
| 940 | UGAUGACC A AGAAGAAC | 6287 | GUUCUUCU CUGAUGAGGCCGUUAGGCCGAA IGUCAUCA | 15627 |
| 949 | AGAAGAAC A GCACAUUU | 6288 | AAAUGUGC CUGAUGAGGCCGUUAGGCCGAA IUUCUUCU | 15628 |
| 952 | AGAACAGC A CAUUUGUC | 6289 | GACAAAUG CUGAUGAGGCCGUUAGGCCGAA ICUGUUCU | 15629 |
| 954 | AACAGCAC A UUUGUCAG | 6290 | CUGACAAA CUGAUGAGGCCGUUAGGCCGAA IUGCUGUU | 15630 |
| 961 | CAUUUGUC A GGGUCCAU | 6291 | AUGGACCC CUGAUGAGGCCGUUAGGCCGAA IACAAAUG | 15631 |
| 967 | UCAGGGUC C AUGAAAAA | 6292 | UUUUUCAU CUGAUGAGGCCGUUAGGCCGAA IACCCUGA | 15632 |
| 968 | CAGGGUCC A UGAAAAAC | 6293 | GUUUUUCA CUGAUGAGGCCGUUAGGCCGAA IGACCCUG | 15633 |
| 977 | UGAAAAAC C UUUGUUG | 6294 | CAACAAAA CUGAUGAGGCCGUUAGGCCGAA IUUUUUCA | 15634 |
| 978 | GAAAAACC U UUGUUGC | 6295 | GCAACAAA CUGAUGAGGCCGUUAGGCCGAA IGUUUUUC | 15635 |
| 987 | UUUGUUGC U UUGGAAG | 6296 | CUUCCAAA CUGAUGAGGCCGUUAGGCCGAA ICAACAAA | 15636 |
| 1000 | GAAGUGGC A UGGAAUCU | 6297 | AGAUUCCA CUGAUGAGGCCGUUAGGCCGAA ICCACUUC | 15637 |
| 1008 | AUGGAAUC U CUGGUGGA | 6298 | UCCACCAG CUGAUGAGGCCGUUAGGCCGAA IAUUCCAU | 15638 |

TABLE XVI-continued

Human KDR NCH Ribozyme and Target Sequences

| Pos | Target | Seq ID No | Ribozyme Sequence | Seq ID No. |
|---|---|---|---|---|
| 1010 | GGAAUCUC U GGUGGAAG | 6299 | CUUCCACC CUGAUGAGGCCGUUAGGCCGAA IAGAUUCC | 15639 |
| 1020 | GUGGAAGC C ACGGUGGG | 6300 | CCCACCGU CUGAUGAGGCCGUUAGGCCGAA ICUUCCAC | 15640 |
| 1021 | UGGAAGCC A CGGUGGGG | 6301 | CCCCACCG CUGAUGAGGCCGUUAGGCCGAA IGCUUCCA | 15641 |
| 1039 | AGCGUGUC A GAAUCCCU | 6302 | AGGGAUUC CUGAUGAGGCCGUUAGGCCGAA IACACGCU | 15642 |
| 1045 | UCAGAAUC C CUGCGAAG | 6303 | CUUCGCAG CUGAUGAGGCCGUUAGGCCGAA IAUUCUGA | 15643 |
| 1046 | CAGAAUCC C UGCGAAGU | 6304 | ACUUCGCA CUGAUGAGGCCGUUAGGCCGAA IGAUUCUG | 15644 |
| 1047 | AGAAUCCC U GCGAAGUA | 6305 | UACUUCGC CUGAUGAGGCCGUUAGGCCGAA IGGAUUCU | 15645 |
| 1057 | CGAAGUAC C UUGGUUAC | 6306 | GUAACCAA CUGAUGAGGCCGUUAGGCCGAA IACUUCG | 15646 |
| 1058 | GAAGUACC U UGGUUACC | 6307 | GGUAACCA CUGAUGAGGCCGUUAGGCCGAA IGUACUUC | 15647 |
| 1066 | UUGGUUAC C CACCCCCA | 6308 | UGGGGGUG CUGAUGAGGCCGUUAGGCCGAA IUAACCAA | 15648 |
| 1067 | UGGUUACC C ACCCCCAG | 6309 | CUGGGGGU CUGAUGAGGCCGUUAGGCCGAA IGUAACCA | 15649 |
| 1068 | GGUUACCC A CCCCCAGA | 6310 | UCUGGGGG CUGAUGAGGCCGUUAGGCCGAA IGGUAACC | 15650 |
| 1070 | UUACCCAC C CCCAGAAA | 6311 | UUUCUGGG CUGAUGAGGCCGUUAGGCCGAA IUGGGUAA | 15651 |
| 1071 | UACCCACC C CAGAAAU | 6312 | AUUUCUGG CUGAUGAGGCCGUUAGGCCGAA IGUGGGUA | 15652 |
| 1072 | ACCCACCC C AGAAAUA | 6313 | UAUUUCUG CUGAUGAGGCCGUUAGGCCGAA IGGUGGGU | 15653 |
| 1073 | CCCACCCC C AGAAAUAA | 6314 | UUAUUUCU CUGAUGAGGCCGUUAGGCCGAA IGGGUGGG | 15654 |
| 1074 | CCACCCCC A GAAAUAAA | 6315 | UUUAUUUC CUGAUGAGGCCGUUAGGCCGAA IGGGGUGG | 15655 |
| 1103 | UGGAAUAC C CUUGAGU | 6316 | ACUCAAGG CUGAUGAGGCCGUUAGGCCGAA IUAUUCCA | 15656 |
| 1104 | GGAAUACC C UUGAGUC | 6317 | GACUCAAG CUGAUGAGGCCGUUAGGCCGAA IGUAUUCC | 15657 |
| 1105 | GAAUACCC C UUGAGUCC | 6318 | GGACUCAA CUGAUGAGGCCGUUAGGCCGAA IGGUAUUC | 15658 |
| 1106 | AAUACCCC U UGAGUCCA | 6319 | UGGACUCA CUGAUGAGGCCGUUAGGCCGAA IGGGUAUU | 15659 |
| 1113 | CUUGAGUC C AAUCACAC | 6320 | GUGUGAUU CUGAUGAGGCCGUUAGGCCGAA IACUCAAG | 15660 |
| 1114 | UUGAGUCC A AUCACACA | 6321 | UGUGUGAU CUGAUGAGGCCGUUAGGCCGAA IGACUCAA | 15661 |
| 1118 | GUCCAAUC A CACAAUUA | 6322 | UAAUUGUG CUGAUGAGGCCGUUAGGCCGAA IAUUGGAC | 15662 |
| 1120 | CCAAUCAC A CAAUUAAA | 6323 | UUUAAUUG CUGAUGAGGCCGUUAGGCCGAA IUGAUUGG | 15663 |
| 1122 | AAUCACAC A AUUAAAGC | 6324 | GCUUUAAU CUGAUGAGGCCGUUAGGCCGAA IUGUGAUU | 15664 |
| 1136 | AGCGGGGC A UGUACUGA | 6325 | UCAGUACA CUGAUGAGGCCGUUAGGCCGAA ICCCCGCU | 15665 |
| 1142 | GCAUGUAC U GACGAUUA | 6326 | UAAUCGUC CUGAUGAGGCCGUUAGGCCGAA IUACAUGC | 15666 |
| 1171 | AAAGAGAC A CAGGAAAU | 6327 | AUUUCCUG CUGAUGAGGCCGUUAGGCCGAA IUCUCUUU | 15667 |
| 1173 | AGAGACAC A GGAAAUUA | 6328 | UAAUUUCC CUGAUGAGGCCGUUAGGCCGAA IGUGUCUCU | 15668 |
| 1183 | GAAAUUAC A CUGUCAUC | 6329 | GAUGACAG CUGAUGAGGCCGUUAGGCCGAA IUAAUUUC | 15669 |
| 1185 | AAUUACAC U GUCAUCCU | 6330 | AGGAUGAC CUGAUGAGGCCGUUAGGCCGAA IGUAAUU | 15670 |
| 1189 | ACACUGUC A UCCUUACC | 6331 | GGUAAGGA CUGAUGAGGCCGUUAGGCCGAA IACAGUGU | 15671 |
| 1192 | CUGUCAUC C UUACCAAU | 6332 | AUUGGUAA CUGAUGAGGCCGUUAGGCCGAA IAUGACAG | 15672 |
| 1193 | UGUCAUCC U UACCAAUC | 6333 | GAUUGGUA CUGAUGAGGCCGUUAGGCCGAA IGAUGACA | 15673 |
| 1197 | AUCCUUAC C AAUCCCAU | 6334 | AUGGGAUU CUGAUGAGGCCGUUAGGCCGAA IUAAGGAU | 15674 |
| 1198 | UCCUUACC A AUCCCAUU | 6335 | AAUGGGAU CUGAUGAGGCCGUUAGGCCGAA IGUAAGGA | 15675 |

TABLE XVI-continued

Human KDR NCH Ribozyme and Target Sequences

| Pos | Target | Seq ID No | Ribozyme Sequence | Seq ID No. |
|---|---|---|---|---|
| 1202 | UACCAAUC C CAUUUCAA | 6336 | UUGAAAUG CUGAUGAGGCCGUUAGGCCGAA IAUUGGUA | 15676 |
| 1203 | ACCAAUCC C AUUUCAAA | 6337 | UUUGAAAU CUGAUGAGGCCGUUAGGCCGAA IGAUUGGU | 15677 |
| 1204 | CCAAUCCC A UUUCAAAG | 6338 | CUUUGAAA CUGAUGAGGCCGUUAGGCCGAA IGGAUUGG | 15678 |
| 1209 | CCCAUUUC A AAGGAGAA | 6339 | UUCUCCUU CUGAUGAGGCCGUUAGGCCGAA IAAAUGGG | 15679 |
| 1220 | GGAGAAGC A GAGCCAUG | 6340 | CAUGGCUC CUGAUGAGGCCGUUAGGCCGAA ICUUCUCC | 15680 |
| 1225 | AGCAGAGC C AUGGGUC | 6341 | GACCACAU CUGAUGAGGCCGUUAGGCCGAA ICUCUGCU | 15681 |
| 1226 | GCAGAGCC A UGUGGCU | 6342 | AGACCACA CUGAUGAGGCCGUUAGGCCGAA IGCUCUGC | 15682 |
| 1234 | AUGUGGUC U CUCUGGUU | 6343 | AACCAGAG CUGAUGAGGCCGUUAGGCCGAA IACCACAU | 15683 |
| 1236 | GUGGUCUC U CUGGUUGU | 6344 | ACAACCAG CUGAUGAGGCCGUUAGGCCGAA IAGACCAC | 15684 |
| 1238 | GGUCUCUC U GGUUGUGU | 6345 | ACACAACC CUGAUGAGGCCGUUAGGCCGAA IAGAGACC | 15685 |
| 1252 | UGUAUGUC C CACCCCAG | 6346 | CUGGGGUG CUGAUGAGGCCGUUAGGCCGAA IACAUACA | 15686 |
| 1253 | GUAUGUCC C ACCCCAGA | 6347 | UCUGGGGU CUGAUGAGGCCGUUAGGCCGAA IGACAUAC | 15687 |
| 1254 | UAUGUCCC A CCCCAGAU | 6348 | AUCUGGGG CUGAUGAGGCCGUUAGGCCGAA IGGACAUA | 15688 |
| 1256 | UGUCCCAC C CCAGAUUG | 6349 | CAAUCUGG CUGAUGAGGCCGUUAGGCCGAA IUGGGACA | 15689 |
| 1257 | GUCCCACC C CAGAUUGG | 6350 | CCAAUCUG CUGAUGAGGCCGUUAGGCCGAA IGUGGGAC | 15690 |
| 1258 | UCCCACCC C AGAUUGGU | 6351 | ACCAAUCU CUGAUGAGGCCGUUAGGCCGAA IGGUGGGA | 15691 |
| 1259 | CCCACCCC A GAUUGGUG | 6352 | CACCAAUC CUGAUGAGGCCGUUAGGCCGAA IGGGUGUG | 15692 |
| 1275 | GAGAAAUC U CUAAUCUC | 6353 | GAGAUUAG CUGAUGAGGCCGUUAGGCCGAA IAUUUCUC | 15693 |
| 1277 | GAAAUCUC U AAUCUCUC | 6354 | GAGAGAUU CUGAUGAGGCCGUUAGGCCGAA IAGAUUUC | 15694 |
| 1282 | CUCUAAUC U CUCCUGUG | 6355 | CACAGGAG CUGAUGAGGCCGUUAGGCCGAA IAUUAGAG | 15695 |
| 1284 | CUAAUCUC U CCUGUGGA | 6356 | UCCACAGG CUGAUGAGGCCGUUAGGCCGAA IAGAUUAG | 15696 |
| 1286 | AAUCUCUC C UGGGAUU | 6357 | AAUCCACA CUGAUGAGGCCGUUAGGCCGAA IAGAGAUU | 15697 |
| 1287 | AUCUCUCC U GGGAUUC | 6358 | GAAUCCAC CUGAUGAGGCCGUUAGGCCGAA IGAGAGAU | 15698 |
| 1296 | GUGGAUUC C UACCAGUA | 6359 | UACUGGUA CUGAUGAGGCCGUUAGGCCGAA IAAUCCAC | 15699 |
| 1297 | UGGAUUCC U ACCAGUAC | 6360 | GUACUGGU CUGAUGAGGCCGUUAGGCCGAA IGAAUCCA | 15700 |
| 1300 | AUUCCUAC C AGUACGGC | 6361 | GCCGUACU CUGAUGAGGCCGUUAGGCCGAA IUAGGAAU | 15701 |
| 1301 | UUCCUACC A GUACGGCA | 6362 | UGCCGUAC CUGAUGAGGCCGUUAGGCCGAA IGUAGGAA | 15702 |
| 1309 | AGUACGGC A CCACUCAA | 6363 | UUGAGUGG CUGAUGAGGCCGUUAGGCCGAA ICCGUACU | 15703 |
| 1311 | UACGGCAC C ACUCAAAC | 6364 | GUUUGAGU CUGAUGAGGCCGUUAGGCCGAA IUGCCGUA | 15704 |
| 1312 | ACGGCACC A CUCAAACG | 6365 | CGUUUGAG CUGAUGAGGCCGUUAGGCCGAA IGUGCCGU | 15705 |
| 1314 | GGCACCAC U CAAACGCU | 6366 | AGCGUUUG CUGAUGAGGCCGUUAGGCCGAA IUGGUGCC | 15706 |
| 1316 | CACCACUC A AACGCUGA | 6367 | UCAGCGUU CUGAUGAGGCCGUUAGGCCGAA IAGUGGUG | 15707 |
| 1322 | UCAAACGC U GACAUGUA | 6368 | UACAUGUC CUGAUGAGGCCGUUAGGCCGAA ICGUUUGA | 15708 |
| 1326 | ACGCUGAC A UGUACGGU | 6369 | ACCGUACA CUGAUGAGGCCGUUAGGCCGAA IUCAGCGU | 15709 |
| 1336 | GUACGGUC U AUGCCAUU | 6370 | AAUGGCAU CUGAUGAGGCCGUUAGGCCGAA IACCGUAC | 15710 |
| 1341 | GUCUAUGC C AUUCCUCC | 6371 | GGAGGAAU CUGAUGAGGCCGUUAGGCCGAA ICAUAGAC | 15711 |
| 1342 | UCUAUGCC A UUCCUCCC | 6372 | GGGAGGAA CUGAUGAGGCCGUUAGGCCGAA IGCAUAGA | 15712 |

TABLE XVI-continued

Human KDR NCH Ribozyme and Target Sequences

| Pos | Target | Seq ID No | Ribozyme Sequence | Seq ID No. |
|-----|--------|-----------|-------------------|------------|
| 1346 | UGCCAUUC C UCCCCCGC | 6373 | GCGGGGGA CUGAUGAGGCCGUUAGGCCGAA IAAUGGCA | 15713 |
| 1347 | GCCAUUCC U CCCCCGCA | 6374 | UGCGGGGG CUGAUGAGGCCGUUAGGCCGAA IGAAUGGC | 15714 |
| 1349 | CAUUCCUC C CCCGCAUC | 6375 | GAUGCGGG CUGAUGAGGCCGUUAGGCCGAA IAGGAAUG | 15715 |
| 1350 | AUUCCUCC C CCCCAUCA | 6376 | UGAUGCGG CUGAUGAGGCCGUUAGGCCGAA IGAGGAAU | 15716 |
| 1351 | UUCCUCCC C CCCAUCAC | 6377 | GUGAUGCG CUGAUGAGGCCGUUAGGCCGAA IGGAGGAA | 15717 |
| 1352 | UCCUCCCC C GCAUCACA | 6378 | UGUGAUGC CUGAUGAGGCCGUUAGGCCGAA IGGGAGGA | 15718 |
| 1355 | UCCCCCGC A UCACAUCC | 6379 | GGAUGUGA CUGAUGAGGCCGUUAGGCCGAA ICGGGGGA | 15719 |
| 1358 | CCCGCAUC A CAUCCACU | 6380 | AGUGGAUG CUGAUGAGGCCGUUAGGCCGAA IAUGCGGG | 15720 |
| 1360 | CGCAUCAC A UCCACUGG | 6381 | CCAGUGGA CUGAUGAGGCCGUUAGGCCGAA IUGAUGCG | 15721 |
| 1363 | AUCACAUC C ACUGGUAU | 6382 | AUACCAGU CUGAUGAGGCCGUUAGGCCGAA IAUGUGAU | 15722 |
| 1364 | UCACAUCC A CUGGUAUU | 6383 | AAUACCAG CUGAUGAGGCCGUUAGGCCGAA IGAUGUGA | 15723 |
| 1366 | ACAUCCAC U GGUAUUGG | 6384 | CCAAUACC CUGAUGAGGCCGUUAGGCCGAA IUGGAUGU | 15724 |
| 1376 | GUAUUGGC A GUUGGAGG | 6385 | CCUCCAAC CUGAUGAGGCCGUUAGGCCGAA ICCAAUAC | 15725 |
| 1395 | GAGUGCGC C AACGAGCC | 6386 | GGCUCGUU CUGAUGAGGCCGUUAGGCCGAA ICGCACUC | 15726 |
| 1396 | AGUGCGCC A ACGAGCCC | 6387 | GGGCUCGU CUGAUGAGGCCGUUAGGCCGAA IGCGCACU | 15727 |
| 1403 | CAACGAGC C CAGCCAAG | 6388 | CUUGGCUG CUGAUGAGGCCGUUAGGCCGAA ICUCGUUG | 15728 |
| 1404 | AACGAGCC C AGCCAAGC | 6389 | GCUUGGCU CUGAUGAGGCCGUUAGGCCGAA IGCUCGUU | 15729 |
| 1405 | ACGAGCCC A GCCAAGCU | 6390 | AGCUUGGC CUGAUGAGGCCGUUAGGCCGAA IGGCUCGU | 15730 |
| 1408 | AGCCCAGC C AAGCUGUC | 6391 | GACAGCUU CUGAUGAGGCCGUUAGGCCGAA ICUGGGCU | 15731 |
| 1409 | GCCCAGCC A AGCUGUCU | 6392 | AGACAGCU CUGAUGAGGCCGUUAGGCCGAA IGCUGGGC | 15732 |
| 1413 | AGCCAAGC U GUCUCAGU | 6393 | ACUGAGAC CUGAUGAGGCCGUUAGGCCGAA ICUUGGCU | 15733 |
| 1417 | AAGCUGUC U CAGUGACA | 6394 | UGUCACUG CUGAUGAGGCCGUUAGGCCGAA IACAGCUU | 15734 |
| 1419 | GCUGUCUC A GUGACAAA | 6395 | UUUGUCAC CUGAUGAGGCCGUUAGGCCGAA IAGACAGC | 15735 |
| 1425 | UCAGUGAC A AACCCAUA | 6396 | UAUGGGUU CUGAUGAGGCCGUUAGGCCGAA IUCACUGA | 15736 |
| 1429 | UGACAAAC C CAUACCCU | 6397 | AGGGUAUG CUGAUGAGGCCGUUAGGCCGAA IUUUGUCA | 15737 |
| 1430 | GACAAACC C AUACCCUU | 6398 | AAGGGUAU CUGAUGAGGCCGUUAGGCCGAA IGUUUGUC | 15738 |
| 1431 | ACAAACCC A UACCCUUG | 6399 | CAAGGGUA CUGAUGAGGCCGUUAGGCCGAA IGGUUUGU | 15739 |
| 1435 | ACCCAUAC C CUUGUGAA | 6400 | UUCACAAG CUGAUGAGGCCGUUAGGCCGAA IUAUGGGU | 15740 |
| 1436 | CCCAUACC C UUGUGAAG | 6401 | CUUCACAA CUGAUGAGGCCGUUAGGCCGAA IGUAUGGG | 15741 |
| 1437 | CCAUACCC U UGUGAAGA | 6402 | UCUUCACA CUGAUGAGGCCGUUAGGCCGAA IGGUAUGG | 15742 |
| 1465 | UGGAGGAC U UCCAGGGA | 6403 | UCCCUGGA CUGAUGAGGCCGUUAGGCCGAA IUCCUCCA | 15743 |
| 1468 | AGGACUUC C AGGGAGGA | 6404 | UCCUCCCU CUGAUGAGGCCGUUAGGCCGAA IAAGUCCU | 15744 |
| 1469 | GGACUUCC A GGGAGGAA | 6405 | UUCCUCCC CUGAUGAGGCCGUUAGGCCGAA IGAAGUCC | 15745 |
| 1502 | UAAAAAUC A AUUUGCUC | 6406 | GAGCAAAU CUGAUGAGGCCGUUAGGCCGAA IAUUUUUA | 15746 |
| 1509 | CAAUUUGC U CUAAUUGA | 6407 | UCAAUUAG CUGAUGAGGCCGUUAGGCCGAA ICAAAUUG | 15747 |
| 1511 | AUUUGCUC U AAUUGAAG | 6408 | CUUCAAUU CUGAUGAGGCCGUUAGGCCGAA IAGCAAAU | 15748 |
| 1528 | GAAAAAAC A AAACUGUA | 6409 | UACAGUUU CUGAUGAGGCCGUUAGGCCGAA IUUUUUUC | 15749 |

TABLE XVI-continued

Human KDR NCH Ribozyme and Target Sequences

| Pos | Target | Seq ID No | Ribozyme Sequence | Seq ID No. |
|---|---|---|---|---|
| 1533 | AACAAAAC U GUAAGUAC | 6410 | GUACUUAC CUGAUGAGGCCGUUAGGCCGAA IUUUUGUU | 15750 |
| 1542 | GUAAGUAC C CUUGUUAU | 6411 | AUAACAAG CUGAUGAGGCCGUUAGGCCGAA IUACUUAC | 15751 |
| 1543 | UAAGUACC C UUGUUAUC | 6412 | GAUAACAA CUGAUGAGGCCGUUAGGCCGAA IGUACUUA | 15752 |
| 1544 | AAGUACCC U UGUUAUCC | 6413 | GGAUAACA CUGAUGAGGCCGUUAGGCCGAA IGGUACUU | 15753 |
| 1552 | UUGUUAUC C AAGCGGCA | 6414 | UGCCGCUU CUGAUGAGGCCGUUAGGCCGAA IAUAACAA | 15754 |
| 1553 | UGUUAUCC A AGCGGCAA | 6415 | UUGCCGCU CUGAUGAGGCCGUUAGGCCGAA IGAUAACA | 15755 |
| 1560 | CAAGCGGC A AAUGUGUC | 6416 | GACACAUU CUGAUGAGGCCGUUAGGCCGAA ICCGCUUG | 15756 |
| 1569 | AAUGUGUC A GCUUUGUA | 6417 | UACAAAGC CUGAUGAGGCCGUUAGGCCGAA IACACAUU | 15757 |
| 1572 | GUGUCAGC U UUGUACAA | 6418 | UUGUACAA CUGAUGAGGCCGUUAGGCCGAA ICUGACAC | 15758 |
| 1579 | CUUUGUAC A AAUGUGAA | 6419 | UUCACAUU CUGAUGAGGCCGUUAGGCCGAA IUACAAAG | 15759 |
| 1594 | AAGCGGUC A ACAAAGUC | 6420 | GACUUUGU CUGAUGAGGCCGUUAGGCCGAA IACCGCUU | 15760 |
| 1597 | CGGUCAAC A AAGUCGGG | 6421 | CCCGACUU CUGAUGAGGCCGUUAGGCCGAA IUUGACCG | 15761 |
| 1624 | GGGUGAUC U CCUUCCAC | 6422 | GUGGAAGG CUGAUGAGGCCGUUAGGCCGAA IAUCACCC | 15762 |
| 1626 | GUGAUCUC C UUCCACGU | 6423 | ACGUGGAA CUGAUGAGGCCGUUAGGCCGAA IAGAUCAC | 15763 |
| 1627 | UGAUCUCC U UCCACGUG | 6424 | CACGUGGA CUGAUGAGGCCGUUAGGCCGAA IGAGAUCA | 15764 |
| 1630 | UCUCCUUC C ACGUGACC | 6425 | GGUCACGU CUGAUGAGGCCGUUAGGCCGAA IAAGGAGA | 15765 |
| 1631 | CUCCUUCC A CGUGACCA | 6426 | UGGUCACG CUGAUGAGGCCGUUAGGCCGAA IGAAGGAG | 15766 |
| 1638 | CACGUGAC C AGGGGUCC | 6427 | GGACCCCU CUGAUGAGGCCGUUAGGCCGAA IUCACGUG | 15767 |
| 1639 | ACGUGACC A GGGGUCCU | 6428 | AGGACCCC CUGAUGAGGCCGUUAGGCCGAA IGUCACGU | 15768 |
| 1646 | CAGGGGUC C UGAAAUUA | 6429 | UAAUUUCA CUGAUGAGGCCGUUAAGCCCGA IACCCCUG | 15769 |
| 1647 | AGGGGUCC U GAAAUUAC | 6430 | GUAAUUUC CUGAUGAGGCCGUUAGGCCGAA IGACCCCU | 15770 |
| 1656 | GAAAUUAC U UUGCAACC | 6431 | GGUUGCAA CUGAUGAGGCCGUUAGGCCGAA IUAAUUUC | 15771 |
| 1661 | UACUUUGC A ACCUGACA | 6432 | UGUCAGGU CUGAUGAGGCCGUUAGGCCGAA ICAAAGUA | 15772 |
| 1664 | UUUGCAAC C UGACAUGC | 6433 | GCAUGUCA CUGAUGAGGCCGUUAGGCCGAA IUUGCAAA | 15773 |
| 1665 | UUGCAACC U GACAUGCA | 6434 | UGCAUGUC CUGAUGAGGCCGUUAGGCCGAA IGUUGCAA | 15774 |
| 1669 | AACCUGAC A UGCAGCCC | 6435 | GGGCUGCA CUGAUGAGGCCGUUAGGCCGAA IUCAGGUU | 15775 |
| 1673 | UGACAUGC A GCCCACUG | 6436 | CAGUGGGC CUGAUGAGGCCGUUAGGCCGAA ICAUGUCA | 15776 |
| 1676 | CAUGCAGC C CACUGAGC | 6437 | GCUCAGUG CUGAUGAGGCCGUUAGGCCGAA ICUGCAUG | 15777 |
| 1677 | AUGCAGCC C ACUGAGCA | 6438 | UGCUCAGU CUGAUGAGGCCGUUAGGCCGAA IGCUGCAU | 15778 |
| 1678 | UGCAGCCC A CUGAGCAG | 6439 | CUGCUCAG CUGAUGAGGCCGUUAGGCCGAA IGGCUGCA | 15779 |
| 1680 | CAGCCCAC U GAGCAGGA | 6440 | UCCUGCUC CUGAUGAGGCCGUUAGGCCGAA IUGGGCUG | 15780 |
| 1685 | CACUGAGC A GGAGAGCG | 6441 | CGCUCUCC CUGAUGAGGCCGUUAGGCCGAA ICUCAGUG | 15781 |
| 1698 | AGCGUGUC U UUGUGGUG | 6442 | CACCACAA CUGAUGAGGCCGUUAGGCCGAA IACACGCU | 15782 |
| 1708 | UGUGGUGC A CUGCAGAC | 6443 | GUCUGCAG CUGAUGAGGCCGUUAGGCCGAA ICACCACA | 15783 |
| 1710 | UGGUGCAC U GCAGACAG | 6444 | CUGUCUGC CUGAUGAGGCCGUUAGGCCGAA IUGCACCA | 15784 |
| 1713 | UGCACUGC A GACAGAUC | 6445 | GAUCUGUC CUGAUGAGGCCGUUAGGCCGAA ICAGUGCA | 15785 |
| 1717 | CUGCAGAC A GAUCUACG | 6446 | CGUAGAUC CUGAUGAGGCCGUUAGGCCGAA IUCUGCAG | 15786 |

TABLE XVI-continued

Human KDR NCH Ribozyme and Target Sequences

| Pos | Target | Seq ID No | Ribozyme Sequence | Seq ID No. |
|---|---|---|---|---|
| 1722 | GACAGAUC U ACGUUUGA | 6447 | UCAAACGU CUGAUGAGGCCGUUAGGCCGAA IAUCUGUC | 15787 |
| 1735 | UUGAGAAC C UCACAUGG | 6448 | CCAUGUGA CUGAUGAGGCCGUUAGGCCGAA IUUCUCAA | 15788 |
| 1736 | UGAGAACC U CACAUGGU | 6449 | ACCAUGUG CUGAUGAGGCCGUUAGGCCGAA IGUUCUCA | 15789 |
| 1738 | AGAACCUC A CAUGGUAC | 6450 | GUACCAUG CUGAUGAGGCCGUUAGGCCGAA IAGGUUCU | 15790 |
| 1740 | AACCUCAC A UGGUACAA | 6451 | UUGUACCA CUGAUGAGGCCGUUAGGCCGAA IUGAGGUU | 15791 |
| 1747 | CAUGGUAC A AGCUUGGC | 6452 | GCCAAGCU CUGAUGAGGCCGUUAGGCCGAA IUACCAUG | 15792 |
| 1751 | GUACAAGC U UGGCCCAC | 6453 | GUGGGCCA CUGAUGAGGCCGUUAGGCCGAA ICUUGUAC | 15793 |
| 1756 | AGCUUGGC C CACAGCCU | 6454 | AGGCUGUG CUGAUGAGGCCGUUAGGCCGAA ICCAAGCU | 15794 |
| 1757 | GCUUGGCC C ACAGCCUC | 6455 | GAGGCUGU CUGAUGAGGCCGUUAGGCCGAA IGCCAAGC | 15795 |
| 1758 | CUUGGCCC A CAGCCUCU | 6456 | AGAGGCUG CUGAUGAGGCCGUUAGGCCGAA IGGCCAAG | 15796 |
| 1760 | UGGCCCAC A GCCUCUGC | 6457 | GCAGAGGC CUGAUGAGGCCGUUAGGCCGAA IUGGGCCA | 15797 |
| 1763 | CCCACAGC C UCUGCCAA | 6458 | UUGGCAGA CUGAUGAGGCCGUUAGGCCGAA ICUGUGGG | 15798 |
| 1764 | CCACAGCC U CUGCCAAU | 6459 | AUUGGCAG CUGAUGAGGCCGUUAGGCCGAA IGCUGUGG | 15799 |
| 1766 | ACAGCCUC U GCCAAUCC | 6460 | GGAUUGGC CUGAUGAGGCCGUUAGGCCGAA IAGGCUGU | 15800 |
| 1769 | GCCUCUGC C AAUCCAUG | 6461 | CAUGGAUU CUGAUGAGGCCGUUAGGCCGAA ICAGAGGC | 15801 |
| 1770 | CCUCUGCC A AUCCAUGU | 6462 | ACAUGGAU CUGAUGAGGCCGUUAGGCCGAA IGCAGAGG | 15802 |
| 1774 | UGCCAAUC C AUGGGGA | 6463 | UCCCACAU CUGAUGAGGCCGUUAGGCCGAA IAUUGGCA | 15803 |
| 1775 | GCCAAUCC A UGUGGGAG | 6464 | CUCCCACA CUGAUGAGGCCGUUAGGCCGAA IGAUUGGC | 15804 |
| 1790 | AGAGUUGC C CACACCUG | 6465 | CAGGUGUG CUGAUGAGGCCGUUAGGCCGAA ICAACUCU | 15805 |
| 1791 | GAGUUGCC C ACACCGUU | 6466 | ACAGGUGU CUGAUGAGGCCGUUAGGCCGAA IGCAACUC | 15806 |
| 1792 | AGUUGCCC A CACCUGUU | 6467 | AACAGGUG CUGAUGAGGCCGUUAGGCCGAA IGGCAACU | 15807 |
| 1794 | UUGCCCAC A CCUGUUUG | 6468 | CAAACAGG CUGAUGAGGCCGUUAGGCCGAA IUGGGCAA | 15808 |
| 1796 | GCCCACAC C UGUUUGCA | 6469 | UGCAAACA CUGAUGAGGCCGUUAGGCCGAA IUGUGGGC | 15809 |
| 1797 | CCCACACC U GUUUGCAA | 6470 | UUGCAAAC CUGAUGAGGCCGUUAGGCCGAA IGUGUGGG | 15810 |
| 1804 | CUGUUUGC A AGAACUUG | 6471 | CAAGUUCU CUGAUGAGGCCGUUAGGCCGAA ICAAACAG | 15811 |
| 1810 | GCAAGAAC U UGGAUACU | 6472 | AGUAUCCA CUGAUGAGGCCGUUAGGCCGAA IUUCUUGC | 15812 |
| 1818 | UUGGAUAC U CUUUGGAA | 6473 | UUCCAAAG CUGAUGAGGCCGUUAGGCCGAA IUAUCCAA | 15813 |
| 1820 | GGAUACUC U UUGGAAAU | 6474 | AUUUCCAA CUGAUGAGGCCGUUAGGCCGAA IAGUAUCC | 15814 |
| 1836 | UUGAAUGC C ACCAUGUU | 6475 | AACAUGGU CUGAUGAGGCCGUUAGGCCGAA ICAUUCAA | 15815 |
| 1837 | UGAAUGCC A CCAUGUUC | 6476 | GAACAUGG CUGAUGAGGCCGUUAGGCCGAA IGCAUUCA | 15816 |
| 1839 | AAUGCCAC C AUGUUCUC | 6477 | GAGAACAU CUGAUGAGGCCGUUAGGCCGAA IUGGCAUU | 15817 |
| 1840 | AUGCCACC A UGUUCUCU | 6478 | AGAGAACA CUGAUGAGGCCGUUAGGCCGAA IGUGGCAU | 15818 |
| 1846 | CCAUGUUC U CUAAUAGC | 6479 | GCUAUUAG CUGAUGAGGCCGUUAGGCCGAA IAACAUGG | 15819 |
| 1848 | AUGUUCUC U AAUAGCAC | 6480 | GUGCUAUU CUGAUGAGGCCGUUAGGCCGAA IAGAACAU | 15820 |
| 1855 | CUAAUAGC A CAAAUGAC | 6481 | GUCAUUUG CUGAUGAGGCCGUUAGGCCGAA ICUAUUAG | 15821 |
| 1857 | AAUAGCAC A AAUGACAU | 6482 | AUGUCAUU CUGAUGAGGCCGUUAGGCCGAA IUGCUAUU | 15822 |
| 1864 | CAAAUGAC A UUUUGAUC | 6483 | GAUCAAAA CUGAUGAGGCCGUUAGGCCGAA IUCAUUUG | 15823 |

TABLE XVI-continued

Human KDR NCH Ribozyme and Target Sequences

| Pos | Target | Seq ID No | Ribozyme Sequence | Seq ID No. |
|---|---|---|---|---|
| 1873 | UUUUGAUC A UGGAGCUU | 6484 | AAGCUCCA CUGAUGAG<u>GCCGUUAGGCC</u>GAA IAUCAAAA | 15824 |
| 1880 | CAUGGAGC U UAAGAAUG | 6485 | CAUUCUUA CUGAUGAG<u>GCCGUUAGGCC</u>GAA ICUCCAUG | 15825 |
| 1890 | AAGAAUGC A UCCUUGCA | 6486 | UGCAAGGA CUGAUGAG<u>GCCGUUAGGCC</u>GAA ICAUUCUU | 15826 |
| 1893 | AAUGCAUC C UUGCAGGA | 6487 | UCCUGCAA CUGAUGAG<u>GCCGUUAGGCC</u>GAA IAUGCAUU | 15827 |
| 1894 | AUGCAUCC U UGCAGGAC | 6488 | GUCCUGCA CUGAUGAG<u>GCCGUUAGGCC</u>GAA IGAUGCAU | 15828 |
| 1898 | AUCCUUGC A GGACCAAG | 6489 | CUUGGUCC CUGAUGAG<u>GCCGUUAGGCC</u>GAA ICAAGGAU | 15829 |
| 1903 | UGCAGGAC C AAGGAGAC | 6490 | GUCUCCUU CUGAUGAG<u>GCCGUUAGGCC</u>GAA IUCCUGCA | 15830 |
| 1904 | GCAGGACC A AGGAGACU | 6491 | AGUCUCCU CUGAUGAG<u>GCCGUUAGGCC</u>GAA IGUCCUGC | 15831 |
| 1912 | AAGGAGAC U AUGUCUGC | 6492 | GCAGACAU CUGAUGAG<u>GCCGUUAGGCC</u>GAA IUCUCCUU | 15832 |
| 1918 | ACUAUGUC U GCCUUGCU | 6493 | AGCAAGGC CUGAUGAG<u>GCCGUUAGGCC</u>GAA IACAUAGU | 15833 |
| 1921 | AUGUCUGC C UUGCUCAA | 6494 | UUGAGCAA CUGAUGAG<u>GCCGUUAGGCC</u>GAA ICAGACAU | 15834 |
| 1922 | UGUCUGCC U UGCUCAAG | 6495 | CUUGAGCA CUGAUGAG<u>GCCGUUAGGCC</u>GAA IGCAGACA | 15835 |
| 1926 | UGCCUUGC U CAAGACAG | 6496 | CUGUCUUG CUGAUGAG<u>GCCGUUAGGCC</u>GAA ICAAGGCA | 15836 |
| 1928 | CCUUGCUC A AGACAGGA | 6497 | UCCUGUCU CUGAUGAG<u>GCCGUUAGGCC</u>GAA IAGCAAGG | 15837 |
| 1933 | CUCAAGAC A GGAAGACC | 6498 | GGUCUUCC CUGAUGAG<u>GCCGUUAGGCC</u>GAA IUCUUGAG | 15838 |
| 1941 | AGGAAGAC C AAGAAAAG | 6499 | CUUUCUUU CUGAUGAG<u>GCCGUUAGGCC</u>GAA IUCUUCCU | 15839 |
| 1942 | GGAAGACC A AGAAAAGA | 6500 | UCUUUUCU CUGAUGAG<u>GCCGUUAGGCC</u>GAA IGUCUUCC | 15840 |
| 1952 | GAAAAGAC A UUGCGUGG | 6501 | CCACGCAA CUGAUGAG<u>GCCGUUAGGCC</u>GAA IUCUUUUC | 15841 |
| 1963 | GCGUGGUC A GGCAGCUC | 6502 | GAGCUGCC CUGAUGAG<u>GCCGUUAGGCC</u>GAA IACCACGC | 15842 |
| 1967 | GGUCAGGC A GCUCACAG | 6503 | CUGUGAGC CUGAUGAG<u>GCCGUUAGGCC</u>GAA ICCUGACC | 15843 |
| 1970 | CAGGCAGC U CACAGUCC | 6504 | GGACUGUG CUGAUGAG<u>GCCGUUAGGCC</u>GAA ICUGCCUG | 15844 |
| 1972 | GCAGCUC A CAGUCCUA | 6505 | UAGGACUG CUGAUGAG<u>GCCGUUAGGCC</u>GAA IAGCUGCC | 15845 |
| 1974 | CAGCUCAC A GUCCUAGA | 6506 | UCUAGGAC CUGAUGAG<u>GCCGUUAGGCC</u>GAA IUGAGCUG | 15846 |
| 1978 | UCACAGUC C UAGAGCGU | 6507 | ACGCUCUA CUGAUGAG<u>GCCGUUAGGCC</u>GAA IACUGUGA | 15847 |
| 1979 | CACAGUCC U AGAGCGUG | 6508 | CACGCUCU CUGAUGAG<u>GCCGUUAGGCC</u>GAA IGACUGUG | 15848 |
| 1992 | CGUGUGGC A CCCACGAU | 6509 | AUCGUGGG CUGAUGAG<u>GCCGUUAGGCC</u>GAA ICCACACG | 15849 |
| 1994 | UGUGGCAC C CACGAUCA | 6510 | UGAUCGUG CUGAUGAG<u>GCCGUUAGGCC</u>GAA IUGCCACA | 15850 |
| 1995 | GUGGCACC C ACGAUCAC | 6511 | GUGAUCGU CUGAUGAG<u>GCCGUUAGGCC</u>GAA IGUGCCAC | 15851 |
| 1996 | UGGCACCC A CGAUCACA | 6512 | UGUGAUCG CUGAUGAG<u>GCCGUUAGGCC</u>GAA IGGUGCCA | 15852 |
| 2002 | CCACGAUC A CAGGAAAC | 6513 | GUUUCCUG CUGAUGAG<u>GCCGUUAGGCC</u>GAA IAUCGUGG | 15853 |
| 2004 | ACGAUCAC A GGAAACCU | 6514 | AGGUUUCC CUGAUGAG<u>GCCGUUAGGCC</u>GAA IUGAUCGU | 15854 |
| 2011 | CAGGAAAC C UGGAGAAU | 6515 | AUUCUCCA CUGAUGAG<u>GCCGUUAGGCC</u>GAA IUUUCCUG | 15855 |
| 2012 | AGGAAACC U GGAGAAUC | 6516 | GAUUCUCC CUGAUGAG<u>GCCGUUAGGCC</u>GAA IGUUUCCU | 15856 |
| 2021 | GGAGAAUC A GACGACAA | 6517 | UUGUCGUC CUGAUGAG<u>GCCGUUAGGCC</u>GAA IAUUCUCC | 15857 |
| 2028 | CAGACGAC A AGUAUUGG | 6518 | CCAAUACU CUGAUGAG<u>GCCGUUAGGCC</u>GAA ICGUCUG | 15858 |
| 2044 | GGGAAAGC A UCGAAGUC | 6519 | GACUUCGA CUGAUGAG<u>GCCGUUAGGCC</u>GAA ICUUUCCC | 15859 |
| 2053 | UCGAAGUC U CAUGCACG | 6520 | CGUGCAUG CUGAUGAG<u>GCCGUUAGGCC</u>GAA IACUUCGA | 15860 |

TABLE XVI-continued

Human KDR NCH Ribozyme and Target Sequences

| Pos | Target | Seq ID No | Ribozyme Sequence | Seq ID No. |
|---|---|---|---|---|
| 2055 | GAAGUCUC A UGCACGGC | 6521 | GCCGUGCA CUGAUGAGGCCGUUAGGCCGAA IAGACUUC | 15861 |
| 2059 | UCUCAUGC A CGGCAUCU | 6522 | AGAUGCCG CUGAUGAGGCCGUUAGGCCGAA ICAUGAGA | 15862 |
| 2064 | UGCACGGC A UCUGGGAA | 6523 | UUCCCAGA CUGAUGAGGCCGUUAGGCCGAA ICCGUGCA | 15863 |
| 2067 | ACGGCAUC U GGGAAUCC | 6524 | GGAUUCCC CUGAUGAGGCCGUUAGGCCGAA IAUGCCGU | 15864 |
| 2075 | UGGGAAUC C CCCUCCAC | 6525 | GUGGAGGG CUGAUGAGGCCGUUAGGCCGAA IAUUCCCA | 15865 |
| 2076 | GGGAAUCC C CCUCCACA | 6526 | UGUGGAGO CUGAUGAGGCCGUUAGGCCGAA IGAUUCCC | 15866 |
| 2077 | GGAAUCCC C CUCCACAG | 6527 | CUGUGGAG CUGAUGAGGCCGUUAGGCCGAA IGGAUUCC | 15867 |
| 2078 | GAAUCCCC C UCCACAGA | 6528 | UCUGUGGA CUGAUGAGGCCGUUAGGCCGAA IGGGAUUC | 15868 |
| 2079 | AAUCCCCC U CCACAGAU | 6529 | AUCUGUGG CUGAUGAGGCCGUUAGGCCGAA IGGGGAUU | 15869 |
| 2081 | UCCCCCUC C ACAGAUCA | 6530 | UGAUCUGU CUGAUGAGGCCGUUAGGCCGAA IAGGGGGA | 15870 |
| 2082 | CCCCCUCC A CAGAUCAU | 6531 | AUGAUCUG CUGAUGAGGCCGUUAGGCCGAA IGAGGGGG | 15871 |
| 2084 | CCCUCCAC A GAUCAUGU | 6532 | ACAUGAUC CUGAUGAGGCCGUUAGGCCGAA IUGGAGGG | 15872 |
| 2089 | CACAGAUC A UGUGGUUU | 6533 | AAACCACA CUGAUGAGGCCGUUAGGCCGAA IAUCUGUG | 15873 |
| 2112 | AAUGAGAC C CUUGUAGA | 6534 | UCUACAAG CUGAUGAGGCCGUUAGGCCGAA IUCUCAUU | 15874 |
| 2113 | AUGAGACC C UUGUAGAA | 6535 | UUCUACAA CUGAUGAGGCCGUUAGGCCGAA IGUCUCAU | 15875 |
| 2114 | UGAGACCC U UGUAGAAG | 6536 | CUUCUACA CUGAUGAGGCCGUUAGGCCGAA IGGUCUCA | 15876 |
| 2125 | UAGAAGAC U CAGGCAUU | 6537 | AAUGCCUG CUGAUGAGGCCGUUAGGCCGAA IUCUUCUA | 15877 |
| 2127 | GAAGACUC A GGCAUUGU | 6538 | ACAAUGCC CUGAUGAGGCCGUUAGGCCGAA IAGUCUUC | 15878 |
| 2131 | ACUCAGGC A UUGUAUUG | 6539 | CAAUACAA CUGAUGAGGCCGUUAGGCCGAA ICCUGAGU | 15879 |
| 2152 | AUGGGAAC C GGAACCUC | 6540 | GAGGUUCC CUGAUGAGGCCGUUAGGCCGAA IUUCCCAU | 15880 |
| 2158 | ACCGGAAC C UCACUAUC | 6541 | GAUAGUGA CUGAUGAGGCCGUUAGGCCGAA IUUCCGGU | 15881 |
| 2159 | CCGGAACC U CACUAUCC | 6542 | GGAUAGUG CUGAUGAGGCCGUUAGGCCGAA IGUUCCGG | 15882 |
| 2161 | GGAACCUC A CUAUCCGC | 6543 | GCGGAUAG CUGAUGAGGCCGUUAGGCCGAA IAGGUUCC | 15883 |
| 2163 | AACCUCAC U AUCCGCAG | 6544 | CUGCGGAU CUGAUGAGGCCGUUAGGCCGAA IUGAGGUU | 15884 |
| 2167 | UCACUAUC C GCAGAGUG | 6545 | CACUCUGC CUGAUGAGGCCGUUAGGCCGAA IAUAGUGA | 15885 |
| 2170 | CUAUCCGC A GAGUGAGG | 6546 | CCUCACUC CUGAUGAGGCCGUUAGGCCGAA ICGGAUAG | 15886 |
| 2194 | ACGAAGGC C UCUACACC | 6547 | GGUGUAGA CUGAUGAGGCCGUUAGGCCGAA ICCUUCGU | 15887 |
| 2195 | CGAAGGCC U CUACACCU | 6548 | AGGUGUAG CUGAUGAGGCCGUUAGGCCGAA IGCCUUCG | 15888 |
| 2197 | AAGGCCUC U ACACCUGC | 6549 | GCAGGUGU CUGAUGAGGCCGUUAGGCCGAA IAGGCCUU | 15889 |
| 2200 | GCCUCUAC A CCUGCCAG | 6550 | CUGGCAGG CUGAUGAGGCCGUUAGGCCGAA IUAGAGGC | 15890 |
| 2202 | CUCUACAC C UGCCAGGC | 6551 | GCCUGGCA CUGAUGAGGCCGUUAGGCCGAA IUGUAGAG | 15891 |
| 2203 | UCUACACC U GCCAGGCA | 6552 | UGCCUGGC CUGAUGAGGCCGUUAGGCCGAA IGUGUAGA | 15892 |
| 2206 | ACACCUGC C AGGCAUGC | 6553 | GCAUGCCU CUGAUGAGGCCGUUAGGCCGAA ICAGGUGU | 15893 |
| 2207 | CACCUGCC A GGCAUGCA | 6554 | UGCAUGCC CUGAUGAGGCCGUUAGGCCGAA IGCAGGUG | 15894 |
| 2211 | UGCCAGGC A UGCAGUGU | 6555 | ACACUGCA CUGAUGAGGCCGUUAGGCCGAA ICCUGGCA | 15895 |
| 2215 | AGGCAUGC A GUGUUCUU | 6556 | AAGAACAC CUGAUGAGGCCGUUAGGCCGAA ICAUGCCU | 15896 |
| 2222 | CAGUGUUC U UGGCUGUG | 6557 | CACAGCCA CUGAUGAGGCCGUUAGGCCGAA IAACACUG | 15897 |

TABLE XVI-continued

Human KDR NCH Ribozyme and Target Sequences

| Pos | Target | Seq ID No | Ribozyme Sequence | Seq ID No. |
|---|---|---|---|---|
| 2227 | UUCUUGGC U GUGCAAAA | 6558 | UUUUGCAC CUGAUGAGGCCGUUAGGCCGAA ICCAAGAA | 15898 |
| 2232 | GGCUGUGC A AAAGUGGA | 6559 | UCCACUUU CUGAUGAGGCCGUUAGGCCGAA ICACAGCC | 15899 |
| 2244 | GUGGAGGC A UUUUUCAU | 6560 | AUGAAAAA CUGAUGAGGCCGUUAGGCCGAA ICCUCCAC | 15900 |
| 2251 | CAUUUUUC A UAAUAGAA | 6561 | UUCUAUUA CUGAUGAGGCCGUUAGGCCGAA IAAAAAUG | 15901 |
| 2265 | GAAGGUGC C CAGGAAAA | 6562 | UUUUCCUG CUGAUGAGGCCGUUAGGCCGAA ICACCUUC | 15902 |
| 2266 | AAGGUGCC C AGGAAAAG | 6563 | CUUUUCCU CUGAUGAGGCCGUUAGGCCGAA IGCACCUU | 15903 |
| 2267 | AGGUGCCC A GGAAAAGA | 6564 | UCUUUUCC CUGAUGAGGCCGUUAGGCCGAA IGGCACCU | 15904 |
| 2281 | AGACGAAC U UGGAAAUC | 6565 | GAUUUCCA CUGAUGAGGCCGUUAGGCCGAA IUUCGUCU | 15905 |
| 2290 | UGGAAAUC A UUAUUCUA | 6566 | UAGAAUAA CUGAUGAGGCCGUUAGGCCGAA IAUUUCCA | 15906 |
| 2297 | CAUUAUUC U AGUAGGCA | 6567 | UGCCUACU CUGAUGAGGCCGUUAGGCCGAA IAAUAAUG | 15907 |
| 2305 | UAGUAGGC A CGACGGUG | 6568 | CACCGUCG CUGAUGAGGCCGUUAGGCCGAA ICCUACUA | 15908 |
| 2319 | GUGAUUGC C AUGUUCUU | 6569 | AAGAACAU CUGAUGAGGCCGUUAGGCCGAA ICAAUCAC | 15909 |
| 2320 | UGAUUGCC A UGUUCUUC | 6570 | GAAGAACA CUGAUGAGGCCGUUAGGCCGAA IGCAAUCA | 15910 |
| 2326 | CCAUGUUC U UCUGGCUA | 6571 | UAGCCAGA CUGAUGAGGCCGUUAGGCCGAA IAACAUGG | 15911 |
| 2329 | UGUUCUUC U GGCUACUU | 6572 | AAGUAGCC CUGAUGAGGCCGUUAGGCCGAA IAAGAACA | 15912 |
| 2333 | CUUCUGGC U ACUUCUUG | 6573 | CAAGAAGU CUGAUGAGGCCGUUAGGCCGAA ICCAGAAG | 15913 |
| 2336 | CUGGCUAC U UCUUGUCA | 6574 | UGACAAGA CUGAUGAGGCCGUUAGGCCGAA IUAGCCAG | 15914 |
| 2339 | GCUACUUC U UGUCAUCA | 6575 | UGAUGACA CUGAUGAGGCCGUUAGGCCGAA IAAGUAGC | 15915 |
| 2344 | UUCUUGUC A UCAUCCUA | 6576 | UAGGAUGA CUGAUGAGGCCGUUAGGCCGAA IACAAGAA | 15916 |
| 2347 | UUGUCAUC A UCCUAGGG | 6577 | CCCUAGGA CUGAUGAGGCCGUUAGGCCGAA IAUGACAA | 15917 |
| 2350 | UCAUCAUC C UAGGGACC | 6578 | GGUCCCUA CUGAUGAGGCCGUUAGGCCGAA IAUGAUGA | 15918 |
| 2351 | CAUCAUCC U AGGGACCG | 6579 | CGGUCCCU CUGAUGAGGCCGUUAGGCCGAA IGAUGAUG | 15919 |
| 2358 | CUAGGGAC C GUUAAGCG | 6580 | CGCUUAAC CUGAUGAGGCCGUUAGGCCGAA IUCCCUAG | 15920 |
| 2370 | AAGCGGGC C AAUGGAGG | 6581 | CCUCCAUU CUGAUGAGGCCGUUAGGCCGAA ICCCGCUU | 15921 |
| 2371 | AGCGGGCC A AUGGAGGG | 6582 | CCCUCCAU CUGAUGAGGCCGUUAGGCCGAA IGCCCGCU | 15922 |
| 2384 | AGGGGAAC U GAAGACAG | 6583 | CUGUCUUC CUGAUGAGGCCGUUAGGCCGAA IUUCCCCU | 15923 |
| 2391 | CUGAAGAC A GGCUACUU | 6584 | AAGUAGCC CUGAUGAGGCCGUUAGGCCGAA IUCUUCAG | 15924 |
| 2395 | AGACAGGC U ACUUGUCC | 6585 | GGACAAGU CUGAUGAGGCCGUUAGGCCGAA ICCUGUCU | 15925 |
| 2398 | CAGGCUAC U UGUCCAUC | 6586 | GAUGGACA CUGAUGAGGCCGUUAGGCCGAA IUAGCCUG | 15926 |
| 2403 | UACUUGUC C AUCGUCAU | 6587 | AUGACGAU CUGAUGAGGCCGUUAGGCCGAA IACAAGUA | 15927 |
| 2404 | ACUUGUCC A UCGUCAUG | 6588 | CAUGACGA CUGAUGAGGCCGUUAGGCCGAA IGACAAGU | 15928 |
| 2410 | CCAUCGUC A UGGAUCCA | 6589 | UGGAUCCA CUGAUGAGGCCGUUAGGCCGAA IACGAUGG | 15929 |
| 2417 | CAUGGAUC C AGAUGAAC | 6590 | GUUCAUCU CUGAUGAGGCCGUUAGGCCGAA IAUCCAUG | 15930 |
| 2418 | AUGGAUCC A GAUGAACU | 6591 | AGUUCAUC CUGAUGAGGCCGUUAGGCCGAA IGAUCCAU | 15931 |
| 2426 | AGAUGAAC U CCCAUUGG | 6592 | CCAAUGGG CUGAUGAGGCCGUUAGGCCGAA IUUCAUCU | 15932 |
| 2428 | AUGAACUC C CAUUGGAU | 6593 | AUCCAAUG CUGAUGAGGCCGUUAGGCCGAA IAGUUCAU | 15933 |
| 2429 | UGAACUCC C AUUGGAUG | 6594 | CAUCCAAU CUGAUGAGGCCGUUAGGCCGAA IGAGUUCA | 15934 |

TABLE XVI-continued

Human KDR NCH Ribozyme and Target Sequences

| Pos | Target | Seq ID No | Ribozyme Sequence | Seq ID No. |
|---|---|---|---|---|
| 2430 | GAACUCCC A UUGGAUGA | 6595 | UCAUCCAA CUGAUGAGGCCGUUAGGCCGAA IGGAGUUC | 15935 |
| 2441 | GGAUGAAC A UUGUGAAC | 6596 | GUUCACAA CUGAUGAGGCCGUUAGGCCGAA IUUCAUCC | 15936 |
| 2453 | UGAACGAC U GCCUUAUG | 6597 | CAUAAGGC CUGAUGAGGCCGUUAGGCCGAA IUCGUUCA | 15937 |
| 2456 | ACGACUGC C UUAUGAUG | 6598 | CAUCAUAA CUGAUGAGGCCGUUAGGCCGAA ICAGUCGU | 15938 |
| 2457 | CGACUGCC U UAUGAUGC | 6599 | GCAUCAUA CUGAUGAGGCCGUUAGGCCGAA IGCAGUCG | 15939 |
| 2466 | UAUGAUGC C AGCAAAUG | 6600 | CAUUUGCU CUGAUGAGGCCGUUAGGCCGAA ICAUCAUA | 15940 |
| 2467 | AUGAUGCC A GCAAAUGG | 6601 | CCAUUUGC CUGAUGAGGCCGUUAGGCCGAA IGCAUCAU | 15941 |
| 2470 | AUGCCAGC A AAUGGGAA | 6602 | UUCCCAUU CUGAUGAGGCCGUUAGGCCGAA ICUGGCAU | 15942 |
| 2482 | GGGAAUUC C CCAGAGAC | 6603 | GUCUCUGG CUGAUGAGGCCGUUAGGCCGAA IAAUUCCC | 15943 |
| 2483 | GGAAUUCC C CAGAGACC | 6604 | GGUCUCUG CUGAUGAGGCCGUUAGGCCGAA IGAAUUCC | 15944 |
| 2484 | GAAUUCCC C AGAGACCG | 6605 | CGGUCUCU CUGAUGAGGCCGUUAGGCCGAA IGGAAUUC | 15945 |
| 2485 | AAUUCCCC A GAGACCGG | 6606 | CCGGUCUC CUGAUGAGGCCGUUAGGCCGAA IGGGAAUU | 15946 |
| 2491 | CCAGAGAC C GGCUGAAC | 6607 | GUUCAGCC CUGAUGAGGCCGUUAGGCCGAA IUCUCUGG | 15947 |
| 2495 | AGACCGGC U GAACCUAG | 6608 | CUAGGUUC CUGAUGAGGCCGUUAGGCCGAA ICCGGUCU | 15948 |
| 2500 | GGCUGAAC C UAGGUAAG | 6609 | CUUACCUA CUGAUGAGGCCGUUAGGCCGAA IUUCAGCC | 15949 |
| 2501 | GCUGAACC U AGGUAAGC | 6610 | GCUUACCU CUGAUGAGGCCGUUAGGCCGAA IGUUCAGC | 15950 |
| 2510 | AGGUAAGC C UCUUGGCC | 6611 | GGCCAAGA CUCAUGAGGCCGUUAGGCCGAA ICUUACCU | 15951 |
| 2511 | GGUAAGCC U CUUGGCCG | 6612 | CGGCCAAG CUGAUGAGGCCGUUAGGCCGAA IGCUUACC | 15952 |
| 2513 | UAAGCCUC U UGGCCGUG | 6613 | CACGGCCA CUGAUGAGGCCGUUAGGCCGAA IAGGCUUA | 15953 |
| 2518 | CUCUUGGC C GUGGUGCC | 6614 | GGCACCAC CUGAUGAGGCCGUUAGGCCGAA ICCAAGAG | 15954 |
| 2526 | CGUGGUGC C UUUGGCCA | 6615 | UGGCCAAA CUGAUGAGGCCGUUAGGCCGAA ICACCACO | 15955 |
| 2527 | GUGGUGCC U UUGGCCAA | 6616 | UUGGCCAA CUGAUGAGGCCGUUAGGCCGAA IGCACCAC | 15956 |
| 2533 | CCUUUGGC C AAGAGAUU | 6617 | AAUCUCUU CUGAUGAGGCCGUUAGGCCGAA ICCAAAGG | 15957 |
| 2534 | CUUUGGCC A AGAGACUG | 6618 | CAAUCUCU CUGAUGAGGCCGUUAGGCCGAA IGCCAAAG | 15958 |
| 2547 | AUUGAAGC A GAUGCCUU | 6619 | AAGGCAUC CUGAUGAGGCCGUUAGGCCGAA ICUUCAAU | 15959 |
| 2553 | GCAGAUGC C UUUGGAAU | 6620 | AUUCCAAA CUGAUGAGGCCGUUAGGCCGAA ICAUCUGC | 15960 |
| 2554 | CAGAUGCC U UUGGAAUU | 6621 | AAUUCCAA CUGAUGAGGCCGUUAGGCCGAA IGCAUCUG | 15961 |
| 2566 | GAAUUGAC A AGACAGCA | 6622 | UGCUGUCU CUGAUGAGGCCGUUAGGCCGAA IUCAAUUC | 15962 |
| 2571 | GACAAGAC A GCAACUUG | 6623 | CAAGUUGC CUGAUGAGGCCGUUAGGCCGAA IUCUUGUC | 15963 |
| 2574 | AAGACAGC A ACUUGCAG | 6624 | CUGCAAGU CUGAUGAGGCCGUUAGGCCGAA ICUGUCUU | 15964 |
| 2577 | ACAGCAAC U UGCAGGAC | 6625 | GUCCUGCA CUGAUGAGGCCGUUAGGCCGAA IUUGCUGU | 15965 |
| 2581 | CAACUUGC A GGACAGUA | 6626 | UACUGUCC CUGAUGAGGCCGUUAGGCCGAA ICAAGUUG | 15966 |
| 2586 | UGCAGGAC A GUAGCAGU | 6627 | ACUGCUAC CUGAUGAGGCCGUUAGGCCGAA IUCCUGCA | 15967 |
| 2592 | ACAGUAGC A GUCAAAAU | 6628 | AUUUUGAC CUGAUGAGGCCGUUAGGCCGAA ICUACUGU | 15968 |
| 2596 | UAGCAGUC A AAUGUUG | 6629 | CAACAUUU CUGAUGAGGCCGUUAGGCCGAA IACUGCUA | 15969 |
| 2616 | GAAGGAGC A ACACACAG | 6630 | CUGUGUGU CUGAUGAGGCCGUUAGGCCGAA ICUCCUUC | 15970 |
| 2619 | GGAGCAAC A CACAGUGA | 6631 | UCACUGUG CUGAUGAGGCCGUUAGGCCGAA IUUGCUCC | 15971 |

TABLE XVI-continued

Human KDR NCH Ribozyme and Target Sequences

| Pos | Target | Seq ID No | Ribozyme Sequence | Seq ID No. |
|---|---|---|---|---|
| 2621 | AGCAACAC A CAGUGAGC | 6632 | GCUCACUG CUGAUGAGGCCGUUAGGCCGAA IUGUUGCU | 15972 |
| 2623 | CAACACAC A GUGAGCAU | 6633 | AUGCUCAC CUGAUGAGGCCGUUAGGCCGAA IUGUGUUG | 15973 |
| 2630 | CAGUGAGC A UCGAGCUC | 6634 | GAGCUCGA CUGAUGAGGCCGUUAGGCCGAA ICUCACUG | 15974 |
| 2637 | CAUCGAGC U CUCAUGUC | 6635 | GACAUGAG CUGAUGAGGCCGUUAGGCCGAA ICUCGAUG | 15975 |
| 2639 | UCGAGCUC U CAUGUCUG | 6636 | CAGACAUG CUGAUGAGGCCGUUAGGCCGAA IAGCUCGA | 15976 |
| 2641 | GAGCUCUC A UGUCUGAA | 6637 | UUCAGACA CUGAUGAGGCCGUUAGGCCGAA IAGAGCUC | 15977 |
| 2646 | CUCAUGUC U GAACUCAA | 6638 | UUGAGUUC CUGAUGAGGCCGUUAGGCCGAA IACAUGAG | 15978 |
| 2651 | GUCUGAAC U CAAGAUCC | 6639 | GGAUCUUG CUGAUGAGGCCGUUAGGCCGAA IUUCAGAC | 15979 |
| 2653 | CUGAACUC A AGAUCCUC | 6640 | GAGGAUCU CUGAUGAGGCCGUUAGGCCGAA IAGUUCAG | 15980 |
| 2659 | UCAAGAUC C UCAUUCAU | 6641 | AUGAAUGA CUGAUGAGGCCGUUAGGCCGAA IAUCUUGA | 15981 |
| 2660 | CAAGAUCC U CAUUCAUA | 6642 | UAUGAAUG CUGAUGAGGCCGUUAGGCCGAA IGAUCUUG | 15982 |
| 2662 | AGAUCCUC A UUCAUAUU | 6643 | AAUAUGAA CUGAUGAGGCCGUUAGGCCGAA IAGGAUCU | 15983 |
| 2666 | CCUCAUUC A UAUUGGUC | 6644 | GACCAAUA CUGAUGAGGCCGUUAGGCCGAA IAAUGAGG | 15984 |
| 2675 | UAUUGGUC A CCAUCUCA | 6645 | UGAGAUGG CUGAUGAGGCCGUUAGGCCGAA IACCAAUA | 15985 |
| 2677 | UUGGUCAC C AUCUCAAU | 6646 | AUUGAGAU CUGAUGAGGCCGUUAGGCCGAA IUGACCAA | 15986 |
| 2678 | UGGUCACC A UCUCAAUG | 6647 | CAGUGAGA CUGAUGAGGCCGUUAGGCCGAA IGUGACCA | 15987 |
| 2681 | UCACCAUC U CAAUGUGG | 6648 | CCACAUUG CUGAUGAGGCCGUUAGGCCGAA IAUGGUGA | 15988 |
| 2683 | ACCAUCUC A AUGGGUC | 6649 | GACCACAU CUGAUGAGGCCGUUAGGCCGAA IAGAUGGU | 15989 |
| 2692 | AUGUGGUC A ACCUUCUA | 6650 | UAGAAGGU CUGAUGAGGCCGUUAGGCCGAA IACCACAU | 15990 |
| 2695 | UGGUCAAC C UUCUAGGU | 6651 | ACCUAGAA CUGAUGAGGCCGUUAGGCCGAA IUUGACCA | 15991 |
| 2696 | GGUCAACC U UCUAGGUG | 6652 | CACCUAGA CUGAUGAGGCCGUUAGGCCGAA IGUUGACC | 15992 |
| 2699 | CAACCUUC U AGGUGCCU | 6653 | AGGCACCU CUGAUGAGGCCGUUAGGCCGAA IAAGGUUG | 15993 |
| 2706 | CUAGGUGC C UGUACCAA | 6654 | UUGGUACA CUGAUGAGGCCGUUAGGCCGAA ICACCUAG | 15994 |
| 2707 | UAGGUGCC U GUACCAAG | 6655 | CUUGGUAC CUGAUGAGGCCGUUAGGCCGAA IGCACCUA | 15995 |
| 2712 | GCCUGUAC C AAGCCAGG | 6656 | CCUGGCUU CUGAUGAGGCCGUUAGGCCGAA IUACAGGC | 15996 |
| 2713 | CCUGUACC A AGCCAGGA | 6657 | UCCUGGCU CUGAUGAGGCCGUUAGGCCGAA IGUACAGG | 15997 |
| 2717 | UACCAAGC C AGGAGGGC | 6658 | GCCCUCCU CUGAUGAGGCCGUUAGGCCGAA ICUUGGUA | 15998 |
| 2718 | ACCAAGCC A GGAGGGCC | 6659 | GGCCCUCC CUGAUGAGGCCGUUAGGCCGAA IGCUUGGU | 15999 |
| 2726 | AGGAGGGC C ACUCAUGG | 6660 | CCAUGAGU CUGAUGAGGCCGUUAGGCCGAA ICCCUCCU | 16000 |
| 2727 | GGAGGGCC A CUCAUGGU | 6661 | ACCAUGAG CUGAUGAGGCCGUUAGGCCGAA IGCCCUCC | 16001 |
| 2729 | AGGGCCAC U CAUGGUGA | 6662 | UCACCAUG CUGAUGAGGCCGUUAGGCCGAA IUGGCCCU | 16002 |
| 2731 | GGCCACUC A UGGUGAUU | 6663 | AAUCACCA CUGAUGAGGCCGUUAGGCCGAA IAGUGGCC | 16003 |
| 2749 | UGGAAUUC U GCAAAUUU | 6664 | AAAUUUGC CUGAUGAGGCCGUUAGGCCGAA IAAUUCCA | 16004 |
| 2752 | AAUUCUGC A AAUUUGGA | 6665 | UCCAAAUU CUGAUGAGGCCGUUAGGCCGAA ICAGAAUU | 16005 |
| 2764 | UUGGAAAC C UGUCCACU | 6666 | AGUGGACA CUGAUGAGGCCGUUAGGCCGAA IUUUCCAA | 16006 |
| 2765 | UGGAAACC U GUCCACUU | 6667 | AAGUGGAC CUGAUGAGGCCGUUAGGCCGAA IGUUUCCA | 16007 |
| 2769 | AACCUGUC C ACUUACCU | 6668 | AGGUAAGU CUGAUGAGGCCGUUAGGCCGAA IACAGGUU | 16008 |

TABLE XVI-continued

Human KDR NCH Ribozyme and Target Sequences

| Pos | Target | Seq ID No | Ribozyme Sequence | Seq ID No. |
|---|---|---|---|---|
| 2770 | ACCUGUCC A CUUACCUG | 6669 | CAGGUAAG CUGAUGAGGCCGUUAGGCCGAA IGACAGGU | 16009 |
| 2772 | CUGUCCAC U UACCUGAG | 6670 | CUCAGGUA CUGAUGAGGCCGUUAGGCCGAA IUGGACAG | 16010 |
| 2776 | CCACUUAC C UGAGGAGC | 6671 | GCUCCUCA CUGAUGAGGCCGUUAGGCCGAA IUAAGUGG | 16011 |
| 2777 | CACUUACC U GAGGAGCA | 6672 | UGCUCCUC CUGAUGAGGCCGUUAGGCCGAA IGUAAGUG | 16012 |
| 2785 | UGAGGAGC A AGAGAAAU | 6673 | AUUUCUCU CUGAUGAGGCCGUUAGGCCGAA ICUCCUCA | 16013 |
| 2803 | AAUUUGUC C CCUACAAG | 6674 | CUUGUAGG CUGAUGAGGCCGUUAGGCCGAA IACAAAUU | 16014 |
| 2804 | AUUUGUCC C CUACAAGA | 6675 | UCUUGUAG CUGAUGAGGCCGUUAGGCCGAA IGACAAAU | 16015 |
| 2805 | UUUGUCCC C UACAAGAC | 6676 | GUCUUGUA CUGAUGAGGCCGUUAGGCCGAA IGGACAAA | 16016 |
| 2806 | UUGUCCCC U ACAAGACC | 6677 | GGUCUUGU CUGAUGAGGCCGUUAGGCCGAA IGGGACAA | 16017 |
| 2809 | UCCCCUAC A AGACCAAA | 6678 | UUUGGUCU CUGAUGAGGCCGUUAGGCCGAA IAGGGGA | 16018 |
| 2814 | UACAAGAC C AAAGGGC | 6679 | GCCCCUUU CUGAUGAGGCCGUUAGGCCGAA IUCUUGUA | 16019 |
| 2815 | ACAAGACC A AAGGGCA | 6680 | UGCCCCUU CUGAUGAGGCCGUUAGGCCGAA IGUCUUGU | 16020 |
| 2823 | AAAGGGGC A CGAUUCCG | 6681 | CGGAAUCG CUGAUGAGGCCGUUAGGCCGAA ICCCCUUU | 16021 |
| 2830 | CACGAUUC C GUCAAGGG | 6682 | CCCUUGAC CUGAUGAGGCCGUUAGGCCGAA IAAUCGUG | 16022 |
| 2834 | AUUCCGUC A AGGGAAAG | 6683 | CUUUCCCU CUGAUGAGGCCGUUAGGCCGAA IACGGAAU | 16023 |
| 2845 | GGAAAGAC U ACGUUGGA | 6684 | UCCAACGU CUGAUGAGGCCGUUAGGCCGAA IUCUUUCC | 16024 |
| 2856 | GUUGGAGC A AUCCCUGU | 6685 | ACAGGGAU CUGAUGAGGCCGUUAGGCCGAA ICUCCAAC | 16025 |
| 2860 | GAGCAAUC C CUGUGGAU | 6686 | AUCCACAG CUGAUGAGGCCGUUAGGCCGAA IAUUGCUC | 16026 |
| 2861 | AGCAAUCC C UGUGGAUC | 6687 | GAUCCACA CUGAUGAGGCCGUUAGGCCGAA IGAUUGCU | 16027 |
| 2862 | GCAAUCCC U GUGGAUCU | 6688 | AGAUCCAC CUGAUGAGGCCGUUAGGCCGAA IGGAUUGC | 16028 |
| 2870 | UGUGGAUC U GAAACGGC | 6689 | GCCGUUUC CUGAUGAGGCCGUUAGGCCGAA IAUCCACA | 16029 |
| 2881 | AACGGCGC U UGGACAGC | 6690 | GCUGUCCA CUGAUGAGGCCGUUAGGCCGAA ICGCCGUU | 16030 |
| 2887 | GCUUGGAC A GCAUCACC | 6691 | GGUGAUGC CUGAUGAGGCCGUUAGGCCGAA IUCCAAGC | 16031 |
| 2890 | UGGACAGC A UCACCAGU | 6692 | ACUGGUGA CUGAUGAGGCCGUUAGGCCGAA ICUGUCCA | 16032 |
| 2893 | ACAGCAUC A CCAGUAGC | 6693 | GCUACUGG CUGAUGAGGCCGUUAGGCCGAA IAUGCUGU | 16033 |
| 2895 | AGCAUCAC C AGUAGCCA | 6694 | UGGCUACU CUGAUGAGGCCGUUAGGCCGAA IUGAUGCU | 16034 |
| 2896 | GCAUCACC A GUAGCCAG | 6695 | CUGGCUAC CUGAUGAGGCCGUUAGGCCGAA IGUGAUGC | 16035 |
| 2902 | CCAGUAGC C AGAGCUCA | 6696 | UGAGCUCU CUGAUGAGGCCGUUAGGCCGAA ICUACUGG | 16036 |
| 2903 | CAGUAGCC A GAGCUCAG | 6697 | CUGAGCUC CUGAUGAGGCCGUUAGGCCGAA IGCUACUG | 16037 |
| 2908 | GCCAGAGC U CAGCCAGC | 6698 | GCUGGCUG CUGAUGAGGCCGUUAGGCCGAA ICUCUGGC | 16038 |
| 2910 | CAGAGCUC A GCCAGCUC | 6699 | GAGCUGGC CUGAUGAGGCCGUUAGGCCGAA IAGCUCUG | 16039 |
| 2913 | AGCUCAGC C AGCUCUGG | 6700 | CCAGAGCU CUGAUGAGGCCGUUAGGCCGAA ICUGAGCU | 16040 |
| 2914 | GCUCAGCC A GCUCUGGA | 6701 | UCCAGAGO CUGAUGAGGCCGUUAGGCCGAA IGCUGAGC | 16041 |
| 2917 | CAGCCAGC U CUGGAUUU | 6702 | AAAUCCAG CUGAUGAGGCCGUUAGGCCGAA ICUGGCUG | 16042 |
| 2919 | GCCAGCUC U GGAUUUGU | 6703 | ACAAAUCC CUGAUGAGGCCGUUAGGCCGAA IAGCUGGC | 16043 |
| 2940 | GAGAAGUC C CUCAGUGA | 6704 | UCACUGAG CUGAUGAGGCCGUUAGGCCGAA IACUUCUC | 16044 |
| 2941 | AGAAGUCC C UCAGUGAU | 6705 | AUCACUGA CUGAUGAGGCCGUUAGGCCGAA IGACUUCU | 16045 |

TABLE XVI-continued

Human KDR NCH Ribozyme and Target Sequences

| Pos | Target | Seq ID No | Ribozyme Sequence | Seq ID No. |
|---|---|---|---|---|
| 2942 | GAAGUCCC U CAGUGAUG | 6706 | CAUCACUG CUGAUGAGGCCGUUAGGCCGAA IGGACUUC | 16046 |
| 2944 | AGUCCUC A GUGAUGUA | 6707 | UACAUCAC CUGAUGAGGCCGUUAGGCCGAA IAGGGACU | 16047 |
| 2967 | GAGGAAGC U CCUGAAGA | 6708 | UCUUCAGG CUGAUGAGGCCGUUAGGCCGAA ICUUCCUC | 16048 |
| 2969 | GGAAGCUC C UGAAGAUC | 6709 | GAUCUUCA CUGAUGAGGCCGUUAGGCCGAA IAGCUUCC | 16049 |
| 2970 | GAAGCUCC U GAAGAUCU | 6710 | AGAUCUUC CUGAUGAGGCCGUUAGGCCGAA IGAGCUUC | 16050 |
| 2978 | UGAAGAUC U GUAUAAGG | 6711 | CCUUAUAC CUGAUGAGGCCGUUAGGCCGAA IAUCUUCA | 16051 |
| 2989 | AUAAGGAC U UCCUGACC | 6712 | GGUCAGGA CUGAUGAGGCCGUUAGGCCGAA IUCCUUAU | 16052 |
| 2992 | AGGACUUC C UGACCUUG | 6713 | CAAGGUCA CUGAUGAGGCCGUUAGGCCGAA IAAGUCCU | 16053 |
| 2993 | GGACUUCC U GACCUUGG | 6714 | CCAAGGUC CUGAUGAGGCCGUUAGGCCGAA IGAAGUCC | 16054 |
| 2997 | UUCCUGAC C UUGGAGCA | 6715 | UGCUCCAA CUGAUGAGGCCGUUAGGCCGAA ICAGGAA | 16055 |
| 2998 | UCCUGACC U UGGAGCAU | 6716 | AUGCUCCA CUGAUGAGGCCGUUAGGCCGAA IGUCAGGA | 16056 |
| 3005 | CUUGGAGC A UCUCAUCU | 6717 | AGAUGAGA CUGAUGAGGCCGUUAGGCCGAA ICUCCAAG | 16057 |
| 3008 | GGAGCAUC U CAUCUGUU | 6718 | AACAGAUG CUGAUGAGGCCGUUAGGCCGAA IAUGCUCC | 16058 |
| 3010 | AGCAUCUC A UCUGUUAC | 6719 | GUAACAGA CUGAUGAGGCCGUUAGGCCGAA IAGAUGCU | 16059 |
| 3013 | AUCUCAUC U GUUACAGC | 6720 | GCUGUAAC CUGAUGAGGCCGUUAGGCCGAA IAUGAGAU | 16060 |
| 3029 | UCUGUUAC A GCUUCCAA | 6721 | UUGGAAGC CUGAUGAGGCCGUUAGGCCGAA IUAACAGA | 16061 |
| 3022 | GUUACAGC U UCCAAGUG | 6722 | CACUUGGA CUGAUGAGGCCGUUAGGCCGAA ICUGUAAC | 16062 |
| 3025 | ACAGCUUC C AAGUGGCU | 6723 | AGCCACUU CUGAUGAGGCCGUUAGGCCGAA IAAGCUGU | 16063 |
| 3026 | CAGCUUCC A AGUGGCUA | 6724 | UAGCCACU CUGAUGAGGCCGUUAGGCCGAA IGAAGCUG | 16064 |
| 3033 | CAAGUGGC U AAGGGCAU | 6725 | AUGCCCUU CUGAUGAGGCCGUUAGGCCGAA ICCACUUG | 16065 |
| 3040 | CUAAGGGC A UGGAGUUC | 6726 | GAACUCCA CUGAUGAGGCCGUUAGGCCGAA ICCCUUAG | 16066 |
| 3049 | UGGAGUUC U UGGCAUCG | 6727 | CGAUGCCA CUGAUGAGGCCGUUAGGCCGAA IAACUCCA | 16067 |
| 3054 | UUCUUGGC A UCGCGAAA | 6728 | UUUCGCGA CUGAUGAGGCCGUUAGGCCGAA ICCAAGAA | 16068 |
| 3070 | AGUGUAUC C ACAGGGAC | 6729 | GUCCCUGU CUGAUGAGGCCGUUAGGCCGAA IAUACACU | 16069 |
| 3071 | GUGUAUCC A CAGGGACC | 6730 | GGUCCCUG CUGAUGAGGCCGUUAGGCCGAA IGAUACAC | 16070 |
| 3073 | GUAUCCAC A GGGACCUG | 6731 | CAGGUCCC CUGAUGAGGCCGUUAGGCCGAA IUGGAUAC | 16071 |
| 3079 | ACAGGGAC C UGGCGGCA | 6732 | UGCCGCCA CUGAUGAGGCCGUUAGGCCGAA IUCCCUGU | 16072 |
| 3080 | CAGGGACC U GGCGGCAC | 6733 | GUGCCGCC CUGAUGAGGCCGUUAGGCCGAA IGUCCCUG | 16073 |
| 3087 | CUGGCGGC A CGAAAUAU | 6734 | AUAUUUCG CUGAUGAGGCCGUUAGGCCGAA ICCGCCAG | 16074 |
| 3097 | GAAAUAUC C UCUUAUCG | 6735 | CGAUAAGA CUGAUGAGGCCGUUAGGCCGAA IAUAUUUC | 16075 |
| 3098 | AAAUAUCC U CUUAUCGG | 6736 | CCGAUAAG CUGAUGAGGCCGUUAGGCCGAA IGAUAUUU | 16076 |
| 3100 | AUAUCCUC U UAUCGGAG | 6737 | CUCCGAUA CUGAUGAGGCCGUUAGGCCGAA IAGGAUAU | 16077 |
| 3127 | UUAAAAUC U GUGACUUU | 6738 | AAAGUCAC CUGAUGAGGCCGUUAGGCCGAA IAUUUUAA | 16078 |
| 3133 | UCUGUGAC U UUGGCUUG | 6739 | CAAGCCAA CUGAUGAGGCCGUUAGGCCGAA IUCACAGA | 16079 |
| 3139 | ACUUGGC U UGGCCCGG | 6740 | CCGGGCCA CUGAUGAGGCCGUUAGGCCGAA ICCAAAGU | 16080 |
| 3144 | GGCUUGGC C CGGAUAU | 6741 | AUAUCCCG CUGAUGAGGCCGUUAGGCCGAA ICCAAGCC | 16081 |
| 3145 | GCUUGGCC C GGAUAUU | 6742 | AAUAUCCC CUGAUGAGGCCGUUAGGCCGAA IGCCAAGC | 16082 |

TABLE XVI-continued

Human KDR NCH Ribozyme and Target Sequences

| Pos | Target | Seq ID No | Ribozyme Sequence | Seq ID No. |
|---|---|---|---|---|
| 3164 | UAAAGAUC C AGAUUAUG | 6743 | CAUAAUCU CUGAUGAGgccGUUAGGCCGAA IAUCUUUA | 16083 |
| 3165 | AAAGAUCC A GAUUAUGU | 6744 | ACAUAAUC CUGAUGAGgccGUUAGGCCGAA IGAUCUUU | 16084 |
| 3175 | AUUAUGUC A GAAAAGGA | 6745 | UCCUUUUC CUGAUGAGgccGUUAGGCCGAA IACAUAAU | 16085 |
| 3189 | GGAGAUGC U CGCCUCCC | 6746 | GGGAGGCG CUGAUGAGgccGUUAGGCCGAA ICAUCUCC | 16086 |
| 3293 | AUGCUCGC C UCCCUUUG | 6747 | CAAAGGGA CUGAUGAGgccGUUAGGCCGAA ICGAGCAU | 16087 |
| 3294 | UGCUCGCC U CCCUUUGA | 6748 | UCAAAGGG CUGAUGAGgccGUUAGGCCGAA IGCGAGCA | 16088 |
| 3296 | CUCGCCUC C CUUUGAAA | 6749 | UUUCAAAG CUGAUGAGgccGUUAGGCCGAA IAGGCGAG | 16089 |
| 3297 | UCGCCUCC C UUUGAAAU | 6750 | AUUUCAAA CUGAUGAGgccGUUAGGCCGAA IGAGGCGA | 16090 |
| 3298 | CGCCUCCC U UUGAAAUG | 6751 | CAUUUCAA CUGAUGAGgccGUUAGGCCGAA IGGAGGCG | 16091 |
| 3213 | UGGAUGGC C CCAGAAAC | 6752 | CUUUCUGG CUGAUGAGgccGUUAGGCCGAA ICCAUCCA | 16092 |
| 3214 | GGAUGGCC C CAGAAACA | 6753 | UGUUUCUG CUGAUGAGgccGUUAGGCCGAA IGCCAUCC | 16093 |
| 3215 | GAUGGCCC C AGAAACAA | 6754 | UUGUUUCU CUGAUGAGgccGUUAGGCCGAA IGGCCAUC | 16094 |
| 3216 | AUGGCCCC A GAAACAAU | 6755 | AUUGUUUC CUGAUGAGgccGUUAGGCCGAA IGCGCCAU | 16095 |
| 3222 | CCAGAAAC A AUUUUGA | 6756 | UCAAAAAU CUGAUGAGgccGUUAGGCCGAA IUUUCUGG | 16096 |
| 3232 | UUUUUGAC A GAGUGUAC | 6757 | GUACACUC CUGAUGAGgccGUUAGGCCGAA IUCAAAAA | 16097 |
| 3241 | GAGUGUAC A CAAUCCAG | 6758 | CUGGAUUG CUGAUGAGgccGUUAGGCCGAA IUACACUC | 16098 |
| 3243 | GUGUACAC A AUCCAGAG | 6759 | CUCUGGAU CUGAUGAGgccGUUAGGCCGAA IUGUACAC | 16099 |
| 3247 | ACACAAUC C AGAGUGAC | 6760 | GUCACUCU CUGAUGAGgccGUUAGGCCGAA IAUUGUGU | 16100 |
| 3248 | CACAAUCC A GAGUGACG | 6761 | CGUCACUC CUGAUGAGgccGUUAGGCCGAA IGAUUGUG | 16101 |
| 3259 | GUGACGUC U GGUCUUUU | 6762 | AAAAGACC CUGAUGAGgccGUUAGGCCGAA IACGUCAC | 16102 |
| 3264 | GUCUGGUC U UUUGGUGU | 6763 | ACACCAAA CUGAUGAGgccGUUAGGCCGAA IACCAGAC | 16103 |
| 3278 | UGUUUUGC U GUGGGAAA | 6764 | UUUCCCAC CUGAUGAGgccGUUAGGCCGAA ICAAAACA | 16104 |
| 3294 | AUAUUUUC C UUAGGUGC | 6765 | GCACCUAA CUGAUGAGgccGUUAGGCCGAA IAAAAUAU | 16105 |
| 3295 | UAUUUUCC U UAGGUGCU | 6766 | AGCACCUA CUGAUGAGgccGUUAGGCCGAA IGAAAAUA | 16106 |
| 3303 | UUAGGUGC U UCUCCAUA | 6767 | UAUGGAGA CUGAUGAGgccGUUAGGCCGAA ICACCUAA | 16107 |
| 3306 | GGUGCUUC U CCAUAUCC | 6768 | GGAUAUGG CUGAUGAGgccGUUAGGCCGAA IAAGCACC | 16108 |
| 3308 | UGCUUCUC C AUAUCCUG | 6769 | CAGGAUAU CUGAUGAGgccGUUAGGCCGAA IAGAAGCA | 16109 |
| 3309 | GCUUCUCC A UAUCCUGG | 6770 | CCAGGAUA CUGAUGAGgccGUUAGGCCGAA IGAGAAGC | 16110 |
| 3314 | UCCAUAUC C UGGGUAA | 6771 | UUACCCCA CUGAUGAGgccGUUAGGCCGAA IAUAUGGA | 16111 |
| 3315 | CCAUAUCC U GGGUAAA | 6772 | UUUACCCC CUGAUGAGgccGUUAGGCCGAA IGAUAUGG | 16112 |
| 3363 | GAAGGAAC U AGAAUGAG | 6773 | CUCAUUCU CUGAUGAGgccGUUAGGCCGAA IUUCCUUC | 16113 |
| 3375 | AUGAGGGC C CCUGAUUA | 6774 | UAAUCAGG CUGAUGAGgccGUUAGGCCGAA ICCCUCAU | 16114 |
| 3376 | UGAGGGCC C CUGAUUAU | 6775 | AUAAUCAG CUGAUGAGgccGUUAGGCCGAA IGCCCUCA | 16115 |
| 3377 | GAGGGCCC C UGAUUAUA | 6776 | UAUAAUCA CUGAUGAGgccGUUAGGCCGAA IGGCCCUC | 16116 |
| 3378 | AGGGCCCC U GAUUAUAC | 6777 | GUAUAAUC CUGAUGAGgccGUUAGGCCGAA IGGGCCCU | 16117 |
| 3387 | GAUUAUAC U ACACCAGA | 6778 | UCUGGUGU CUGAUGAGgccGUUAGGCCGAA IUAUAAUC | 16118 |
| 3390 | UAUACUAC A CCAGAAAU | 6779 | AUUUCUGG CUGAUGAGgccGUUAGGCCGAA IUAGUAUA | 16119 |

TABLE XVI-continued

Human KDR NCH Ribozyme and Target Sequences

| Pos | Target | Seq ID No | Ribozyme Sequence | Seq ID No. |
|---|---|---|---|---|
| 3392 | UACUACAC C AGAAAUGU | 6780 | ACAUUUCU CUGAUGAGGCCGUUAGGCCGAA IUGUAGUA | 16120 |
| 3393 | ACUACACC A GAAAUGUA | 6781 | UACAUUUC CUGAUGAGGCCGUUAGGCCGAA IGUGUAGU | 16121 |
| 3403 | AAAUGUAC C AGACCAUG | 6782 | CAUGGUCU CUGAUGAGGCCGUUAGGCCGAA IUACAUUU | 16122 |
| 3404 | AAUGUACC A GACCAUGC | 6783 | GCAUGGUC CUGAUGAGGCCGUUAGGCCGAA IGUACAUU | 16123 |
| 3408 | UACCAGAC C AUGCUGGA | 6784 | UCCAGCAU CUGAUGAGGCCGUUAGGCCGAA IUCUGGUA | 16124 |
| 3409 | ACCAGACC A UGCUGGAC | 6785 | GUCCAGCA CUGAUGAGGCCGUUAGGCCGAA IGUCUGGU | 16125 |
| 3413 | GACCAUGC U GGACUGCU | 6786 | AGCAGUCC CUGAUGAGGCCGUUAGGCCGAA ICAUGGUC | 16126 |
| 3418 | UGCUGGAC U GCUGGCAC | 4886 | GUGCCAGC CUGAUGAGGCCGUUAGGCCGAA IUCCAGCA | 14226 |
| 3421 | UGGACUGC U GGCACGGG | 6787 | CCCGUGCC CUGAUGAGGCCGUUAGGCCGAA ICAGUCCA | 16127 |
| 3425 | CUGCUGGC A CGGGGAGC | 6788 | GCUCCCCG CUGAUGAGGCCGUUAGGCCGAA ICCAGCAG | 16128 |
| 3434 | CGGGGAGC C CAGUCAGA | 6789 | UCUGACUG CUGAUGAGGCCGUUAGGCCGAA ICUCCCCG | 16129 |
| 3435 | GGGGAGCC C AGUCAGAG | 6790 | CUCUGACU CUGAUGAGGCCGUUAGGCCGAA IGCUCCCC | 16130 |
| 3436 | GGGAGCCC A GUCAGAGA | 6791 | UCUCUGAC CUGAUGAGGCCGUUAGGCCGAA IGGCUCCC | 16131 |
| 3440 | GCCCAGUC A GAGACCCA | 6792 | UGGGUCUC CUGAUGAGGCCGUUAGGCCGAA IACUGGGC | 16132 |
| 3446 | UCAGAGAC C CACGUUUU | 6793 | AAAACGUG CUGAUGAGGCCGUUAGGCCGAA IUCUCUGA | 16133 |
| 3447 | CAGAGACC C ACGUUUUC | 6794 | GAAAACGU CUGAUGAGGCCGUUAGGCCGAA IGUCUCUG | 16134 |
| 3448 | AGAGACCC A CGUUUUCA | 6795 | UGAAAACG CUGAUGAGGCCGUUAGGCCGAA IGGUCUCU | 16135 |
| 3456 | ACGUUUUC A GAGUUGGU | 6796 | ACCAACUC CUGAUGAGGCCGUUAGGCCGAA IAAAACGU | 16136 |
| 3470 | GGUGGAAC A UUUGGGAA | 6797 | UUCCCAAA CUGAUGAGGCCGUUAGGCCGAA IUUCCACC | 16137 |
| 3482 | GGGAAAUC U CUUGCAAG | 6798 | CUUGCAAG CUGAUGAGGCCGUUAGGCCGAA IAUUUCCC | 16138 |
| 3484 | GAAAUCUC U UGCAAGCU | 6799 | AGCUUGCA CUGAUGAGGCCGUUAGGCCGAA IAGAUUUC | 16139 |
| 3488 | UCUCUUGC A AGCUAAUG | 6800 | CAUUAGCU CUGAUGAGGCCGUUAGGCCGAA ICAAGAGA | 16140 |
| 3492 | UUGCAAGC U AAUGCUCA | 6801 | UGAGCAUU CUGAUGAGGCCGUUAGGCCGAA ICUUGCAA | 16141 |
| 3498 | GCUAAUGC U CAGCAGGA | 6802 | UCCUGCUG CUGAUGAGGCCGUUAGGCCGAA ICAUUAGC | 16142 |
| 3500 | UAAUGCUC A GCAGGAUG | 6803 | CAUCCUGC CUGAUGAGGCCGUUAGGCCGAA IAGCAUUA | 16143 |
| 3503 | UGCUCAGC A GGAUGGCA | 6804 | UGCCAUCC CUGAUGAGGCCGUUAGGCCGAA ICUGAGCA | 16144 |
| 3511 | AGGAUGGC A AAGACUAC | 6805 | GUAGUCUU CUGAUGAGGCCGUUAGGCCGAA ICCAUCCU | 16145 |
| 3517 | GCAAAGAC U ACAUUGUU | 6806 | AACAAUGU CUGAUGAGGCCGUUAGGCCGAA IUCUUUGC | 16146 |
| 3520 | AAGACUAC A UUGUUCUU | 6807 | AAGAACAA CUGAUGAGGCCGUUAGGCCGAA IUAGUCUU | 16147 |
| 3527 | CAUUGUUC U UCCGAUAU | 6808 | AUAUCGGA CUGAUGAGGCCGUUAGGCCGAA IAACAAUG | 16148 |
| 3530 | UGUUCUUC C GAUAUCAG | 6809 | CUGAUAUC CUGAUGAGGCCGUUAGGCCGAA IAAGAACA | 16149 |
| 3537 | CCGAUAUC A GAGACUUU | 6810 | AAAGUCUC CUGAUGAGGCCGUUAGGCCGAA IAUAUCGG | 16150 |
| 3543 | UCAGAGAC U UUGAGCAU | 6811 | AUGCUCAA CUGAUGAGGCCGUUAGGCCGAA IUCUCUGA | 16151 |
| 3550 | CUUUGAGC A UGGAAGAG | 6812 | CUCUUCCA CUGAUGAGGCCGUUAGGCCGAA ICUCAAAG | 16152 |
| 3564 | GAGGAUUC U GUACUCUC | 6813 | GAGAGUCC CUGAUGAGGCCGUUAGGCCGAA IAAUCCUC | 16153 |
| 3569 | UUCUGGAC U CUCUCUGC | 6814 | GCAGAGAG CUGAUGAGGCCGUUAGGCCGAA IUCCAGAA | 16154 |
| 3571 | CUGGACUC U CUCUGCCU | 6815 | AGGCAGAG CUGAUGAGGCCGUUAGGCCGAA IAGUCCAG | 16155 |

TABLE XVI-continued

Human KDR NCH Ribozyme and Target Sequences

| Pos | Target | Seq ID No | Ribozyme Sequence | Seq ID No. |
|---|---|---|---|---|
| 3573 | GGACUCUC U CUGCCUAC | 6816 | GUAGGCAG CUGAUGAGGCCGUUAGGCCGAA IAGAGUCC | 16156 |
| 3575 | ACUCUCUC U GCCUACCU | 6817 | AGGUAGGC CUGAUGAGGCCGUUAGGCCGAA IAGAGAGU | 16157 |
| 3578 | CUCUCUGC C UACCUCAC | 6818 | GUGAGGUA CUGAUGAGGCCGUUAGGCCGAA ICAGAGAG | 16158 |
| 3579 | UCUCUGCC U ACCUCACC | 6819 | GGUGAGGU CUGAUGAGGCCGUUAGGCCGAA IGCAGAGA | 16159 |
| 3582 | CUGCCUAC C UCACCUGU | 6820 | ACAGGUGA CUGAUGAGGCCGUUAGGCCGAA IUAGGCAG | 16160 |
| 3583 | UGCCUACC U CACCUGUU | 6821 | AACAGGUG CUGAUGAGGCCGUUAGGCCGAA IGUAGGCA | 16161 |
| 3585 | CCUACCUC A CCUGUUUC | 6822 | GAAACAGG CUGAUGAGGCCGUUAGGCCGAA IAGGUAGG | 16162 |
| 3587 | UACCUCAC C UGUUUCCU | 6823 | AGGAAACA CUGAUGAGGCCGUUAGGCCGAA IUGAGGUA | 16163 |
| 3588 | ACCUCACC U GUUUCCUG | 6824 | CAGGAAAC CUGAUGAGGCCGUUAGGCCGAA IGUGAGGU | 16164 |
| 3594 | CCUGUiUC C UGUAUGGA | 6825 | UCCAUACA CUGAUGAGGCCGUUAGGCCGAA IAAACAGG | 16165 |
| 3595 | CUGUUUCC U GUAUGGAG | 6826 | CUCCAUAC CUGAUGAGGCCGUUAGGCCGAA IGAAACAG | 16166 |
| 3622 | UAUGUGAC C CCAAAUUC | 6827 | GAAUUUGG CUGAUGAGGCCGUUAGGCCGAA IUCACAUA | 16167 |
| 3623 | AUGUGACC C CAAAUUCC | 6828 | GGAAUUUG CUGAUGAGGCCGUUAGGCCGAA IGUCACAU | 16168 |
| 3624 | UGUGACCC C AAAUUCCA | 6829 | UGGAAUUU CUGAUGAGGCCGUUAGGCCGAA IGGUCACA | 16169 |
| 3625 | GUGACCCC A AAUUCCAU | 6830 | AUGGAAUU CUGAUGAGGCCGUUAGGCCGAA IGGGUCAC | 16170 |
| 3631 | CCAAAUUC C AUUAUGAC | 6831 | GUCAUAAU CUGAUGAGGCCGUUAGGCCGAA IAAUUUGG | 16171 |
| 3632 | CAAAUUCC A UUAUGACA | 6832 | UGUCAUAA CUGAUGAGGCCGUUAGGCCGAA IGAAUUUG | 16172 |
| 3640 | AUUAUGAC A ACACAGCA | 6833 | UGCUGUGU CUGAUGAGGCCGUUAGGCCGAA IUCAUAAU | 16173 |
| 3643 | AUGACAAC A CAGCAGGA | 6834 | UCCUGCUG CUGAUGAGGCCGUUAGGCCGAA IUUGUCAU | 16174 |
| 3645 | GACAACAC A GCAGGAAU | 6835 | AUUCCUGC CUGAUGAGGCCGUUAGGCCGAA IGUUGUC | 16175 |
| 3648 | AACACAGC A GGAAUCAG | 6836 | CUGAUUCC CUGAUGAGGCCGUUAGGCCGAA ICUGUGUU | 16176 |
| 3655 | CAGGAAUC A GUCAGUAU | 6837 | AUACUGAC CUGAUGAGGCCGUUAGGCCGAA IAUUCCUG | 16177 |
| 3659 | AAUCAGUC A GUAUCUGC | 6838 | GCAGAUAC CUGAUGAGGCCGUUAGGCCGAA IACUGAUU | 16178 |
| 3665 | UCAGUAUC U GCAGAACA | 6839 | UGUUCUGC CUGAUGAGGCCGUUAGGCCGAA IAUACUGA | 16179 |
| 3668 | GUAUCUGC A GAACAGUA | 6840 | UACUGUUC CUGAUGAGGCCGUUAGGCCGAA ICAGAUAC | 16180 |
| 3673 | UGCAGAAC A GUAAGCGA | 6841 | UCGCUUAC CUGAUGAGGCCGUUAGGCCGAA IUUCUGCA | 16181 |
| 3688 | GAAAGAGC C GGCCUGUG | 6842 | CACAGGCC CUGAUGAGGCCGUUAGGCCGAA ICUCUUUC | 16182 |
| 3692 | GAGCCGGC C UGUGAGUG | 6843 | CACUCACA CUGAUGAGGCCGUUAGGCCGAA ICCGGCUC | 16183 |
| 3693 | AGCCGGCC U GUGAGUGU | 6844 | ACACUCAC CUGAUGAGGCCGUUAGGCCGAA IGCCGGCU | 16184 |
| 3708 | GUAAAAAC A UUUGAAGA | 6845 | UCUUCAAA CUGAUGAGGCCGUUAGGCCGAA IUUUUUAC | 16185 |
| 3721 | AAGAUAUC C CCUUAGAA | 6846 | UUCUAACG CUGAUGAGGCCGUUAGGCCGAA IAUAUCUU | 16186 |
| 3722 | AGAUAUCC C GUUAGAAG | 6847 | CUUCUAAC CUGAUGAGGCCGUUAGGCCGAA IGAUAUCU | 16187 |
| 3734 | AGAAGAAC C AGAAGUAA | 6848 | UUACUUCU CUGAUGAGGCCGUUAGGCCGAA IUUCUUCU | 16188 |
| 3735 | GAAGAACC A GAAGUAAA | 6849 | UUUACUUC CUGAUGAGGCCGUUAGGCCGAA IGUUCUUC | 16189 |
| 3751 | AAGUAAUC C CAGAUGAC | 6850 | GUCAUCUG CUGAUGAGGCCGUUAGGCCGAA IAUUACUU | 16190 |
| 3752 | AGUAAUCC C AGAUGACA | 6851 | UGUCAUCU CUGAUGAGGCCGUUAGGCCGAA IGAUUACU | 16191 |
| 3753 | GUAAUCCC A GAUGACAA | 6852 | UUGUCAUC CUGAUGAGGCCGUUAGGCCGAA IGGAUUAC | 16192 |

TABLE XVI-continued

Human KDR NCH Ribozyme and Target Sequences

| Pos | Target | Seq ID No | Ribozyme Sequence | Seq ID No. |
|---|---|---|---|---|
| 3760 | CAGAUGAC A ACCAGACG | 6853 | CGUCUGGU CUGAUGAGGCCGUUAGGCCGAA IUCAUCUG | 16193 |
| 3763 | AUGACAAC C AGACGGAC | 6854 | GUCCGUCU CUGAUGAGGCCGUUAGGCCGAA IUUGUCAU | 16194 |
| 3764 | UGACAACC A GACGGACA | 6855 | UGUCCGUC CUGAUGAGGCCGUUAGGCCGAA IGUUGUCA | 16195 |
| 3772 | AGACGGAC A GUGGUAUG | 6856 | CAUACCAC CUGAUGAGGCCGUUAGGCCGAA IUCCGUCU | 16196 |
| 3785 | UAUGGUUC U UGCCUCAG | 6857 | CUGAGGCA CUGAUGAGGCCGUUAGGCCGAA IAACCAUA | 16197 |
| 3789 | GUUCUUGC C UCAGAAGA | 6858 | UCUUCUGA CUGAUGAGGCCGUUAGGCCGAA ICAAGAAC | 16198 |
| 3790 | UUCUUGCC U CAGAAGAG | 6859 | CUCCUCUG CUGAUGAGGCCGUUAGGCCGAA IGCAAGAA | 16199 |
| 3792 | CUUGCCUC A GAAGAGCU | 6860 | AGCUCUUC CUGAUGAGGCCGUUAGGCCGAA IAGGCAAG | 16200 |
| 3800 | AGAAGAGC U GAAAACUU | 6861 | AAGUUUUC CUGAUGAGGCCGUUAGGCCGAA ICUCUUCU | 16201 |
| 3807 | CUGAAAAC U UUGGAAGA | 6862 | UCUUCCAA CUGAUGAGGCCGUUAGGCCGAA IUUUUCAG | 16202 |
| 3817 | UGGAAGAC A GAACCAAA | 6863 | UUUGGUUC CUGAUGAGGCCGUUAGGCCGAA IUCUUCCA | 16203 |
| 3822 | GACAGAAC C AAAUUAUC | 6864 | GAUAAUUU CUGAUGAGGCCGUUAGGCCGAA IUUCUGUC | 16204 |
| 3823 | ACAGAACC A AAUUAUCU | 6865 | AGAUAAUU CUGAUGAGGCCGUUAGGCCGAA IGUUCUGU | 16205 |
| 3831 | AAAUUAUC U CCAUCUUU | 6866 | AAAGAUGG CUGAUGAGGCCGUUAGGCCGAA IAUAAUUU | 16206 |
| 3833 | AUUAUCUC C AUCUUUUG | 6867 | CAAAAGAU CUGAUGAGGCCGUUAGGCCGAA IAGAUAAU | 16207 |
| 3834 | UUAUCUCC A UCUUUUGG | 6868 | CCAAAAGA CUGAUGAGGCCGUUAGGCCGAA IGAGAUAA | 16208 |
| 3837 | UCUCCAUC U UUUGGUGG | 6869 | CCACCAAA CUGAUGAGGCCGUUAGGCCGAA IAUGGAGA | 16209 |
| 3854 | AAUGGUGC C CAGCAAAA | 6870 | UUUUGCUG CUGAUGAGGCCGUUAGGCCGAA ICACCAUU | 16210 |
| 3855 | AUGGUGCC C AGCAAAAG | 6871 | CUUUUGCU CUGAUGAGGCCGUUAGGCCGAA IGCACCAU | 16211 |
| 3856 | UGGUGCCC A GCAAAAGC | 6872 | GCUUUUGC CUGAUGAGGCCGUUAGGCCGAA IGGCACCA | 16212 |
| 3859 | UGCCCAGC A AAAGCAGG | 6873 | CCUGCUUU CUGAUGAGGCCGUUAGGCCGAA ICUGGGCA | 16213 |
| 3865 | GCAAAAGC A GGGAGUCU | 6874 | AGACUCCC CUGAUGAGGCCGUUAGGCCGAA ICU(UUGC | 16214 |
| 3873 | AGGGAGUC U GUGGCAUC | 6875 | GAUGCCAC CUGAUGAGGCCGUUAGGCCGAA IACUCCCU | 16215 |
| 3879 | UCUGUGGC A UCUGAAGG | 6876 | CCUUCAGA CUGAUGAGGCCGUUAGGCCGAA ICCACAGA | 16216 |
| 3882 | GUGGCAUC U GAAGGCUC | 6877 | GAGCCUUC CUGAUGAGGCCGUUAGGCCGAA IAUGCCAC | 16217 |
| 3889 | CUGAAGGC U CAAACCAG | 6878 | CUGGUUUG CUGAUGAGGCCGUUAGGCCGAA ICCUUCAG | 16218 |
| 3891 | GAAGGCUC A AACCAGAC | 6879 | GUCUGGUU CUGAUGAGGCCGUUAGGCCGAA IAGCCUUC | 16219 |
| 3895 | GCUCAAAC C AGACAAGC | 6880 | GCUUGUCU CUGAUGAGGCCGUUAGGCCGAA IUUUGAGC | 16220 |
| 3896 | CUCAAACC A GACAAGCG | 6881 | CGCUUGUC CUGAUGAGGCCGUUAGGCCGAA IGUUUGAG | 16221 |
| 3900 | AACCAGAC A AGCGGCUA | 6882 | UAGCCGCU CUGAUGAGGCCGUUAGGCCGAA IUCUGGUU | 16222 |
| 3907 | CAAGCGGC U ACCAGUCC | 6883 | GGACUGGU CUGAUGAGGCCGUUAGGCCGAA ICCGCUUG | 16223 |
| 3910 | GCGGCUAC C AGUCCGGA | 6884 | UCCGGACU CUGAUGAGGCCGUUAGGCCGAA IUAGCCGC | 16224 |
| 3911 | CGGCUACC A GUCCGGAU | 6885 | AUCCGGAC CUGAUGAGGCCGUUAGGCCGAA IGUAGCCG | 16225 |
| 3915 | UACCAGUC C GGAUAUCA | 6886 | UGAUAUCC CUGAUGAGGCCGUUAGGCCGAA IACUGGUA | 16226 |
| 3923 | CGGAUAUC A CUCCGAUG | 6887 | CAUCGGAG CUGAUGAGGCCGUUAGGCCGAA IAUAUCCG | 16227 |
| 3925 | GAUAUCAC U CCGAUGAC | 6888 | GUCAUCGG CUGAUGAGGCCGUUAGGCCGAA IUGAUAUC | 16228 |
| 3927 | UAUCACUC C GAUGACAC | 6889 | GUGUCAUC CUGAUGAGGCCGUUAGGCCGAA IAGUGAUA | 16229 |

TABLE XVI-continued

Human KDR NCH Ribozyme and Target Sequences

| Pos | Target | Seq ID No | Ribozyme Sequence | Seq ID No. |
|---|---|---|---|---|
| 3934 | CCGAUGAC A CAGACACC | 6890 | GGUGUCUG CUGAUGAGGCCGUUAGGCCGAA IUCAUCGG | 16230 |
| 3936 | GAUGACAC A GACACCAC | 6891 | GUGGUGUC CUGAUGAGGCCGUUAGGCCGAA IUGUCAUC | 16231 |
| 3940 | ACACAGAC A CCACCGUG | 6892 | CACGGUGG CUGAUGAGGCCGUUAGGCCGAA IUCUGUGU | 16232 |
| 3942 | ACAGACAC C ACCGUGUA | 6893 | UACACGGU CUGAUGAGGCCGUUAGGCCGAA IUGUCUGU | 16233 |
| 3943 | CAGACACC A CCGUGUAC | 6894 | GUACACGG CUGAUGAGGCCGUUAGGCCGAA IGUGUCUG | 16234 |
| 3945 | GACACCAC C GUGUACUC | 6895 | GAGUACAC CUGAUGAGGCCGUUAGGCCGAA IUGGUGUC | 16235 |
| 3952 | CCGUGUAC U CCAGUGAG | 6896 | CUCACUGG CUGAUGAGGCCGUUAGGCCGAA IUACACGG | 16236 |
| 3954 | GUGUACUC C AGUGAGGA | 6897 | UCCUCACU CUGAUGAGGCCGUUAGGCCGAA IAGUACAC | 16237 |
| 3955 | UGUACUCC A GUGAGGAA | 6898 | UUCCUCAC CUGAUGAGGCCGUUAGGCCGAA IGAGUACA | 16238 |
| 3966 | GAGGAAGC A GAACUUUU | 6899 | AAAAGUUC CUGAUGAGGCCGUUAGGCCGAA ICUUCCUC | 16239 |
| 3971 | AGCAGAAC U UUUAAAGC | 6900 | GCUUUAAA CUGAUGAGGCCGUUAGGCCGAA IUUCUGCU | 16240 |
| 3980 | UUUAAAGC U GAUAGAGA | 6901 | UCUCUAUC CUGAUGAGGCCGUUAGGCCGAA ICUUUAAA | 16241 |
| 3998 | UGGAGUGC A AACCGGUA | 6902 | UACCGGUU CUGAUGAGGCCGUUAGGCCGAA ICACUCCA | 16242 |
| 4002 | GUGCAAAC C GGUAGCAC | 6903 | GUGCUACC CUGAUGAGGCCGUUAGGCCGAA IUUUGCAC | 16243 |
| 4009 | CCGGUAGC A CAGCCCAG | 6904 | CUGGGCUG CUGAUGAGGCCGUUAGGCCGAA ICUACCGG | 16244 |
| 4011 | GGUAGCAC A GCCCAGAU | 6905 | AUCUGGGC CUGAUGAGGCCGUUAGGCCGAA IUGCUACC | 16245 |
| 4014 | AGCACAGC C CAGAUUCU | 6906 | AGAAUCUG CUGAUGAGGCCGUUAGGCCGAA ICUGUGCU | 16246 |
| 4015 | GCACAGCC C AGAUUCUC | 6907 | GAGAAUCU CUGAUGAGGCCGUUAGGCCGAA IGCUGUGC | 16247 |
| 4016 | CACAGCCC A GAUUCUCC | 6908 | GGAGAAUC CUGAUGAGGCCGUUAGGCCGAA IGGCUGUG | 16248 |
| 4022 | CCAGAUUC U CCAGCCUG | 6909 | CAGGCUGG CUGAUGAGGCCGUUAGGCCGAA IAAUCUGG | 16249 |
| 4024 | AGAUUCUC C AGCCUGAC | 6910 | GUCAGGCU CUGAUGAGGCCGUUAGGCCGAA IAGAAUCU | 16250 |
| 4025 | GAUUCUCC A GCCUGACA | 6911 | UGUCAGGC CUGAUGAGGCCGUUAGGCCGAA IGAGAAUC | 16251 |
| 4028 | UCUCCAGC C UGACACGG | 6912 | CCGUGUCA CUGAUGAGGCCGUUAGGCCGAA ICUGGAGA | 16252 |
| 4029 | CUCCAGCC U GACACGGG | 6913 | CCCGUGUC CUGAUGAGGCCGUUAGGCCGAA IGCUGGAG | 16253 |
| 4033 | AGCCUGAC A CGGGACC | 6914 | GGUCCCCG CUGAUGAGGCCGUUAGGCCGAA IUCAGGCU | 16254 |
| 4041 | ACGGGAC C ACACUGAG | 6915 | CUCAGUGU CUGAUGAGGCCGUUAGGCCGAA IUCCCCGU | 16255 |
| 4042 | CGGGGACC A CACUGAGC | 6916 | GCUCAGUG CUGAUGAGGCCGUUAGGCCGAA IGUCCCCG | 16256 |
| 4044 | GGGACCAC A CUGAGCUC | 6917 | GAGCUCAG CUGAUGAGGCCGUUAGGCCGAA IUGGUCCC | 16257 |
| 4046 | GACCACAC U GAGCUCUC | 6918 | GAGAGCUC CUGAUGAGGCCGUUAGGCCGAA IUGUGGUC | 16258 |
| 4051 | CACUGAGC U CUCCUCCU | 6919 | AGGAGGAG CUGAUGAGGCCGUUAGGCCGAA ICUCAGUG | 16259 |
| 4053 | CUGAGCUC U CCUCCUGU | 6920 | ACAGGAGG CUGAUGAGGCCGUUAGGCCGAA IAGCUCAG | 16260 |
| 4055 | GAGCUCUC C UCCUGUUU | 6921 | AAACAGGA CUGAUGAGGCCGUUAGGCCGAA IAGAGCUC | 16261 |
| 4056 | AGCUCUCC U CCUGUUUA | 6922 | UAAACAGG CUGAUGAGGCCGUUAGGCCGAA IGAGAGCU | 16262 |
| 4058 | CUCUCCUC C UGUUUAAA | 6923 | UUUAAACA CUGAUGAGGCCGUUAGGCCGAA IAGGAGAG | 16263 |
| 4059 | UCUCCCUC U GUUUAAAA | 6924 | UUUUAAAC CUGAUGAGGCCGUUAGGCCGAA IGAGGAGA | 16264 |
| 4074 | AAGGAAGC A UCCACACC | 6925 | GGUGUGGA CUGAUGAGGCCGUUAGGCCGAA ICUUCCUU | 16265 |
| 4077 | GAAGCAUC C ACACCCCA | 6926 | UGGGGUGU CUGAUGAGGCCGUUAGGCCGAA IAUGCUUC | 16266 |

TABLE XVI-continued

Human KDR NCH Ribozyme and Target Sequences

| Pos | Target | Seq ID No | Ribozyme Sequence | Seq ID No. |
|---|---|---|---|---|
| 4078 | AAGCAUCC A CACCCCAA | 6927 | UUGGGGUG CUGAUGAG<u>GCCGUUAGGC</u>CGAA IGAUGCUU | 16267 |
| 4080 | GCAUCCAC A CCCCAACU | 6928 | AGUUGGGG CUGAUGAG<u>GCCGUUAGGC</u>CGAA IUGGAUGC | 16268 |
| 4082 | AUCCACAC C CCAACUCC | 6929 | GGAGUUGG CUGAUGAG<u>GCCGUUAGGC</u>CGAA IUGUGGAU | 16269 |
| 4083 | UCCACACC C CAACUCCC | 6930 | GGGAGUUG CUGAUGAG<u>GCCGUUAGGC</u>CGAA IGUGUGGA | 16270 |
| 4084 | CCACACCC C AACUCCCG | 6931 | CGGGAGUU CUGAUGAG<u>GCCGUUAGGC</u>CGAA IGGUGUGG | 16271 |
| 4085 | CACACCCC A CUCCCGG | 6932 | CCGGGAGU CUGAUGAG<u>GCCGUUAGGC</u>CGAA IGGGUGUG | 16272 |
| 4088 | ACCCCAAC U CCCGGACA | 6933 | UGUCCGGG CUGAUGAG<u>GCCGUUAGGC</u>CGAA IUUGGGGU | 16273 |
| 4090 | CCCAACUC C CCGACAUC | 6934 | GAUGUCCG CUGAUGAG<u>GCCGUUAGGC</u>CGAA IAGUUGGG | 16274 |
| 4091 | CCAACUCC C GGACAUCA | 6935 | UGAUGUCC CUGAUGAG<u>GCCGUUAGGC</u>CGAA IGAGUUGG | 16275 |
| 4096 | UCCCGGAC A UCACAUGA | 6936 | UCAUGUGA CUGAUGAG<u>GCCGUUAGGC</u>CGAA IUCCGGGA | 16276 |
| 4099 | CGGACAUC A CAUGAGAG | 6937 | CUCUCAUG CUGAUGAG<u>GCCGUUAGGC</u>CGAA IAUGUCCG | 16277 |
| 4101 | GACAUCAC A UGAGAGGU | 6938 | ACCUCUCA CUGAUGAG<u>GCCGUUAGGC</u>CGAA IUGAUGUC | 16278 |
| 4111 | GAGAGGUC U GCUCAGAU | 6939 | AUCUGAGC CUGAUGAG<u>GCCGUUAGGC</u>CGAA IACCUCUC | 16279 |
| 4114 | AGGUCUGC U CAGAUUUU | 6940 | AAAAUCUG CUGAUGAG<u>GCCGUUAGGC</u>CGAA ICAGACCU | 16280 |
| 4116 | GUCUGCUC A GAUUUGA | 6941 | UCAAAAUC CUGAUGAG<u>GCCGUUAGGC</u>CGAA IAGCAGAC | 16281 |
| 4135 | UGUUGUUC U UUCCACCA | 6942 | UGGUGGAA CUGAUGAG<u>GCCGUUAGGC</u>CGAA IACAACA | 16282 |
| 4139 | GUUCUUUC C ACCAGCAG | 6943 | CUGCUGGU CUGAUGAG<u>GCCGUUAGGC</u>CGAA IAAAGAAC | 16283 |
| 4140 | UUCUUUCC A CCAGCAGG | 6944 | CCUGCUGG CUGAUGAG<u>GCCGUUAGGC</u>CGAA IGAAAGAA | 16284 |
| 4142 | CUUUCCAC C AGCAGGAA | 6945 | UUCCUGCU CUGAUGAG<u>GCCGUUAGGC</u>CGAA IUGGAAAG | 16285 |
| 4143 | UUUCCACC A GCAGGAAG | 6946 | CUUCCUGC CUGAUGAG<u>GCCGUUAGGC</u>CGAA IGUGGAAA | 16286 |
| 4146 | CCACCAGC A GGAAGUAG | 6947 | CUACUUCC CUGAUGAG<u>GCCGUUAGGC</u>CGAA ICUGGUGG | 16287 |
| 4156 | GAAGUAGC C CAUUUGA | 6948 | UCAAAUGC CUGAUGAG<u>GCCGUUAGGC</u>CGAA ICUACUUC | 16288 |
| 4159 | GUAGCCGC A UUUGAUUU | 6949 | AAAUCAAA CUGAUGAG<u>GCCGUUAGGC</u>CGAA ICGGCUAC | 16289 |
| 4170 | UGAUUUUC A UUCGACA | 6950 | UGUCGAAA CUGAUGAG<u>GCCGUUAGGC</u>CGAA IAAAAUCA | 16290 |
| 4178 | AUUUCGAC A ACAGAAAA | 6951 | UUUUCUGU CUGAUGAG<u>GCCGUUAGGC</u>CGAA IUCGAAAU | 16291 |
| 4181 | UCGACAAC A GAAAAGG | 6952 | CCUUUUUC CUGAUGAG<u>GCCGUUAGGC</u>CGAA IUUGUCGA | 16292 |
| 4192 | AAAAGGAC C UCGGACUG | 6953 | CAGUCCGA CUGAUGAG<u>GCCGUUAGGC</u>CGAA IUCCUUUU | 16293 |
| 4193 | AAAGGACC U CGGACUGC | 6954 | GCAGUCCG CUGAUGAG<u>GCCGUUAGGC</u>CGAA IGUCCUUU | 16294 |
| 4199 | CCUCGGAC U GCAGGGAG | 6955 | CUCCCUGC CUGAUGAG<u>GCCGUUAGGC</u>CGAA IUCCGAGG | 16295 |
| 4202 | CGGACUGC A GGGAGCCA | 6956 | UGGCUCCC CUGAUGAG<u>GCCGUUAGGC</u>CGAA ICAGUCCG | 16296 |
| 4209 | CAGGGAGC C AGCUCUUC | 6957 | GAAGAGCU CUGAUGAG<u>GCCGUUAGGC</u>CGAA ICUCCCUG | 16297 |
| 4210 | AGGGAGCC A GCUCUUCU | 6958 | AGAAGAGC CUGAUGAG<u>GCCGUUAGGC</u>CGAA IGCUCCCU | 16298 |
| 4213 | GAGCCAGC U CUUCUAGG | 6959 | CCUAGAAG CUGAUGAG<u>GCCGUUAGGC</u>CGAA ICUGGCUC | 16299 |
| 4215 | GCCAGCUC U UCUAGGCU | 6960 | AGCCUAGA CUGAUGAG<u>GCCGUUAGGC</u>CGAA IAGCUGGC | 16300 |
| 4218 | AGCUCUUC U AGGCUUGU | 6961 | ACAAGCCU CUGAUGAG<u>GCCGUUAGGC</u>CGAA IAAGAGCU | 16301 |

Core Sequence = CUGAUGAG <u>GCCGUUAGGC</u> CGAA (SEQ ID NO. 20827).
Underlined region can be any X sequence or linker, as described herein.
"I" represents Inosine

TABLE XVII

KDR G-Cleaver Ribozyme and Target Sequences

| Pos | Target | Seq ID No | Ribozyme Sequence | Seq ID No |
|---|---|---|---|---|
| 12 | GCAAGGUGCU G CUGGC | 6962 | GCCAG UGAUG GCAUGCACUAUGC GCG AGCACCUUGC | 16302 |
| 22 | GCUGGCCGUC G CCCUG | 6963 | CAGGG UGAUG GCAUGCACUAUGC GCG GACGGCCAGC | 16303 |
| 35 | CUGUGGCUCU G CGUGG | 6964 | CCACG UGAUG GCAUGCACUAUGC GCG AGAGCCACAG | 16304 |
| 52 | GACCCGGGCC G CCUCU | 6965 | AGAGG UGAUG GCAUGCACUAUGC GCG GGCCCGGGUC | 16305 |
| 66 | CUGUGGGUUU G CCUAG | 6966 | CUAGG UGAUG GCAUGCACUAUGC GCG AAACCCACAG | 16306 |
| 82 | UGUUUCUCUU G AUCUG | 6967 | CAGAU UGAUG GCAUGCACUAUGC GCG AAGAGAAACA | 16307 |
| 87 | CUCUUGAUCU G CCCAG | 6968 | CUGGG UGAUG GCAUGCACUAUGC GCG AGAUCAAGAG | 16308 |
| 152 | CAAAUUACUU G CAGGG | 6969 | CCCUG UGAUG GCAUGCACUAUGC GCG AAGUAAUUUG | 16309 |
| 205 | GAGUGGCAGU G AGCAA | 6970 | UUGCU UGAUG GCAUGCACUAUGC GCG ACUGCCACUC | 16310 |
| 222 | GGGUGGAGGU G ACUGA | 6971 | UCAGU UGAUG GCAUGCACUAUGC GCG ACCUCCACCC | 16311 |
| 226 | GGAGGUGACU G AGUGC | 6972 | GCACU UGAUG GCAUGCACUAUGC GCG AGUCACCUCC | 16312 |
| 230 | GUGACUGAGU G CAGCG | 6973 | CGCUG UGAUG GCAUGCACUAUGC GCG ACUCAGUCAC | 16313 |
| 235 | UGAGUGCAGC G AUGGC | 6974 | GCCAU UGAUG GCAUGCACUAUGC GCG GCUGCACUCA | 16314 |
| 273 | UUCCAAAAGU G AUCGG | 6975 | CCGAU UGAUG GCAUGCACUAUGC GCG ACUUUUGGAA | 16315 |
| 283 | GAUCGGAAAU G ACACU | 6976 | AGUGU UGAUG GCAUGCACUAUGC GCG AUUUCCGAUC | 16316 |
| 302 | GCCUACAAGU G CUUCU | 6977 | AGAAG UGAUG GCAUGCACUAUGC GCG ACUUGUAGGC | 16317 |
| 319 | CCGGGAAACU G ACUUG | 6978 | CAAGU UGAUG GCAUGCACUAUGC GCG AGUUUCCCGG | 16318 |
| 373 | UCCAUUUAUU C CUUCU | 6979 | AGAAG UGAUG GCAUGCACUAUGC GCG AAUAAAUGGA | 16319 |
| 385 | UUCUGUUAGU G ACCAA | 6980 | UUGGU UGAUG GCAUGCACUAUGC GCG ACUAACAGAA | 16320 |
| 412 | GUACAUUACU G AGAAC | 6981 | GUUCU UGAUG GCAUGCACUAUGC GCG AGUAAUGUAC | 16321 |
| 435 | AAACUGUGGU G AUUCC | 6982 | GGAAU UGAUG GCAUGCACUAUGC GCG ACCACAGUUU | 16322 |
| 481 | GUCACUUUGU G CAAGA | 6983 | UCUUG UGAUG GCAUGCACUAUGC GCG ACAAAGUGAC | 16323 |
| 511 | AUUUGUUCCU G AUGGU | 6984 | ACCAU UGAUG GCAUGCACUAUGC GCG AGGAACAAAU | 16324 |
| 567 | CCAGCUACAU G AUCAG | 6985 | CUGAU UGAUG GCAUGCACUAUGC GCG AUGUAGCUGG | 16325 |
| 577 | GAUCAGCUAU G CUGGC | 6986 | GCCAG UGAUG GCAUGCACUAUGC GCG AUAGCUGAUC | 16326 |
| 595 | GGUCUUCUGU G AAGCA | 6987 | UGCUU UGAUG GCAUGCACUAUGC GCG ACAGAAGACC | 16327 |
| 610 | AAAAAUUAAU G AUGAA | 6988 | UUCAU UGAUG GCAUGCACUAUGC GCG AUUAAUUUUU | 16328 |
| 613 | AAUUAAUGAU G AAAGU | 6989 | ACUUU UGAUG GCAUGCACUAUGC GCG AUCAUUAAUU | 16329 |
| 667 | UAGGAUUUAU G AUGUG | 6990 | CACAU UGAUG GCAUGCACUAUGC GCG AUAAAUCCUA | 16330 |
| 678 | AUGUGGUUCU G AGUCC | 6991 | GGACU UGAUG GCAUGCACUAUGC GCG AGAACCACAU | 16331 |
| 697 | UCAUGGAAUU G AACUA | 6992 | UAGUU UGAUG GCAUGCACUAUGC GCG AAUUCCAUGA | 16332 |
| 745 | AGCAAGAACU G AACUA | 6993 | UAGUU UGAUG GCAUGCACUAUGC GCG AGUUCUUGCU | 16333 |
| 763 | UGUGGGGAUU G ACUUC | 6994 | GAAGU UGAUG GCAUGCACUAUGC GCG AAUCCCCACA | 16334 |
| 789 | ACCCUUCUUC G AAGCA | 6995 | UGCUU UGAUG GCAUGCACUAUGC GCG GAAGAAGGGU | 16335 |
| 818 | CUUGUAAACC G AGACC | 6996 | GGUCU UGAUG GCAUGCACUAUGC GCG GGUUUACAAG | 16336 |
| 844 | GUCUGGGAGU G AGAUG | 6997 | CAUCU UGAUG GCAUGCACUAUGC GCG ACUCCCAGAC | 16337 |
| 849 | GGAGUGAGAU G AAGAA | 6998 | UUCUU UGAUG GCAUGCACUAUGC GCG AUCUCACUCC | 16338 |

TABLE XVII-continued

KDR G-Cleaver Ribozyme and Target Sequences

| Pos | Target | Seq ID No | Ribozyme Sequence | Seq ID No |
|---|---|---|---|---|
| 861 | AGAAAUUUUU G AGCAC | 6999 | GUGCU UGAUG GCAUGCACUAUGC GCG AAAAAUUUCU | 16339 |
| 895 | AACCCGGAGU G ACCAA | 7000 | UUGGU UGAUG GCAUGCACUAUGC GCG ACUCCGGGUU | 16340 |
| 916 | GUACACCUGU G CAGCA | 7001 | UGCUG UGAUG GCAUGCACUAUGC CCC ACACCUCUAC | 16341 |
| 933 | CCAGUGGGCU G AUGAC | 7002 | GUCAU UGAUC GCAUCCACUAUGC GCG AGCCCACUGG | 16342 |
| 936 | GUGGGCUGAU G ACCAA | 7003 | UUGGU UGAUG GCAUGCACUAUGC GCG AUCAGCCCAC | 16343 |
| 970 | CAGGGUCCAU G AAAAA | 7004 | UUUUU UGAUG GCAUGCACUAUGC GCG AUGGACCCUG | 16344 |
| 985 | ACCUUUUGUU G CUUUU | 7005 | AAAAG UGAUG GCAUGCACUAUGC GCG AACAAAAGGU | 16345 |
| 1048 | CAGAAUCCCU G CGAAG | 7006 | CUUCG UGAUG GCAUGCACUAUGC GCG AGGGAUUCUG | 16346 |
| 1050 | GAAUCCCUGC G AAGUA | 7007 | UACUU UGAUG GCAUGCACUAUCC CCC GCAGCGAUUC | 16347 |
| 1108 | AAUACCCCUU G AGUCC | 7008 | GGACU UGAUG GCAUGCACUAUGC GCG AAGGGGUAUU | 16348 |
| 1143 | GGCAUGUACU G ACGAU | 7009 | AUCGU UGAUG GCAUGCACUAUGC GCG AGUACAUGCC | 16349 |
| 1146 | AUGUACUGAC G AUUAU | 7010 | AUAAU UGAUG GCAUGCACUAUGC GCG GUCAGUACAU | 16350 |
| 1158 | UUAUGGAAGU G AGUGA | 7011 | UCACU UGAUG GCAUGCACUAUGC GCG ACUUCCAUAA | 16351 |
| 1162 | GGAAGUGAGU G AAAGA | 7012 | UCUUU UGAUG GCAUGCACUAUGC GCG ACUCACUUCC | 16352 |
| 1267 | CCAGAUUGGU G AGAAA | 7013 | UUUCU UGAUG GCAUGCACUAUGC GCG ACCAAUCUGG | 16353 |
| 1320 | CCACUCAAAC G CUGAC | 7014 | GUCAG UGAUG GCAUGCACUAUGC GCG GUUUGAGUGG | 16354 |
| 1323 | CUCAAACGCU G ACAUG | 7015 | CAUGU UGAUG GCAUGCACUAUGC GCG AGCGUUUGAG | 16355 |
| 1339 | UACGGUCUAU G CCAUU | 7016 | AAUGG UGAUG GCAUGCACUAUGC GCG AUAGACCGUA | 16356 |
| 1353 | UUCCUCCCCC G CAUCA | 7017 | UGAUG UGAUG GCAUGCACUAUGC GCG GGGGGAGGAA | 16357 |
| 1391 | GAGGAAGAGU G CGCCA | 7018 | UGGCG UGAUG GCAUGCACUAUGC GCG ACUCUUCCUC | 16358 |
| 1393 | GGAAGAGUGC G CCAAC | 7019 | GUGUG UGAUG GCAUGCACUAUGC GCG GCACUCUUCC | 16359 |
| 1399 | GUGCGCCAAC G AGCCC | 7020 | GGGCU UGAUG GCAUGCACUAUGC GCG GUUGGCGCAC | 16360 |
| 1422 | CUGUCUCAGU G ACAAA | 7021 | UUUGU UGAUG GCAUGCACUAUGC GCG ACUGAGACAG | 16361 |
| 1441 | AUACCCUUGU G AAGAA | 7022 | UUCUU UGAUG GCAUGCACUAUGC GCG ACAAGGGUAU | 16362 |
| 1486 | AAAUAAAAUU G AAGUU | 7023 | AACUU UGAUG GCAUGCACUAUGC GCG AAUUUUAUUU | 16363 |
| 1507 | AAAUCAAUUU G CUCUA | 7024 | UAGAG UGAUG GCAUGCACUAUGC GCG AAAUUGAUUU | 16364 |
| 1516 | UGCUCUAAUU G AAGGA | 7025 | UCCUU UGAUG GCAUGCACUAUGC GCG AAUUAGAGCA | 16365 |
| 1585 | GUACAAAUGU G AAGCG | 7026 | CGCUU UGAUG GCAUGCACUAUGC GCG ACAUUUGUAC | 16366 |
| 1620 | GAGAGAGGGU G AUCUC | 7027 | GAGAU UGAUG GCAUGCACUAUGC GCG ACCCUCUCUC | 16367 |
| 1635 | CCUUCCACGU G ACCAG | 7028 | CUGGU UGAUG GCAUGCACUAUGC GCG ACGUGGAAGG | 16368 |
| 1648 | CAGGGGUCCU G AAAUU | 7029 | AAUUU UGAUG GCAUGCACUAUGC GCG AGGACCCCUG | 16369 |
| 1659 | AAAUUACUUU G CAACC | 7030 | GGUUG UGAUG GCAUGCACUAUGC GCG AAAGUAAUUU | 16370 |
| 1666 | UUUGCAACCU G ACAUG | 7031 | CAUGU UGAUG GCAUGCACUAUGC GCG AGGUUGCAAA | 16371 |
| 1671 | AACCUGACAU G CAGCC | 7032 | GGCUG UGAUG GCAUGCACUAUGC GCG AUGUCAGGUU | 16372 |
| 1681 | GCAGCCCACU G AGCAG | 7033 | CUGCU UGAUG GCAUGCACUAUGC GCG AGUGGGCUGC | 16373 |
| 1706 | UCUUUGUGGU G CACUG | 7034 | CAGUG UGAUG GCAUGCACUAUGC GCG ACCACAAAGA | 16374 |
| 1711 | GUGGUGCACU G CAGAC | 7035 | GUCUG UGAUG GCAUGCACUAUGC GCG AGUGCACCAC | 16375 |

TABLE XVII-continued

KDR G-Cleaver Ribozyme and Target Sequences

| Pos | Target | Seq ID No | Ribozyme Sequence | Seq ID No |
|---|---|---|---|---|
| 1729 | AUCUACGUUU G AGAAC | 7036 | GUUCU UGAUG GCAUGCACUAUGC GCG AAACGUAGAU | 16376 |
| 1767 | CACAGCCUCU G CCAAU | 7037 | AUUGG UGAUG GCAUGCACUAUGC GCG AGAGGCUGUG | 16377 |
| 1788 | UGGGAGAGUU G CCCAC | 7038 | GUGGG UGAUG GCAUGCACUAUGC GCG AACUCUCCCA | 16378 |
| 1802 | ACACCUGUUU G CAAGA | 7039 | UCUUG UGAUG GCAUGCACUAUGC GCG AAACAGGUGU | 16379 |
| 1830 | UUUGGAAAUU G AAUGC | 7040 | GCAUU UGAUG GCAUGCACUAUGC GCG AAUUUCCAAA | 16380 |
| 1834 | GAAAUUGAAU G CCACC | 7041 | GGUGG UGAUG GCAUGCACUAUGC GCG AUUCAAUUUC | 16381 |
| 1861 | UAGCACAAAU G ACAUU | 7042 | AAUGU UGAUG GCAUGCACUAUGC GCG AUUUGUGCUA | 16382 |
| 1869 | AUGACAUUUU G AUCAU | 7043 | AUGAU UGAUG GCAUGCACUAUGC GCG AAAAUGUCAU | 16383 |
| 1888 | GCUUAAGAAU G CAUCC | 7044 | GGAUG UGAUG GCAUGCACUAUGC GCG AUUCUUAAGC | 16384 |
| 1896 | AUGCAUCCUU G CAGGA | 7045 | UCCUG UGAUG GCAUGCACUAUGC GCG AAGGAUGCAU | 16385 |
| 1919 | GACUAUGUCU G CCUUG | 7046 | CAAGG UGAUG GCAUGCACUAUGC GCG AGACAUAGUC | 16386 |
| 1924 | UGUCUGCCUU G CUCAA | 7047 | UUGAG UGAUG GCAUGCACUAUGC GCG AAGGCAGACA | 16387 |
| 1955 | AAAAGACAUU G CGUGG | 7048 | CCACG UGAUG GCAUGCACUAUGC GCG AAUGUCUUUU | 16388 |
| 1998 | UGGCACCCAC G AUCAC | 7049 | GUGAU UGAUG GCAUGCACUAUGC GCG GUGGGUGCCA | 16389 |
| 2025 | AGAAUCAGAC G ACAAG | 7050 | CUUGU UGAUG GCAUGCACUAUGC GCG GUCUGAUUCU | 16390 |
| 2047 | GGAAAGCAUC G AAGUC | 7051 | GACUU UGAUG GCAUGCACUAUGC GCG GAUGCUUUCC | 16391 |
| 2057 | GAAGUCUCAU G CACGG | 7052 | CCGUG UGAUG GCAUGCACUAUGC GCG AUGAGACUUC | 16392 |
| 2107 | UAAAGAUAAU G AGACC | 7053 | GGUCU UGAUG GCAUGCACUAUGC GCG AUUAUCUUUA | 16393 |
| 2139 | GCAUUGUAUU G AAGGA | 7054 | UCCUU UGAUG GCAUGCACUAUGC GCG AAUACAAUGC | 16394 |
| 2168 | CUCACUAUCC G CAGAG | 7055 | CUCUG UGAUG GCAUGCACUAUGC GCG GGAUAGUGAG | 16395 |
| 2175 | UCCGCAGAGU G AGGAA | 7056 | UUCCU UGAUG GCAUGCACUAUGC GCG ACUCUGCGGA | 16396 |
| 2188 | GAAGGAGGAC G AAGGC | 7057 | GCCUU UGAUG GCAUGCACUAUGC GCG GUCCUCCUUC | 16397 |
| 2204 | CUCUACACCU G CCAGG | 7058 | CCUGG UGAUG GCAUGCACUAUGC GCG AGGUGUAGAG | 16398 |
| 2213 | UGCCAGGCAU G CAGUG | 7059 | CACUG UGAUG GCAUGCACUAUGC GCG AUGCCUGGCA | 16399 |
| 2230 | UCUUGGCUGU G CAAAA | 7060 | UUUUG UGAUG GCAUGCACUAUGC GCG ACAGCCAAGA | 16400 |
| 2263 | AAUAGAAGGU G CCCAG | 7061 | CUGGG UGAUG GCAUGCACUAUGC GCG ACCUUCUAUU | 16401 |
| 2277 | AGGAAAAGAC G AACUU | 7062 | AAGUU UGAUG GCAUGCACUAUGC GCG GUCUUUUCCU | 16402 |
| 2307 | UAGUAGGCAC G ACGGU | 7063 | ACCGU UGAUG GCAUGCACUAUGC GCG GUGCCUACUA | 16403 |
| 2313 | GCACGACGGU G AUUGC | 7064 | GCAAU UGAUG GCAUGCACUAUGC GCG ACCGUCGUGC | 16404 |
| 2317 | GACGGUGAUU G CCAUG | 7065 | CAUGG UGAUG GCAUGCACUAUGC GCG AAUCACCGUC | 16405 |
| 2385 | GAGGGGAACU G AAGAC | 7066 | GUCUU UGAUG GCAUGCACUAUGC GCG AGUUCCCCUC | 16406 |
| 2422 | GGAUCCAGAU G AACUC | 7067 | GAGUU UGAUG GCAUGCACUAUGC GCG AUCUGGAUCC | 16407 |
| 2437 | CCCAUUGGAU G AACAU | 7068 | AUGUU UGAUG GCAUGCACUAUGC GCG AUCCAAUGGG | 16408 |
| 2446 | UGAACAUUGU G AACGA | 7069 | UCGUU UGAUG GCAUGCACUAUGC GCG ACAAUGUUCA | 16409 |
| 2450 | CAUUGUGAAC G ACUGC | 7070 | GCAGU UGAUG GCAUGCACUAUGC GCG GUUCACAAUG | 16410 |
| 2454 | GUGAACGACU G CCUUA | 7071 | UAAGG UGAUG GCAUGCACUAUGC GCG AGUCGUUCAC | 16411 |
| 2461 | ACUGCCUUAU G AUGCC | 7072 | GGCAU UGAUG GCAUGCACUAUGC GCG AUAAGGCAGU | 16412 |

TABLE XVII-continued

KDR G-Cleaver Ribozyme and Target Sequences

| Pos | Target | Seq ID No | Ribozyme Sequence | Seq ID No |
|---|---|---|---|---|
| 2464 | GCCUUAUGAU G CCAGC | 7073 | GCUGG UGAUG GCAUGCACUAUGC GCG AUCAUAAGGC | 16413 |
| 2496 | GAGACCGGCU G AACCU | 7074 | AGGUU UGAUG GCAUGCACUAUGC GCG AGCCGGUCUC | 16414 |
| 2524 | UGGCCGUGGU G CCUUU | 7075 | AAAGG UGAUG GCAUGCACUAUGC GCG ACCACGGCCA | 16415 |
| 2542 | CCAAGAGAUU G AAGCA | 7076 | UGCUU UGAUG GCAUGCACUAUGC GCG AAUCUCUUGG | 16416 |
| 2551 | UGAAGCAGAU G CCUUU | 7077 | AAAGG UGAUG GCAUGCACUAUGC GCG AUCUGCUUCA | 16417 |
| 2563 | CUUUGGAAUU G ACAAG | 7078 | CUUGU UGAUG GCAUGCACUAUGC GCG AAUUCCAAAG | 16418 |
| 2579 | ACAGCAACUU G CAGGA | 7079 | UCCUG UGAUG GCAUGCACUAUGC GCG AAGUUGCUGU | 16419 |
| 2604 | UCAAAAUGUU G AAAGA | 7080 | UCUUU UGAUG GCAUGCACUAUGC GCG AACAUUUUGA | 16420 |
| 2626 | AACACACAGU G AGCAU | 7081 | AUGCU UGAUG GCAUGCACUAUGC GCG ACUGUGUGUU | 16421 |
| 2633 | AGUGAGCAUC G ACCUC | 7082 | GAGCU UGAUG GCAUGCACUAUGC GCG GAUGCUCACU | 16422 |
| 2647 | UCUCAUGUCU G AACUC | 7083 | GAGUU UGAUG GCAUGCACUAUGC GCG AGACAUGAGA | 16423 |
| 2704 | CCUUCUAGGU G CCUGU | 7084 | ACAGG UGAUG GCAUGCACUAUGC GCG ACCUAGAAGG | 16424 |
| 2736 | CACUCAUGGU G AUUGU | 7085 | ACAAU UGAUG GCAUGCACUAUGC GCG ACCAUGAGUG | 16425 |
| 2750 | GUGGAAUUCU G CAAAU | 7086 | AUUUG UGAUG GCAUGCACUAUGC GCG AGAAUUCCAC | 16426 |
| 2778 | CCACUUACCU G AGGAG | 7087 | CUCCU UGAUG GCAUGCACUAUGC GCG AGGUAAGUGG | 16427 |
| 2794 | CAAGAGAAAU G AAUUU | 7088 | AAAUU UGAUG GCAUGCACUAUGC GCG AUUUCUCUUG | 16428 |
| 2825 | AAAGGGGCAC G AUUCC | 7089 | GGAAU UGAUG GCAUGCACUAUGC GCG GUGCCCCUUU | 16429 |
| 2871 | CUGUGGAUCU G AAACG | 7090 | CGUUU UGAUG GCAUGCACUAUGC GCG AGAUCCACAG | 16430 |
| 2879 | CUGAAACGGC G CUUGG | 7091 | CCAAG UGAUG GCAUGCACUAUGC GCG GCCGUUUCAG | 16431 |
| 2947 | GUCCCUCAGU G AUGUA | 7092 | UACAU UGAUG GCAUGCACUAUGC GCG ACUGAGGGAC | 16432 |
| 2971 | GGAAGCUCCU G AAGAU | 7093 | AUCUU UGAUG GCAUGCACUAUGC GCG AGGAGCUUCC | 16433 |
| 2994 | AGGACUUCCU G ACCUU | 7094 | AAGGU UGAUG GCAUGCACUAUGC GCG AGGAAGUCCU | 16434 |
| 3057 | UCUUGGCAUC G CGAAA | 7095 | UUUCG UGAUG GCAUGCACUAUGC GCG GAUGCCAAGA | 16435 |
| 3059 | UUGGCAUCGC G AAAGU | 7096 | ACUUU UGAUG GCAUGCACUAUGC GCG GCGAUGCCAA | 16436 |
| 3089 | CUGGCGGCAC G AAAUA | 7097 | UAUUU UGAUG GCAUGCACUAUGC GCG GUGCCGCCAG | 16437 |
| 3130 | UAAAAUCUGU G ACUUU | 7098 | AAAGU UGAUG GCAUGCACUAUGC GCG ACAGAUUUUA | 16438 |
| 3187 | AAAAGGAGAU G CUCGC | 7099 | GCGAG UGAUG GCAUGCACUAUGC GCG AUCUCCUUUU | 16439 |
| 3191 | GGAGAUGCUC G CCUCC | 7100 | GGAGG UGAUG GCAUGCACUAUGC GCG GAGCAUCUCC | 16440 |
| 3201 | GCCUCCCUUU G AAAUG | 7101 | CAUUU UGAUG GCAUGCACUAUGC GCG AAAGGGAGGC | 16441 |
| 3229 | AACAAUUUUU G ACAGA | 7102 | UCUGU UGAUG GCAUGCACUAUGC GCG AAAAAUUGUU | 16442 |
| 3253 | AAUCCAGAGU G ACUUC | 7103 | GACGU UGAUG GCAUGCACUAUGC GCG ACUCUGGAUU | 16443 |
| 3276 | UUGGUGUUUU G CUGUG | 7104 | CACAG UGAUG GCAUGCACUAUGC GCG AAAACACCAA | 16444 |
| 3301 | UUCCUUAGGU G CUUCU | 7105 | AGAAG UGAUG GCAUGCACUAUGC GCG ACCUAAGGAA | 16445 |
| 3328 | GGUAAAGAUU G AUGAA | 7106 | UUCAU UGAUG GCAUGCACUAUGC GCG AAUCUUUACC | 16446 |
| 3331 | AAAGAUUGAU G AAGAA | 7107 | UUCUU UGAUG GCAUGCACUAUGC GCG AUCAAUCUUU | 16447 |
| 3347 | UUUUGUAGGC G AUUGA | 7108 | UCAAU UGAUG GCAUGCACUAUGC GCG GCCUACAAAA | 16448 |
| 3351 | GUAGGCGAUU G AAAGA | 7109 | UCUUU UGAUG GCAUGCACUAUGC GCG AAUCGCCUAC | 16449 |

TABLE XVII-continued

KDR G-Cleaver Ribozyme and Target Sequences

| Pos | Target | Seq ID No | Ribozyme Sequence | Seq ID No |
|---|---|---|---|---|
| 3369 | GAACUAGAAU G AGGGC | 7110 | GCCCU UGAUG GCAUGCACUAUGC GCG AUUCUAGUUC | 16450 |
| 3379 | GAGGGCCCCU G AUUAU | 7111 | AUAAU UGAUG GCAUGCACUAUGC GCG AGGGGCCCUC | 16451 |
| 3411 | ACCAGACCAU G CUGGA | 7112 | UCCAG UGAUG GCAUGCACUAUGC GCG AUGGUCUGGU | 16452 |
| 3419 | AUGCUGGACU G CUGGC | 5872 | GCCAG UGAUG GCAUGCACUAUGC GCG AGUCCAGCAU | 15212 |
| 3486 | GAAAUCUCUU G CAAGC | 7113 | GCUUG UGAUG GCAUGCACUAUGC GCG AAGAGAUUUC | 16453 |
| 3496 | GCAAGCUAAU G CUCAG | 7114 | CUGAG UGAUG GCAUGCACUAUGC GCG AUUAGCUUGC | 16454 |
| 3531 | UUGUUCUUCC G AUAUC | 7115 | GAUAU UGAUG GCAUGCACUAUGC GCG GGAAGAACAA | 16455 |
| 3546 | CAGAGACUUU G AGCAU | 7116 | AUGCU UGAUG GCAUGCACUAUGC GCG AAAGUCUCUG | 16456 |
| 3576 | GACUCUCUCU G CCUAC | 7117 | GUAGG UGAUG GCAUGCACUAUGC GCG AGAGAGAGUC | 16457 |
| 3619 | GGAAGUAUGU G ACCCC | 7118 | GGGGU UGAUG GCAUGCACUAUGC GCG ACAUACUUCC | 16458 |
| 3637 | AUUCCAUUAU G ACAAC | 7119 | GUUGU UGAUG GCAUGCACUAUGC GCG AUAAUGGAAU | 16459 |
| 3666 | GUCAGUAUCU G CAGAA | 7120 | UCCUG UGAUG GCAUGCACUAUGC GCG AGAUACUGAC | 16460 |
| 3680 | AACAGUAAGC G AAAGA | 7121 | UCUUU UGAUG GCAUGCACUAUGC GCG GCUUACUGUU | 16461 |
| 3696 | GCCGGCCUGU G AGUGU | 7122 | ACACU UGAUG GCAUGCACUAUGC GCG ACAGGCCGGC | 16462 |
| 3712 | AAAAACAUUU G AAGAU | 7123 | AUCUU UGAUG GCAUGCACUAUGC GCG AAAUGUUUUU | 16463 |
| 3757 | AAUCCCAGAU G ACAAC | 7124 | GUUGU UGAUG GCAUGCACUAUGC GCG AUCUGGGAUU | 16464 |
| 3787 | UAUGGUUCUU G CCUCA | 7125 | UGAGG UGAUG GCAUGCACUAUGC GCG AAGAACCAUA | 16465 |
| 3801 | CAGAAGAGCU G AAAAC | 7126 | GUUUU UGAUG GCAUGCACUAUGC GCG AGCUCUUCUG | 16466 |
| 3852 | GUGGAAUGGU G CCCAG | 7127 | CUGGG UGAUG GCAUGCACUAUGC GCG ACCAUUCCAC | 16467 |
| 3883 | UGUGGCAUCU G AAGGC | 7128 | GCCUU UGAUG GCAUGCACUAUGC GCG AGAUGCCACA | 16468 |
| 3928 | AUAUCACUCC G AUGAC | 7129 | GUCAU UGAUG GCAUGCACUAUGC GCG GGAGUGAUAU | 16469 |
| 3931 | UCACUCCGAU G ACACA | 7130 | UGUGU UGAUG GCAUGCACUAUGC GCG AUCGGAGUGA | 16470 |
| 3958 | GUACUCCAGU G AGGAA | 7131 | UUCCU UGAUG GCAUGCACUAUGC GCG ACUGGAGUAC | 16471 |
| 3981 | UUUUAAAGCU G AGAGA | 7132 | UCUAU UGAUG GCAUGCACUAUGC GCG AGCUUUAAAA | 16472 |
| 3996 | AGAUUGGAGU G CAAAC | 7133 | GUUUG UGAUG GCAUGCACUAUGC GCG ACUCCAAUCU | 16473 |
| 4030 | UCUCCAGCCU G ACACG | 7134 | CGUGU UGAUG GCAUGCACUAUGC GCG AGGCUGGAGA | 16474 |
| 4047 | GGACCACACU G AGCUC | 7135 | GAGCU UGAUG GCAUGCACUAUGC GCG AGUGUGGUCC | 16475 |
| 4103 | GACAUCACAU G AGAGG | 7136 | CCUCU UGAUG GCAUGCACUAUGC GCG AUGUGAUGUC | 16476 |
| 4112 | UGAGAGGUCU G CUCAG | 7137 | CUGAG UGAUG GCAUGCACUAUGC GCG AGACCUCUCA | 16477 |
| 4123 | CUCAGAUUUU G AAGUG | 7138 | CACUU UGAUG GCAUGCACUAUGC GCG AAAAUCUGAG | 16478 |
| 4157 | GGAAGUAGCC G CAUUU | 7139 | AAAUG UGAUG GCAUGCACUAUGC GCG GGCUACUUCC | 16479 |
| 4163 | AGCCGCAUUU G AUUUU | 7140 | AAAAU UGAUG GCAUGCACUAUGC GCG AAAUGCGGCU | 16480 |
| 4175 | UUUUCAUUUC G ACAAC | 7141 | GUUGU UGAUG GCAUGCACUAUGC GCG GAAAUGAAAA | 16481 |
| 4200 | ACCUCGGACU G CAGGG | 7142 | CCCUG UGAUG GCAUGCACUAUGC GCG AGUCCGAGGU | 16482 |

TABLE XVIII

Human FLT DNAzyme and Substrate Sequence

| Pos | Substrate | Seq ID No | DNAzyme | Seq ID No |
|---|---|---|---|---|
| 17 | UCCUCUCG G CUCCUCCC | 7143 | GGGAGGAG GGCTAGCTACAACGA CGAGAGGA | 16483 |
| 28 | CCUCCCCG G CAGCGGCG | 7144 | CGCCGCTG GGCTAGCTACAACGA CGGGGAGG | 16484 |
| 31 | CCCCGGCA G CGGCGGCG | 7145 | CGCCGCCG GGCTAGCTACAACGA TGCCGGGG | 16485 |
| 34 | CGGCAGCG G CGGCGGCU | 7146 | AGCCGCCG GGCTAGCTACAACGA CGCTGCCG | 16486 |
| 37 | CAGCGGCG G CGGCUCGG | 7147 | CCGAGCCG GGCTAGCTACAACGA CGCCGCTG | 16487 |
| 40 | CGGCGGCG G CUCGGAGC | 7148 | GCTCCGAG GGCTAGCTACAACGA CGCCGCCG | 16488 |
| 47 | GGCUCGGA G CGGGCUCC | 7149 | GGAGCCCG GGCTAGCTACAACGA TCCGAGCC | 16489 |
| 51 | CGGAGCGG G CUCCGGGG | 7150 | CCCCGGAG GGCTAGCTACAACGA CCGCTCCG | 16490 |
| 59 | GCUCCGGG G CUCGGGUG | 7151 | CACCCGAG GGCTAGCTACAACGA CCCGGAGC | 16491 |
| 65 | GGGCUCGG G UGCAGCGG | 7152 | CCGCTGCA GGCTAGCTACAACGA CCGAGCCC | 16492 |
| 67 | GCUCGGGU G CAGCGGCC | 7153 | GGCCGCTG GGCTAGCTACAACGA ACCCGAGC | 16493 |
| 70 | CGGGUGCA G CGGCCAGC | 7154 | GCTGGCCG GGCTAGCTACAACGA TGCACCCG | 16494 |
| 73 | GUGCAGCG G CCAGCGGG | 7155 | CCCGCTGG GGCTAGCTACAACGA CGCTGCAC | 16495 |
| 77 | AGCGCCCA G CGGGCCUG | 7156 | CAGGCCCG GGCTAGCTACAACGA TGGCCGCT | 16496 |
| 81 | GCCAGCGG G CCUGGCGG | 7157 | CCGCCAGG GGCTAGCTACAACGA CCGCTGGC | 16497 |
| 86 | CGGGCCUG G CGGCGAGG | 7158 | CCTCGCCG GGCTAGCTACAACGA CAGGCCCG | 16498 |
| 89 | GCCUGGCG G CGAGGAUU | 7159 | AATCCTCG GGCTAGCTACAACGA CGCCAGGC | 16499 |
| 95 | CGGCGAGG A UUACCCGG | 7160 | CCGGGTAA GGCTAGCTACAACGA CCTCGCCG | 16500 |
| 98 | CGAGGAUU A CCCGGGGA | 10 | TCCCCGGG GGCTAGCTACAACGA AATCCTCG | 16501 |
| 108 | CCGGGGAA G UGGUUGUC | 7161 | GACAACCA GGCTAGCTACAACGA TTCCCCGG | 16502 |
| 111 | GGGAAGUG G UUGUCUCC | 7162 | GGAGACAA GGCTAGCTACAACGA CACTTCCC | 16503 |
| 114 | AAGUGGUU G UCUCCUGG | 7163 | CCAGGAGA GGCTAGCTACAACGA AACCACTT | 16504 |
| 122 | GUCUCCUG G CUGGAGCC | 7164 | GGCTCCAG GGCTAGCTACAACGA CAGGAGAC | 16505 |
| 128 | UGGCUGGA G CCGCGAGA | 7165 | TCTCGCGG GGCTAGCTACAACGA TCCAGCCA | 16506 |
| 131 | CUGGAGCC G CGAGACGG | 7166 | CCGTCTCG GGCTAGCTACAACGA GGCTCCAG | 16507 |
| 136 | GCCGCGAG A CGGGCGCU | 7167 | AGCGCCCG GGCTAGCTACAACGA CTCGCGGC | 16508 |
| 140 | CGAGACGG G CGCUCAGG | 7168 | CCTGAGCG GGCTAGCTACAACGA CCGTCTCG | 16509 |
| 142 | AGACGGGC G CUCAGGGC | 7169 | GCCCTGAG GGCTAGCTACAACGA GCCCGTCT | 16510 |
| 149 | CGCUCAGG G CGCGGGGC | 7170 | GCCCCGCG GGCTAGCTACAACGA CCTGAGCG | 16511 |
| 151 | CUCAGGGC G CGGGGCCG | 7171 | CGGCCCCG GGCTAGCTACAACGA GCCCTGAG | 16512 |
| 156 | GGCGCGGG G CCGGCGGC | 7172 | GCCGCCGG GGCTAGCTACAACGA CCCGCGCC | 16513 |
| 160 | CGGGGCCG G CGGCGGCG | 7173 | CGCCGCCG GGCTAGCTACAACGA CGGCCCCG | 16514 |
| 163 | GGCCGGCG G CGGCGAAC | 7174 | GTTCGCCG GGCTAGCTACAACGA CGCCGGCC | 16515 |
| 166 | CGGCGGCG G CGAACGAG | 7175 | CTCGTTCG GGCTAGCTACAACGA CGCCGCCG | 16516 |
| 170 | GGCGGCGA A CGAGAGGA | 7176 | TCCTCTCG GGCTAGCTACAACGA TCGCCGCC | 16517 |
| 178 | ACGAGAGG A CGGACUCU | 7177 | AGAGTCCG GGCTAGCTACAACGA CCTCTCGT | 16518 |
| 182 | GAGGACGG A CUCUGGCG | 7178 | CGCCAGAG GGCTAGCTACAACGA CCGTCCTC | 16519 |

TABLE XVIII-continued

Human FLT DNAzyme and Substrate Sequence

| Pos | Substrate | Seq ID No | DNAzyme | Seq ID No |
|---|---|---|---|---|
| 188 | GGACUCUG G CGGCCGGG | 7179 | CCCGGCCG GGCTAGCTACAACGA CAGAGTCC | 16520 |
| 191 | CUCUGGCG G CCGGGUCG | 7180 | CGACCCGG GGCTAGCTACAACGA CGCCAGAG | 16521 |
| 196 | GCGGCCGG G UCGUUGGC | 7181 | GCCAACGA GGCTAGCTACAACGA CCGGCCGC | 16522 |
| 199 | GCCGGGUC G UUGGCCGG | 7182 | CCGGCCAA GGCTAGCTACAACGA GACCCGGC | 16523 |
| 203 | GGUCGUUG G CCGGGGGA | 7183 | TCCCCCGG GGCTAGCTACAACGA CAACGACC | 16524 |
| 212 | CCGGGGGA G CGCGGGCA | 7184 | TGCCCGCG GGCTAGCTACAACGA TCCCCCGG | 16525 |
| 214 | GGGGGAGC G CGGGCACC | 7185 | GGTGCCCG GGCTAGCTACAACGA GCTCCCCC | 16526 |
| 218 | GAGCGCGG G CACCGGGC | 7186 | GCCCGGTG GGCTAGCTACAACGA CCGCGCTC | 16527 |
| 220 | GCGCGGGC A CCGGGCGA | 4191 | UCGCCCGG GGCTAGCTACAACGA GCCCGCGC | 16528 |
| 225 | GGCACCGG G CGAGCAGG | 7187 | CCTGCTCG GGCTAGCTACAACGA CCGGTGCC | 16529 |
| 229 | CCGGGCGA G CAGGCCGC | 7188 | GCGGCCTG GGCTAGCTACAACGA TCGCCCGG | 16530 |
| 233 | GCGAGCAG G CCGCGUCG | 7189 | CGACGCGG GGCTAGCTACAACGA CTGCTCGC | 16531 |
| 236 | AGCAGGCC G CGUCGCGC | 7190 | GCGCGACG GGCTAGCTACAACGA GGCCTGCT | 16532 |
| 238 | CAGGCCGC G UCGCGCUC | 7191 | GAGCGCGA GGCTAGCTACAACGA GCGGCCTG | 16533 |
| 241 | GCCGCGUC G CGCUCACC | 7192 | GGTGAGCG GGCTAGCTACAACGA GACGCGGC | 16534 |
| 243 | CGCGUCGC G CUCACCAU | 7193 | ATGGTGAG GGCTAGCTACAACGA GCGACGCG | 16535 |
| 247 | UCGCGCUC A CCAUGGUC | 4196 | GACCATGG GGCTAGCTACAACGA GAGCGCGA | 16536 |
| 250 | CGCUCACC A UGGUCAGC | 4198 | GCTGACCA GGCTAGCTACAACGA GGTGAGCG | 16537 |
| 253 | UCACCAUG C UCAGCUAC | 7194 | GTAGCTGA GGCTAGCTACAACGA CATGGTGA | 16538 |
| 257 | CAUGGUCA G CUACUGGG | 7195 | CCCAGTAG GGCTAGCTACAACGA TGACCATG | 16539 |
| 260 | GGUCAGCU A CUGGGACA | 21 | UGTCCCAG GGCTAGCTACAACGA AGCTGACC | 16540 |
| 266 | CUACUGGG A CACCGGGG | 7196 | CCCCGGTG GGCTAGCTACAACGA CCCAGTAG | 16541 |
| 268 | ACUGGGAC A CCGGGGUC | 4202 | GACCCCGG GGCTAGCTACAACGA GTCCCAGT | 16542 |
| 274 | ACACCGGG C UCCUGCUG | 7197 | CACCAGGA GGCTAGCTACAACGA CCCGGTGT | 16543 |
| 279 | GGGGUCCU G CUGUGCGC | 7198 | GCGCACAG GGCTAGCTACAACGA AGGACCCC | 16544 |
| 282 | GUCCUGCU G UGCGCGCU | 7199 | ACCGCGCA GGCTAGCTACAACGA AGCAGGAC | 16545 |
| 284 | CCUGCUGU G CGCGCUGC | 7200 | GCAGCGCG GGCTAGCTACAACGA ACAGCAGG | 16546 |
| 286 | UGCUGUGC G CGCUGCUC | 7201 | GAGCAGCG GGCTAGCTACAACGA GCACAGCA | 16547 |
| 288 | CUGUGCGC C CUCCUCAG | 7202 | CTGAGCAG GCCTAGCTACAACGA GCGCACAG | 16548 |
| 291 | UGCGCGCU C CUCAGCUG | 7203 | CAGCTGAG GGCTAGCTACAACGA AGCGCGCA | 16549 |
| 296 | GCUCCUCA C CUGUCUGC | 7204 | GCAGACAG CGCTAGCTACAACGA TGAGCAGC | 16550 |
| 299 | CCUCAGCU G UCUCCGUC | 7205 | GAAGCAGA GGCTAGCTACAACGA AGCTGAGC | 16551 |
| 303 | AGCUCUCU G CUUCUCAC | 7206 | GTGAGAAG CGCTAGCTACAACGA AGACAGCT | 16552 |
| 310 | UGCUUCUC A CACCAUCU | 4214 | AGATCCTG GGCTAGCTACAACGA GAGAAGCA | 16553 |
| 315 | CUCACACG A UCUAGUUC | 7207 | GAACTAGA CGCTACCTACAACGA CCTGTGAC | 16554 |
| 320 | ACCAUCUA G UUCAGCUU | 7208 | AACCTGAA GGCTAGCTACAACGA TACATCCT | 16555 |
| 326 | UAGUUCAG C UUCAAAAU | 7209 | ATTTTGAA GCCTAGCTACAACGA CTGAACTA | 16556 |

TABLE XVIII-continued

Human FLT DNAzyme and Substrate Sequence

| Pos | Substrate | Seq ID No | DNAzyme | Seq ID No |
|-----|-----------|-----------|---------|-----------|
| 333 | GGUUCAAA A UUAAAAGA | 7210 | TCTTTTAA GGCTAGCTACAACGA TTTGAACC | 16557 |
| 341 | AUUAAAAG A UCCUGAAC | 7211 | GTTCAGGA GGCTAGCTACAACGA CTTTTAAT | 16558 |
| 348 | GAUCCUCA A CUGACUUU | 7212 | AAACTCAG GGCTAGCTACAACGA TCAGGATC | 16559 |
| 353 | UGAACUGA G UUUAAAAG | 7213 | CTTTTAAA GGCTAGCTACAACGA TCAGTTCA | 16560 |
| 362 | UUUAAAAG C CACCCAGC | 7214 | GCTGGGTG GGCTAGCTACAACGA CTTTTAAA | 16561 |
| 364 | UAAAAGGC A CCCAGCAC | 4222 | CTCCTCCG GGCTAGCTACAACGA GCCTTTTA | 16562 |
| 369 | CCCACCCA C CACAUCAU | 7215 | ATCATGTC GGCTAGCTACAACGA TCCGTGCC | 16563 |
| 371 | CACCCAGC A CAUCAUGC | 4226 | GCATGATG GGCTAGCTACAACGA CCTCGGTG | 16564 |
| 373 | CCCAGCAC A UCAUGCAA | 4227 | TTGCATCA GGCTAGCTACAACGA GTCCTGCC | 16565 |
| 376 | ACCACAUC A UCCAAGCA | 4228 | TCCTTCCA GGCTAGCTACAACGA CATCTGCT | 16566 |
| 378 | CACAUCAU C CAAGCAGG | 7216 | CCTGCTTG GGCTACCTACAACGA ATGATGTG | 16567 |
| 382 | UCAUCCAA C CAGGCCAG | 7217 | CTGGCCTC GGCTAGCTACAACGA TTCCATGA | 16568 |
| 386 | GCAAGCAG C CCAGACAC | 7218 | GTCTCTGC GGCTAGCTACAACGA CTGCTTCC | 16569 |
| 391 | CACCCCAG A CACUGCAU | 7219 | ATCCAGTC GGCTACCTACAACGA CTCCCCTC | 16570 |
| 393 | GGCCACAC A CUGCAUCU | 4233 | ACATCCAC GGCTAGCTACAACGA CTCTGGCC | 16571 |
| 396 | CAGACACU C CAUCUCCA | 7220 | TGCACATC GGCTAGCTACAACGA ACTGTCTG | 16572 |
| 398 | CACACUGC A UCUCCAAU | 4235 | ATTGCAGA GGCTAGCTACAACGA GCACTCTC | 16573 |
| 405 | CAUCUCCA A UCCAGGGC | 7221 | CCCCTCCA GGCTAGCTACAACGA TGCACATG | 16574 |
| 407 | UCUCCAAU C CACGCCGC | 7222 | CCCCCCTG GGCTAGCTACAACGA ATTGCACA | 16575 |
| 418 | GGGGGGAA C CAGCCCAU | 7223 | ATCGCCTC GGCTAGCTACAACGA TTCCCCCC | 16576 |
| 421 | GGGAAGCA G CCCAUAAA | 7224 | TTTATGGG GGCTAGCTACAACGA TGCTTCCC | 16577 |
| 425 | AGCAGCCC A UAAAUGGU | 4243 | ACCATTTA GGCTAGCTACAACGA GGGCTGCT | 16578 |
| 429 | GCCCAUAA A UGGUCUUU | 7225 | AAAGACCA GGCTAGCTACAACGA TTATGGGC | 16579 |
| 432 | CAUAAAUG G UCUUUGCC | 7226 | GGCAAAGA GGCTAGCTACAACGA CATTTATG | 16580 |
| 438 | UGGUCUUU G CCUGAAAU | 7227 | ATTTCAGG GGCTAGCTACAACGA AAAGACCA | 16581 |
| 445 | UGCCUGAA A UGGUGAGU | 7228 | ACTCACCA GGCTAGCTACAACGA TTCAGGCA | 16582 |
| 448 | CUGAAAUG G UGAGUAAG | 7229 | CTTACTCA GGCTAGCTACAACGA CATTTCAG | 16583 |
| 452 | AAUGGUGA G UAAGGAAA | 7230 | TTTCCTTA GGCTAGCTACAACGA TCACCATT | 16584 |
| 461 | UAAGGAAA G CGAAAGGC | 7231 | GCCTTTCG GGCTAGCTACAACGA TTTCCTTA | 16585 |
| 468 | AGCGAAAG G CUGAGCAU | 7232 | ATGCTCAG GGCTAGCTACAACGA CTTTCGCT | 16586 |
| 473 | AAGGCUGA G CAUAACUA | 7233 | TAGTTATG GGCTAGCTACAACGA TCAGCCTT | 16587 |
| 475 | GGCUGAGC A UAACUAAA | 4248 | TTTAGTTA GGCTAGCTACAACGA GCTCAGCC | 16588 |
| 478 | UGAGCAUA A CUAAAUCU | 7234 | AGATTTAG GGCTAGCTACAACGA TATGCTCA | 16589 |
| 483 | AUAACUAA A UCUGCCUG | 7235 | CAGGCAGA GGCTAGCTACAACGA TTAGTTAT | 16590 |
| 487 | CUAAAUCU G CCUGUGGA | 7236 | TCCACAGG QGCTAGCTACAACGA AGATTTAG | 16591 |
| 491 | AUCUGCCU G UGGAAGAA | 7237 | TTCTTCCA GGCTAGCTACAACGA AGGCAGAT | 16592 |
| 500 | UGGAAGAA A UGGCAAAC | 7238 | GTTTGCCA GGCTAGCTACAACGA TTCTTCCA | 16593 |

TABLE XVIII-continued

Human FLT DNAzyme and Substrate Sequence

| Pos | Substrate | Seq ID No | DNAzyme | Seq ID No |
|---|---|---|---|---|
| 503 | AAGAAAUG G CAAACAAU | 7239 | ATTGTTTG GGCTAGCTACAACGA CATTTCTT | 16594 |
| 507 | AAUGGCAA A CAAUUCUG | 7240 | CAGAATTG GGCTAGCTACAACGA TTGCCATT | 16595 |
| 510 | GGCAAACA A UUCUGCAG | 7241 | CTGCAGAA GGCTAGCTACAACGA TGTTTGCC | 16596 |
| 515 | ACAAUUCU G CAGUACUU | 7242 | AAGTACTG GGCTAGCTACAACGA ACAATTGT | 16597 |
| 518 | AUUCUGCA G UACUUUAA | 7243 | TTAAAGTA GGCTAGCTACAACGA TGCAGAAT | 16598 |
| 520 | UCUGCAGU A CUUUAACC | 53 | GGTTAAAG GGCTAGCTACAACGA ACTGCAGA | 16599 |
| 526 | GUACUUUA A CCUUGAAC | 7244 | GTTCAAGG GGCTAGCTACAACGA TAAAGTAC | 16600 |
| 533 | AACCUUGA A CACAGCUC | 7245 | GAGCTGTG GGCTAGCTACAACGA TCAAGGTT | 16601 |
| 535 | CCUUGAAC A CAGCUCAA | 4260 | TTGAGCTG GGCTAGCTACAACGA GTTCAAGG | 16602 |
| 538 | UGAACACA G CUCAAGCA | 7246 | TGCTTGAG GGCTAGCTACAACGA TGTGTTCA | 16603 |
| 544 | CAGCUCAA G CAAACCAC | 7247 | GTGGTTTG GGCTAGCTACAACGA TTGAGCTG | 16604 |
| 548 | UCAAGCAA A CGACACUG | 7248 | CAGTGTGG GGCTAGCTACAACGA TTGCTTGA | 16605 |
| 551 | AGCAAACC A CACUGGCU | 4266 | AGCCAGTG GGCTAGCTACAACGA GGTTTGCT | 16606 |
| 553 | CAAACCAC A CUGGCUUC | 4267 | GAAGCCAG GGCTAGCTACAACGA GTGGTTTG | 16607 |
| 557 | CGACACUG G CUUCUACA | 7249 | TGTAGAAG GGCTAGCTACAACGA CAGTGTGG | 16608 |
| 563 | UGGCUUCU A CAGCUGCA | 61 | UGCAGCTG GGCTAGCTACAACGA AGAAGCCA | 16609 |
| 566 | CU1CUACA G CUGCAAAU | 7250 | ATTTGCAG GGCTAGCTACAACGA TGTAGAAG | 16610 |
| 569 | CUACAGCU G CAAAUAUC | 7251 | GATATTTG GGCTAGCTACAACGA AGCTGTAG | 16611 |
| 573 | AGCUGCAA A UAUCUAGC | 7252 | GCTAGATA GGCTAGCTACAACGA TTGCAGCT | 16612 |
| 575 | CUGCAAAU A UCUAGCUG | 62 | CAGCTAGA GGCTAGCTACAACGA ATTTGCAG | 16613 |
| 580 | AAUAUCUA G CUGUACCU | 7253 | AGGTACAG GGCTAGCTACAACGA TAGATATT | 16614 |
| 583 | AUCUAGCU G UACCUACU | 7254 | AGTAGGTA GGCTAGCTACAACGA AGCTAGAT | 16615 |
| 585 | CUAGCUGU A CCUACUUC | 65 | GAAGTAGG GGCTAGCTACAACGA ACAGCTAG | 16616 |
| 589 | CUGUACCU A CUUCAAAG | 66 | CTTTGAAG GGCTAGCTACAACGA AGGTACAG | 16617 |
| 607 | AGAAGGAA A CAGAAUCU | 7255 | AGATTCTG GGCTAGCTACAACGA TTCCTTCT | 16618 |
| 612 | GAAACAGA A UCCCAAU | 7256 | ATTGCAGA GGCTAGCTACAACGA TCTGTTTC | 16619 |
| 616 | CAGAAUCU G CAAUCUAU | 7257 | ATAGATTG GGCTAGCTACAACGA AGATTCTG | 16620 |
| 619 | AAUCUGCA A UCUAUAUA | 7258 | TATATAGA GGCTAGCTACAACGA TGCAGATT | 16621 |
| 623 | UGCAAUCU A UAUAUUUA | 71 | UAAATATA GGCTAGCTACAACGA AGATTGCA | 16622 |
| 625 | CAAUCUAU A UAUUUAUU | 72 | AATAAATA GGCTAGCTACAACGA ATAGATTG | 16623 |
| 627 | AUCUAUAU A UUUAUUAG | 73 | CTAATAAA GGCTAGCTACAACGA ATATAGAT | 16624 |
| 631 | AUAUAUUU A UUAGUGAU | 76 | ATCACTAA GGCTAGCTACAACGA AAATATAT | 16625 |
| 635 | AUUUAUUA G UGAUACAG | 7259 | CTGTATCA GGCTAGCTACAACGA TAATAAAT | 16626 |
| 638 | UAUUAGUG A UACAGGUA | 7260 | TACCTGTA GGCTAGCTACAACGA CACTAATA | 16627 |
| 640 | UUAGUGAU A CAGGUAGA | 79 | TCTACCTG GGCTAGCTACAACGA ATCACTAA | 16628 |
| 644 | UGAUACAG G UAGACCUU | 7261 | AAGGTCTA GGCTAGCTACAACGA CTGTATCA | 16629 |
| 648 | ACAGGUAG A CCUUUCGU | 7262 | ACGAAAGG GGCTAGCTACAACGA CTACCTGT | 16630 |

TABLE XVIII-continued

Human FLT DNAzyme and Substrate Sequence

| Pos | Substrate | Seq ID No | DNAzyme | Seq ID No |
|---|---|---|---|---|
| 655 | GACCUUUC G UAGAGAUG | 7263 | CATCTCTA GGCTAGCTACAACGA GAAAGGTC | 16631 |
| 661 | UCGUAGAG A UGUACAGU | 7264 | ACTGTACA GGCTAGCTACAACGA CTCTACGA | 16632 |
| 663 | GUAGAGAU G UACAGUGA | 7265 | TCACTGTA GGCTAGCTACAACGA ATCTCTAC | 16633 |
| 665 | AGAGAUGU A CAGUGAAA | 85 | TTTCACTG GGCTAGCTACAACGA ACATCTCT | 16634 |
| 668 | GAUGUACA G UGAAAUCC | 7266 | GGATTTCA GGCTAGCTACAACGA TGTACATC | 16635 |
| 673 | ACAGUGAA A UCCCCGAA | 7267 | TTCGGGGA GGCTAGCTACAACGA TTCACTGT | 16636 |
| 682 | UCCCCGAA A UUAUACAC | 7268 | GTGTATAA GGCTAGCTACAACGA TTCGGGGA | 16637 |
| 685 | CCGAAAUU A UACACAUG | 88 | CATGTGTA GGCTAGCTACAACGA AATTTCGG | 16638 |
| 687 | GAAAUUAU A CACAUGAC | 89 | GTCATGTG GGCTAGCTACAACGA ATAATTTC | 16639 |
| 689 | AAUUAUAC A CAUGACUG | 4291 | CAGTCATG GGCTAGCTACAACGA GTATAATT | 16640 |
| 691 | UUAUACAC A UGACUAA | 4292 | TTCAGTCA GGCTAGCTACAACGA GTGTATAA | 16641 |
| 694 | UACACAUG A CUGAAGGA | 7269 | TCCTTCAG GGCTAGCTACAACGA CATGTGTA | 16642 |
| 708 | GGAAGGGA G CUCGUCAU | 7270 | ATGACGAG GGCTAGCTACAACGA TCCCTTCC | 16643 |
| 712 | GGGAGCUC G UCAUUCCC | 7271 | GGGAATGA GGCTAGCTACAACGA GAGCTCCC | 16644 |
| 715 | AGCUCGUC A UUCCCUGC | 4295 | GCAGGGAA GGCTAGCTACAACGA GACGAGCT | 16645 |
| 722 | CAUUCCCU G CCGGGUUA | 7272 | TAACCCGG GGCTAGCTACAACGA AGGGAATG | 16646 |
| 727 | CCUGCCGG G UUACGUCA | 7273 | TGACGTAA GGCTAGCTACAACGA CCGGCAGG | 16647 |
| 730 | GCCGGGUU A CGUCACCU | 95 | AGGTGACG GGCTAGCTACAACGA AACCCGGC | 16648 |
| 732 | CGGGUUAC G UCACCUAA | 7274 | TTAGGTGA GGCTAGCTACAACGA GTAACCCG | 16649 |
| 735 | GUUACGUC A CCUAACAU | 4300 | ATGTTAGG GGCTAGCTACAACGA GACGTAAC | 16650 |
| 740 | GUCACCUA A CAUCACUG | 7275 | CAGTGATG GGCTAGCTACAACGA TAGGTGAC | 16651 |
| 742 | CACCUAAC A UCACUGUU | 4303 | AACAGTGA GGCTAGCTACAACGA GTTAGGTG | 16652 |
| 745 | CUAACAUC A CUGUUACU | 4304 | AGTAACAG GGCTAGCTACAACGA GATGTTAG | 16653 |
| 748 | ACAUCACU G UUACUUUA | 7276 | TAAAGTAA GGCTAGCTACAACQA AGTGATGT | 16654 |
| 751 | UCACUGUU A CUUUAAAA | 100 | TTTTAAAG GGCTAGCTACAACGA AACAGTGA | 16655 |
| 762 | UUAAAAAA G UUCCACU | 7277 | AGTGGAAA GGCTAGCTACAACGA TTTTTTAA | 16656 |
| 768 | AAGUUUCC A CUUGACAC | 4308 | GTGTCAAG GGCTAGCTACAACGA GGAAACTT | 16657 |
| 773 | UCCACUUG A CACUUUGA | 7278 | TCAAAGTG GGCTAGCTACAACGA CAAGTGGA | 16658 |
| 775 | CACUUGAC A CUUUGAUC | 4310 | GATCAAAG GGCTAGCTACAACGA GTCAAGTG | 16659 |
| 781 | ACACUUUG A UCCCUGAU | 7279 | ATCAGGGA GGCTAGCTACAACGA CAAAGTGT | 16660 |
| 788 | GAUCCCUG A UGGAAAAC | 7280 | GTTTTCCA GGCTAGCTACAACGA CAGGGATC | 16661 |
| 795 | GAUGGAAA A CGCAUAAU | 7281 | ATTATGCG GGCTAGCTACAACGA TTTCCATC | 16662 |
| 797 | UGGAAAAC G CAUAAUCU | 7282 | AGATTATG GGCTAGCTACAACGA GTTTTCCA | 16663 |
| 799 | GAAAACGC A UAAUCUGG | 4315 | CCAGATTA GGCTAGCTACAACGA GCGTTTTC | 16664 |
| 802 | AACGCAUA A UCUGGGAC | 7283 | GTCCCAGA GGCTAGCTACAACGA TATGCGTT | 16665 |
| 809 | AAUCUGGG A CAGUAGAA | 7284 | TTCTACTG GGCTAGCTACAACGA CCCAGATT | 16666 |
| 812 | CUGGGACA G UAGAAAGG | 7285 | CCTTTCTA GGCTAGCTACAACGA TGTCCCAG | 16667 |

TABLE XVIII-continued

Human FLT DNAzyme and Substrate Sequence

| Pos | Substrate | Seq ID No | DNAzyme | Seq ID No |
|---|---|---|---|---|
| 821 | UAGAAAGG C CUUCAUCA | 7286 | TGATGAAG GGCTAGCTACAACGA CCTTTCTA | 16668 |
| 826 | AGGGCUUC A UCAUAUCA | 4319 | TGATATGA GGCTAGCTACAACGA GAAGCCCT | 16669 |
| 829 | GCUUCAUC A UAUCAAAU | 4320 | ATTTGATA GGCTAGCTACAACGA GATGAAGC | 16670 |
| 831 | UUCAUCAU A UCAAAUGC | 117 | GCATTTGA GGCTAGCTACAACGA ATGATGAA | 16671 |
| 836 | CAUAUCAA A UGCAACGU | 7287 | ACGTTGCA GGCTAGCTACAACGA TTGATATG | 16672 |
| 838 | UAUCAAAU C CAACGUAC | 7288 | GTACGTTG GGCTAGCTACAACGA ATTTGATA | 16673 |
| 841 | CAAAUGCA A CGUACAAA | 7289 | TTTGTACG GGCTAGCTACAACGA TGCATTTG | 16674 |
| 843 | AAUGCAAC G UACAAAGA | 7290 | TCTTTGTA GGCTAGCTACAACGA GTTGCATT | 16675 |
| 845 | UGCAACGU A CAAAGAAA | 119 | TTTCTTTG GGCTAGCTACAACGA ACGTTGCA | 16676 |
| 853 | ACAAAGAA A UAGGGCUU | 7291 | AAGCCCTA GGCTAGCTACAACGA TTCTTTGT | 16677 |
| 858 | GAAAUAGG G CUUCUGAC | 7292 | GTCAGAAG GGCTAGCTACAACGA CCTATTTC | 16678 |
| 865 | GGCUUCUG A CCUGUGAA | 7293 | TTCACAGG GGCTAGCTACAACGA CAGAAGCC | 16679 |
| 869 | UCUGACCU G UGAAGCAA | 7294 | TTGCTTCA GGCTAGCTACAACGA AGGTCAGA | 16680 |
| 874 | CCUGUGAA C CAACAGUC | 7295 | GACTGTTG GGCTAGCTACAACGA TTCACAGG | 16681 |
| 877 | GUGAAGCA A CAGUCAAU | 7296 | ATTGACTG GGCTAGCTACAACGA TGCTTCAC | 16682 |
| 880 | AAGCAACA G UCAAUGGG | 7297 | CCCATTGA GGCTAGCTACAACGA TGTTGCTT | 16683 |
| 884 | AACAGUCA A UGGGCAUU | 7298 | AATGCCCA GGCTAGCTACAACGA TGACTGTT | 16684 |
| 888 | GUCAAUGG G CAUUUGUA | 7299 | TACAAATG GGCTAGCTACAACGA CCATTGAC | 16685 |
| 890 | CAAUGGGC A UUUGUAUA | 433 | UATACAAA GGCTAGCTACAACGA GCCCATTG | 16686 |
| 894 | GGGCAUUU G UAUAAGAC | 7300 | GTCTTATA GGCTAGCTACAACGA AAATGCCC | 16687 |
| 896 | GCAUUUGU A UAAGACAA | 126 | TTGTCTTA GGCTAGCTACAACGA ACAAATGC | 16688 |
| 901 | UGUAUAAG A CAAACUAU | 7301 | ATAGTTTG GGCTAGCTACAACGA CTTATACA | 16689 |
| 905 | UAAGACAA A CUAUCUCA | 7302 | TGAGATAG GGCTAGCTACAACGA TTGTCTTA | 16690 |
| 908 | GACAAACU A UCUCACAC | 128 | GTGTGAGA GGCTAGCTACAACGA AGTTTCTC | 16691 |
| 913 | ACUAUCUC A CACAUCCA | 4335 | TCGATGTG GGCTAGCTACAACGA GAGATAGT | 16692 |
| 915 | UAUCUCAC A CAUCGACA | 4336 | TGTCGATG GGCTAGCTACAACGA GTGAGATA | 16693 |
| 917 | UCUCACAC A UCGACAAA | 4337 | TTTGTCGA GGCTAGCTACAACGA GTGTGAGA | 16694 |
| 921 | ACACAUCG A CAAACCAA | 7303 | TTGGTTTG GGCTAGCTACAACGA CGATGTCT | 16695 |
| 925 | AUCGACAA A CCAAUACA | 7304 | TGTATTGG GGCTAGCTACAACGA TTGTCGAT | 16696 |
| 929 | ACAAACCA A UACAAUCA | 7305 | TGATTGTA GGCTAGCTACAACGA TGGTTTGT | 16697 |
| 931 | AAACCAAU A CAAUCAUA | 132 | TATGATTG GGCTAGCTACAACGA ATTGGTTT | 16698 |
| 934 | CCAAUACA A UCAUAGAU | 7306 | ATCTATGA GGCTAGCTACAACGA TGTATTCG | 16699 |
| 937 | AUACAAUC A UAGAUGUC | 4342 | GACATCTA GGCTAGCTACAACGA GATTGTAT | 16700 |
| 941 | AAUCAUAG A UGUCCAAA | 7307 | TTTGGACA GGCTAGCTACAACGA CTATGATT | 16701 |
| 943 | UCAUAGAU C UCCAAAUA | 7308 | TATTTGGA GGCTAGCTACAACGA ATCTATGA | 16702 |
| 949 | AUGUCCAA A UAAGCACA | 7309 | TGTCCTTA GGCTACCTACAACGA TTGGACAT | 16703 |
| 953 | CCAAAUAA G CACACCAC | 7310 | GTGGTGTG GGCTAGCTACAACGA TTATTTGG | 16704 |

TABLE XVIII-continued

Human FLT DNAzyme and Substrate Sequence

| Pos | Substrate | Seq ID No | DNAzyme | Seq ID No |
|---|---|---|---|---|
| 955 | AAAUAAGC A CACCACGC | 4345 | GCGTGGTG GGCTAGCTACAACGA GCTTATTT | 16705 |
| 957 | AUAAGCAC A CCACGCCC | 4346 | GGGCGTGG GCCTAGCTACAACGA GTGCTTAT | 16706 |
| 960 | AGCACACC A CGCCCAGU | 4348 | ACTGGCCG GCCTAGCTACAACGA GGTGTGCT | 16707 |
| 962 | CACACCAC C CCCAGUCA | 731 | UGACTGGG GGCTAGCTACAACGA GTGGTGTG | 16708 |
| 967 | CACGCCCA C UCAAAUUA | 7312 | TAATTTGA GGCTAGCTACAACGA TGGGCGTG | 16709 |
| 972 | CCAGUCAA A UUACUUAG | 7313 | CTAAGTAA GGCTAGCTACAACGA TTGACTGG | 16710 |
| 975 | GUCAAAUU A CUUAGAGG | 139 | CCTCTAAG GGCTAGCTACAACGA AATTTGAC | 16711 |
| 983 | ACUUAGAG G CCAUACUC | 7314 | GAGTATGG GGCTAGCTACAACGA CTCTAAGT | 16712 |
| 986 | UAGAGGCC A UACUCUUG | 4355 | CAAGAGTA CGCTAGCTACAACGA GGCCTCTA | 16713 |
| 988 | GAGGCCAU A CUCUUGUC | 142 | GACAACAG GGCTAGCTACAACGA ATGGCCTC | 16714 |
| 994 | AUACUCUU G UCCUCAAU | 7315 | ATTGAGGA GGCTAGCTACAACGA AAGAGTAT | 16715 |
| 1001 | UGUCCUCA A UUGUACUG | 7316 | CAGTACAA GGCTAGCTACAACGA TGAGGACA | 16716 |
| 1004 | CCUCAAUU G UACUGCUA | 7317 | TACCACTA GGCTAGCTACAACGA AATTGAGG | 16717 |
| 1006 | UCAAUUCU A CUGCUACC | 148 | GGTAGCAG CGCTAGCTACAACGA ACAATTGA | 16718 |
| 1009 | AUUCUACU C CUACCACU | 7318 | AGTGGTAC GGCTAGCTACAACGA AGTACAAT | 16719 |
| 1012 | GUACUGCU A CCACUCCC | 149 | GGGAGTGG GGCTAGCTACAACGA ACCACTAC | 16720 |
| 1015 | CUGCUACC A CUCCCUUC | 4364 | CAAGGGAG GGCTAGCTACAACGA GGTAGCAG | 16721 |
| 1025 | UCCCUUCA A CACGAGAG | 7319 | CTCTCGTC CGCTAGCTACAACGA TCAACGCA | 16722 |
| 1027 | CCUUGAAC A CGAGAGUU | 4369 | AACTCTCG GGCTACCTACAACGA CTTCAAGC | 16723 |
| 1033 | ACACGAGA G UUCAAAUG | 7320 | CATTTGAA GGCTAGCTACAACGA TCTCGTGT | 16724 |
| 1039 | GAGUUCAA A UGACCUGG | 7321 | CCAGGTCA GGCTAGCTACAACGA TTGAACTC | 16725 |
| 1042 | UUCAAAUG A CCUGGAGU | 7322 | ACTCCAGG GGCTAGCTACAACGA CATTTGAA | 16726 |
| 1049 | GACCUGGA G UUACCCUG | 7323 | CAGGGTAA GGCTAGCTACAACGA TCCAGGTC | 16727 |
| 1052 | CUGGAGUU A CCCUGAUG | 155 | CATCAGGG GGCTAGCTACAACGA AACTCCAG | 16728 |
| 1058 | UUACCCUG A UGAAAAAA | 7324 | TTTTTTCA GGCTAGCTACAACGA CAGGGTAA | 16729 |
| 1067 | UGAAAAAA A UAAGAGAG | 7325 | CTCTCTTA GGCTAGCTACAACGA TTTTTTCA | 16730 |
| 1075 | AUAAGAGA G CUUCCGUA | 7326 | TACGGAA3 GGCTAGCTACAACGA TCTCTTAT | 16731 |
| 1081 | GAGCUUCC G UAAGGCGA | 7327 | TCGCCTTA GGCTAGCTACAACGA GGAAGCTC | 16732 |
| 1086 | UCCGUAAG G CGACGAAU | 7328 | ATTCGTCG GGCTAGCTACAACGA CTTACGGA | 16733 |
| 1089 | GUAAGGCG A CGAAUUGA | 7329 | TCAATTCG GGCTAGCTACAACGA CGCCTTAC | 16734 |
| 1093 | GGCGACGA A UUGACCAA | 7330 | TTGGTCAA GGCTAGCTACAACGA TCGTCGCC | 16735 |
| 1097 | ACGAAUUG A CCAAAGCA | 733 | UGCTTTGG GGCTAGCTACAACGA CAATTCGT | 16736 |
| 1103 | UGACCAAA G CAAUUCCC | 7332 | GGGAATTG GGCTAGCTACAACGA TTTGGTCA | 16737 |
| 1106 | CCAAAGCA A UUCCCAUG | 7333 | CATGGGAA GGCTAGCTACAACGA TGCTTTGG | 16738 |
| 1112 | CAAUUCCC A UGCCAACA | 4383 | TGTTGGCA GGCTAGCTACAACGA GGGAATTG | 16739 |
| 1114 | AUUCCCAU G CCAACAUA | 7334 | TATGTTGG GGCTAGCTACAACGA ATGGGAAT | 16740 |
| 1118 | CCAUGCCA A CAUAUUCU | 7335 | AGAATATG GGCTAGCTACAACGA TGGCATGG | 16741 |

TABLE XVIII-continued

Human FLT DNAzyme and Substrate Sequence

| Pos | Substrate | Seq ID No | DNAzyme | Seq ID No |
|---|---|---|---|---|
| 1120 | AUGCCAAC A UAUUCUAC | 4386 | GTAGAATA GGCTAGCTACAACGA GTTGGCAT | 16742 |
| 1122 | GCCAACAU A UUCUACAG | 163 | CTGTAGAA GGCTAGCTACAACGA ATGTTGGC | 16743 |
| 1127 | CAUAUUCU A CAGUGUUC | 166 | GAACACTG GGCTAGCTACAACGA AGAATATG | 16744 |
| 1130 | AUUCUACA G UGUUCUUA | 7336 | TAAGAACA GGCTAGCTACAACGA TGTAGAAT | 16745 |
| 1132 | UCUACAGU G UUCUUACU | 7337 | AGTAAGAA GGCTAGCTACAACGA ACTGTAGA | 16746 |
| 1138 | GUGUUCUU A CUAUUGAC | 170 | GTCAATAG GGCTAGCTACAACGA AAGAACAC | 16747 |
| 1141 | UUCUUACU A UUGACAAA | 171 | TTTGTCAA GGCTAGCTACAACGA AGTAAGAA | 16748 |
| 1145 | UACUAUUG A CAAAAUGC | 7338 | GCATTTTG GGCTAGCTACAACGA CAATAGTA | 16749 |
| 1150 | UUGACAAA A UGCAGAAC | 7339 | GTTCTGCA GGCTAGCTACAACGA TTTGTCAA | 16750 |
| 1152 | GACAAAAU G CAGAACAA | 7340 | TTGTTCTG GGCTAGCTACAACGA ATTTTGTC | 16751 |
| 1157 | AAUGCAGA A CAAAGACA | 734 | UGTCTTTG GCCTAGCTACAACGA TCTGCATT | 16752 |
| 1163 | GAACAAAG A CAAAGGAC | 7342 | GTCCTTTG GGCTAGCTACAACGA CTTTGTTC | 16753 |
| 1170 | GACAAAGG A CUUUAUAC | 7343 | GTATAAAG GGCTAGCTACAACGA CCTTTGTC | 16754 |
| 1175 | AGGACUUU A UACUUGUC | 175 | GACAAGTA GGCTAGCTACAACGA AAAGTCCT | 16755 |
| 1177 | GACUUUAU A CUUGUCGU | 176 | ACGACAAG GGCTAGCTACAACGA ATAAAGTC | 16756 |
| 1181 | UUAUACUU G UCGUGUAA | 7344 | TTACACGA GGCTAGCTACAACGA AAGTATAA | 16757 |
| 1184 | UACUUGUC G UGUAAGGA | 7345 | TCCTTACA GGCTAGCTACAACGA GACAAGTA | 16758 |
| 1186 | CUUGUCGU G UAAGGAGU | 7346 | ACTCCTTA GGCTAGCTACAACGA ACGACAAG | 16759 |
| 1193 | UGUAAGGA G UGGACCAU | 7347 | ATGGTCCA GGCTAGCTACAACGA TCCTTACA | 16760 |
| 1197 | AGGAGUGG A CCAUCAUU | 7348 | AATGATGG GGCTAGCTACAACGA CCACTCCT | 16761 |
| 1200 | AGUGGACC A UCAUUCAA | 4398 | TTGAATGA GGCTAGCTACAACGA GGTCCACT | 16762 |
| 1203 | UGACCAUC A UUCAAAUC | 4399 | GATTTGAA GGCTAGCTACAACGA GATGGTCC | 16763 |
| 1209 | UCAUUCAA A UCUCUUAA | 7349 | TTAACAGA GGCTAGCTACAACGA TTGAATGA | 16764 |
| 1213 | UCAAAUCU G UUAACACC | 7350 | GGTGTTAA GGCTAGCTACAACGA AGATTTGA | 16765 |
| 1217 | AUCUGUUA A CACCUCAG | 7351 | CTGAGGTG GGCTAGCTACAACGA TAACAGAT | 16766 |
| 1219 | CUGUUAAC A CCUCAGUG | 4402 | CACTGAGG GGCTAGCTACAACGA GTTAACAG | 16767 |
| 1225 | ACACCUCA G UGCAUAUA | 7352 | TATATGCA GGCTAGCTACAACGA TGAGGTGT | 16768 |
| 1227 | ACCUCAGU G CAUAUAUA | 7353 | TATATATG GGCTAGCTACAACGA ACTGAGGT | 16769 |
| 1229 | CUCAGUGC A UAUAUAUG | 4406 | CATATATA GGCTAGCTACAACGA GCACTGAG | 16770 |
| 1231 | CAGUGCAU A UAUAUGAU | 187 | ATCATATA GGCTAGCTACAACGA ATGCACTG | 16771 |
| 1233 | GUGCAUAU A UAUGAUAA | 188 | TTATCATA GGCTAGCTACAACGA ATATGCAC | 16772 |
| 1235 | GCAUAUAU A UGAUAAAG | 189 | CTTTATCA GGCTAGCTACAACGA ATATATGC | 16773 |
| 1238 | UAUAUAUG A UAAAGCAU | 7354 | ATGCTTTA GGCTAGCTACAACGA CATATATA | 16774 |
| 1243 | AUGAUAAA G CAUUCAUC | 7355 | GATGAATG GGCTAGCTACAACGA TTTATCAT | 16775 |
| 1245 | GAUAAAGC A UUCAUCAC | 4407 | GTGATGAA GGCTAGCTACAACGA GCTTTATC | 16776 |
| 1249 | AAGCAUUC A UCACUGUG | 4408 | CACAGTGA GGCTAGCTACAACGA GAATGCTT | 16777 |
| 1252 | CAUUCAUC A CUGUGAAA | 4409 | TTTCACAG GGCTAGCTACAACGA GATGAATG | 16778 |

TABLE XVIII-continued

Human FLT DNAzyme and Substrate Sequence

| Pos | Substrate | Seq ID No | DNAzyme | Seq ID No |
|---|---|---|---|---|
| 1255 | UCAUCACU G UGAAACAU | 7356 | ATGTTTCA GGCTAGCTACAACGA AGTGATGA | 16779 |
| 1260 | ACUGUGAA A CAUCGAAA | 7357 | TTTCGATG GGCTAGCTACAACGA TTCACAGT | 16780 |
| 1262 | UGUGAAAC A UCGAAAAC | 4411 | GTTTTCGA GGCTAGCTACAACGA GTTTCACA | 16781 |
| 1269 | CAUCGAAA A CAGCAGGU | 7358 | ACCTGCTG GGCTAGCTACAACGA TTTCGATG | 16782 |
| 1272 | CGAAAACA G CAGGUGCU | 7359 | AGCACCTG GGCTAGCTACAACGA TGTTTTCG | 16783 |
| 1276 | AACAGCAG G UGCUUGAA | 7360 | TTCAAGCA GGCTAGCTACAACGA CTGCTGTT | 16784 |
| 1278 | CAGCAGGU G CUUGAAAC | 7361 | GTTTCAAG GGCTAGCTACAACGA ACCTGCTG | 16785 |
| 1285 | UGCUUGAA A CCGUAGCU | 7362 | AGCTACGG GGCTAGCTACAACGA TTCAAGCA | 16786 |
| 1288 | UUGAAACC C UACCGGGC | 7363 | GCCAGCTA GGCTAGCTACAACGA GCTTTCAA | 16787 |
| 1291 | AAACCGUA G CUGGCAAG | 7364 | CTTGCCAG GGCTAGCTACAACGA TACGGTTT | 16788 |
| 1295 | CGUAGCUG G CAACCGCU | 7365 | ACCGCTTG GGCTAGCTACAACGA CAGCTACG | 16789 |
| 1299 | GCUGGCAA C CGGUCUUA | 7366 | TAAGACCG GGCTAGCTACAACGA TTGCCAGC | 16790 |
| 1302 | GGCAAGCG G UCUUACCG | 7367 | CGGTAAGA GGCTAGCTACAACGA CGCTTGCC | 16791 |
| 1307 | GCGGUCUU A CCGGCUCU | 199 | AGAGCCGG GGCTAGCTACAACGA AAGACCGC | 16792 |
| 1311 | UCUUACCG G CUCUCUAU | 7368 | ATAGAGAG GGCTAGCTACAACGA CGGTAAGA | 16793 |
| 1318 | GGCUCUCU A UGAAAGUG | 202 | CACTTTCA GGCTAGCTACAACGA AGAGAGCC | 16794 |
| 1324 | CUAUGAAA G UGAAGGCA | 7369 | TGCCTTCA GGCTAGCTACAACGA TTTCATAG | 16795 |
| 1330 | AAGUGAAG G CAUUUCCC | 7370 | GGGAAATG GGCTAGCTACAACGA CTTCACTT | 16796 |
| 1332 | GUGAAGGC A UUUCCCUC | 4423 | GAGGGAAA GGCTAGCTACAACGA GCCTTCAC | 16797 |
| 1341 | UUUCCCUC G CCGGAAGU | 7371 | ACTTCCGG GGCTAGCTACAACGA GAGGGAAA | 16798 |
| 1348 | CGCCGGAA C UUGUAUGG | 7372 | CCATACAA GGCTAGCTACAACGA TTCCGGCG | 16799 |
| 1351 | CGGAAGUU G UAUGGUUA | 7373 | TAACCATA GGCTAGCTACAACGA AACTTCCG | 16800 |
| 1353 | GAAGUUGU A UGGUUAAA | 208 | TTTAACCA GGCTAGCTACAACGA ACAACTTC | 16801 |
| 1356 | GUUGUAUG C UUAAAAGA | 7374 | TCTTTTAA GGCTAGCTACAACGA CATACAAC | 16802 |
| 1364 | GUUAAAAG A UGGGUUAC | 7375 | GTAACCCA GGCTAGCTACAACGA CTTTTAAC | 16803 |
| 1368 | AAAGAUGG C UUACCUGC | 7376 | GCAGGTAA GGCTAGCTACAACGA CCATCTTT | 16804 |
| 1371 | GAUGGGUU A CCUGCGAC | 212 | GTCGCAGG GGCTAGCTACAACGA AACCCATC | 16805 |
| 1375 | GGUUACCU C CCACUGAC | 7377 | CTCAGTCG CGCTAGCTACAACGA ACGTAACC | 16806 |
| 1378 | UACCUGCG A CUGAGAAA | 7378 | TTTCTCAC GCCTAGCTACAACGA CGCAGGTA | 16807 |
| 1386 | ACUGAGAA A UCUCCUCC | 7379 | CGAGCACA GCCTAGCTACAACGA TTCTCACT | 16808 |
| 1390 | AGAAAUCU C CUCCCUAU | 7380 | ATACCGAG GCCTAGCTACAACGA AGATTTCT | 16809 |
| 1394 | AUCCUCC C CUAUUUGA | 738 | UCAAATAG GGCTAGCTACAACGA GAGCAGAT | 16810 |
| 1397 | UGCUCGCU A UUUCACUC | 215 | CAGTCAAA GGCTAGCTACAACGA AGCCAGCA | 16811 |
| 1402 | GCUAUUUC A CUCGUCCC | 7382 | CCCACGAG GGCTAGCTACAACGA CAAATACC | 16812 |
| 1406 | UUUGACUC C UGCCUACU | 7383 | AGTAGCCA GGCTAGCTACAACGA GAGTCAAA | 16813 |
| 1409 | CACUCCUC C CUACUCGU | 7384 | ACCAGTAC CGCTAGCTACAACGA CACGACTC | 16814 |
| 1412 | UCGUGCCU A CUCGUUAA | 219 | TTAACCAG CGCTAGCTACAACGA ACCCACCA | 16815 |

TABLE XVIII-continued

Human FLT DNAzyme and Substrate Sequence

| Pos | Substrate | Seq ID No | DNAzyme | Seq ID No |
|---|---|---|---|---|
| 1416 | GGCUACUC C UUAAUUAU | 7385 | ATAATTAA GGCTAGCTACAACGA GAGTAGCC | 16816 |
| 1420 | ACUCGUUA A UUAUCAAG | 7386 | CTTGATAA GGCTAGCTACAACGA TAACGAGT | 16817 |
| 1423 | CGUUAAUU A UCAAGGAC | 224 | CTCCTTGA GGCTAGCTACAACGA AATTAACG | 16818 |
| 1430 | UAUCAACC A CGUAACUC | 7387 | CAGTTACG GCCTAGCTACAACGA CCTTCATA | 16819 |
| 1432 | UCAACGAC C UAACUGAA | 7388 | TTCAGTTA GCCTAGCTACAACGA GTCCTTCA | 16820 |
| 1435 | AGCACCUA A CUCAACAC | 7389 | CTCTTCAG CCCTACCTACAACGA TACGTCCT | 16821 |
| 1445 | UGAAGAGG A UGCAGGGA | 7390 | TCCCTGCA GGCTAGCTACAACGA CCTCTTCA | 16822 |
| 1447 | AAGAGGAU G CAGGGAAU | 7391 | ATTCCCTG GGCTAGCTACAACGA ATCCTCTT | 16823 |
| 1454 | UGCAGGGA A UUAUACAA | 7392 | TTGTATAA GGCTAGCTACAACGA TCCCTGCA | 16824 |
| 1457 | AGGGAAUU A UACAAUCU | 228 | AGATTGTA GGCTAGCTACAACGA AATTCCCT | 16825 |
| 1459 | GGAAUUAU A CAAUCUUG | 229 | CAAGATTG GGCTAGCTACAACGA ATAATTCC | 16826 |
| 1462 | AUUAUACA A UCUUGCUG | 7393 | CAGCAAGA GGCTAGCTACAACGA TGTATAAT | 16827 |
| 1467 | ACAAUCUU G CUGAGCAU | 7394 | ATGCTCAG GGCTAGCTACAACGA AAGATTGT | 16828 |
| 1472 | CUUGCUGA G CAUAAAAC | 7395 | GTTTTATG GGCTAGCTACAACGA TCAGCAAG | 16829 |
| 1474 | UGCUGAGC A UAAAACAG | 4443 | CTGTTTTA GGCTAGCTACAACGA GCTCAGCA | 16830 |
| 1479 | AGCAUAAA A CAGUCAAA | 7396 | TTTGACTG GGCTAGCTACAACGA TTTATGCT | 16831 |
| 1482 | AUAAAACA G UCAAAUGU | 7397 | ACATTTGA GGCTAGCTACAACGA TGTTTTAT | 16832 |
| 1487 | ACAGUCAA A UGUGUUUA | 7398 | TAAACACA GGCTAGCTACAACGA TTGACTGT | 16833 |
| 1489 | AGUCAAAU G UGUUUAAA | 7399 | TTTAAACA GGCTAGCTACAACGA ATTTGACT | 16834 |
| 1491 | UCAAAUGU G UUUAAAAA | 7400 | TTTTTAAA GGCTAGCTACAACGA ACATTTGA | 16835 |
| 1499 | GUUUAAAA A CCUCACUG | 7401 | CAGTGAGG GGCTAGCTACAACGA TTTTAAAC | 16836 |
| 1504 | AAAACCUC A CUGCCACU | 4448 | AGTGGCAG GGCTAGCTACAACGA GAGGTTTT | 16837 |
| 1507 | ACCUCACU G CCACUCUA | 7402 | TAGAGTGG GGCTAGCTACAACGA AGTGAGGT | 16838 |
| 1510 | UCACUGCC A CUCUAAUU | 4451 | AATTAGAG GGCTAGCTACAACGA GGCAGTGA | 16839 |
| 1516 | CCACUCUA A UUGUCAAU | 7403 | ATTGACAA GGCTAGCTACAACGA TAGAGTGG | 16840 |
| 1519 | CUCUAAUU G UCAAUGUG | 7404 | CACATTGA GGCTAGCTACAACGA AATTAGAG | 16841 |
| 1523 | AAUUGUCA A UGUGAAAC | 7405 | GTTTCACA GGCTAGCTACAACGA TGACAATT | 16842 |
| 1525 | UUGUCAAU G UGAAACCC | 7406 | GGGTTTCA GGCTAGCTACAACGA ATTGACAA | 16843 |
| 1530 | AAUGUGAA A CCCCAGAU | 7407 | ATCTGGGG GGCTAGCTACAACGA TTCACATT | 16844 |
| 1537 | AACCCCAG A UUUACGAA | 7408 | TTCGTAAA GGCTAGCTACAACGA CTGGGGTT | 16845 |
| 1541 | CCAGAUUU A CGAAAAGG | 244 | CCTTTTCG GGCTAGCTACAACGA AAATCTGG | 16846 |
| 1549 | ACGAAAAG G CCGUGUCA | 7409 | TGACACGG GGCTAGCTACAACGA CTTTTCGT | 16847 |
| 1552 | AAAAGGCC G UGUCAUCG | 7410 | CGATGACA GGCTAGCTACAACGA GGCCTTTT | 16848 |
| 1554 | AAGGCCGU G UCAUCGUU | 7411 | AACGATGA GGCTAGCTACAACGA ACGGCCTT | 16849 |
| 1557 | GCCGUGUC A UCGUUUCC | 4460 | GGAAACGA GGCTAGCTACAACGA GACACGGC | 16850 |
| 1560 | GUGUCAUC G UUUCCAGA | 7412 | TCTGGAAA GGCTAGCTACAACGA GATGACAC | 16851 |
| 1568 | GUUUCCAG A GCCGGCUC | 7413 | GAGCCGGG GGCTAGCTACAACGA CTGGAAAC | 16852 |

TABLE XVIII-continued

Human FLT DNAzyme and Substrate Sequence

| Pos | Substrate | Seq ID No | DNAzyme | Seq ID No |
|---|---|---|---|---|
| 1573 | CAGACCCG G CUCUCUAC | 7414 | GTAGAGAG GGCTAGCTACAACGA CGGGTCTG | 16853 |
| 1580 | GGCUCUCG A CCCACUGG | 252 | CCAGTGGG GGCTAGCTACAACGA AGAGAGCC | 16854 |
| 1584 | CUCUACCC A CUGGGCAG | 4470 | CTGCCCAG GGCTAGCTACAACGA GGGTAGAG | 16855 |
| 1589 | CCCACUGG G CAGCAGAC | 7415 | GTCTGCTG GGCTAGCTACAACGA CCAGTGGG | 16856 |
| 1592 | ACUGGGCA G CAGACAAA | 7416 | TTTGTCTG GGCTAGCTACAACGA TGCCCAGT | 16857 |
| 1596 | GGCAGCAG A CAAAUCCU | 7417 | AGGATTTG GGCTAGCTACAACGA CTGCTGCC | 16858 |
| 1600 | GCAGACAA A UCCUGACU | 7418 | AGTCAGGA GGCTAGCTACAACGA TTGTCTGC | 16859 |
| 1606 | AAAUCCUG A CUUGUACC | 7419 | GGTACAAG GGCTAGCTACAACGA CAGGATTT | 16860 |
| 1610 | CCUGACUU G UACCGCAU | 7420 | ATGCGGTA GGCTAGCTACAACGA AAGTCAGG | 16861 |
| 1612 | UGACUUGU A CCGCAUAU | 255 | ATATGCGG GGCTAGCTACAACGA ACAAGTCA | 16862 |
| 1615 | CUUGUACC G CAUAUGGU | 7421 | ACCATATG GGCTAGCTACAACGA GGTACAAG | 16863 |
| 1617 | UGUACCGC A UAUGGUAU | 4479 | ATACCATA GGCTAGCTACAACGA GCGGTACA | 16864 |
| 1619 | UACCGCAU A UGGUAUCC | 256 | GGATACCA GGCTAGCTACAACGA ATGCCGTA | 16865 |
| 1622 | CGCAUAUG G UAUCCCUC | 7422 | GAGGGATA GGCTAGCTACAACGA CATATGCG | 16866 |
| 1624 | CAUAUGGU A UCCCUCAA | 257 | TTGAGGGA GGCTAGCTACAACGA ACCATATG | 16867 |
| 1632 | AUCCCUCA A CCUACAAU | 7423 | ATTGTAGG GGCTAGCTACAACGA TGAGGGAT | 16868 |
| 1636 | CUCAACCU A CAAUCAAG | 260 | CTTGATTG GGCTAGCTACAACGA AGGTTGAG | 16869 |
| 1639 | AACCUACA A UCAAGUGG | 7424 | CCACTTGA GGCTAGCTACAACGA TGTAGGTT | 16870 |
| 1644 | ACAAUCAA G UGGUUCUG | 7425 | CAGAACCA GGCTAGCTACAACGA TTGATTGT | 16871 |
| 1647 | AUCAAGUG G UUCUGGCA | 7426 | TGCCAGAA GGCTAGCTACAACGA CACTTGAT | 16872 |
| 1653 | UGGUUCUG G CACCCCUG | 7427 | CAGGGGTG GGCTAGCTACAACGA CAGAACCA | 16873 |
| 1655 | GUUCUGGC A CCCCUGUA | 4489 | TACAGGGG GGCTAGCTACAACGA GCCAGAAC | 16874 |
| 1661 | GCACCCCU G UAACCAUA | 7428 | TATGGTTA GGCTAGCTACAACGA AGGGGTGC | 16875 |
| 1664 | CCCCUGUA A CCAUAAUC | 7429 | GATTATGG GGCTAGCTACAACGA TACAGGGG | 16876 |
| 1667 | CUGUAACC A UAAUCAUU | 4495 | AATGATTA GGCTAGCTACAACGA GGTTACAG | 16877 |
| 1670 | UAACCAUA A UCAUUCCG | 7430 | CGGAATGA GGCTAGCTACAACGA TATGGTTA | 16878 |
| 1673 | CCAUAAUC A UUCCGAAG | 4496 | CTTCGGAA GGCTAGCTACAACGA GATTATCG | 16879 |
| 1681 | AUUCCGAA C CAAGGUGU | 7431 | ACACCTTG GGCTAGCTACAACGA TTCGGAAT | 16880 |
| 1686 | GAAGCAAG G UGUGACUU | 7432 | AAGTCACA GGCTAGCTACAACGA CTTCCTTC | 16881 |
| 1688 | AGCAAGGU G UGACUUUU | 7433 | AAAAGTCA GGCTAGCTACAACGA ACCTTGCT | 16882 |
| 1691 | AAGGUGUG A CUUUUGUU | 7434 | AACAAAAG GGCTAGCTACAACGA CACACCTT | 16883 |
| 1697 | UGACUUUU C UUCCAAUA | 7435 | TATTGGAA CGCTAGCTACAACGA AAAAGTCA | 16884 |
| 1703 | UUCUUCCA A UAAUGAAG | 7436 | CTTCATTA GGCTAGCTACAACGA TGGAACAA | 16885 |
| 1706 | UUCCAAUA A UGAAGAGU | 7437 | ACTCTTCA CGCTAGCTACAACGA TATTGCAA | 16886 |
| 1713 | AAUCAAGA G UCCUUUAU | 7438 | ATAAAGGA GGCTACCTACAACGA TCTTCATT | 16887 |
| 1720 | AGUCCUUU A UCCUGGAU | 278 | ATCCAGGA GGCTAGCTACAACGA AAAGGACT | 16888 |
| 1727 | UAUCCUGG A UCCUGACA | 7439 | TGTCAGCA GGCTAGCTACAACGA CCAGGATA | 16889 |

TABLE XVIII-continued

Human FLT DNAzyme and Substrate Sequence

| Pos | Substrate | Seq ID No | DNAzyme | Seq ID No |
|---|---|---|---|---|
| 1729 | UCCUCGAU C CUGACAGC | 7440 | GCTGTCAC GGCTAGCTACAACGA ATCCACCA | 16890 |
| 1733 | GCAUCCUG A CACCAACA | 744 | UGTTCCTG CCCTAGCTACAACGA CACCATCC | 16891 |
| 1736 | UCCUCACA C CAACAUGC | 7442 | CCATCTTC CCCTACCTACAACGA TGTCAGCA | 16892 |
| 1739 | UGACACCA A CAUCCGAA | 7443 | TTCCCATC CGCTACCTACAACGA TGCTCTCA | 16893 |
| 1741 | ACAGCAAC A UGGCAAAC | 4509 | GTTTCCCA GGCTAGCTACAACGA CTTGCTGT | 16894 |
| 1748 | CAUGGGAA A CACAAUUG | 7444 | CAATTCTC CCCTACCTACAACGA TTCCCATC | 16895 |
| 1753 | GAAACAGA A UUGACAGC | 7445 | CCTCTCAA GGCTAGCTACAACGA TCTGTTTC | 16896 |
| 1760 | AAUUGAGA C CAUCACUC | 7446 | GAGTGATG CGCTACCTACAACGA TCTCAATT | 16897 |
| 1762 | UUGAGAGC A UCACUCAG | 4511 | CTCAGTGA GGCTAGCTACAACGA CCTCTCAA | 16898 |
| 1765 | AGAGCAUC A CUCAGCGC | 4512 | GCGCTCAG GGCTAGCTACAACGA CATGCTCT | 16899 |
| 1770 | AUCACUCA C CGCAUCGC | 7447 | CCCATCCG GGCTAGCTACAACGA TGAGTGAT | 16900 |
| 1772 | CACUCAGC G CAUGGCAA | 7448 | TTGCCATC CGCTAGCTACAACGA GCTGAGTG | 16901 |
| 1774 | CUCACCGC A UGGCAAUA | 4515 | TATTGCCA GCCTAGCTACAACGA GCGCTCAC | 16902 |
| 1777 | AGCGCAUG C CAAUAAUA | 7449 | TATTATTC CGCTAGCTACAACGA CATGCGCT | 16903 |
| 1780 | GCAUGGCA A UAAUACAA | 7450 | TTCTATTA GGCTAGCTACAACGA TGCCATGC | 16904 |
| 1783 | UGCCAAUA A UAGAACGA | 745 | UCCTTCTA GGCTAGCTACAACGA TATTGCCA | 16905 |
| 1796 | ACGAAAGA A UAAGAUGG | 7452 | CCATCTTA GGCTAGCTACAACGA TCTTTCCT | 16906 |
| 1801 | ACAAUAAC A UCCCUACC | 7453 | GCTACCCA GCCTAGCTACAACGA CTTATTCT | 16907 |
| 1804 | AUAACAUG C CUAGCACC | 7454 | CCTCCTAG GCCTAGCTACAACGA CATCTTAT | 16908 |
| 1808 | GAUGGCUA C CACCUUGG | 7455 | CCAAGGTG CGCTAGCTACAACGA TACCCATC | 16909 |
| 1810 | UCGCUAGC A CCUUCCUU | 4518 | AACCAAGG GGCTAGCTACAACGA GCTAGCCA | 16910 |
| 1816 | CCACCUUC C UUCUCCCU | 7456 | ACCCACAA CCCTACCTACAACGA CAACCTCC | 16911 |
| 1819 | CCUUCCUU C UCCCUCAC | 7457 | CTCACCCA CCCTACCTACAACGA AACCAACC | 16912 |
| 1822 | UCCUUCUC C CUCACUCU | 7458 | AGAGTCAC CCCTACCTACAACGA CACAACCA | 16913 |
| 1826 | UCUCGCUC A CUCUACAA | 7459 | TTCTACAG GGCTAGCTACAACGA CACCCACA | 16914 |
| 1834 | ACUCUACA A UUUCUCGA | 7460 | TCCACAAA CCCTACCTACAACGA TCTACAGT | 16915 |
| 1843 | UUUCUCCA A UCUACAUU | 7461 | AATCTAGA CGCTAGCTACAACGA TCCACAAA | 16916 |
| 1847 | UCCAAUCU A CAUUCCA | 295 | TCCAAATC CCCTACCTACAACGA ACATTCCA | 16917 |
| 1849 | GAAUCUAC A UUCCAUA | 4526 | TATCCAAA CCCTACCTACAACGA CTACATTC | 16918 |
| 1853 | CUACAUUU C CAUACCUU | 7462 | AACCTATC CCCTACCTACAACGA AAATCTAC | 16919 |
| 1855 | ACAUUUGC A UAGCUUCC | 4527 | GGAAGCTA GGCTAGCTACAACGA GCAAATGT | 16920 |
| 1858 | UUUGCAUA G CUUCCAAU | 7463 | ATTGGAAG GGCTAGCTACAACGA TATGCAAA | 16921 |
| 1865 | AGCUUCCA A UAAAGUUG | 7464 | CAACTTTA GGCTAGCTACAACGA TGGAAGCT | 16922 |
| 1870 | CCAAUAAA G UUGGGACU | 7465 | AGTCCCAA GGCTAGCTACAACGA TTTATTGG | 16923 |
| 1876 | AAGUUGGG A CUGUGGGA | 7466 | TCCCACAG GGCTAGCTACAACGA CCCAACTT | 16924 |
| 1879 | UUGGGACU G UGGGAAGA | 7467 | TCTTCCCA GGCTAGCTACAACGA AGTCCCAA | 16925 |
| 1889 | GGGAAGAA A CAUAAGCU | 7468 | AGCTTATG GGCTAGCTACAACGA TTCTTCCC | 16926 |

TABLE XVIII-continued

Human FLT DNAzyme and Substrate Sequence

| Pos | Substrate | Seq ID No | DNAzyme | Seq ID No |
|---|---|---|---|---|
| 1891 | GAAGAAAC A UAAGCUUU | 4532 | AAAGCTTA GGCTAGCTACAACGA GTTTCTTC | 16927 |
| 1895 | AAACAUAA G CUUUUAUA | 7469 | TATAAAAG GGCTAGCTACAACGA TTATGTTT | 16928 |
| 1901 | AAGCUUUU A UAUCACAG | 307 | CTGTGATA GGCTAGCTACAACGA AAAAGCTT | 16929 |
| 1903 | GCUUUUAU A UCACAGAU | 308 | ATCTGTGA GGCTAGCTACAACGA ATAAAGC | 16930 |
| 1906 | UUUAUAUC A CAGAUGUG | 4534 | CACATCTG GGCTAGCTACAACGA GATATAAA | 16931 |
| 1910 | UAUCACAG A UGUGCCAA | 7470 | TTGGCACA GGCTAGCTACAACGA CTGTGATA | 16932 |
| 1912 | UCACAGAU G UGCCAAAU | 7471 | ATTTGGCA GGCTAGCTACAACGA ATCTGTGA | 16933 |
| 1914 | ACAGAUGU G CCAAAUGG | 7472 | CCATTTGG GGCTAGCTACAACGA ACATCTGT | 16934 |
| 1919 | UGUGCCAA A UGGGUUUC | 7473 | GAAACCCA GGCTAGCTACAACGA TTGGCACA | 16935 |
| 1923 | CCAAAUGG G UUUCAUGU | 7474 | ACATGAAA GGCTAGCTACAACGA CCATTTGG | 16936 |
| 1928 | UGGGUUUC A UGUUAACU | 4538 | AGTTAACA GGCTAGCTACAACGA GAAACCCA | 16937 |
| 1930 | GGUUUCAU G UUAACUUG | 7475 | CAAGTTAA GGCTAGCTACAACGA ATGAAACC | 16938 |
| 1934 | UCAUGUUA A CUUGGAAA | 7476 | TTTCCAAG GGCTAGCTACAACGA TAACATGA | 16939 |
| 1945 | UGGAAAAA A UGCCGACG | 7477 | CGTCGGCA GGCTAGCTACAACGA TTTTTCCA | 16940 |
| 1947 | GAAAAAAU G CCGACGGA | 7478 | TCCGTCGG GGCTAGCTACAACGA ATTTTTTC | 16941 |
| 1951 | AAAUGCCG A CGGAAGGA | 7479 | TCCTTCCG GGCTAGCTACAACGA CGGCATTT | 16942 |
| 1964 | AGGAGAGG A CCUGAAAC | 7480 | GTTTCAGG GGCTAGCTACAACGA CCTCTCCT | 16943 |
| 1971 | GACCUGAA A CUGUCUUG | 7481 | CAAGACAG GGCTAGCTACAACGA TTCAGGTC | 16944 |
| 1974 | CUGAAACU G UCUUGCAC | 7482 | GTGCAAGA GGCTAGCTACAACGA AGTTTCAG | 16945 |
| 1979 | ACUGUCUU G CACAGUUA | 7483 | TAACTGTG GGCTAGCTACAACGA AAGACAGT | 16946 |
| 1981 | UGUCUUGC A CAGUUAAC | 4545 | GTTAACTG GGCTAGCTACAACGA GCAAGACA | 16947 |
| 1984 | CUUGCACA G UUAACAAG | 7484 | CTTGTTAA GGCTAGCTACAACGA TGTGCAAG | 16948 |
| 1988 | CACAGUUA A CAAGUUCU | 7485 | AGAACTTG GGCTAGCTACAACGA TAACTGTG | 16949 |
| 1992 | GUUAACAA G UUCUUAUA | 7486 | TATAAGAA GGCTAGCTACAACGA TTGTTAAC | 16950 |
| 1998 | AAGUUCUU A UACAGAGA | 323 | TCTCTGTA GGCTAGCTACAACGA AAGAACTT | 16951 |
| 2000 | GUUCUUAU A CAGAGACG | 324 | CGTCTCTG GGCTAGCTACAACGA ATAAGAAC | 16952 |
| 2006 | AUACAGAG A CGUUACUU | 7487 | AAGTAACG GGCTAGCTACAACGA CTCTGTAT | 16953 |
| 2008 | ACAGAGAC G UUACUUGG | 7488 | CCAAGTAA GGCTAGCTACAACGA GTCTCTGT | 16954 |
| 2011 | GAGACGUU A CUUGGAUU | 326 | AATCCAAG GGCTAGCTACAACGA AACGTCTC | 16955 |
| 2017 | UUACUUGG A UUUUACUG | 7489 | CAGTAAAA GGCTAGCTACAACGA CCAAGTAA | 16956 |
| 2022 | UGGAUUUU A CUGCGGAC | 331 | GTCCGCAG GGCTAGCTACAACGA AAAATCCA | 16957 |
| 2025 | AUUUUACU G CGGACAGU | 7490 | ACTGTCCG GGCTAGCTACAACGA AGTAAAAT | 16958 |
| 2029 | UACUGCGG A CAGUUAAU | 7491 | ATTAACTG GGCTAGCTACAACGA CCGCAGTA | 16959 |
| 2032 | UGCGGACA G UUAAUAAC | 7492 | GTTATTAA GGCTAGCTACAACGA TGTCCGCA | 16960 |
| 2036 | GACAGUUA A UAACAGAA | 7493 | TTCTGTTA GGCTAGCTACAACGA TAACTGTC | 16961 |
| 2039 | AGUUAAUA A CAGAACAA | 7494 | TTGTTCTG GGCTAGCTACAACGA TATTAACT | 16962 |
| 2044 | AUAACAGA A CAAUGCAC | 7495 | GTGCATTG GGCTAGCTACAACGA TCTGTTAT | 16963 |

TABLE XVIII-continued

Human FLT DNAzyme and Substrate Sequence

| Pos | Substrate | Seq ID No | DNAzyme | Seq ID No |
|---|---|---|---|---|
| 2047 | ACAGAACA A UGCACUAC | 7496 | GTAGTGCA GGCTAGCTACAACGA TGTTCTGT | 16964 |
| 2049 | AGAACAAU G CACUACAG | 7497 | CTGTAGTG GGCTAGCTACAACGA ATTGTTCT | 16965 |
| 2051 | AACAAUGC A CUACAGUA | 4555 | TACTGTAG GGCTAGCTACAACGA GCATTGTT | 16966 |
| 2054 | AAUGCACU A CAGUAUUA | 335 | TAATACTG GGCTAGCTACAACGA AGTGCATT | 16967 |
| 2057 | GCACUACA G UAUUAGCA | 7498 | TGCTAATA GGCTAGCTACAACGA TGTAGTGC | 16968 |
| 2059 | ACUACAGU A UUAGCAAG | 336 | CTTGCTAA GGCTAGCTACAACGA ACTGTAGT | 16969 |
| 2063 | CAGUAUUA G CAAGCAAA | 7499 | TTTGCTTG GGCTAGCTACAACGA TAATACTG | 16970 |
| 2067 | AUUAGCAA G CAAAAAAU | 7500 | ATTTTTTG GGCTAGCTACAACGA TTGCTAAT | 16971 |
| 2074 | AGCAAAAA A UGGCCAUC | 7501 | GATGGCCA GGCTAGCTACAACGA TTTTTGCT | 16972 |
| 2077 | AAAAAAUG G CCAUCACU | 7502 | AGTGATGG GGCTAGCTACAACGA CATTTTTT | 16973 |
| 2080 | AAAUGGCC A UCACUAAG | 4561 | CTTAGTGA GGCTAGCTACAACGA GGCCATTT | 16974 |
| 2083 | UGGCCAUC A CUAAGGAG | 4562 | CTCCTTAG GGCTAGCTACAACGA GATGGCCA | 16975 |
| 2091 | ACUAAGGA G CACUCCAU | 7503 | ATGGAGTG GGCTAGCTACAACGA TCCTTAGT | 16976 |
| 2093 | UAAGGAGC A CUCCAUCA | 4564 | TGATGGAG GGCTAGCTACAACGA GCTCCTTA | 16977 |
| 2098 | AGCACUCC A UCACUCUU | 4567 | AAGAGTGA GGCTAGCTACAACGA GGAGTGCT | 16978 |
| 2101 | ACUCCAUC A CUCUUAAU | 4568 | ATTAAGAG GGCTAGCTACAACGA GATGGAGT | 16979 |
| 2108 | CACUCUUA A UCUUACCA | 7504 | TGGTAAGA GGCTAGCTACAACGA TAAGAGTG | 16980 |
| 2113 | UUAAUCUU A CCAUCAUG | 348 | CATGATGG GGCTAGCTACAACGA AAGATTAA | 16981 |
| 2116 | AUCUUACC A UCAUGAAU | 4573 | ATTCATGA GGCTAGCTACAACGA GGTAAGAT | 16982 |
| 2119 | UUACCAUC A UGAAUGUU | 4574 | AACATTCA GGCTAGCTACAACGA GATGGTAA | 16983 |
| 2123 | CAUCAUGA A UGUUUCCC | 7505 | GGGAAACA GGCTAGCTACAACGA TCATGATG | 16984 |
| 2125 | UCAUGAAU C UUUCCCUG | 7506 | CAGGGAAA GGCTAGCTACAACGA ATTCATGA | 16985 |
| 2133 | GUUUCCCU C CAAGAUUC | 7507 | GAATCTTG GGCTAGCTACAACGA AGGGAAAC | 16986 |
| 2138 | CCUGCAAG A UUCAGGCA | 7508 | TGCCTGAA GGCTAGCTACAACGA CTTGCAGG | 16987 |
| 2144 | AGAUUCAG G CACCUAUG | 7509 | CATAGGTG GGCTAGCTACAACGA CTGAATCT | 16988 |
| 2146 | AUUCAGGC A CCUAUGCC | 4580 | GGCATAGG GCCTAGCTACAACGA GCCTGAAT | 16989 |
| 2150 | AGGCACCU A UGCCUGCA | 355 | TGCAGGCA GGCTAGCTACAACGA AGGTGCCT | 16990 |
| 2152 | GCACCUAU G CCUGCAGA | 7510 | TCTCCAGG GGCTAGCTACAACGA ATACGTCC | 16991 |
| 2156 | CUAUGCCU G CAGAGCCA | 751 | UGGCTCTG GGCTAGCTACAACGA AGGCATAG | 16992 |
| 2161 | CCUGCAGA G CCAGGAAU | 7512 | ATTCCTGC CCCTAGCTACAACGA TCTGCAGG | 16993 |
| 2168 | ACCCAGGA A UGUAUACA | 7513 | TGTATACA GGCTAGCTACAACGA TCCTGGCT | 16994 |
| 2170 | CCAGGAAU G UAUACACA | 7514 | TGTGTATA GGCTAGCTACAACGA ATTCCTGG | 16995 |
| 2172 | AGGAAUGU A UACACAGG | 356 | CCTGTGTA GGCTAGCTACAACGA ACATTCCT | 16996 |
| 2174 | GAAUGUAU A CACAGCGG | 357 | CCCCTCTG GGCTAGCTACAACGA ATACATTC | 16997 |
| 2176 | AUGUAUAC A CAGGGGAA | 4588 | TTCCCCTG GGCTAGCTACAACGA GTATACAT | 16998 |
| 2188 | GGGAAGAA A UCCUCCAG | 7515 | CTGGAGGA GGCTAGCTACAACGA TTCTTCCC | 16999 |
| 2206 | AGAAAGAA A UUACAAUC | 7516 | GATTGTAA GGCTAGCTACAACGA TTCTTTCT | 17000 |

TABLE XVIII-continued

Human FLT DNAzyme and Substrate Sequence

| Pos | Substrate | Seq ID No | DNAzyme | Seq ID No |
|---|---|---|---|---|
| 2209 | AAGAAAUU A CAAUCAGA | 36 | UCTGATTG GGCTAGCTACAACGA AATTTCTT | 17001 |
| 2212 | AAAUUACA A UCAGAGAU | 7517 | ATCTCTGA GGCTAGCTACAACGA TGTAATTT | 17002 |
| 2219 | AAUCAGAG A UCAGGAAG | 7518 | CTTCCTGA GGCTAGCTACAACGA CTCTGATT | 17003 |
| 2227 | AUCAGGAA C CACCAUAC | 7519 | GTATGGTG GGCTAGCTACAACGA TTCCTCAT | 17004 |
| 2229 | CAGGAACC A CCAUACCU | 4597 | AGCTATGG GGCTAGCTACAACGA GCTTCCTG | 17005 |
| 2232 | GAAGCACC A UACCUCCU | 4599 | AGGACGTA CGCTAGCTACAACGA GGTGCTTC | 17006 |
| 2234 | AGCACCAU A CCUCCUGC | 364 | GCAGGAGG GGCTAGCTACAACGA ATGGTGCT | 17007 |
| 2241 | UACCUCCU C CGAAACCU | 7520 | AGGTTTCG GGCTACCTACAACGA ACCAGGTA | 17008 |
| 2246 | CCUGCGAA A CCUCAGUG | 7521 | CACTGAGG GGCTAGCTACAACGA TTCGCACG | 17009 |
| 2252 | AAACCUCA G UGAUCACA | 7522 | TGTCATCA GGCTAGCTACAACGA TGAGGTTT | 17010 |
| 2255 | CCUCAGUG A UCACACAG | 7523 | CTGTGTGA CGCTAGCTACAACGA CACTCAGG | 17011 |
| 2258 | CAGUGAUC A CACAGUGG | 4607 | CCACTGTG GGCTAGCTACAACGA GATCACTC | 17012 |
| 2260 | GUGAUCAC A CACUGCCC | 4608 | GGCCACTG CCCTAGCTACAACGA GTGATCAC | 17013 |
| 2263 | AUCACACA G UGGCCAUC | 7524 | GATCGCCA GCCTAGCTACAACGA TGTGTGAT | 17014 |
| 2266 | ACACAGUG G CCAUCAGC | 7525 | GCTGATCG CGCTAGCTACAACGA CACTGTCT | 17015 |
| 2269 | CAGUGGCC A UCAGCAGU | 4611 | ACTGCTCA GGCTAGCTACAACGA GCCCACTG | 17016 |
| 2273 | GGCCAUCA G CAGUUCCA | 7526 | TGCAACTG GGCTAGCTACAACGA TGATGGCC | 17017 |
| 2276 | CAUCAGCA G UUCCACCA | 7527 | TGGTGGAA GGCTAGCTACAACGA TGCTGATG | 17018 |
| 2281 | GCAGUUCC A CCACUUUA | 4615 | TAAAGTGG GGCTAGCTACAACGA GGAACTCC | 17019 |
| 2284 | GUUCCACC A CUUUAGAC | 4617 | GTCTAAAG GGCTAGCTACAACGA GGTGGAAC | 17020 |
| 2291 | CACUUUAG A CUGUCAUG | 7528 | CATGACAG GGCTAGCTACAACGA CTAAAGTG | 17021 |
| 2294 | UUUAGACU G UCAUGCUA | 7529 | TAGCATGA GGCTAGCTACAACGA AGTCTAAA | 17022 |
| 2297 | AGACUGUC A UGCUAAUG | 4620 | CATTAGCA GGCTAGCTACAACGA GACAGTCT | 17023 |
| 2299 | ACUGUCAU G CUAAUGGU | 7530 | ACCATTAG GGCTAGCTACAACGA ATGACAGT | 17024 |
| 2303 | UCAUGCUA A UGGUGUCC | 7531 | GGACACCA GGCTAGCTACAACGA TAGCATGA | 17025 |
| 2306 | UGCUAAUG G UGUCCCCG | 7532 | CGGGGACA GGCTAGCTACAACGA CATTAGCA | 17026 |
| 2308 | CUAAUGGU G UCCCGAG | 7533 | CTCGGGGA GGCTAGCTACAACGA ACCATTAG | 17027 |
| 2316 | GUCCCCGA G CCUCAGAU | 7534 | ATCTGAGG GGCTAGCTACAACGA TCGGGGAC | 17028 |
| 2323 | AGCCUCAG A UCACUUGG | 7535 | CCAAGTGA GGCTAGCTACAACGA CTGAGGCT | 17029 |
| 2326 | CUCAGAUC A CUUGGUUU | 4628 | AAACCAAG GGCTAGCTACAACGA GATCTGAG | 17030 |
| 2331 | AUCACUUG C UUUAAAAA | 7536 | TTTTTAAA GGCTAGCTACAACGA CAAGTGAT | 17031 |
| 2339 | GUUUAAAA A CAACCACA | 7537 | TGTGGTTG GGCTAGCTACAACGA TTTTAAAC | 17032 |
| 2342 | UAAAAACA A CCACAAAA | 7538 | TTTTGTGG GGCTAGCTACAACGA TGTTTTTA | 17033 |
| 2345 | AAACAACC A CAAAAUAC | 4632 | GTATTTTG GGCTAGCTACAACGA GGTTGTTT | 17034 |
| 2350 | ACCACAAA A UACAACAA | 7539 | TTGTTGTA GGCTAGCTACAACGA TTTGTGGT | 17035 |
| 2352 | CACAAAAU A CAACAAGA | 383 | TCTTGTTG GGCTAGCTACAACGA ATTTTGTG | 17036 |
| 2355 | AAAAUACA A CAAGAGCC | 7540 | GGCTCTTG GGCTAGCTACAACGA TGTATTTT | 17037 |

TABLE XVIII-continued

Human FLT DNAzyme and Substrate Sequence

| Pos | Substrate | Seq ID No | DNAzyme | Seq ID No |
|---|---|---|---|---|
| 2361 | CAACAAGA G CCUGGAAU | 7541 | ATTCCAGG GGCTAGCTACAACGA TCTTGTTG | 17038 |
| 2368 | AGCCUGGA A UUAUUUUA | 7542 | TAAAATAA GGCTAGCTACAACGA TCCAGGCT | 17039 |
| 2371 | CUGGAAUU A UUUUAGGA | 385 | TCCTAAAA GGCTAGCTACAACGA AATTCCAG | 17040 |
| 2379 | AUUUUAGG A CCAGGAAG | 7543 | CTTCCTGG GGCTAGCTACAACGA CCTAAAAT | 17041 |
| 2387 | ACCAGGAA G CAGCACGC | 7544 | GCGTGCTG GGCTAGCTACAACGA TTCCTGGT | 17042 |
| 2390 | AGGAAGCA G CACGCUGU | 7545 | ACAGCGTG GGCTAGCTACAACGA TGCTTCCT | 17043 |
| 2392 | GAAGCAGC A CGCUGUUU | 4641 | AAACAGCG GGCTAGCTACAACGA GCTGCTTC | 17044 |
| 2394 | AGCAGCAC G CUGUUUAU | 7546 | ATAAACAG GGCTAGCTACAACGA GTGCTGCT | 17045 |
| 2397 | AGCACGCU G UUUAUUGA | 7547 | TCAATAAA GGCTAGCTACAACGA AGCGTGCT | 17046 |
| 2401 | CGCUGUUU A UUGAAAGA | 392 | TCTTTCAA GGCTAGCTACAACGA AAACAGCG | 17047 |
| 2410 | UUGAAAGA G UCACAGAA | 7548 | TTCTGTGA GGCTAGCTACAACGA TCTTTCAA | 17048 |
| 2413 | AAAGAGUC A CAGAAGAG | 4643 | CTCTTCTG GGCTAGCTACAACGA GACTCTTT | 17049 |
| 2423 | AGAAGAGG A UGAAGGUG | 7549 | CACCTTCA GGCTAGCTACAACGA CCTCTTCT | 17050 |
| 2429 | GGAUGAAG G UGUCUAUC | 7550 | GATAGACA GGCTAGCTACAACGA CTTCATCC | 17051 |
| 2431 | AUGAAGGU G UCUAUCAC | 7551 | GTGATAGA GGCTAGCTACAACGA ACCTTCAT | 17052 |
| 2435 | AGGUGUCU A UCACUGCA | 396 | TGCAGTGA GGCTAGCTACAACGA AGACACCT | 17053 |
| 2438 | UGUCUAUC A CUGCAAAG | 4646 | CTTTGCAG GGCTAGCTACAACGA GATAGACA | 17054 |
| 2441 | CUAUCACU G CAAAGCCA | 7552 | TGGCTTTG GGCTAGCTACAACGA AGTGATAG | 17055 |
| 2446 | ACUGCAAA G CCACCAAC | 7553 | GTTGGTGG GGCTAGCTACAACGA TTTGCAGT | 17056 |
| 2449 | GCAAAGCC A CCAACCAG | 4650 | CTGGTTGG GGCTAGCTACAACGA GGCTTTGC | 17057 |
| 2453 | AGCCACCA A CCAGAAGG | 7554 | CCTTCTGG GGCTAGCTACAACGA TGGTGGCT | 17058 |
| 2462 | CCAGAAGG G CUCUGUGG | 7555 | CCACAGAG GGCTAGCTACAACGA CCTTCTGG | 17059 |
| 2467 | AGGGCUCU C UGGAAAGU | 7556 | ACTTTCCA GGCTAGCTACAACGA AGAGCCCT | 17060 |
| 2474 | UGUGGAAA G UUCAGCAU | 7557 | ATGCTGAA GGCTAGCTACAACGA TTTCCACA | 17061 |
| 2479 | AAAGUUCA C CAUACCUC | 7558 | GAGGTATG GGCTAGCTACAACGA TGAACTTT | 17062 |
| 2481 | AGUUCAGC A UACCUCAC | 4658 | GTGAGGTA GGCTAGCTACAACGA GCTGAACT | 17063 |
| 2483 | UUCAGCAU A CCUCACUG | 401 | CAGTGAGG GGCTAGCTACAACGA ATGCTGAA | 17064 |
| 2488 | CAUACCUC A CUGUUCAA | 466 | TTGAACAG GGCTAGCTACAACGA GAGGTATG | 17065 |
| 2491 | ACCUCACU C UUCAAGGA | 7559 | TCCTTGAA GGCTAGCTACAACGA AGTGAGGT | 17066 |
| 2500 | UUCAAGGA A CCUCGGAC | 7560 | GTCCGAGG GGCTAGCTACAACGA TCCTTGAA | 17067 |
| 2507 | AACCUCGG A CAAGUCUA | 756 | TAGACTTG GGCTAGCTACAACGA CCGAGGTT | 17068 |
| 2511 | UCGGACAA G UCUAAUCU | 7562 | AGATTAGA GGCTAGCTACAACGA TTGTCCGA | 17069 |
| 2516 | CAAGUCUA A UCUGGAGC | 7563 | GCTCCAGA GGCTAGCTACAACGA TAGACTTG | 17070 |
| 2523 | AAUCUGGA G CUGAUCAC | 7564 | GTGATCAG GGCTAGCTACAACGA TCCAGATT | 17071 |
| 2527 | UGGAGCUG A UCACUCUA | 7565 | TAGAGTGA GGCTAGCTACAACGA CAGCTCCA | 17072 |
| 2530 | AGCUGAUC A CUCUAACA | 4670 | TGTTAGAG GGCTAGCTACAACGA GATCAGCT | 17073 |
| 2536 | UCACUCUA A CAUGCACC | 7566 | GGTGCATG GGCTAGCTACAACGA TAGAGTGA | 17074 |

TABLE XVIII-continued

Human FLT DNAzyme and Substrate Sequence

| Pos | Substrate | Seq ID No | DNAzyme | Seq ID No |
|---|---|---|---|---|
| 2538 | ACUCUAAC A UGCACCUG | 4673 | CAGGTGCA GGCTAGCTACAACGA GTTAGAGT | 17075 |
| 2540 | UCUAACAU G CACCUGUG | 7567 | CACAGGTG GGCTAGCTACAACGA ATGTTAGA | 17076 |
| 2542 | UAACAUGC A CCUGUGUG | 4674 | CACACAGG GGCTAGCTACAACGA GCATGTTA | 17077 |
| 2546 | AUGCACCU G UGUGGCUG | 7568 | CAGCCACA GGCTAGCTACAACGA AGGTGCAT | 17078 |
| 2548 | GCACCUGU C UGGCUGCG | 7569 | CGCAGCCA GGCTAGCTACAACGA ACAGGTGC | 17079 |
| 2551 | GCUGUGUG C CUGCGACU | 7570 | AGTCGCAG GGCTAGCTACAACGA CACACAGG | 17080 |
| 2554 | GUGUGGCU G CGACUCUC | 7571 | GAGAGTCG GGCTAGCTACAACGA AGCCACAC | 17081 |
| 2557 | UGGCUGCG A CUCUCUUC | 7572 | GAAGACAG GGCTAGCTACAACGA CGCAGCCA | 17082 |
| 2568 | CUCCUCUG G CUCCUAUU | 7573 | AATAGGAG GGCTAGCTACAACGA CAGAAGAG | 17083 |
| 2574 | UGGCUCCU A UUAACCCU | 417 | AGGGTTAA GGCTAGCTACAACGA AGGAGCCA | 17084 |
| 2578 | UCCUAUUA A CCCUCCUU | 7574 | AAGGAGGG GGCTAGCTACAACGA TAATAGGA | 17085 |
| 2587 | CCCUCCUU A UCCGAAAA | 422 | TTTTCGGA GGCTAGCTACAACGA AAGGAGGG | 17086 |
| 2596 | UCCGAAAA A UGAAAAGG | 7575 | CCTTTTCA GGCTAGCTACAACGA TTTTCGGA | 17087 |
| 2604 | AUGAAAAC G CUUCUUC | 7576 | GAAGAAGA GGCTAGCTACAACGA CTTTTCAT | 17088 |
| 2617 | CUUCUGAA A UAAAGACU | 7577 | AGTCTTTA GGCTAGCTACAACGA TTCAGAAG | 17089 |
| 2623 | AAAUAAAG A CUGACUAC | 7578 | GTAGTCAG GGCTAGCTACAACGA CTTTATTT | 17090 |
| 2627 | AAAGACUG A CUACCUAU | 7579 | ATAGGTAG GGCTAGCTACAACGA CAGTCTTT | 17091 |
| 2630 | GACUGACU A CCUAUCAA | 430 | TTGATAGG GGCTAGCTACAACGA AGTCAGTC | 17092 |
| 2634 | GACUACCU A UCAAUUAU | 431 | ATAATTGA GGCTAGCTACAACGA AGGTAGTC | 17093 |
| 2638 | ACCUAUCA A UUAUAAUG | 7580 | CATTATAA GGCTAGCTACAACGA TGATAGGT | 17094 |
| 2641 | UAUCAAUU A UAAUGGAC | 434 | GTCCATTA GGCTAGCTACAACGA AATTGATA | 17095 |
| 2644 | CAAUUAUA A UGGACCCA | 758 | TGGGTCCA GGCTAGCTACAACGA TATAATTG | 17096 |
| 2648 | UAUAAUGG A CCCAGAUG | 7582 | CATCTGGG GGCTAGCTACAACGA CCATTATA | 17097 |
| 2654 | GGACCCAG A UGAAGUUC | 7583 | GAACTTCA GGCTAGCTACAACGA CTGGGTCC | 17098 |
| 2659 | CAGAUGAA C UUCCUUUG | 7584 | CAAAGGAA GGCTAGCTACAACGA TTCATCTG | 17099 |
| 2669 | UCCUUUGC A UGAGCAGU | 7585 | ACTGCTCA GGCTAGCTACAACGA CCAAAGGA | 17100 |
| 2673 | UUGGAUGA G CAGUGUGA | 7586 | TCACACTG GGCTAGCTACAACGA TCATCCAA | 17101 |
| 2676 | GAUGAGCA G UGUGAGCG | 7587 | CGCTCACA GGCTAGCTACAACGA TGCTCATC | 17102 |
| 2678 | UGAGCAGU G UGAGCGGC | 7588 | GCCGCTCA GGCTAGCTACAACGA ACTGCTCA | 17103 |
| 2682 | CAGUGUGA G CGGCUCCC | 7589 | GGGAGCCG GGCTAGCTACAACGA TCACACTG | 17104 |
| 2685 | UGUGAGCG G CUCCCUUA | 7590 | TAAGGCAG GGCTAGCTACAACGA CGCTCACA | 17105 |
| 2693 | GCUCCCUU A UGAUGCCA | 442 | TGGCATCA GGCTAGCTACAACGA AAGGGAGC | 17106 |
| 2696 | CCCUUAUG A UGCCAGCA | 759 | UGCTGGCA GGCTAGCTACAACGA CATAAGGG | 17107 |
| 2698 | CUUAUGAU G CCAGCAAG | 7592 | CTTGCTGG GGCTAGCTACAACGA ATCATAAG | 17108 |
| 2702 | UGAUGCCA C CAAGUGGG | 7593 | CCCACTTG GGCTAGCTACAACGA TGGCATCA | 17109 |
| 2706 | GCCAGCAA G UGGGAGUU | 7594 | AACTCCCA GGCTAGCTACAACGA TTGCTGGC | 17110 |
| 2712 | AAGUGGGA G UUUGCCCG | 7595 | CGGGCAAA GGCTAGCTACAACGA TCCCACTT | 17111 |

TABLE XVIII-continued

Human FLT DNAzyme and Substrate Sequence

| Pos | Substrate | Seq ID No | DNAzyme | Seq ID No |
|---|---|---|---|---|
| 2716 | CGGAGUUU C CCCGGGAC | 7596 | CTCCCGGG GGCTAGCTACAACGA AAACTCCC | 17112 |
| 2727 | CGCGAGAG A CUUAAACU | 7597 | AGTTTAAG GGCTAGCTACAACGA CTCTCCCG | 17113 |
| 2733 | AGACUUAA A CUGGGCAA | 7598 | TTGCCCAG GGCTAGCTACAACGA TTAAGTCT | 17114 |
| 2738 | UAAACUGG C CAAAUCAC | 7599 | CTGATTTG GGCTAGCTACAACGA CCAGTTTA | 17115 |
| 2742 | CUGGGCAA A UCACUUGG | 7600 | CCAAGTGA GGCTAGCTACAACGA TTGCCCAG | 17116 |
| 2745 | GGCAAAUC A CUUGGAAG | 4717 | CTTCCAAG GGCTAGCTACAACGA GATTTGCC | 17117 |
| 2758 | GAAGAGGG G CUUUUGGA | 760 | UCCAAAAG GGCTAGCTACAACGA CCCTCTTC | 17118 |
| 2770 | UUGGAAAA G UGGUUCAA | 7602 | TTGAACCA GGCTAGCTACAACGA TTTTCCAA | 17119 |
| 2773 | GAAAAGUG G UUCAAGCA | 7603 | TGCTTGAA GGCTAGCTACAACGA CACTTTTC | 17120 |
| 2779 | UGGUUCAA G CAUCAGCA | 7604 | TGCTGATG GGCTAGCTACAACGA TTGAACCA | 17121 |
| 2781 | GUUCAAGC A UCAGCAUU | 4721 | AATGCTGA GGCTAGCTACAACGA GCTTGAAC | 17122 |
| 2785 | AAGCAUCA G CAUUUGGC | 7605 | GCCAAATG GGCTAGCTACAACGA TGATGCTT | 17123 |
| 2787 | GCAUCAGC A UUUGGCAU | 4723 | ATGCCAAA GGCTAGCTACAACGA GCTGATGC | 17124 |
| 2792 | AGCAUUUG G CAUUAAGA | 7606 | TCTTAATG GGCTAGCTACAACGA CAAATGCT | 17125 |
| 2794 | CAUUUGGC A UUAAGAAA | 4724 | TTTCTTAA GGCTAGCTACAACGA GCCAAATG | 17126 |
| 2802 | AUUAAGAA A UCACCUAC | 7607 | GTAGGTGA GGCTAGCTACAACGA TTCTTAAT | 17127 |
| 2805 | AAGAAAUC A CCUACGUG | 4725 | CACGTAGG GGCTAGCTACAACGA GATTTCTT | 17128 |
| 2809 | AAUCACCU A CGUGCCGG | 460 | CCGGCACG GGCTAGCTACAACGA AGGTGATT | 17129 |
| 2811 | UCACCUAC C UCCCGCAC | 7608 | CTCCGGCA GGCTAGCTACAACGA GTAGGTGA | 17130 |
| 2813 | ACCUACGU C CCGGACUG | 7609 | CAGTCCGG GGCTAGCTACAACGA ACGTAGGT | 17131 |
| 2818 | CGUCCCGC A CUGUGGCU | 7610 | AGCCACAG GGCTAGCTACAACGA CCCCCACG | 17132 |
| 2821 | CCCCCACU C UGGCUGUG | 7611 | CACAGCCA GGCTAGCTACAACGA AGTCCGGC | 17133 |
| 2824 | GGACUCUG G CUGUCAAA | 7612 | TTTCACAG GGCTAGCTACAACGA CACAGTCC | 17134 |
| 2827 | CUGUGGCU G UGAAAAUG | 7613 | CATTTTCA GGCTAGCTACAACGA AGCCACAG | 17135 |
| 2833 | CUCUCAAA A UCCUCAAA | 7614 | TTTCACCA CGCTACCTACAACGA TTTCACAG | 17136 |
| 2835 | GUGAAAAU G CUGAAACA | 7615 | TCTTTCAG GGCTAGCTACAACGA ATTTTCAC | 17137 |
| 2848 | AACAGGGC G CCACGGCC | 7616 | GGCCCTGG GGCTACCTACAACGA CCCTCTT | 17138 |
| 2851 | AGGGCGCC A CCCCCAGC | 4733 | GCTGCCCC GGCTACCTACAACGA CCCCCCCT | 17139 |
| 2854 | GCCCCACC G CCAGCGAG | 7617 | CTCGCTCG GGCTAGCTACAACGA CGTCGCCC | 17140 |
| 2858 | CACCCCCA G CGACUACA | 7618 | TGTACTCC GGCTACCTACAACGA TCCCCCTG | 17141 |
| 2862 | GCCAGCGA G UACAAACC | 7619 | GCTTTGTA GCCTAGCTACAACGA TCCCTCGC | 17142 |
| 2864 | CAGCGAGU A CAAAGCUC | 461 | GAGCTTTC GGCTAGCTACAACGA ACTCCCTC | 17143 |
| 2869 | ACUACAAA C CUCUGAUC | 7620 | CATCAGAC GGCTACCTACAACGA TTTCTACT | 17144 |
| 2875 | AACCUCUG A UGACUGAC | 7621 | CTCAGTCA GCCTAGCTACAACGA CACACCTT | 17145 |
| 2878 | CUCUGAUG A CUGACCUA | 7622 | TACCTCAG GGCTAGCTACAACGA CATCAGAC | 17146 |
| 2883 | AUGACUGA C CUAAAAUU | 7623 | ATTTTTAG GGCTAGCTACAACGA TCAGTCAT | 17147 |
| 2890 | AGCUAAAA A UCUUGACC | 7624 | CCTCAACA GCCTAGCTACAACGA TTTTAGCT | 17148 |

TABLE XVIII-continued

Human FLT DNAzyme and Substrate Sequence

| Pos | Substrate | Seq ID No | DNAzyme | Seq ID No |
|---|---|---|---|---|
| 2896 | AAAUCUUG A CCCACAUU | 7625 | AATGTGGG GCCTAGCTACAACGA CAAGATTT | 17149 |
| 2900 | CUUGACCC A CAUUGGCC | 4744 | GGCCAATG GGCTAGCTACAACGA GGGTCAAG | 17150 |
| 2902 | UCACCCAC A UUGGCCAC | 4745 | GTCCCCAA GGCTAGCTACAACGA GTGGGTCA | 17151 |
| 2906 | CCACAUUG C CCACCAUC | 7626 | CATCGTGG GGCTACCTACAACGA CAATGTGG | 17152 |
| 2909 | CAUUCGCC A CCAUCUGA | 4747 | TCACATGC CCCTAGCTACAACGA CCCCAATG | 17153 |
| 2912 | UCGCCACC A UCUGAACG | 4749 | CGTTCAGA GCCTAGCTACAACGA GGTGGCCA | 17154 |
| 2918 | CCAUCUGA A CGUGCUUA | 7627 | TAACCACG CCCTAGCTACAACGA TCAGATGG | 17155 |
| 2920 | AUCUGAAC C UCCUUAAC | 7628 | CTTAACCA GGCTACCTACAACGA GTTCACAT | 17156 |
| 2923 | UGAACGUG C UUAACCUG | 7629 | CAGGTTAA GGCTAGCTACAACGA CACGTTCA | 17157 |
| 2927 | CCUCCUUA A CCUCCUCC | 7630 | CCAGCACC CGCTACCTACAACGA TAACCACC | 17158 |
| 2931 | GUUAACCU C CUCCGACC | 7631 | GCTCCCAC GGCTAGCTACAACGA AGCTTAAC | 17159 |
| 2938 | UCCUCCCA C CCUGCACC | 7632 | CCTCCACG CCCTACCTACAACGA TCCCACCA | 17160 |
| 2942 | CCCACCCU C CACCAAGC | 7633 | GCTTCCTG CGCTAGCTACAACGA AGGCTCCC | 17161 |
| 2944 | CACCCUCC A CCAAGCAA | 4756 | TTGCTTCG GCCTAGCTACAACGA GCAGGCTC | 17162 |
| 2949 | UCCACCAA C CAAGGACG | 7634 | CCTCCTTG CGCTAGCTACAACGA TTCCTCCA | 17163 |
| 2958 | CAAGCACG C CCUCUCAU | 7635 | ATCAGACC CCCTACCTACAACGA CCTCCTTC | 17164 |
| 2965 | GGCCUCUG A UGGUGAUU | 7636 | AATCACCA GGCTAGCTACAACGA CAGAGGCC | 17165 |
| 2968 | CUCUGAUG G UGAUUGUU | 7637 | AACAATCA GGCTAGCTACAACGA CATCAGAG | 17166 |
| 2971 | UGAUGGUG A UUGUUGAA | 7638 | TTCAACAA GGCTAGCTACAACGA CACCATCA | 17167 |
| 2974 | UGGUGAUU G UUGAAUAC | 7639 | GTATTCAA GGCTAGCTACAACGA AATCACCA | 17168 |
| 2979 | AUUGUUGA A UACUGCAA | 7640 | TTGCAGTA GGCTAGCTACAACGA TCAACAAT | 17169 |
| 2981 | UGUUGAAU A CUGCAAAU | 473 | ATTTGCAG GGCTAGCTACAACGA ATTCAACA | 17170 |
| 2984 | UGAAUACU G CAAAUAUG | 7641 | CATATTTG GGCTAGCTACAACGA AGTATTCA | 17171 |
| 2988 | UACUGCAA A UAUGGAAA | 7642 | TTTCCATA GGCTAGCTACAACGA TTGCAGTA | 17172 |
| 2990 | CUGCAAAU A UGGAAAUC | 474 | GATTTCCA GGCTAGCTACAACGA ATTTGCAG | 17173 |
| 2996 | AUAUGGAA A UCUCUCCA | 7643 | TGGAGAGA GGCTAGCTACAACGA TTCCATAT | 17174 |
| 3005 | UCUCUCCA A CUACCUCA | 7644 | TGAGGTAG GGCTAGCTACAACGA TGGAGAGA | 17175 |
| 3008 | CUCCAACU A CCUCAAGA | 478 | TCTTGAGG GGCTAGCTACAACGA AGTTGGAG | 17176 |
| 3017 | CCUCAAGA G CAAACGUG | 7645 | CACGTTTG GGCTAGCTACAACGA TCTTGAGG | 17177 |
| 3021 | AAGAGCAA A CGUGACUU | 7646 | AAGTCACG GGCTAGCTACAACGA TTGCTCTT | 17178 |
| 3023 | GAGCAAAC G UGACUUAU | 7647 | ATAAGTCA GGCTAGCTACAACGA GTTTGCTC | 17179 |
| 3026 | CAAACGUG A CUUAUUUU | 7648 | AAAATAAG GGCTAGCTACAACGA CACGTTTG | 17180 |
| 3030 | CGUGACUU A UUUUUUCU | 481 | AGAAAAAA GGCTAGCTACAACGA AAGTCACG | 17181 |
| 3041 | UUUUCUCA A CAAGGAUG | 7649 | CATCCTTG GGCTAGCTACAACGA TGAGAAAA | 17182 |
| 3047 | CAACAAGG A UGCAGCAC | 7650 | GTGCTGCA GGCTAGCTACAACGA CCTTGTTG | 17183 |
| 3049 | ACAAGGAU G CAGCACUA | 765 | UAGTGCTG GGCTAGCTACAACGA ATCCTTGT | 17184 |
| 3052 | AGGAUGCA G CACUACAC | 7652 | GTGTAGTG GGCTAGCTACAACGA TGCATCCT | 17185 |

TABLE XVIII-continued

Human FLT DNAzyme and Substrate Sequence

| Pos | Substrate | Seq ID No | DNAzyme | Seq ID No |
|---|---|---|---|---|
| 3054 | GAUGCAGC A CUACACAU | 4779 | ATGTGTAG GGCTAGCTACAACGA GCTGCATC | 17186 |
| 3057 | GCAGCACU A CACAUGGA | 489 | TCCATGTG GGCTAGCTACAACGA AGTGCTGC | 17187 |
| 3059 | AGCACUAC A CAUGGAGC | 4781 | GCTCCATG GGCTAGCTACAACGA GTAGTGCT | 17188 |
| 3061 | CACUACAC A UGGAGCCU | 4782 | AGGCTCCA GGCTAGCTACAACGA GTGTAGTG | 17189 |
| 3066 | CACAUGGA G CCUAAGAA | 7653 | TTCTTAGG GGCTAGCTACAACGA TCCATGTG | 17190 |
| 3082 | AAGAAAAA A UGGAGCCA | 7654 | TGGCTCCA GGCTAGCTACAACGA TTTTTCTT | 17191 |
| 3087 | AAAAUGGA G CCAGGCCU | 7655 | AGGCCTGG GGCTAGCTACAACGA TCCATTTT | 17192 |
| 3092 | GGAGCCAG G CCUGGAAC | 7656 | GTTCCAGG GGCTAGCTACAACGA CTGGCTCC | 17193 |
| 3099 | GGCCUGGA A CAAGGCAA | 7657 | TTGCCTTG GGCTAGCTACAACGA TCCAGGCC | 17194 |
| 3104 | GGAACAAG G CAAGAAAC | 7658 | GTTTCTTG GGCTAGCTACAACGA CTTGTTCC | 17195 |
| 3111 | GGCAAGAA A CCAAGACU | 7659 | AGTCTTGG GGCTAGCTACAACGA TTCTTGCC | 17196 |
| 3117 | AAACCAAG A CUAGAUAG | 7660 | CTATCTAG GGCTAGCTACAACGA CTTGGTTT | 17197 |
| 3122 | AAGACUAG A UAGCGUCA | 766 | UGACGCTA GGCTAGCTACAACGA CTAGTCTT | 17198 |
| 3125 | ACUAGAUA G CGUCACCA | 7662 | TGGTGACG GGCTAGCTACAACGA TATCTAGT | 17199 |
| 3127 | UAGAUAGC G UCACCAGC | 7663 | GCTGGTGA GGCTAGCTACAACGA GCTATCTA | 17200 |
| 3130 | AUAGCGUC A CCAGCAGC | 4794 | GCTGCTGG GGCTAGCTACAACGA GACGCTAT | 17201 |
| 3134 | CGUCACCA G CAGCGAAA | 7664 | TTTCGCTG GGCTAGCTACAACGA TGGTGACG | 17202 |
| 3137 | CACCAGCA G CGAAAGCU | 7665 | AGCTTTCG GGCTAGCTACAACGA TGCTGGTG | 17203 |
| 3143 | CAGCGAAA G CUUUGCGA | 7666 | TCGCAAAG GGCTAGCTACAACGA TTTCGCTG | 17204 |
| 3148 | AAAGCUUU G CGAGCUCC | 7667 | GGAGCTCG GGCTAGCTACAACGA AAAGCTTT | 17205 |
| 3152 | CUUUGCGA G CUCCGGCU | 7668 | AGCCGGAG GGCTAGCTACAACGA TCGCAAAG | 17206 |
| 3158 | GAGCUCCG G CUUUCAGG | 7669 | CCTGAAAG GGCTAGCTACAACGA CGGAGCTC | 17207 |
| 3170 | UCAGGAAG A UAAAAGUC | 7670 | GACTTTTA GGCTAGCTACAACGA CTTCCTGA | 17208 |
| 3176 | AGAUAAAA G UCUGAGUG | 7671 | CACTCAGA GGCTAGCTACAACGA TTTTATCT | 17209 |
| 3182 | AAGUCUGA G UGAUGUUG | 7672 | CAACATCA GGCTAGCTACAACGA TCAGACTT | 17210 |
| 3185 | UCUGAGUG A UGUUGAGG | 7673 | CCTCAACA GGCTAGCTACAACGA CACTCAGA | 17211 |
| 3187 | UGAGUGAU G UUGAGGAA | 7674 | TTCCTCAA GGCTAGCTACAACGA ATCACTCA | 17212 |
| 3203 | AGAGGAGG A UUCUGACG | 7675 | CGTCAGAA GGCTAGCTACAACGA CCTCCTCT | 17213 |
| 3209 | GGAUUCUG A CGGUUUCU | 7676 | AGAAACCG GGCTAGCTACAACGA CAGAATCC | 17214 |
| 3212 | UUCUGACG G UUUCUACA | 7677 | TGTAGAAA GGCTAGCTACAACGA CGTCAGAA | 17215 |
| 3218 | CGGUUUCU A CAAGGAGC | 508 | GCTCCTTG GGCTAGCTACAACGA AGAAACCG | 17216 |
| 3225 | UACAAGGA G CCCAUCAC | 7678 | GTGATGGG GGCTAGCTACAACGA TCCTTGTA | 17217 |
| 3229 | AGGAGCCC A UCACUAUG | 4809 | CATAGTGA GGCTAGCTACAACGA GGCCTCCT | 17218 |
| 3232 | AGCCCAUC A CUAUGGAA | 4810 | TTCCATAG GGCTAGCTACAACGA GATGGGCT | 17219 |
| 3235 | CCAUCACU A UGGAAGAU | 510 | ATCTTCCA GGCTAGCTACAACGA AGTGATGG | 17220 |
| 3242 | UAUGGAAG A UCUGAUUU | 7679 | AAATCAGA GGCTAGCTACAACGA CTTCCATA | 17221 |
| 3247 | AAGAUCUG A UUUCUUAC | 7680 | GTAAGAAA GGCTAGCTACAACGA CAGATCTT | 17222 |

TABLE XVIII-continued

Human FLT DNAzyme and Substrate Sequence

| Pos | Substrate | Seq ID No | DNAzyme | Seq ID No |
|---|---|---|---|---|
| 3254 | GAUUUCUU A CAGUUUUC | 516 | GAAAACTG GGCTAGCTACAACGA AAGAAATC | 17223 |
| 3257 | UUCUUACA G UUUUCAAG | 7681 | CTTGAAAA GGCTAGCTACAACGA TGTAAGAA | 17224 |
| 3265 | GUUUUCAA G UGGCCAGA | 7682 | TCTGGCCA GGCTAGCTACAACGA TTGAAAAC | 17225 |
| 3268 | UUCAAGUG G CCAGAGGC | 7683 | GCCTCTGG GGCTAGCTACAACGA CACTTGAA | 17226 |
| 3275 | GGCCAGAG G CAUGGAGU | 7684 | ACTCCATG GGCTAGCTACAACGA CTCTGGCC | 17227 |
| 3277 | CCAGAGGC A UGGAGUUC | 4818 | GAACTCCA GGCTAGCTACAACGA GCCTCTGG | 17228 |
| 3282 | GGCAUGGA G UUCCUGUC | 7685 | GACAGGAA GGCTAGCTACAACGA TCCATGCC | 17229 |
| 3288 | GAGUUCCU G UCUUCCAG | 7686 | CTGGAAGA GGCTAGCTACAACGA AGGAACTC | 17230 |
| 3300 | UCCAGAAA G UGCAUUCA | 7687 | TGAATGCA GGCTAGCTACAACGA TTTCTGGA | 17231 |
| 3302 | CAGAAAGU C CAUUCAUC | 7688 | GATGAATG GGCTAGCTACAACGA ACTTTCTG | 17232 |
| 3304 | GAAAGUGC A UUCAUCGG | 4824 | CCGATGAA GGCTAGCTACAACGA GCACTTTC | 17233 |
| 3308 | GUGCAUUC A UCGGGACC | 4825 | GGTCCCGA GGCTAGCTACAACGA GAATGCAC | 17234 |
| 3314 | UCAUCGGG A CCUGGCAG | 7689 | CTGCCAGG GGCTAGCTACAACGA CCCGATGA | 17235 |
| 3319 | GGGACCUG C CACCGACA | 7690 | TCTCCCTG GGCTAGCTACAACGA CAGGTCCC | 17236 |
| 3322 | ACCUGGCA G CCAGAAAC | 7691 | GTTTCTCC CGCTACCTACAACGA TGCCACGT | 17237 |
| 3329 | ACCCACAA A CAUUCUUU | 7692 | AAAGAATG GGCTAGCTACAACGA TTCTCGCT | 17238 |
| 3331 | CGAGAAAC A UUCUUUUA | 4829 | TAAAAGAA GGCTAGCTACAACGA GTTTCTCG | 17239 |
| 3339 | AUUCUUUU A UCUGAGAA | 534 | TTCTCAGA GGCTAGCTACAACGA AAAAGAAT | 17240 |
| 3347 | AUCUGAGA A CAACGUCG | 7693 | CCACGTTG GGCTAGCTACAACGA TCTCAGAT | 17241 |
| 3350 | UGAGAACA A CGUGGUCA | 7694 | TCACCACG CGCTAGCTACAACGA TGTTCTCA | 17242 |
| 3352 | AGAACAAC G UGGUGAAG | 7695 | CTTCACCA CCCTACCTACAACGA CTTCTTCT | 17243 |
| 3355 | ACAACGUG G UCAAGAUU | 7696 | AATCTTCA GGCTAGCTACAACGA CACGTTGT | 17244 |
| 3361 | UCCUGAAG A UUUCUGAU | 7697 | ATCACAAA GGCTAGCTACAACGA CTTCACCA | 17245 |
| 3365 | GAAGAUUU C UGAUUUUG | 7698 | CAAAATCA GGCTAGCTACAACGA AAATCTTC | 17246 |
| 3368 | CAUUUGUG A UUUUGGCC | 7699 | GGCCAAAA GCCTAGCTACAACGA CACAAATC | 17247 |
| 3374 | UGAUUUUG G CCUUGCCC | 7700 | GGGCAAGG GGCTAGCTACAACGA CAAAATCA | 17248 |
| 3379 | UUGGCCUU G CCCGGGAU | 7701 | ATCCCCCG GGCTAGCTACAACGA AAGGCCAA | 17249 |
| 3386 | UGCCCGGC A UAUUUAUA | 7702 | TATAAATA GGCTAGCTACAACGA CCCGGGCA | 17250 |
| 3388 | CCCGGGAU A UUUAUAAG | 542 | CTTATAAA GGCTAGCTACAACGA ATCCCGGG | 17251 |
| 3392 | GCAUAUUU A UAAGAACC | 545 | CGTTCTTA CGCTAGCTACAACGA AAATATCC | 17252 |
| 3398 | UUAUAAGA A CCCCGAUU | 7703 | AATCGGGG GGCTAGCTACAACGA TCTTATAA | 17253 |
| 3404 | CAACCCCG A UUAUGUCA | 7704 | TCACATAA CGCTAGCTACAACGA CGGGGTTC | 17254 |
| 3407 | CCCCGAUU A UGUCAGAA | 548 | TTCTCACA GGCTACCTACAACGA AATCGGGG | 17255 |
| 3409 | CCGAUUAU C UCACAAAA | 7705 | TTTTCTCA GGCTAGCTACAACGA ATAATCCG | 17256 |
| 3422 | AAAAGGAG A UACUCGAC | 7706 | GTCGAGTA GGCTAGCTACAACGA CTCCTTTT | 17257 |
| 3424 | AAGCAGAU A CUCGACUU | 549 | AAGTCGAG GGCTAGCTACAACGA ATCTCCTT | 17258 |
| 3429 | GAUACUCG A CUUCCUCU | 7707 | AGAGGAAG GGCTAGCTACAACGA CGAGTATC | 17259 |

TABLE XVIII-continued

Human FLT DNAzyme and Substrate Sequence

| Pos | Substrate | Seq ID No | DNAzyme | Seq ID No |
|---|---|---|---|---|
| 3441 | CCUCUGAA A UGGAUGGC | 7708 | GCCATCCA GGCTAGCTACAACGA TTCAGAGG | 17260 |
| 3445 | UGAAAUGG A UGGCUCCC | 7709 | CGGACCCA GGCTAGCTACAACGA CCATTTCA | 17261 |
| 3448 | AAUCCAUG G CUCCCGAA | 7710 | TTCGGGAG GGCTAGCTACAACGA CATCCATT | 17262 |
| 3456 | GCUCCCGA A UCUAUCUU | 7711 | AAGATAGA GGCTAGCTACAACGA TCGGGAGC | 17263 |
| 3460 | CCGAAUCU A UCUUUGAC | 556 | TCAAAGA GGCTAGCTACAACGA AGATTCGG | 17264 |
| 3467 | UAUCUUUG A CAAAAUCU | 7712 | AGATTTTG GGCTAGCTACAACGA CAAAGATA | 17265 |
| 3472 | UUGACAAA A UCUACAGC | 7713 | GCTGTAGA GGCTAGCTACAACGA TTTGTCAA | 17266 |
| 3476 | CAAAAUCU A CAGCACCA | 56 | UGGTGCTG GGCTAGCTACAACGA AGATTTTG | 17267 |
| 3479 | AAUCUACA G CACCAAGA | 7714 | TCTTGGTG GGCTAGCTACAACGA TGTAGATT | 17268 |
| 3481 | UCUACAGC A CCAAGAGC | 4853 | GCTCTTGG GGCTAGCTACAACGA GCTGTAGA | 17269 |
| 3488 | CACCAAGA G CGACGUGU | 7715 | ACACGTCG GGCTAGCTACAACGA TCTTGGTG | 17270 |
| 3491 | CAAGAGCG A CGUGGGU | 7716 | ACCACACG GGCTAGCTACAACGA CGCTCTTG | 17271 |
| 3493 | AGAGCGAC G UGGGUCU | 7717 | AGACCACA GGCTAGCTACAACGA GTCGCTCT | 17272 |
| 3495 | AGCGACGU C UGGUCUUA | 7718 | TAAGACCA GGCTAGCTACAACGA ACGTCGCT | 17273 |
| 3498 | GACGUGUG G UCUUACGG | 7719 | CCGTAAGA GGCTAGCTACAACGA CACACGTC | 17274 |
| 3503 | GUGGUCUG A CGGAGUAU | 564 | ATACTCCG GGCTAGCTACAACGA AAGACCAC | 17275 |
| 3508 | CUUACGGA C UAUUGCUG | 7720 | CAGCAATA GGCTAGCTACAACGA TCCGTAAG | 17276 |
| 3510 | UACGGAGU A UUGCUGUG | 565 | CACAGCAA GGCTAGCTACAACGA ACTCCGTA | 17277 |
| 3513 | GGAGUAUU G CUGUGGGA | 772 | UGCCACAG GGCTAGCTACAACGA AATACTCC | 17278 |
| 3516 | GUAUUGCU G UGGGAAAU | 7722 | ATTTCCCA GGCTAGCTACAACGA AGCAATAC | 17279 |
| 3523 | UGUGGGAA A UCUUCUCC | 7723 | GGAGAAGA GGCTAGCTACAACGA TTCCCACA | 17280 |
| 3536 | CUCCUUAG C UGGGCUC | 7724 | GAGACCCA GGCTAGCTACAACGA CTAAGGAG | 17281 |
| 3540 | UUAGGUGG G UCCAUA | 7725 | TATGGAGA GGCTAGCTACAACGA CCACCTAA | 17282 |
| 3546 | GGGUCUCC A UACCCAGG | 4864 | CCTGGGTA GGCTAGCTACAACGA GGACACCC | 17283 |
| 3548 | GUCUCCAC A CCCAGGAG | 575 | CTCCTGGG GGCTAGCTACAACGA ATGGAGAC | 17284 |
| 3556 | ACCCAGGA G UACAAAUG | 7726 | CATTTGTA GGCTAGCTACAACGA TCCTGGGT | 17285 |
| 3558 | CCAGGAGU A CAAAUGGA | 576 | TCCATTTG GGCTAGCTACAACGA ACTCCTGG | 17286 |
| 3562 | GAGUACAA A UGGAUGAG | 7727 | CTCATCCA GGCTAGCTACAACGA TTGTACTC | 17287 |
| 3566 | ACAAAUGG A UGAGGACU | 7728 | AGTCCTCA GGCTAGCTACAACGA CCATTTGT | 17288 |
| 3572 | GGAUGAGG A CUUUUGCA | 7729 | TGCAAAAG GGCTAGCTACAACGA CCTCATCC | 17289 |
| 3578 | GGACUUUU C CAGUCGCC | 7730 | GGCGACTG GGCTAGCTACAACGA AAAAGTCC | 17290 |
| 3581 | CUUUUGCA G UCGCCUGA | 7731 | UCAGGCGA GGCTAGCTACAACGA TGCAAAAG | 17291 |
| 3584 | UUGCAGUC G CCUGAGGG | 7732 | CCCTCAGG GGCTAGCTACAACGA GACTGCAA | 17292 |
| 3596 | GAGGGAAG G CAUGAGGA | 7733 | TCCTCATG GGCTAGCTACAACGA CTTCCCTC | 17293 |
| 3598 | GGGAAGGC A UGAGGAUG | 4873 | CATCCTCA GGCTAGCTACAACGA GCCTTCCC | 17294 |
| 3604 | GCAUGAGG A UGAGAGCU | 7734 | AGCTCTCA GGCTAGCTACAACGA CCTCATGC | 17295 |
| 3610 | GGAUGAGA G CUCCUGAG | 7735 | CTCAGGAG GGCTAGCTACAACGA TCTCATCC | 17296 |

TABLE XVIII-continued

Human FLT DNAzyme and Substrate Sequence

| Pos | Substrate | Seq ID No | DNAzyme | Seq ID No |
|---|---|---|---|---|
| 3618 | GCUCCUGA G UACUCUAC | 7736 | GTAGAGTA GGCTAGCTACAACGA TCAGGAGC | 17297 |
| 3620 | UCCUGAGU A CUCUACUC | 582 | GAGTAGAG GGCTAGCTACAACGA ACTCAGGA | 17298 |
| 3625 | AGUACUCU A CUCCUGAA | 584 | TTCAGGAG GGCTAGCTACAACGA AGAGTACT | 17299 |
| 3634 | CUCCUGAA A UCUAUCAG | 7737 | CTGATAGA GGCTAGCTACAACGA TTCAGGAG | 17300 |
| 3638 | UGAAAUCU A UCAGAUCA | 587 | TGATCTGA GGCTAGCTACAACGA AGATTTCA | 17301 |
| 3643 | UCUAUCAG A UCAUGCUG | 7738 | CAGCATGA GGCTAGCTACAACGA CTGATAGA | 17302 |
| 3646 | AUCAGAUC A UCCUGGAC | 4884 | GTCCAGCA GGCTAGCTACAACGA GATCTGAT | 17303 |
| 3648 | CAGAUCAU G CUGGACUG | 7739 | CAGTCCAG GGCTAGCTACAACGA ATGATCTG | 17304 |
| 3653 | CAUGCUGG A CUGCUGGC | 7740 | GCCAGCAG GGCTAGCTACAACGA CCAGCATG | 17305 |
| 3656 | GCUGGACU G CUGGCACA | 774 | UGTGCCAG GGCTAGCTACAACGA AGTCCAGC | 17306 |
| 3660 | GACUCCUG C CACACAGA | 7742 | TCTCTGTG GGCTAGCTACAACGA CAGCAGTC | 17307 |
| 3662 | CUGCUGGC A CAGAGACC | 4888 | GGTCTCTG GGCTACCTACAACGA GCCAGCAG | 17308 |
| 3668 | GCACAGAG A CCCAAAAG | 7743 | CTTTTGGG GGCTAGCTACAACGA CTCTGTGC | 17309 |
| 3681 | AAAGAAAG G CCAAGAUU | 7744 | AATCTTGG GGCTAGCTACAACGA CTTTCTTT | 17310 |
| 3687 | AGGCCAAG A UUUGCAGA | 7745 | TCTGCAAA GCCTAGCTACAACGA CTTGGCCT | 17311 |
| 3691 | CAAGAUUU G CAGAACUU | 7746 | AAGTTCTG GGCTAGCTACAACGA AAATCTTG | 17312 |
| 3696 | UUUGCAGA A CUUGUGGA | 7747 | TCCACAAG GGCTAGCTACAACGA TCTGCAAA | 17313 |
| 3700 | CAGAACUU G UGGAAAAA | 7748 | TTTTTCCA GGCTAGCTACAACGA AAGTTCTG | 17314 |
| 3708 | GUGGAAAA A CUAGGUGA | 7749 | TCACCTAG GGCTAGCTACAACGA TTTTCCAC | 17315 |
| 3713 | AAAACUAG G UGAUUUGC | 7750 | GCAAATCA GGCTAGCTACAACGA CTAGTTTT | 17316 |
| 3716 | ACUAGGUG A UUUGCUUC | 7751 | GAAGCAAA GGCTAGCTACAACGA CACCTAGT | 17317 |
| 3720 | GGUGAUUU C CUUCAAGC | 7752 | GCTTGAAG GGCTAGCTACAACGA AAATCACC | 17318 |
| 3727 | UGCUUCAA G CAAAUGUA | 7753 | TACATTTG GGCTAGCTACAACGA TTGAAGCA | 17319 |
| 3731 | UCAAGCAA A UGUACAAC | 7754 | GTTGTACA GGCTAGCTACAACGA TTGCTTGA | 17320 |
| 3733 | AAGCAAAU C UACAACAG | 7755 | CTGTTGTA GGCTAGCTACAACGA ATTTGCTT | 17321 |
| 3735 | GCAAAUGU A CAACAGGA | 598 | TCCTGTTG GGCTAGCTACAACGA ACATTTGC | 17322 |
| 3738 | AAUGUACA A CAGGAUGG | 7756 | CCATCCTG GGCTAGCTACAACGA TGTACATT | 17323 |
| 3743 | ACAACAGG A UGGUAAAG | 7757 | CTTTACCA GGCTAGCTACAACGA CCTGTTGT | 17324 |
| 3746 | ACAGGAUG C UAAAGACU | 7758 | AGTCTTTA GGCTAGCTACAACGA CATCCTGT | 17325 |
| 3752 | UGGUAAAG A CUACAUCC | 7759 | GGATGTAG GGCTAGCTACAACGA CTTTACCA | 17326 |
| 3755 | UAAAGACU A CAUCCCAA | 600 | TTGGGATG GGCTAGCTACAACGA AGTCTTTA | 17327 |
| 3757 | AAGACUAC A UCCCAAUC | 4904 | GATTGGGA GGCTAGCTACAACGA GTAGTCTT | 17328 |
| 3763 | ACAUCCCA A UCAAUGCC | 7760 | GGCATTGA GGCTACCTACAACGA TGGCATCT | 17329 |
| 3767 | CCCAAUCA A UGCCAUAC | 7761 | GTATGGCA GGCTAGCTACAACGA TGATTGGG | 17330 |
| 3769 | CAAUCAAU G CCAUACUG | 7762 | CAGTATGG GGCTAGCTACAACGA ATTGATTG | 17331 |
| 3772 | UCAAUGCC A UACUGACA | 4910 | TGTCAGTA GGCTAGCTACAACGA GGCATTGA | 17332 |
| 3774 | AAUGCCAU A CUGACAGG | 603 | CCTGTCAG GGCTAGCTACAACGA ATGGCATT | 17333 |

TABLE XVIII-continued

Human FLT DNAzyme and Substrate Sequence

| Pos | Substrate | Seq ID No | DNAzyme | Seq ID No |
|---|---|---|---|---|
| 3778 | CCAUACUG A CAGGAAAU | 7763 | ATTTCCTG GGCTAGCTACAACGA CAGTATGG | 17334 |
| 3785 | GACAGGAA A UAGUGGGU | 7764 | ACCCACTA GGCTAGCTACAACGA TTCCTGTC | 17335 |
| 3788 | AGGAAAUA G UGGGUUUA | 7765 | TAAACCCA CGCTAGCTACAACGA TATTTCCT | 17336 |
| 3792 | AAUAGUGG G UUUACAUA | 7766 | TATGTAAA GGCTAGCTACAACGA CCACTATT | 17337 |
| 3796 | GUGGGUUU A CAUACUCA | 607 | TGAGTATG GGCTAGCTACAACGA AAACCCAC | 17338 |
| 3798 | GGCUUUAC A UACUCAAC | 4913 | GTTGAGTA GGCTAGCTACAACGA GTAAACCC | 17339 |
| 3800 | GUUUACAU A CUCAACUC | 608 | GAGTTGAG GGCTAGCTACAACGA ATGTAAAC | 17340 |
| 3805 | CAUACUCA A CUCCUGCC | 7767 | GGCAGGAG GGCTAGCTACAACGA TGAGTATG | 17341 |
| 3811 | CAACUCCU G CCUUCUCU | 7768 | AGAGAAGG GGCTAGCTACAACGA AGGAGTTG | 17342 |
| 3824 | CUCUGAGG A CUUCUUCA | 7769 | TGAAGAAG GGCTAGCTACAACGA CCTCAGAG | 17343 |
| 3839 | CAAGGAAA C UAUUUCAG | 7770 | CTGAAATA GGCTAGCTACAACGA TTTCCTTG | 17344 |
| 3841 | AGGAAAGU A UUUCAGCU | 618 | AGCTGAAA GGCTAGCTACAACGA ACTTTCCT | 17345 |
| 3847 | GUAUUUCA C CUCCGAAG | 7771 | CTTCGGAG GGCTAGCTACAACGA TGAAATAC | 17346 |
| 3855 | GCUCCGAA G UUUAAUUC | 7772 | GAATTAAA GGCTAGCTACAACGA TTCGGAGC | 17347 |
| 3860 | GAAGUUUA A UUCAGGAA | 7773 | TTCCTGAA GGCTAGCTACAACGA TAAACTTC | 17348 |
| 3869 | UUCAGGAA C CUCUGAUG | 7774 | CATCAGAG GGCTAGCTACAACGA TTCCTGAA | 17349 |
| 3875 | AAGCUCUG A UGAUGUCA | 7775 | TCACATCA GCCTAGCTACAACGA CACACCTT | 17350 |
| 3878 | CUCUGAUG A UGUCAGAU | 7776 | ATCTGACA GGCTAGCTACAACGA CATCAGAG | 17351 |
| 3880 | CUGAUGAU C UCAGAUAU | 7777 | ATATCTGA GCCTAGCTACAACGA ATCATCAG | 17352 |
| 3885 | GAUGUCAC A UAUGUAAA | 7778 | TTTACATA GGCTAGCTACAACGA CTGACATC | 17353 |
| 3887 | UGUCAGAU A UCUAAAUG | 630 | CATTTACA GGCTAGCTACAACGA ATCTCACA | 17354 |
| 3889 | UCAGAUAU C UAAAUGCU | 7779 | ACCATTTA GGCTAGCTACAACGA ATATCTGA | 17355 |
| 3893 | AUAUGUAA A UCCUCUCA | 7780 | TGAAAGCA GGCTAGCTACAACGA TTACATAT | 17356 |
| 3895 | AUGUAAAU C CUUUCAAG | 7781 | CTTGAAAG GGCTAGCTACAACGA ATTTACAT | 17357 |
| 3903 | GCUUUCAA C UUCAUGAG | 7782 | CTCATGAA GGCTAGCTACAACGA TTGAAAGC | 17358 |
| 3907 | UCAAGUUC A UGAGCCUC | 4935 | CACGCTCA GCCTAGCTACAACGA CAACTTCA | 17359 |
| 3911 | GUUCAUGA C CCUGGAAA | 7783 | TTTCCAGG GGCTAGCTACAACGA TCATGAAC | 17360 |
| 3922 | UGGAAAGA A UCAAAACC | 7784 | GGTTTTGA GGCTAGCTACAACGA TCTTTCCA | 17361 |
| 3928 | GAAUCAAA A CCUUUGAA | 7785 | TTCAAAGG GGCTAGCTACAACGA TTTGATTC | 17362 |
| 3939 | UUUGAAGA A CUUUUACC | 7786 | GGTAAAAG GGCTAGCTACAACGA TCTTCAAA | 17363 |
| 3945 | GAACUUUU A CCGAAUGC | 643 | GCATTCGG GGCTAGCTACAACGA AAAAGTTC | 17364 |
| 3950 | UUUACCGA A UGCCACCU | 7787 | AGGTGGCA GGCTAGCTACAACGA TCGGTAAA | 17365 |
| 3952 | UACCGAAV C CCACCUCC | 7788 | GGAGGTGG GGCTAGCTACAACGA ATTCGGTA | 17366 |
| 3955 | CGAAUGCC A CCUCCAUG | 4944 | CATGGAGG GGCTAGCTACAACGA GGCATTCG | 17367 |
| 3961 | CCACCUCC A UGUUUGAU | 4948 | ATCAAACA GGCTAGCTACAACGA GGAGGTGG | 17368 |
| 3963 | ACCUCCAU G UUUGAUGA | 7789 | TCATCAAA GGCTAGCTACAACGA ATGCAGGT | 17369 |
| 3968 | CAUGUUUG A UGACUACC | 7790 | GGTAGTCA GGCTAGCTACAACGA CAAACATG | 17370 |

TABLE XVIII-continued

Human FLT DNAzyme and Substrate Sequence

| Pos | Substrate | Seq ID No | DNAzyme | Seq ID No |
|---|---|---|---|---|
| 3971 | GUUUGAUG A CUACCAGG | 7791 | CCTGGTAG GGCTAGCTACAACGA CATCAAAC | 17371 |
| 3974 | UGAUGACU A CCAGCGCC | 647 | CGCCCTGG CGCTAGCTACAACGA AGTCATCA | 17372 |
| 3980 | CUACCAGG C CGACAGCA | 7792 | TGCTGTCG GGCTAGCTACAACGA CCTGCTAG | 17373 |
| 3983 | CCAGGCCG A CAGCAGCA | 7793 | TGCTGCTG GGCTAGCTACAACGA CGCCCTGG | 17374 |
| 3986 | GGGCGACA G CAGCACUC | 7794 | GAGTGCTG GGCTAGCTACAACGA TGTCGCCC | 17375 |
| 3989 | CGACAGCA C CACUCUCU | 7795 | ACAGAGTG CGCTAGCTACAACGA TGCTGTCG | 17376 |
| 3991 | ACAGCACC A CUCUGUUG | 4954 | CAACAGAG GGCTAGCTACAACGA CCTGCTGT | 17377 |
| 3996 | ACCACUCU C UUGGCCUC | 7796 | GAGGCCAA GGCTAGCTACAACGA AGACTCCT | 17378 |
| 4000 | CUCUCUUG C CCUCUCCC | 7797 | CGCACACC GGCTACCTACAACGA CAACAGAC | 17379 |
| 4009 | CCUCUCCC A UGCUGAAG | 4962 | CTTCAGCA CGCTAGCTACAACGA GGGAGAGG | 17380 |
| 4011 | UCUCCCAU G CUGAAGCG | 7798 | CGCTTCAG GGCTACCTACAACGA ATGCCACA | 17381 |
| 4017 | AUGCUCAA G CGCUUCAC | 7799 | CTGAAGCG GGCTAGCTACAACGA TTCAGCAT | 17382 |
| 4019 | CCUCAACC G CUUCACCU | 7800 | ACGTCAAG CGCTAGCTACAACGA GCTTCAGC | 17383 |
| 4024 | ACCGCUUC A CCUGCACU | 4965 | ACTCCAGC GGCTAGCTACAACGA GAAGCGCT | 17384 |
| 4030 | UCACCUGC A CUGACAGC | 7801 | CCTCTCAC CCCTACCTACAACGA CCAGCTCA | 17385 |
| 4034 | CUGGACUG A CAGCAAAC | 7802 | GTTTGCTG GGCTACCTACAACGA CAGTCCAG | 17386 |
| 4037 | GACUGACA C CAAACCCA | 7803 | TGGGTTTC GGCTACCTACAACGA TCTCAGTC | 17387 |
| 4041 | GACAGCAA A CCCAAGGC | 7804 | GCCTTCCC GCCTAGCTACAACGA TTGCTGTC | 17388 |
| 4048 | AACCCAAC G CCUCGCUC | 7805 | CACCCACG GGCTAGCTACAACGA CTTCGCTT | 17389 |
| 4053 | AAGGCCUC C CUCAAGAU | 7806 | ATCTTCAG GGCTACCTACAACGA GAGGCCTT | 17390 |
| 4060 | CGCUCAAG A UUGACUUG | 7807 | CAACTCAA GGCTACCTACAACGA CTTCAGCC | 17391 |
| 4064 | CAACAUUG A CUCCACAG | 7808 | CTCTCAAC GGCTAGCTACAACGA CAATCTTG | 17392 |
| 4072 | ACUUCAGA C UAACCACU | 7809 | ACTCCTTA GGCTACCTACAACGA TCTCAAGT | 17393 |
| 4075 | UCACACCA A CCAGUAAA | 7810 | TTTACTGG GCCTAGCTACAACGA TACTCTCA | 17394 |
| 4079 | AGUAACCA C UAAAGUA | 781 | UACTTTTA GCCTAGCTACAACGA TGGTTACT | 17395 |
| 4085 | CAGUAAAA C UAAGCACU | 7812 | ACTCCTTA GGCTAGCTACAACGA TTTTACTC | 17396 |
| 4092 | ACUAACCA C UCCGCCCU | 7813 | ACCCCCGA GGCTACCTACAACGA TCCTTACT | 17397 |
| 4098 | CACUCCGC C CUCUCUGA | 7814 | TCACACAC CGCTAGCTACAACGA CCCCACTC | 17398 |
| 4101 | UCCCCGCU C UCUCAUGU | 7815 | ACATCAGA GGCTAGCTACAACGA AGCCCCGA | 17399 |
| 4106 | GCUCUCUC A UCUCAGCA | 7816 | TGCTCACA GGCTAGCTACAACGA CAGACACC | 17400 |
| 4108 | UCUCUCAU C UCACCACC | 7817 | CCTGCTCA GGCTAGCTACAACGA ATCAGACA | 17401 |
| 4112 | UCAUCUCA C CACCCCCA | 7818 | TCCGCCTC CCCTAGCTACAACGA TCACATCA | 17402 |
| 4116 | CUCACCAG C CCCAGUUU | 7819 | AAACTCGC GGCTAGCTACAACGA CTCCTGAC | 17403 |
| 4121 | CACCCCCA C UUUCUCCC | 7820 | GGCAGAAA GGCTAGCTACAACGA TCCCCCTC | 17404 |
| 4127 | CACUUUCU C CCAUUCCA | 782 | UCGAATCG GGCTAGCTACAACGA ACAAACTG | 17405 |
| 4130 | UUUCUCCC A UUCCACCU | 4990 | AGCTCGAA CGCTAGCTACAACGA CGCACAAA | 17406 |
| 4136 | CCAUUCCA C CUGUGGGC | 7822 | CCCCACAC CGCTAGCTACAACGA TGCAATGG | 17407 |

TABLE XVIII-continued

Human FLT DNAzyme and Substrate Sequence

| Pos | Substrate | Seq ID No | DNAzyme | Seq ID No |
|---|---|---|---|---|
| 4139 | UUCCACCU C UGCCCACC | 7823 | CGTCCCCA CCCTACCTACAACGA ACCTGCAA | 17408 |
| 4143 | AGCUGUGG C CACCUCAG | 7824 | CTCACGTG GGCTAGCTACAACGA CCACACCT | 17409 |
| 4145 | CUGUGGGC A CGUCAGCG | 4994 | CGCTGACG GGCTAGCTACAACGA CCCCACAG | 17410 |
| 4147 | GUGGGCAC G UCAGCGAA | 7825 | TTCGCTGA GGCTAGCTACAACGA GTGCCCAC | 17411 |
| 4151 | GCACGUCA G CGAAGGCA | 7826 | TGCCTTCG GGCTAGCTACAACGA TGACGTGC | 17412 |
| 4157 | CAGCGAAG G CAAGCGCA | 7827 | TGCGCTTG GGCTAGCTACAACGA CTTCGCTG | 17413 |
| 4161 | GAAGGCAA G CGCAGGUU | 7828 | AACCTGCG GGCTAGCTACAACGA TTGCCTTC | 17414 |
| 4163 | AGGCAAGC G CAGGUUCA | 7829 | TGAACCTG GGCTAGCTACAACGA GCTTGCCT | 17415 |
| 4167 | AAGCGCAG G UUCACCUA | 7830 | TAGGTGAA GGCTAGCTACAACGA CTGCGCTT | 17416 |
| 4171 | GCAGGUUC A CCUACGAC | 4998 | GTCGTAGG GGCTAGCTACAACGA GAACCTGC | 17417 |
| 4175 | GUUCACCU A CGACCACG | 672 | CGTGGTCG GGCTAGCTACAACGA AGGTGAAC | 17418 |
| 4178 | CACCUACG A CCACGCUG | 7831 | CAGCGTGG GGCTAGCTACAACGA CGTAGGTG | 17419 |
| 4181 | CUACGACC A CGCUGAGC | 5002 | GCTCAGCG GGCTAGCTACAACGA GGTCGTAG | 17420 |
| 4183 | ACGACCAC G CUGASCUG | 7832 | CAGCTCAG GGCTAGCTACAACGA GTGGTCGT | 17421 |
| 4188 | CACGCUGA G CUGGAAAG | 7833 | CTTTCCAG GGCTAGCTACAACGA TCASCGTG | 17422 |
| 4201 | AAAGGAAA A UCGCGUGC | 7834 | GCACGCGA GGCTAGCTACAACGA TTTCCTTT | 17423 |
| 4204 | GGAAAAUC G CGUGCUGC | 7835 | GCASCACG GGCTAGCTACAACGA GATTTTCC | 17424 |
| 4206 | AAAAUCSC G UGCUGCUC | 7836 | GAGCAGCA GGCTAGCTACAACGA GCGATTTT | 17425 |
| 4208 | AAUCGCGU G CUGCUCCC | 7837 | GGGAGCAG GGCTAGCTACAACSA ACGCGATT | 17426 |
| 4211 | CGCGUGCU G CUCCCCGC | 7838 | GCGGGGAG GGCTAGCTACAACGA AGCACGCG | 17427 |
| 4218 | UGCUCCCC G CCCCCAGA | 7839 | TCTGGGGG GGCTAGCTACAACSA SGGGAGCA | 17428 |
| 4226 | GCCCCCAG A CUACAACU | 7840 | AGTTGTAG SGCTAGCTACAACGA CTGGGGGC | 17429 |
| 4229 | CCCAGACU A CAACUCGG | 675 | CCGAGTTG GGCTAGCTACAACGA AGTCTGSG | 17430 |
| 4232 | AGACUACA A CUCGGUGG | 7841 | CCACCGAG GGCTAGCTACAACSA TGTAGTCT | 17431 |
| 4237 | ACAACUCG G UGGUCCUG | 7842 | CAGGACCA GGCTAGCTACAACGA CGAGTTGT | 17432 |
| 4240 | ACUCGGUG G UCCUGUAC | 7843 | GTACAGGA GGCTAGCTACAACGA CACCGAST | 17433 |
| 4245 | GUGGUCCU G UACUCCAC | 7844 | GTGGAGTA GGCTAGCTACAACSA AGGACCAC | 17434 |
| 4247 | GGUCCUGU A CUCCACCC | 678 | GGGTGGAG GGCTAGCTACAACGA ACAGGACC | 17435 |
| 4252 | UGUACUCC A CCCCACCC | 5022 | GGGTGGGG GGCTAGCTACAACGA GGAGTACA | 17436 |
| 4257 | UCCACCCC A CCCAUCUA | 5026 | TAGATGGG GGCTAGCTACAACGA GGGGTGGA | 17437 |
| 4261 | CCCCACCC A UCUAGAGU | 5029 | ACTCTAGA GGCTAGCTACAACGA SSSTGGGG | 17438 |
| 4268 | CAUCUAGA G UUUGACAC | 7845 | GTGTCAAA GGCTAGCTACAACGA TCTAGATG | 17439 |
| 4273 | AGAGUUUS A CACGAAGC | 7846 | GCTTCGTG GGCTAGCTACAACGA CAAACTCT | 17440 |
| 4275 | AGUUUGAC A CGAAGCCU | 5031 | AGGCTTCG GGCTAGCTACAACGA GTCAAACT | 17441 |
| 4280 | GACACGAA G CCUUAUUU | 7847 | AAATAAGG GGCTAGCTACAACGA TTCGTSTC | 17442 |
| 4285 | GAAGCCUU A UUUCUAGA | 685 | TCTAGAAA GGCTAGCTACAACGA AAGGCTTC | 17443 |
| 4295 | UUCUAGAA G CACAUGUG | 7848 | CACATGTG GGCTAGCTACAACGA TTCTAGAA | 17444 |

TABLE XVIII-continued

Human FLT DNAzyme and Substrate Sequence

| Pos | Substrate | Seq ID No | DNAzyme | Seq ID No |
|---|---|---|---|---|
| 4297 | CUAGAAGC A CAUGUGUA | 5035 | TACACATG GGCTAGCTACAACGA GCTTCTAG | 17445 |
| 4299 | AGAAGCAC A USUSUAUU | 5036 | AATACACA GGCTAGCTACAACGA STGCTTCT | 17446 |
| 4301 | AAGCACAU G USUAUUUA | 7849 | TAAATACA GGCTAGCTACAACGA ATSTGCTT | 17447 |
| 4303 | GCACAUGU G UAUUUAUA | 7850 | TATAAATA GGCTAGCTACAACGA ACATSTGC | 17448 |
| 4305 | ACAUGUGU A UUUAUACC | 690 | GGTATAAA GGCTAGCTACAACGA ACACATGT | 17449 |
| 4309 | GUGUAUUU A UACCCCCA | 693 | TSGGGGTA GGCTAGCTACAACGA AAATACAC | 17450 |
| 4311 | GUAUUUAU A CCCCCAGG | 694 | CCTGGGGG GGCTAGCTACAACGA ATAAATAC | 17451 |
| 4322 | CCCAGGAA A CUAGCUUU | 7851 | AAAGCTAG GGCTAGCTACAACGA TTCCTGGG | 17452 |
| 4326 | GGAAACUA G CUUUUGCC | 7852 | GGCAAAAG GGCTAGCTACAACGA TAGTTTCC | 17453 |
| 4332 | UAGCUUUU G CCAGUAUU | 7853 | AATACTGG GGCTAGCTACAACGA AAAAGCTA | 17454 |
| 4336 | UUUUGCCA G UAUUAUGC | 7854 | GCATAATA GGCTAGCTACAACGA TGGCAAAA | 17455 |
| 4338 | UUGCCAGU A UUAUGCAU | 699 | ATGCATAA GGCTAGCTACAACGA ACTGGCAA | 17456 |
| 4341 | CCAGUAUU A UGCAUAUA | 70 | UATATGCA GGCTAGCTAGAACGA AATACTGG | 17457 |
| 4343 | AGUAUUAU G CAUAUAUA | 7855 | TATATATG GGCTAGCTACAACGA ATAATACT | 17458 |
| 4345 | UAUUAUGC A UAUAUAAG | 5046 | CTTATATA GGCTAGCTACAACGA GCATAATA | 17459 |
| 4347 | UUAUGCAU A UAUAAGUU | 702 | AACTTATA GGCTAGCTACAACGA ATGCATAA | 17460 |
| 4349 | AUGCAUAU A UAAGUUUA | 703 | TAAACTTA GGCTAGCTACAACGA ATATGCAT | 17461 |
| 4353 | AUAUAUAA G UUUACACC | 7856 | GGTGTAAA GGCTAGCTACAACGA TTATATAT | 17462 |
| 4357 | AUAAGUUU A CACCUUUA | 707 | TAAAGGTG GGCTAGCTACAACGA AAACTTAT | 17463 |
| 4359 | AAGUUUAC A CCUUUAUC | 5047 | GATAAAGG GGCTAGCTACAACGA GTAAACTT | 17464 |
| 4365 | ACACCUUU A UCUUUCCA | 710 | TGGAAAGA GGCTAGCTACAACGA AAAGGTGT | 17465 |
| 4373 | AUCUUUCC A UGGGAGCC | 5052 | GGCTCCCA GGCTAGCTACAACGA GGAAAGAT | 17466 |
| 4379 | CCAUGGGA G CCAGCUGC | 7857 | GCAGCTGG GGCTAGCTACAACGA TCCCATGG | 17467 |
| 4383 | GGGAGCCA G CUGCUUUU | 7858 | AAAAGCAG GGCTAGCTACAACGA TGGCTCCC | 17468 |
| 4386 | AGCCAGCU G CUUUUUGU | 7859 | ACAAAAAG GGCTAGCTACAACGA AGCTGGCT | 17469 |
| 4393 | UGCUUUUU G UGAUUUUU | 7860 | AAAAATCA GGCTAGCTACAACGA AAAAAGCA | 17470 |
| 4396 | UUUUUGUG A UUUUUUUA | 786 | UAAAAAAA GGCTAGCTACAACGA CACAAAAA | 17471 |
| 4405 | UUUUUUUA A UAGUGCUU | 7862 | AAGCACTA GGCTAGCTACAACGA TAAAAAAA | 17472 |
| 4408 | UUUUAAUA G UGCUUUUU | 7863 | AAAAAGCA GGCTAGCTACAACGA TATTAAAA | 17473 |
| 4410 | UUAAUAGU G CUUUUUUU | 7864 | AAAAAAAG GGCTAGCTACAACGA ACTATTAA | 17474 |
| 4424 | UUUUUUUG A CUAACAAG | 7865 | CTTGTTAG GGCTAGCTACAACGA CAAAAAAA | 17475 |
| 4428 | UUUGACUA A CAAGAAUG | 7866 | CATTCTTG GGCTAGCTACAACGA TAGTCAAA | 17476 |
| 4434 | UAACAAGA A UGUAACUC | 7867 | GAGTTACA GGCTAGCTACAACGA TCTTGTTA | 17477 |
| 4436 | ACAAGAAU G UAACUCCA | 7868 | TGGAGTTA GGCTAGCTACAACGA ATTCTTGT | 17478 |
| 4439 | AGAAUGUA A CUCCAGAU | 7869 | ATCTGGAG GGCTAGCTACAACGA TACATTCT | 17479 |
| 4446 | AACUCCAG A UAGAGAAA | 7870 | TTTCTCTA GGCTAGCTACAACGA CTGGAGTT | 17480 |
| 4454 | AUAGAGAA A UAGUGACA | 787 | UGTCACTA GGCTAGCTACAACGA TTCTCTAT | 17481 |

TABLE XVIII-continued

Human FLT DNAzyme and Substrate Sequence

| Pos | Substrate | Seq ID No | DNAzyme | Seq ID No |
|---|---|---|---|---|
| 4457 | GAGAAAUA G UGACAAGU | 7872 | ACTTGTCA GGCTAGCTACAACGA TATTTCTC | 17482 |
| 4460 | AAAUAGUG A CAAGUGAA | 7873 | TTCACTTG GGCTAGCTACAACGA CACTATTT | 17483 |
| 4464 | AGUGACAA G UGAAGAAC | 7874 | GTTCTTCA GGCTAGCTACAACGA TTGTCACT | 17484 |
| 4471 | AGUGAAGA A CACUACUG | 7875 | CAGTAGTG GGCTAGCTACAACGA TCTTCACT | 17485 |
| 4473 | UGAAGAAC A CUACUGCU | 5064 | AGCAGTAG GGCTAGCTACAACGA GTTCTTCA | 17486 |
| 4476 | AGAACACU A CUGCUAAA | 742 | TTTAGCAG GGCTAGCTACAACGA AGTGTTCT | 17487 |
| 4479 | ACACUACU G CUAAAUCC | 7876 | GGATTTAG GGCTAGCTACAACGA AGTAGTGT | 17488 |
| 4484 | ACUGCUAA A UCCUCAUG | 7877 | CATGAGGA GGCTAGCTACAACGA TTAGCAGT | 17489 |
| 4490 | AAAUCCUC A UGUUACUC | 5070 | GAGTAACA GGCTAGCTACAACGA GAGGATTT | 17490 |
| 4492 | AUCCUCAU G UUACUCAG | 7878 | CTGAGTAA GGCTAGCTACAACGA ATGAGGAT | 17491 |
| 4495 | CUCAUGUU A CUCAGUGU | 747 | ACACTGAG GGCTAGCTACAACGA AACATGAG | 17492 |
| 4500 | GUUACUCA G UGUUAGAG | 7879 | CTCTAACA GGCTAGCTACAACGA TGAGTAAC | 17493 |
| 4502 | UACUCAGU G UUAGAAA | 7880 | TTCTCTAA GGCTAGCTACAACGA ACTGAGTA | 17494 |
| 4511 | UUAGAGAA A UCCUUCCU | 7881 | AGGAAGGA GGCTAGCTACAACGA TTCTCTAA | 17495 |
| 4522 | CUUCCUAA A CCCAAUGA | 7882 | TCATTGGG GGCTAGCTACAACGA TTAGGAAG | 17496 |
| 4527 | UAAACCCA A UGACUUCC | 7883 | GGAAGTCA GGCTAGCTACAACGA TGGGTTTA | 17497 |
| 4530 | ACCCAAUG A CUUCCCUG | 7884 | CAGGGAAG GGCTAGCTACAACGA CATTGGGT | 17498 |
| 4538 | ACUUCCCU G CUCCAACC | 7885 | GGTTGGAG GGCTAGCTACAACGA AGGGAAGT | 17499 |
| 4544 | CUGCUCCA A CCCCCGCC | 7886 | GGCGGGGG GGCTAGCTACAACGA TGGAGCAG | 17500 |
| 4550 | CAACCCCC G CCACCUCA | 7887 | TGAGGTGG GGCTAGCTACAACGA GGGGGTTG | 17501 |
| 4553 | CCCCCGCC A CCUCAGGG | 5092 | CCCTGAGG GGCTAGCTACAACGA GGCGGGGG | 17502 |
| 4561 | ACCUCAGG G CACGCAGG | 7888 | CCTGCGTG GGCTAGCTACAACGA CCTGAGGT | 17503 |
| 4563 | CUCAGGGC A CGCAGGAC | 5096 | GTCCTGCG GGCTAGCTACAACGA GCCCTGAG | 17504 |
| 4565 | CAGGGCAC G CAGGACCA | 7889 | TGGTCCTG GGCTAGCTACAACGA GTGCCCTG | 17505 |
| 4570 | CACGCAGG A CCAGUUUG | 7890 | CAAACTGG GGCTAGCTACAACGA CCTGCGTG | 17506 |
| 4574 | CAGGACCA G UUUGAUUG | 7891 | CAATCAAA GGCTAGCTACAACGA TGGTCCTG | 17507 |
| 4579 | CCAGUUUG A UUGAGGAG | 7892 | CTCCTCAA GGCTAGCTACAACGA CAAACTGG | 17508 |
| 4587 | AUUGAGGA G CUGCACUG | 7893 | CAGTGCAG GGCTAGCTACAACGA TCCTCAAT | 17509 |
| 4590 | GAGGAGCU G CACUGAUC | 7894 | GATCAGTG GGCTAGCTACAACGA AGCTCCTC | 17510 |
| 4592 | GGAGCUGC A CUGAUCAC | 5101 | GTGATCAG GGCTAGCTACAACGA GCAGCTCC | 17511 |
| 4596 | CUGCACUG A UCACCCAA | 7895 | TTGGGTGA GGCTAGCTACAACGA CAGTGCAG | 17512 |
| 4599 | CACUGAUC A CCCAAUGC | 5103 | GCATTGGG GGCTAGCTACAACGA GATCAGTG | 17513 |
| 4604 | AUCACCCA A UGCAUCAC | 7896 | GTGATGCA GGCTAGCTACAACGA TGGGTGAT | 17514 |
| 4606 | CACCCAAU G CAUCACGU | 7897 | ACGTGATG GGCTAGCTACAACGA ATTGGGTG | 17515 |
| 4608 | CCCAAUGC A UCACGUAC | 5107 | GTACGTGA GGCTAGCTACAACGA GCATTGGG | 17516 |
| 4611 | AAUGCAUC A CGUACCCC | 5108 | GGGGTACG GGCTAGCTACAACGA GATGCATT | 17517 |
| 4613 | UGCAUCAC G UACCCCAC | 7898 | GTGGGGTA GGCTAGCTACAACGA GTGATGCA | 17518 |

TABLE XVIII-continued

Human FLT DNAzyme and Substrate Sequence

| Pos | Substrate | Seq ID No | DNAzyme | Seq ID No |
|---|---|---|---|---|
| 4615 | CAUCACGU A CCCCACUG | 764 | CAGTGGGG GGCTAGCTACAACGA ACGTGATG | 17519 |
| 4620 | CGUACCCC A CUGGGCCA | 5112 | TGGCCCAG GGCTAGCTACAACGA GGGGTACG | 17520 |
| 4625 | CCCACUGG G CCAGCCCU | 7899 | AGGGCTGG GGCTAGCTACAACGA CCAGTGGG | 17521 |
| 4629 | CUGGGCCA G CCCUGCAG | 7900 | CTGCAGGG GGCTAGCTACAACGA TGGCCCAG | 17522 |
| 4634 | CCAGCCCU G CAGCCCAA | 7901 | UTGGGCTG GGCTAGCTACAACGA AGGGCTGG | 17523 |
| 4637 | GCCCUGCA G CCCAAAAC | 7902 | GTTTTGGG GGCTAGCTACAACGA TGCAGGGC | 17524 |
| 4644 | AGCCCAAA A CCCAGGGC | 7903 | GCCCTGGG GGCTAGCTACAACGA TTTGGGCT | 17525 |
| 4651 | AACCCAGG G CAACAAGC | 7904 | GCTTGTTG GGCTAGCTACAACGA CCTGGGTT | 17526 |
| 4654 | CCAGGGCA A CAAGCCCG | 7905 | CGGGCTTG GGCTAGCTACAACGA TGCCCTGG | 17527 |
| 4658 | GGCAACAA G CCCGUUAG | 7906 | CTAACGGG GGCTAGCTACAACGA TTGTTGCC | 17528 |
| 4662 | ACAAGCCC G UUAGCCCC | 7907 | GGGGCTAA GGCTAGCTACAACGA GGGCTTGT | 17529 |
| 4666 | GCCCGUUA G CCCCAGGG | 7908 | CCCTGGGG GGCTAGCTACAACGA TAACGGGC | 17530 |
| 4676 | CCCAGGGG A UCACUGGC | 7909 | GCCAGTGA GGCTAGCTACAACGA CCCCTGGG | 17531 |
| 4679 | AGGGGAUC A CUGGCUGG | 5134 | CCAGCCAG GGCTAGCTACAACGA GATCCCCT | 17532 |
| 4683 | GAUCACUG G CUGGCCUG | 7910 | CAGGCCAG GGCTAGCTACAACGA CAGTGATC | 17533 |
| 4687 | ACUGGCUG G CCUGAGCA | 791 | UGCTCAGG GGCTAGCTACAACGA CAGCCAGT | 17534 |
| 4693 | UGGCCUGA G CAACAUCU | 7912 | AGATGTTG GGCTAGCTACAACGA TCAGGCCA | 17535 |
| 4696 | CCUGAGCA A CAUCUCGG | 7913 | CCGAGATG GGCTAGCTACAACGA TGCTCAGG | 17536 |
| 4698 | UGAGCAAC A UCUCGGGA | 5140 | TCCCGAGA GGCTAGCTACAACGA GTTGCTCA | 17537 |
| 4707 | UCUCGGGA G UCCUCUAG | 7914 | CTAGAGGA GGCTAGCTACAACGA TCCCGAGA | 17538 |
| 4715 | GUCCUCUA G CAGGCCUA | 7915 | TAGGCCTG GGCTAGCTACAACGA TAGAGGAC | 17539 |
| 4719 | UCUAGCAG G CCUAAGAC | 7916 | GTCTTAGG GGCTAGCTACAACGA CTGCTAGA | 17540 |
| 4726 | GGCCUAAG A CAUGUGAG | 7917 | CTCACATG GGCTAGCTACAACGA CTTAGGCC | 17541 |
| 4728 | CCUAAGAC A UGUGAGGA | 5148 | TCCTCACA GGCTAGCTACAACGA GTCTTAGG | 17542 |
| 4730 | UAAGACAU G UGAGGAGG | 7918 | CCTCCTCA GGCTAGCTACAACGA ATGTCTTA | 17543 |
| 4752 | GAAAAAAA G CAAAAAGC | 7919 | GCTTTTTG GGCTAGCTACAACGA TTTTTTTC | 17544 |
| 4759 | AGCAAAAA G CAAGGGAG | 7920 | CTCCCTTG GGCTAGCTACAACGA TTTTTGCT | 17545 |
| 4777 | AAAGAGAA A CCGGGAGA | 792 | UCTCCCGG GGCTAGCTACAACGA TTCTCTTT | 17546 |
| 4788 | GGGAGAAG G CAUGAGAA | 7922 | TTCTCATG GGCTAGCTACAACGA CTTCTCCC | 17547 |
| 4790 | GAGAAGGC A UGAGAAAG | 5152 | CTTTCTCA GGCTAGCTACAACGA GCCTTCTC | 17548 |
| 4800 | GAGAAAGA A UUUGAGAC | 7923 | GTCTCAAA GGCTAGCTACAACGA TCTTTCTC | 17549 |
| 4807 | AAUUUGAG A CGCACCAU | 7924 | ATGGTGCG GGCTAGCTACAACGA CTCAAATT | 17550 |
| 4809 | UUUGAGAC G CACCAUGU | 7925 | ACATGGTG GGCTAGCTACAACGA GTCTCAAA | 17551 |
| 4811 | UGAGACGC A CCAUGUGG | 5153 | CCACATGG GGCTAGCTACAACGA GCGTCTCA | 17552 |
| 4814 | GACGCACC A UGUGGCA | 5155 | TGCCCACA GGCTAGCTACAACGA GGTGCGTC | 17553 |
| 4816 | CGCACCAU G UGGCACG | 7926 | CGTGCCCA GGCTAGCTACAACGA ATGGTGCG | 17554 |
| 4820 | CCAUGUGG G CACGGAGG | 7927 | CCTCCGTG GGCTAGCTACAACGA CCACATGG | 17555 |

TABLE XVIII-continued

Human FLT DNAzyme and Substrate Sequence

| Pos | Substrate | Seq ID No | DNAzyme | Seq ID No |
|---|---|---|---|---|
| 4822 | AUGUGGGC A CGGAGGGG | 5156 | CCCCTCCG GGCTAGCTACAACGA GCCCACAT | 17556 |
| 4832 | GGAGGGGG A CGGGGCUC | 7928 | GAGCCCCG GGCTAGCTACAACGA CCCCCTCC | 17557 |
| 4837 | GGGACGGG G CUCAGCAA | 7929 | TTGCTGAG GGCTAGCTACAACGA CCCGTCCC | 17558 |
| 4842 | GGGGCUCA G CAAUGCCA | 7930 | TGGCATTG GGCTAGCTACAACGA TGAGCCCC | 17559 |
| 4845 | GCUCAGCA A UGCCAUUU | 7931 | AAATGGCA GGCTAGCTACAACGA TGCTGAGC | 17560 |
| 4847 | UCAGCAAU G CCAUUUCA | 7932 | TGAAATGG GGCTAGCTACAACGA ATTGCTGA | 17561 |
| 4850 | GCAAUGCC A UUUCAGUG | 5161 | CACTGAAA GGCTAGCTACAACGA GGCATTGC | 17562 |
| 4856 | CCAUUUCA G UGGCUUCC | 7933 | GGAAGCCA GGCTAGCTACAACGA TGAAATGG | 17563 |
| 4859 | UUUCAGUG G CUUCCCAG | 7934 | CTGGGAAG GGCTAGCTACAACGA CACTGAAA | 17564 |
| 4867 | GCUUCCCA G CUCUGACC | 7935 | GGTCAGAG GGCTAGCTACAACGA TGGGAAGC | 17565 |
| 4873 | CAGCUCUG A CCCUUCUA | 7936 | TAGAAGGG GGCTAGCTACAACGA CAGAGCTG | 17566 |
| 4881 | ACCCUUCU A CAUUUGAG | 785 | CTCAAATG GGCTAGCTACAACGA AGAAGGGT | 17567 |
| 4883 | CCUUCUAC A UUUGAGGG | 5173 | CCCTCAAA GGCTAGCTACAACGA GTAGAAGG | 17568 |
| 4891 | AUUUGAGG G CCCAGCCA | 7937 | TGGCTGGG GGCTAGCTACAACGA CCTCAAAT | 17569 |
| 4896 | AGGGCCCA G CCAGGAGC | 7938 | GCTCCTGG GGCTAGCTACAACGA TGGGCCCT | 17570 |
| 4903 | AGCCAGGA G CAGAUGGA | 7939 | TCCATCTG GGCTAGCTACAACGA TCCTGGCT | 17571 |
| 4907 | AGGAGCAG A UGGACAGG | 7940 | GCTGTCCA GGCTAGCTACAACGA CTGCTCCT | 17572 |
| 4911 | GCAGAUGG A CAGCGAUG | 7941 | CATCGCTG GGCTAGCTACAACGA CCATCTGC | 17573 |
| 4914 | GAUGGACA G CGAUGAGG | 7942 | CCTCATCG GGCTAGCTACAACGA TGTCCATC | 17574 |
| 4917 | GGACAGCG A UGAGGGA | 7943 | TCCCCTCA GGCTAGCTACAACGA CGCTGTCC | 17575 |
| 4925 | AUGAGGGG A CAUUUUCU | 7944 | AGAAAATG GGCTAGCTACAACGA CCCCTCAT | 17576 |
| 4927 | GAGGGGAC A UUUUCUGG | 5181 | CCAGAAAA GGCTAGCTACAACGA GTCCCCTC | 17577 |
| 4936 | UUUUCUGG A UUCUGGGA | 7945 | TCCCAGAA GGCTAGCTACAACGA CCAGAAAA | 17578 |
| 4946 | UCUGGGAG G CAAGAAAA | 7946 | TTTTCTTG GGCTAGCTACAACGA CTCCCAGA | 17579 |
| 4957 | AGAAAAGG A CAAAUAUC | 7947 | GATATTTG GGCTAGCTACAACGA CCTTTTCT | 17580 |
| 4961 | AAGGACAA A UAUCUUUU | 7948 | AAAAGATA GGCTAGCTACAACGA TTGTCCTT | 17581 |
| 4963 | GGACAAAU A UCUUUUUU | 794 | AAAAAAGA GGCTAGCTACAACGA ATTTGTCC | 17582 |
| 4975 | UUUUUGGA A CUAAAGCA | 7949 | TGCTTTAG GGCTAGCTACAACGA TCCAAAAA | 17583 |
| 4981 | GAACUAAA G CAAAUUUU | 7950 | AAAATTTG GGCTAGCTACAACGA TTTAGTTC | 17584 |
| 4985 | UAAAGCAA A UUUUAGAC | 7951 | GTCTAAAA GGCTAGCTACAACGA TTGCTTTA | 17585 |
| 4992 | AAUUUUAG A CCUUUACC | 7952 | GGTAAAGG GGCTAGCTACAACGA CTAAAATT | 17586 |
| 4998 | AGACCUUU A CCUAUGGA | 808 | TCCATAGG GGCTAGCTACAACGA AAAGGTCT | 17587 |
| 5002 | CUUUACCU A UGGAAGUG | 809 | CACTTCCA GGCTAGCTACAACGA AGGTAAAG | 17588 |
| 5008 | CUAUGGAA G UGGUUCUA | 7953 | TAGAACCA GGCTAGCTACAACGA TTCCATAG | 17589 |
| 5011 | UGGAAGUG G UUCUAUGU | 7954 | ACATAGAA GGCTAGCTACAACGA CACTTCCA | 17590 |
| 5016 | GUGGUUCU A UGCCAUU | 812 | AATGGACA GGCTAGCTACAACGA AGAACCAC | 17591 |
| 5018 | GGUUCUAU G UCCAUUCU | 7955 | AGAATGGA GGCTAGCTACAACGA ATAGAACC | 17592 |

TABLE XVIII-continued

Human FLT DNAzyme and Substrate Sequence

| Pos | Substrate | Seq ID No | DNAzyme | Seq ID No |
|---|---|---|---|---|
| 5022 | CUAUGUCC A UUCUCAUU | 5195 | AATGAGAA GGCTAGCTACAACGA GGACATAG | 17593 |
| 5028 | CCAUUCUC A UUCGUGGC | 5197 | GCCACGAA GGCTAGCTACAACGA GAGAATGG | 17594 |
| 5032 | UCUCAUUC G UGGCAUGU | 7956 | ACATGCCA GGCTAGCTACAACGA GAATGAGA | 17595 |
| 5035 | CAUUCGUG G CAUGUUUU | 7957 | AAAACATG GGCTAGCTACAACGA CACGAATG | 17596 |
| 5037 | UUCGUGGC A UGUUUUGA | 5198 | TCAAAACA GGCTAGCTACAACGA GCCACGAA | 17597 |
| 5039 | CGUGGCAU G UUUUGAUU | 7958 | AATCAAAA GGCTAGCTACAACGA ATGCCACG | 17598 |
| 5045 | AUGUUUUG A UUUGUAGC | 7959 | GCTACAAA GGCTAGCTACAACGA CAAAACAT | 17599 |
| 5049 | UUUGAUUU G UAGCACUG | 7960 | CAGTGCTA GGCTAGCTACAACGA AAATCAAA | 17600 |
| 5052 | GAUUUGUA G CACUGAGG | 7961 | CCTCAGTG GGCTAGCTACAACGA TACAAATC | 17601 |
| 5054 | UUUGUAGC A CUGAGGGU | 5199 | ACCCTCAG GGCTAGCTACAACGA GCTACAAA | 17602 |
| 5061 | CACUGAGG G UGGCACUC | 7962 | GAGTGCCA GGCTAGCTACAACGA CCTCAGTG | 17603 |
| 5064 | UGAGGGUG G CACUCAAC | 7963 | GTTGAGTG GGCTAGCTACAACGA CACCCTCA | 17604 |
| 5066 | AGGGUGGC A CUCAACUC | 5201 | GAGTTGAG GGCTAGCTACAACGA GCCACCCT | 17605 |
| 5071 | GGCACUCA A CUCUGAGC | 7964 | GCTCAGAG GGCTAGCTACAACGA TGAGTGCC | 17606 |
| 5078 | AACUCUGA G CCCAUACU | 7965 | AGTATGGG GGCTAGCTACAACGA TCAGAGTT | 17607 |
| 5082 | CUGAGCCC A UACUUUUG | 5208 | CAAAAGTA GGCTAGCTACAACGA GGGCTCAG | 17608 |
| 5084 | GAGCCCAU A CUUUUGGC | 827 | GCCAAAG GGCTAGCTACAACGA ATGGGCTC | 17609 |
| 5091 | UACUUUUG G CUCCUCUA | 7966 | TAGAGGAG GGCTAGCTACAACGA CAAAAGTA | 17610 |
| 5100 | CUCCUCUA G UAAGAUGC | 7967 | GCATCTTA GGCTAGCTACAACGA TAGAGGAG | 17611 |
| 5105 | CUAGUAAG A UGCACUGA | 7968 | TCAGTGCA GGCTAGCTACAACGA CTTACTAG | 17612 |
| 5107 | AGUAAGAU G CACUGAAA | 7969 | TTTCAGTG GGCTAGCTACAACGA ATCTTACT | 17613 |
| 5109 | UAAGAUGC A CUGAAAAC | 5214 | GTTTTCAG GGCTAGCTACAACGA GCATCTTA | 17614 |
| 5116 | CACUGAAA A CUUAGCCA | 7970 | TGGCTAAG GGCTAGCTACAACGA TTTCAGTG | 17615 |
| 5121 | AAAACUUA G CCAGAGUU | 7971 | AACTCTGG GGCTAGCTACAACGA TAAGTTTT | 17616 |
| 5127 | UAGCCAGA G UUAGGUUG | 7972 | CAACCTAA GGCTAGCTACAACGA TCTGGCTA | 17617 |
| 5132 | AGAGUUAG G UUGUCUCC | 7973 | GGAGACAA GGCTAGCTACAACGA CTAACTCT | 17618 |
| 5135 | GUUAGGUU G UCUCCAGG | 7974 | CCTGGAGA GGCTAGCTACAACGA AACCTAAC | 17619 |
| 5143 | GUCUCCAG G CCAUGAUG | 7975 | CATCATGG GGCTAGCTACAACGA CTGGAGAC | 17620 |
| 5146 | UCCAGGCC A UGAUGGCC | 5223 | GGCCATCA GGCTAGCTACAACGA GGCCTGGA | 17621 |
| 5149 | AGGCCAUG A UGGCCUUA | 7976 | TAAGGCCA GGCTAGCTACAACGA CATGGCCT | 17622 |
| 5152 | CCAUGAUG G CCUUACAC | 7977 | GTGTAAGG GGCTAGCTACAACGA CATCATGG | 17623 |
| 5157 | AUGGCCUU A CACUGAAA | 843 | TTTCAGTG GGCTAGCTACAACGA AAGGCCAT | 17624 |
| 5159 | GGCCUUAC A CUGAAAAU | 5226 | ATTTTCAG GGCTAGCTACAACGA GTAAGGCC | 17625 |
| 5166 | CACUGAAA A UGUCACAU | 7978 | ATGTGACA GGCTAGCTACAACGA TTTCAGTG | 17626 |
| 5168 | CUGAAAAU G UCACAUUC | 7979 | GAATGTGA GGCTAGCTACAACGA ATTTTCAG | 17627 |
| 5171 | AAAAUGUC A CAUUCUAU | 5228 | ATAGAATG GGCTAGCTACAACGA GACATTTT | 17628 |
| 5173 | AAUGUCAC A UUCUAUUU | 5229 | AAATAGAA GGCTAGCTACAACGA GTGACATT | 17629 |

TABLE XVIII-continued

Human FLT DNAzyme and Substrate Sequence

| Pos | Substrate | Seq ID No | DNAzyme | Seq ID No |
|---|---|---|---|---|
| 5178 | CACAUUCU A UUUUGGGU | 847 | ACCCAAAA GGCTAGCTACAACGA AGAATGTG | 17630 |
| 5185 | UAUUUUGG G UAUUAAUA | 7980 | TATTAATA GGCTAGCTACAACGA CCAAAATA | 17631 |
| 5187 | UUUUGGGU A UUAAUAUA | 851 | UATATTAA GGCTAGCTACAACGA ACCCAAAA | 17632 |
| 5191 | GGGUAUUA A UAUAUAGU | 7981 | ACTATATA GGCTAGCTACAACGA TAATACCC | 17633 |
| 5193 | GUAUUAAU A UAUAGUCC | 854 | GGACTATA GGCTAGCTACAACGA ATTAATAC | 17634 |
| 5195 | AUUAAUAU A CAGUCCAG | 855 | CTGGACTA GGCTAGCTACAACGA ATATTAAT | 17635 |
| 5198 | AAUAUAUA G UCCAGACA | 7982 | TGTCTGGA GGCTAGCTACAACGA TATATATT | 17636 |
| 5204 | UAGUCCAG A CACUUAAC | 7983 | GTTAAGTG GGCTAGCTACAACGA CTGGACTA | 17637 |
| 5206 | GUCCAGAC A CUUAACUC | 5233 | GAGTTAAG GGCTAGCTACAACGA GTCTGGAC | 17638 |
| 5211 | GACACUUA A CUCAAUUU | 7984 | AAATTGAG GGCTAGCTACAACGA TAAGTGTC | 17639 |
| 5216 | UUAACUCA A UUUCUUGG | 7985 | CCAAGAAA GGCTAGCTACAACGA TGAGTTAA | 17640 |
| 5224 | AUUUCUUG G UAUUAUUC | 7986 | GAATAATA GGCTAGCTACAACGA CAAGAAAT | 17641 |
| 5226 | UUCUUGGU A UUAUUCUG | 865 | CAGAATAA GGCTAGCTACAACGA ACCAAGAA | 17642 |
| 5229 | UUGGUAUU A UUCUGUUU | 867 | AAACAGAA GGCTAGCTACAACGA AATACCAA | 17643 |
| 5234 | AUUAUUCU G UUUUGCAC | 7987 | GTGCAAAA GGCTAGCTACAACGA AGAATAAT | 17644 |
| 5239 | UCUGUUUU G CACAGUUA | 7988 | TAACTGTG GGCTAGCTACAACGA AAAACAGA | 17645 |
| 5241 | UGUUUUGC A CAGUUAGU | 5239 | ACTAACTG GGCTAGCTACAACGA GCAAAACA | 17646 |
| 5244 | UUUGCACA G UUAGUUGU | 7989 | ACAACTAA GGCTAGCTACAACGA TGTGCAAA | 17647 |
| 5248 | CACAGUUA G UUGUGAAA | 7990 | TTTCACAA GGCTAGCTACAACGA TAACTGTG | 17648 |
| 5251 | AGUUAGUU G UGAAAGAA | 799 | UCTTTCA GGCTAGCTACAACGA AACTAACT | 17649 |
| 5261 | GAAAGAAA G CUGAGAAG | 7992 | CTTCTCAG GGCTAGCTACAACGA TTTCTTTC | 17650 |
| 5271 | UGAGAAGA A UGAAAAUG | 7993 | CATTTTCA GGCTAGCTACAACGA TCTTCTCA | 17651 |
| 5277 | GAAUGAAA A UGCAGUCC | 7994 | GGACTGCA GGCTAGCTACAACGA TTTCATTC | 17652 |
| 5279 | AUGAAAAU G CAGUCCUG | 7995 | CAGGACTG GGCTAGCTACAACGA ATTTTCAT | 17653 |
| 5282 | AAAAUGCA G UCCUGAGG | 7996 | CCTCAGGA GGCTAGCTACAACGA TGCATTTT | 17654 |
| 5294 | UGAGGAGA G UUUUCUCC | 7997 | GGAGAAAA GGCTAGCTACAACGA TCTCCTCA | 17635 |
| 5303 | UUUUCUCC A UAUCAAAA | 5247 | TTTTGATA GGCTAGCTACAACGA GGAGAAAA | 17656 |
| 5305 | UUCUCCAU A UCAAAACG | 882 | CGTTTTGA GGCTAGCTACAACGA ATGGAGAA | 17657 |
| 5312 | AUAUCAAA A CGAGGGCU | 7998 | AGCCCTCG GGCTAGCTACAACGA TTTGATAT | 17658 |
| 5317 | AAACGAGG G CUGAUGGA | 7999 | TCCATCAG GGCTAGCTACAACGA CCTCGTTT | 17659 |
| 5321 | GAGGGCUG A UGGAGGAA | 8000 | TTCCTCCA GGCTAGCTACAACGA CAGCCCTC | 17660 |
| 5334 | GGAAAAAG G UCAAUAAG | 8001 | CTTATTGA GGCTAGCTACAACGA CTTTTTCC | 17661 |
| 5338 | AAAGGUCA A UAAGGUCA | 8002 | TGACCTTA GGCTAGCTACAACGA TGACCTTT | 17662 |
| 5343 | UCAAUAAG G UCAAGGGA | 8003 | TCCCTTGA GGCTAGCTACAACGA CTTATTGA | 17663 |
| 5354 | AAGGGAAG A CCCCGUCU | 8004 | AGACGGGG GGCTAGCTACAACGA CTTCCCTT | 17664 |
| 5359 | AAGACCCC G UCUCUAUA | 8005 | TATAGAGA GGCTAGCTACAACGA GGGGTCTT | 17665 |
| 5365 | CCGUCUCU A UACCAACC | 889 | GGTTGGTA GGCTAGCTACAACGA AGAGACGG | 17666 |

TABLE XVIII-continued

Human FLT DNAzyme and Substrate Sequence

| Pos | Substrate | Seq ID No | DNAzyme | Seq ID No |
|---|---|---|---|---|
| 5367 | GUCUCUAU A CCAACCAA | 890 | TTGGTTGG GGCTAGCTACAACGA ATAGAGAC | 17667 |
| 5371 | CUAUACCA A CCAAACCA | 8006 | TGGTTTGG GGCTAGCTACAACGA TGGTATAG | 17668 |
| 5376 | CCAACCAA A CCAAUUCA | 8007 | TGAATTGG GGCTAGCTACAACGA TTGGTTGG | 17669 |
| 5380 | CCAAACCA A UUCACCAA | 8008 | TTGGTGAA GGCTAGCTACAACGA TGGTTTGG | 17670 |
| 5384 | ACCAAUUC A CCAACACA | 5263 | TGTGTTGG GGCTAGCTACAACGA GAATTGGT | 17671 |
| 5388 | AUUCACCA A CACAGUUG | 8009 | CAACTGTG GGCTAGCTACAACGA TGGTGAAT | 17672 |
| 5390 | UCACCAAC A CAGUUGGG | 5266 | CCCAACTG GGCTAGCTACAACGA GTTGGTGA | 17673 |
| 5393 | CCAACACA G UUGGGACC | 8010 | GGTCCCAA GGCTAGCTACAACGA TGTGTTGG | 17674 |
| 5399 | CAGUUGGG A CCCAAAAC | 8011 | GTTTTGGG GGCTAGCTACAACGA CCCAACTG | 17675 |
| 5406 | GACCCAAA A CACAGGAA | 8012 | TTCCTGTG GGCTAGCTACAACGA TTTGGGTC | 17676 |
| 5408 | CCCAAAAC A CAGGAAGU | 5271 | ACTTCCTG GGCTAGCTACAACGA GTTTTGGG | 17677 |
| 5415 | CACAGGAA G UCAGUCAC | 8013 | GTGACTGA GGCTAGCTACAACGA TTCCTGTG | 17678 |
| 5419 | GGAAGUCA G UCACGUUU | 8014 | AAACGTGA GGCTAGCTACAACGA TGACTTCC | 17679 |
| 5422 | AGUCAGUC A CGUUUCCU | 5274 | AGGAAACG GGCTAGCTACAACGA GACTGACT | 17680 |
| 5424 | UCAGUCAC G UUUCCUUU | 8015 | AAAGGAAA GGCTAGCTACAACGA GTGACTGA | 17681 |
| 5435 | UCCUUUUC A UUUAAUGG | 5277 | CCATTAAA GGCTAGCTACAACGA GAAAAGGA | 17682 |
| 5440 | UUCAUUUA A UGGGGAUU | 8016 | AATCCCCA GGCTAGCTACAACGA TAAATGAA | 17683 |
| 5446 | UAAUGGGG A UUCCACUA | 8017 | TAGTGGAA GGCTAGCTACAACGA CCCCATTA | 17684 |
| 5451 | GGGAUUCC A CUAUCUCA | 5279 | TGAGATAG GGCTAGCTACAACGA GGAATCCC | 17685 |
| 5454 | AUUCCACU A UCUCACAC | 908 | GTGTGAGA GGCTAGCTACAACGA AGTGGAAT | 17686 |
| 5459 | ACUAUCUC A CACUAAUC | 5282 | GATTAGTG GGCTAGCTACAACGA GAGATAGT | 17687 |
| 5461 | UAUCUCAC A CUAAUCUG | 5283 | CAGATTAG GGCTAGCTACAACGA GTGAGATA | 17688 |
| 5465 | UCACACUA A UCUGAAAG | 8018 | CTTTCAGA GGCTAGCTACAACGA TAGTGTGA | 17689 |
| 5475 | CUGAAAGG A UGUGGAAG | 8019 | CTTCCACA GGCTAGCTACAACGA CCTTTCAG | 17690 |
| 5477 | GAAAGGAU G UGGAAGAG | 8020 | CTCTTCCA GGCTAGCTACAACGA ATCCTTTC | 17691 |
| 5485 | GUGGAAGA G CAUUAGCU | 8021 | AGCTAATG GGCTAGCTACAACGA TCTTCCAC | 17692 |
| 5487 | GGAAGAGC A UUAGCUGG | 5286 | CCAGCTAA GGCTAGCTACAACGA GCTCTTCC | 17693 |
| 5491 | GAGCAUUA G CUGGCGCA | 8022 | TGCGCCAG GGCTAGCTACAACGA TAATGCTC | 17694 |
| 5495 | AUUAGCUG G CGCAUAUU | 8023 | AATATGCG GGCTAGCTACAACGA CAGCTAAT | 17695 |
| 5497 | UAGCUGGC G CAUAUUAA | 8024 | TTAATATG GGCTAGCTACAACGA GCCAGCTA | 17696 |
| 5499 | GCUGGCGC A UAUUAAGC | 5288 | GCTTAATA GGCTAGCTACAACGA GCGCCAGC | 17697 |
| 5501 | UGGCGCAU A UUAAGCAC | 915 | GTGCTTAA GGCTAGCTACAACGA ATGCGCCA | 17698 |
| 5506 | CAUAUUAA G CACUUUAA | 8025 | TTAAAGTG GGCTAGCTACAACGA TTAATATG | 17699 |
| 5508 | UAUUAAGC A CUUUAGC | 5289 | GCTTAAAG GGCTAGCTACAACGA GCTTAATA | 17700 |
| 5515 | CACUUUAA G CUCCUUGA | 8026 | TCAAGGAG GGCTAGCTACAACGA TTAAAGTG | 17701 |
| 5524 | CUCCUUGA G UAAAAGG | 8027 | CCTTTTTA GGCTAGCTACAACGA TCAAGGAG | 17702 |
| 5532 | GUAAAAAG G UGGUAUGU | 8028 | ACATACCA GGCTAGCTACAACGA CTTTTTAC | 17703 |

TABLE XVIII-continued

Human FLT DNAzyme and Substrate Sequence

| Pos | Substrate | Seq ID No | DNAzyme | Seq ID No |
|---|---|---|---|---|
| 5535 | AAAAGGUG G UAUGUAAU | 8029 | ATTACATA GGCTAGCTACAACGA CACCTTTT | 17704 |
| 5537 | AAGGUGGU A UGUAAUUU | 924 | AAATTACA GGCTAGCTACAACGA ACCACCTT | 17705 |
| 5539 | GGUGGUAU G UAAUUUAU | 8030 | ATAAATTA GGCTAGCTACAACGA ATACCACC | 17706 |
| 5542 | GGUAUGUA A UUUAUGCA | 803 | UGCATAAA GGCTAGCTACAACGA TACATACC | 17707 |
| 5546 | UGUAAUUU A UGCAAGGU | 928 | ACCTTGCA GGCTAGCTACAACGA AAATTACA | 17708 |
| 5548 | UAAUUUAU G CAAGGUAU | 8032 | ATACCTTG GGCTAGCTACAACGA ATAAATTA | 17709 |
| 5553 | UAUGCAAG G UAUUUCUC | 8033 | GAGAAATA GGCTAGCTACAACGA CTTGCATA | 17710 |
| 5555 | UGCAAGGU A UUUCUCCA | 929 | TGGAGAAA GGCTAGCTACAACGA ACCTTGCA | 17711 |
| 5564 | UUUCUCCA G UUGGGACU | 8034 | AGTCCCAA GGCTAGCTACAACGA TGGAGAAA | 17712 |
| 5570 | CAGUUGGG A CUCAGGAU | 8035 | ATCCTGAG GGCTAGCTACAACGA CCCAACTG | 17713 |
| 5577 | GACUCAGG A UAUUAGUU | 8036 | AACTAATA GGCTAGCTACAACGA CCTGAGTC | 17714 |
| 5579 | CUCAGGAU A UUAGUUAA | 936 | TTAACTAA GGCTAGCTACAACGA ATCCTGAG | 17715 |
| 5583 | GGAUAUUA G UUAAUGAG | 8037 | CTCATTAA GGCTAGCTACAACGA TAATATCC | 17716 |
| 5587 | AUUAGUUA A UGAGCCAU | 8038 | ATGGCTCA GGCTAGCTACAACGA TAACTAAT | 17717 |
| 5591 | GUUAAUGA G CCAUCACU | 8039 | AGTGATGG GGCTAGCTACAACGA TCATTAAC | 17718 |
| 5594 | AAUGAGCC A UCACUAGA | 530 | UCTAGTGA GGCTAGCTACAACGA GGCTCATT | 17719 |
| 5597 | GAGCCAUC A CUAGAAGA | 5302 | TCTTCTAG GGCTAGCTACAACGA GATGGCTC | 17720 |
| 5609 | GAAGAAAA G CCCAUUUU | 8040 | AAAATGGG GGCTAGCTACAACGA TTTTCTTC | 17721 |
| 5613 | AAAAGCCC A UUUUCAAC | 5306 | GTTGAAAA GGCTAGCTACAACGA GGGCTTTT | 17722 |
| 5620 | CAUUUUCA A CUGCUUUG | 8041 | CAAAGCAG GGCTAGCTACAACGA TGAAAATG | 17723 |
| 5623 | UUUCAACU G CUUUGAAA | 8042 | TTTCAAAG GGCTAGCTACAACGA AGTTGAAA | 17724 |
| 5631 | GCUUUGAA A CUUGCCUG | 8043 | CAGGCAAG GGCTAGCTACAACGA TTCAAAGC | 17725 |
| 5635 | UGAAACUU G CCUGGGGU | 8044 | ACCCCAGG GGCTAGCTACAACGA AAGTTTCA | 17726 |
| 5642 | UGCCUGGG C UCUGACCA | 8045 | TGCTCAGA GGCTAGCTACAACGA CCCAGGCA | 17727 |
| 5648 | GGGUCUGA C CAUGAUGG | 8046 | CCATCATG GGCTAGCTACAACGA TCAGACCC | 17728 |
| 5650 | GUCUGAGC A UGAUGGGA | 5314 | TCCCATCA GGCTAGCTACAACGA GCTCAGAC | 17729 |
| 5653 | UGACCAUG A UGGGAAUA | 8047 | TATTCCCA GGCTAGCTACAACGA CATGCTCA | 17730 |
| 5659 | UGAUGGGA A UAGGGAGA | 8048 | TCTCCCTA GGCTAGCTACAACGA TCCCATCA | 17731 |
| 5667 | AUAGGGAG A CAGGGUAG | 8049 | CTACCCTG GGCTAGCTACAACGA CTCCCTAT | 17732 |
| 5672 | GAGACAGG G UAGGAAAG | 8050 | CTTTCCTA GGCTAGCTACAACGA CCTGTCTC | 17733 |
| 5682 | AGGAAAGG G CGCCUACU | 8051 | AGTAGGCG GGCTAGCTACAACGA CCTTTCCT | 17734 |
| 5684 | GAAAGGGC G CCUACUCU | 8052 | AGAGTAGG GGCTAGCTACAACGA GCCCTTTC | 17735 |
| 5688 | GGGCGCCU A CUCUUCAG | 953 | CTGAAGAG GGCTAGCTACAACGA AGGCGCCC | 17736 |
| 5698 | UCUUCAGG G UCUAAAGA | 8053 | TCTTTAGA GGCTAGCTACAACGA CCTGAAGA | 17737 |
| 5706 | GUCUAAAG A UCAAGUGG | 8054 | CCACTTGA GGCTAGCTACAACGA CTTTAGAC | 17738 |
| 5711 | AAGAUCAA G UGGGCCUU | 8055 | AAGGCCCA GGCTAGCTACAACGA TTGATCTT | 17739 |
| 5715 | UCAAGUGG G CCUUGGAU | 8056 | ATCCAAGG GGCTAGCTACAACGA CCACTTGA | 17740 |

TABLE XVIII-continued

Human FLT DNAzyme and Substrate Sequence

| Pos | Substrate | Seq ID No | DNAzyme | Seq ID No |
|---|---|---|---|---|
| 5722 | GGCCUUGG A UCGCUAAG | 8057 | CTTAGCGA GGCTAGCTACAACGA CCAAGGCC | 17741 |
| 5725 | CUUGGAUC G CUAAGCUG | 8058 | CAGCTTAG GGCTAGCTACAACGA GATCCAAG | 17742 |
| 5730 | AUCGCUAA C CUGGCUCU | 8059 | AGAGCCAG GGCTAGCTACAACGA TTAGCGAT | 17743 |
| 5734 | CUAAGCUG G CUCUGUUU | 8060 | AAACAGAG GGCTAGCTACAACGA CAGCTTAG | 17744 |
| 5739 | CUGGCUCU G UUUGAUGC | 8061 | GCATCAAA GGCTAGCTACAACGA AGAGCCAG | 17745 |
| 5744 | UCUGUUUG A UGCUAUUU | 8062 | AAATAGCA GGCTAGCTACAACGA CAAACAGA | 17746 |
| 5746 | UGUUUGAU G CUAUUUAU | 8063 | ATAAATAG GGCTAGCTACAACGA ATCAAACA | 17747 |
| 5749 | UUGAUGCU A UUUAUGCA | 966 | TGCATAAA GGCTAGCTACAACGA AGCATCAA | 17748 |
| 5753 | UCCUAUUU A UGCAAGUU | 969 | AACTTGCA GGCTAGCTACAACGA AAATAGCA | 17749 |
| 5755 | CUAUUUAU C CAAGUUAG | 8064 | CTAACTTG CGCTAGCTACAACGA ATAAATAG | 17750 |
| 5759 | UUAUGCAA G UUAGGGUC | 8065 | GACCCTAA GGCTAGCTACAACGA TTGCATAA | 17751 |
| 5765 | AAGUUAGG G UCUAUGUA | 8066 | TACATAGA GGCTAGCTACAACGA CCTAACTT | 17752 |
| 5769 | UAGGGUCU A UGUAUUUA | 973 | TAAATACA GGCTAGCTACAACGA AGACCCTA | 17753 |
| 5771 | GGGUCUAU G UAUUUAGG | 8067 | CCTAAATA GGCTAGCTACAACGA ATAGACCC | 17754 |
| 5773 | GUCUAUGU A UUUAGGAU | 974 | ATCCTAAA GGCTAGCTACAACGA ACATAGAC | 17755 |
| 5780 | UAUUUAGG A UGCGCCUA | 8068 | TAGGCGCA GGCTAGCTACAACGA CCTAAATA | 17756 |
| 5782 | UUUAGGAU G CGCCUACU | 8069 | AGTAGGCG GGCTAGCTACAACGA ATCCTAAA | 17757 |
| 5784 | UAGGAUGC G CCUACUCU | 8070 | AGAGTAGG GGCTAGCTACAACGA GCATCCTA | 17758 |
| 5788 | AUGCGCCU A CUCUUCAG | 978 | CTGAAGAG GGCTAGCTACAACGA AGGCGCAT | 17759 |
| 5798 | UCUUCAGG G UCUAAAGA | 8053 | TCTTTAGA GGCTAGCTACAACGA CCTGAAGA | 17737 |
| 5806 | GUCUAAAG A UCAAGUGG | 8054 | CCACTTCA GGCTAGCTACAACGA CTTTAGAC | 17738 |
| 5811 | AAGAUCAA G UGGGCCUU | 8055 | AAGGCCCA GGCTAGCTACAACGA TTGATCTT | 17739 |
| 5815 | UCAAGUGG G CCUUGGAU | 8056 | ATCCAAGG GGCTAGCTACAACGA CCACTTGA | 17740 |
| 5822 | GGCCUUGG A UCGCUAAG | 8057 | CTTAGCGA GGCTAGCTACAACGA CCAAGGCC | 17741 |
| 5825 | CUUGGAUC G CUAAGCUG | 8058 | CAGCTTAG GGCTAGCTACAACGA GATCCAAG | 17742 |
| 5830 | AUCGCUAA G CUGGCUCU | 8059 | AGAGCCAG GGCTAGCTACAACGA TTAGCGAT | 17743 |
| 5834 | CUAAGCUG G CUCUGUUU | 8060 | AAACAGAG GGCTAGCTACAACGA CAGCTTAG | 17744 |
| 5839 | CUGGCUCU G UUUGAUGC | 8061 | GCATCAAA GGCTAGCTACAACGA AGAGCCAG | 17745 |
| 5844 | UCUGUUUG A UGCUAUUU | 8062 | AAATAGCA GGCTAGCTACAACGA CAAACAGA | 17746 |
| 5846 | UGUUUGAU G CUAUUUAU | 8063 | ATAAATAG GGCTAGCTACAACGA ATCAAACA | 17747 |
| 5849 | UUGAUGCU A UUUAUGCA | 966 | TGCATAAA GGCTAGCTACAACGA AGCATCAA | 17748 |
| 5853 | UGCUAUUU A UGCAAGUU | 969 | AACTTGCA GGCTAGCTACAACGA AAATAGCA | 17749 |
| 5855 | CUAUUUAU G CAAGUUAG | 8064 | CTAACTTG GGCTAGCTACAACGA ATAAATAG | 17750 |
| 5859 | UUAUGCAA G UUAGGGUC | 8065 | GACCCTAA GGCTAGCTACAACGA TTGCATAA | 17751 |
| 5865 | AAGUUAGG G UCUAUGUA | 8066 | TACATAGA GGCTAGCTACAACGA CCTAACTT | 17752 |
| 5869 | UAGGGUCU A UGUAUUUA | 973 | TAAATACA GGCTAGCTACAACGA AGACCCTA | 17753 |
| 5871 | GGGUCUAU G UAUUUAGG | 8067 | CCTAAATA GGCTAGCTACAACGA ATAGACCC | 17754 |

TABLE XVIII-continued

Human FLT DNAzyme and Substrate Sequence

| Pos | Substrate | Seq ID No | DNAzyme | Seq ID No |
|---|---|---|---|---|
| 5873 | GUCUAUGU A UUUAGGAU | 974 | ATCCTAAA GGCTAGCTACAACGA ACATAGAC | 17755 |
| 5880 | UAUUUAGG A UGUCUGCA | 807 | UGCAGACA GGCTAGCTACAACGA CCTAAATA | 17760 |
| 5882 | UUUAGGAU G UCUGCACC | 8072 | GGTGCAGA GGCTAGCTACAACGA ATCCTAAA | 17761 |
| 5886 | GGAUGUCU G CACCUUCU | 8073 | AGAAGGTG GGCTAGCTACAACGA AGACATCC | 17762 |
| 5888 | AUGUCUGC A CCUUCUGC | 5335 | GCAGAAGG GGCTAGCTACAACGA GCAGACAT | 17763 |
| 5895 | CACCUUCU G CAGCCAGU | 8074 | ACTGGCTG GGCTAGCTACAACGA AGAAGGTG | 17764 |
| 5898 | CUUCUGCA G CCAGUCAG | 8075 | CTGACTGG GGCTAGCTACAACGA TGCAGAAG | 17765 |
| 5902 | UGCAGCCA G UCAGAAGC | 8076 | GCTTCTGA GGCTAGCTACAACGA TGGCTGCA | 17766 |
| 5909 | AGUCAGAA G CUGGAGAG | 8077 | CTCTCCAG GGCTAGCTACAACGA TTCTGACT | 17767 |
| 5918 | CUGGAGAG G CAACAGUG | 8078 | CACTGTTG GGCTAGCTACAACGA CTCTCCAG | 17768 |
| 5921 | GAGAGGCA A CAGUGGAU | 8079 | ATCCACTG GGCTAGCTACAACGA TGCCTCTC | 17769 |
| 5924 | AGGCAACA G UGGAUUGC | 8080 | GCAATCCA GGCTAGCTACAACGA TGTTGCCT | 17770 |
| 5928 | AACAGUGG A UUGCUGCU | 8081 | AGCAGCAA GGCTAGCTACAACGA CCACTGTT | 17771 |
| 5931 | AGUGGAUU G CUGCUUCU | 8082 | AGAAGCAG GGCTAGCTACAACGA AATCCACT | 17772 |
| 5934 | GGAUUGCU G CUUCUUGG | 8083 | CCAAGAAG GGCTAGCTACAACGA AGCAATCC | 17773 |
| 5951 | GGAGAAGA G UAUGCUUC | 8084 | GAAGCATA GGCTAGCTACAACGA TCTTCTCC | 17774 |
| 5953 | AGAAGAGU A UGCUUCCU | 990 | AGGAAGCA GGCTAGCTACAACGA ACTCTTCT | 17775 |
| 5955 | AAGAGUAU G CUUCCUUU | 8085 | AAAGGAAG GGCTAGCTACAACGA ATACTCTT | 17776 |
| 5965 | UUCCUUUU A UCCAUGUA | 996 | TACATGGA GGCTAGCTACAACGA AAAAGGAA | 17777 |
| 5969 | UUUUAUCC A UGUAAUUU | 5353 | AAATTACA GGCTAGCTACAACGA GGATAAAA | 17778 |
| 5971 | UUAUCCAU G UAAUUUAA | 8086 | TTAAATTA GGCTAGCTACAACGA ATGGATAA | 17779 |
| 5974 | UCCAUGUA A UUUAACUG | 8087 | CAGTTAAA GGCTAGCTACAACGA TACATGGA | 17780 |
| 5979 | GUAAUUUA A CUGUAGAA | 8088 | TTCTACAG GGCTAGCTACAACGA TAAATTAC | 17781 |
| 5982 | AUUUAACU G UAGAACCU | 8089 | AGGTTCTA GGCTAGCTACAACGA AGTTAAAT | 17782 |
| 5987 | ACUGUAGA A CCUGAGCU | 8090 | AGCTCAGG GGCTAGCTACAACGA TCTACAGT | 17783 |
| 5993 | GAACCUGA G CUCUAAGU | 8091 | ACTTAGAG GGCTAGCTACAACGA TCAGGTTC | 17784 |
| 6000 | AGCUCUAA G UAACCGAA | 8092 | TTCGGTTA GGCTAGCTACAACGA TTAGAGCT | 17785 |
| 6003 | UCUAAGUA A CCGAAGAA | 8093 | TTCTTCGG GGCTAGCTACAACGA TACTTAGA | 17786 |
| 6011 | ACCGAAGA A UGUAUGCC | 8094 | GGCATACA GGCTAGCTACAACGA TCTTCGGT | 17787 |
| 6013 | CGAAGAAU G UAUGCCUC | 8095 | GAGGCATA GGCTAGCTACAACGA ATTCTTCG | 17788 |
| 6015 | AAGAAUGU A UGCCUCUG | 1006 | CAGAGGCA GGCTAGCTACAACGA ACATTCTT | 17789 |
| 6017 | GAAUGUAU G CCUCUGUU | 8096 | AACAGAGG GGCTAGCTACAACGA ATACATTC | 17790 |
| 6023 | AUGCCUCU G UUCUUAUG | 8097 | CATAAGAA GGCTAGCTACAACGA AGAGGCAT | 17791 |
| 6029 | CUGUUCUU A UGUGCCAC | 1011 | GTGGCACA GGCTAGCTACAACGA AAGAACAG | 17792 |
| 6031 | GUUCUUAU G UGCCACAU | 8098 | ATGTGGCA GGCTAGCTACAACGA ATAAGAAC | 17793 |
| 6033 | UCUAUGU G CCACAUCC | 8099 | GGATGTGG GGCTAGCTACAACGA ACATAAGA | 17794 |
| 6036 | UAUGUGCC A CAUCCUUG | 5365 | CAAGGATG GGCTAGCTACAACGA GGCACATA | 17795 |

TABLE XVIII-continued

Human FLT DNAzyme and Substrate Sequence

| Pos | Substrate | Seq ID No | DNAzyme | Seq ID No |
|---|---|---|---|---|
| 6038 | UGUGCCAC A UCCUUGUU | 5366 | AACAAGGA GGCTAGCTACAACGA GTGGCACA | 17796 |
| 6044 | ACAUCCUU G UUUAAAGG | 8100 | CCTTTAAA GGCTAGCTACAACGA AAGGATGT | 17797 |
| 6052 | GUUUAAAG G CUCUCUGU | 8101 | ACAGAGAG GGCTAGCTACAACGA CTTTAAAC | 17798 |
| 6059 | GGCUCUCU G UAUGAAGA | 8102 | TCTTCATA GGCTAGCTACAACGA AGAGAGCC | 17799 |
| 6061 | CUCUCUGU A UGAAGAGA | 1019 | TCTCTTCA GGCTAGCTACAACGA ACAGAGAG | 17800 |
| 6069 | AUGAAGAG A UGGGACCG | 8103 | CGGTCCCA GGCTAGCTACAACGA CTCTTCAT | 17801 |
| 6074 | GAGAUGGG A CCGUCAUC | 8104 | GATGACGG GGCTAGCTACAACGA CCCATCTC | 17802 |
| 6077 | AUGGGACC G UCAUCAGC | 8105 | GCTGATGA GGCTAGCTACAACGA GGTCCCAT | 17803 |
| 6080 | GGACCGUC A UCAGCACA | 5373 | TGTGCTGA GGCTAGCTACAACGA GACGGTCC | 17804 |
| 6084 | CGUCAUCA G CACAUUCC | 8106 | GGAATGTG GGCTAGCTACAACGA TGATGACG | 17805 |
| 6086 | UCAUCAGC A CAUUCCCU | 5375 | AGGGAATG GGCTAGCTACAACGA GCTGATGA | 17806 |
| 6088 | AUCAGCAC A UUCCCUAG | 5376 | CTAGGGAA GGCTAGCTACAACGA GTGCTGAT | 17807 |
| 6096 | AUUCCCUA G UGAGCCUA | 8107 | TAGGCTCA GGCTAGCTACAACGA TAGGGAAT | 17808 |
| 6100 | CCUAGUGA G CCUACUGG | 8108 | CCAGTAGG GGCTAGCTACAACGA TCACTAGG | 17809 |
| 6104 | GUGAGCCU A CUGGCUCC | 1025 | GGAGCCAG GGCTAGCTACAACGA AGGCTCAC | 17810 |
| 6108 | GCCUACUG G CUCCUGGC | 8109 | GCCAGGAG GGCTAGCTACAACGA CAGTAGGC | 17811 |
| 6115 | GGCUCCUG G CAGCGGCU | 8110 | AGCCGCTG GGCTAGCTACAACGA CAGGAGCC | 17812 |
| 6118 | UCCUGGCA G CGGCUUUU | 8111 | AAAAGCCG GGCTAGCTACAACGA TGCCAGGA | 17813 |
| 6121 | UGGCAGCG G CUUUUGUG | 8112 | CACAAAAG GGCTAGCTACAACGA CGCTGCCA | 17814 |
| 6127 | CGGCUUUU G UGGAAGAC | 8113 | GTCTTCCA GGCTAGCTACAACGA AAAAGCCG | 17815 |
| 6134 | UGUGGAAG A CUCACUAG | 8114 | CTAGTGAG GGCTAGCTACAACGA CTTCCACA | 17816 |
| 6138 | GAAGACUC A CUAGCCAG | 5389 | CTGGCTAG GGCTAGCTACAACGA GAGTCTTC | 17817 |
| 6142 | ACUCACUA G CCAGAAGA | 8115 | TCTTCTGG GGCTAGCTACAACGA TAGTGAGT | 17818 |
| 6156 | AGAGAGGA G UGGGACAG | 8116 | CTGTCCCA GGCTAGCTACAACGA TCCTCTCT | 17819 |
| 6161 | GGAGUGGG A CAGUCCUC | 8117 | GAGGACTG GGCTAGCTACAACGA CCCACTCC | 17820 |
| 6164 | GUGGGACA G UCCUCUCC | 8118 | GGAGAGGA GGCTAGCTACAACGA TGTCCCAC | 17821 |
| 6173 | UCCUCUCC A CCAAGAUC | 5398 | GATCTTGG GGCTAGCTACAACGA GGAGAGGA | 17822 |
| 6179 | CCACCAAG A UCUAAAUC | 8119 | GATTTAGA GGCTAGCTACAACGA CTTGGTGG | 17823 |
| 6185 | AGAUCUAA A UCCAAACA | 8120 | TGTTTGGA GGCTAGCTACAACGA TTAGATCT | 17824 |
| 6191 | AAAUCCAA A CAAAAGCA | 812 | UGCTTTTG GGCTAGCTACAACGA TTGGATTT | 17825 |
| 6197 | AAACAAAA G CAGGCUAG | 8122 | CTAGCCTG GGCTAGCTACAACGA TTTTGTTT | 17826 |
| 6201 | AAAAGCAG G CUAGAGCC | 8123 | GGCTCTAG GGCTAGCTACAACGA CTGCTTTT | 17827 |
| 6207 | AGGCUAGA G CCAGAAGA | 8124 | TCTTCTGG GGCTAGCTACAACGA TCTAGCCT | 17828 |
| 6220 | AAGAGAGG A CAAAUCUU | 8125 | AAGATTTG GGCTAGCTACAACGA CCTCTCTT | 17829 |
| 6224 | GAGGACAA A UCUUUGUU | 8126 | AACAAAGA GGCTAGCTACAACGA TTGTCCTC | 17830 |
| 6230 | AAAUCUUU G UUGUUCCU | 8127 | AGGAACAA GGCTAGCTACAACGA AAAGATTT | 17831 |
| 6233 | UCUUUGUU G UUCCUCUU | 8128 | AAGAGGAA GGCTAGCTACAACGA AACAAAGA | 17832 |

TABLE XVIII-continued

Human FLT DNAzyme and Substrate Sequence

| Pos | Substrate | Seq ID No | DNAzyme | Seq ID No |
|---|---|---|---|---|
| 6246 | UCUUCUUU A CACAUACG | 1050 | CGTATGTG GGCTAGCTACAACGA AAAGAAGA | 17833 |
| 6248 | UUCUUUAC A CAUACGCA | 5415 | TGCGTATG GGCTAGCTACAACGA GTAAAGAA | 17834 |
| 6250 | CUUUACAC A UACGCAAA | 5416 | TTTGCGTA GGCTAGCTACAACGA GTGTAAAG | 17835 |
| 6252 | UUACACAU A CGCAAACC | 1051 | GGTTTGCG GGCTAGCTACAACGA ATGTGTAA | 17836 |
| 6254 | ACACAUAC G CAAACCAC | 8129 | GTGGTTTG GGCTAGCTACAACGA GTATGTGT | 17837 |
| 6258 | AUACGCAA A CCACCUGU | 8130 | ACAGGTGG GGCTAGCTACAACGA TTGCGTAT | 17838 |
| 6262 | CGCAAACC A CCUGUGAC | 5419 | GTCACAGG GGCTAGCTACAACGA GGTTTGCG | 17839 |
| 6265 | AACCACCU G UGACAGCU | 8131 | AGCTGTCA GGCTAGCTACAACGA AGGTGGTT | 17840 |
| 6268 | CACCUGUG A CACCUGGG | 8132 | GCCAGCTG GGCTAGCTACAACGA CACAGGTG | 17841 |
| 6271 | CUGUGACA G CUGGCAAU | 8133 | ATTGCCAG GGCTAGCTACAACGA TGTCACAG | 17842 |
| 6275 | GACACCUG G CAAUUUUA | 8134 | TAAAATTG GGCTAGCTACAACGA CAGCTGTC | 17843 |
| 6278 | AGCUGGCA A UUUUAUAA | 8135 | TTATAAAA GGCTAGCTACAACGA TGCCAGCT | 17844 |
| 6283 | GCAAUUUU A UAAAUCAG | 1055 | CTGATTTA GGCTAGCTACAACGA AAAATTGC | 17845 |
| 6287 | UUUUAUAA A UCAGGUAA | 8136 | TTACCTGA GGCTAGCTACAACGA TTATAAAA | 17846 |
| 6292 | UAAAUCAG G UAACUGGA | 8137 | TCCAGTTA GGCTAGCTACAACGA CTGATTTA | 17847 |
| 6295 | AUCAGGUA A CUGGAAGG | 8138 | CCTTCCAG GGCTAGCTACAACGA TACCTGAT | 17848 |
| 6306 | GGAAGGAG G UUAAACUC | 8139 | GAGTTTAA GGCTAGCTACAACGA CTCCTTCC | 17849 |
| 6311 | GAGGUUAA A CUCAGAAA | 8140 | TTTCTGAG GGCTAGCTACAACGA TTAACCTC | 17850 |
| 6327 | AAAAGAAG A CCUCAGUC | 8141 | GACTGAGG GGCTAGCTACAACGA CTTCTTTT | 17851 |
| 6333 | AGACCUCA G UCAAUUCU | 8142 | AGAATTGA GGCTAGCTACAACGA TGAGGTCT | 17852 |
| 6337 | CUCAGUCA A UUCUCUAC | 8143 | GTAGAGAA GGCTAGCTACAACGA TGACTGAG | 17853 |
| 6344 | AAUUCUCU A CUUUUUUU | 1067 | AAAAAAAG GGCTAGCTACAACGA AGAGAATT | 17854 |
| 6366 | UUUUCCAA A UCAGAUAA | 8144 | TTATCTGA GGCTAGCTACAACGA TTGGAAAA | 17855 |
| 6371 | CAAAUCAG A UAAUAGCC | 8145 | GGCTATTA GGCTAGCTACAACGA CTGATTTG | 17856 |
| 6374 | AUCAGAUA A UAGCCCAG | 8146 | CTGGGCTA GGCTAGCTACAACGA TATCTGAT | 17857 |
| 6377 | AGAUAAUA G CCCAGCAA | 8147 | TTGCTGGG GGCTAGCTACAACGA TATTATCT | 17858 |
| 6382 | AUAGCCCA G CAAAUAGU | 8148 | ACTATTTG GGCTAGCTACAACGA TGGGCTAT | 17859 |
| 6386 | CCCAGCAA A UAGUGAUA | 8149 | TATCACTA GGCTAGCTACAACGA TTGCTGGG | 17860 |
| 6389 | AGCAAAUA G UGAUAACA | 8150 | TGTTATCA GGCTAGCTACAACGA TATTTGCT | 17861 |
| 6392 | AAAUAGUG A UAACAAAU | 8151 | ATTTGTTA GGCTAGCTACAACGA CACTATTT | 17862 |
| 6395 | UAGUGAUA A CAAAUAAA | 8152 | TTTATTTG GGCTAGCTACAACGA TATCACTA | 17863 |
| 6399 | GAUAACAA A UAAACCU | 8153 | AGGTTTTA GGCTAGCTACAACGA TTGTTATC | 17864 |
| 6404 | CAAAUAAA A CCUUAGCU | 8154 | AGCTAAGG GGCTAGCTACAACGA TTTATTTG | 17865 |
| 6410 | AAACCUUA G CUGUUCAU | 8155 | ATGAACAG GGCTAGCTACAACGA TAAGGTTT | 17866 |
| 6413 | CCUUAGCU G UUCAUGUC | 8156 | GACATGAA GGCTAGCTACAACGA AGCTAAGG | 17867 |
| 6417 | AGCUGUUC A UGUCUUGA | 5447 | TCAAGACA GGCTAGCTACAACGA GAACAGCT | 17868 |
| 6419 | CUGUUCAU G UCUUGAUU | 8157 | AATCAAGA GGCTAGCTACAACGA ATGAACAG | 17869 |

TABLE XVIII-continued

Human FLT DNAzyme and Substrate Sequence

| Pos | Substrate | Seq ID No | DNAzyme | Seq ID No |
|---|---|---|---|---|
| 6425 | AUGUCUUG A UUUCAAUA | 8158 | TATTGAAA GGCTAGCTACAACGA CAAGACAT | 17870 |
| 6431 | UGAUUUCA A UAAUUAAU | 8159 | ATTAATTA GGCTAGCTACAACGA TGAAATCA | 17871 |
| 6434 | UUUCAAUA A UUAAUUCU | 8160 | AGAATTAA GGCTAGCTACAACGA TATTGAAA | 17872 |
| 6438 | AAUAAUUA A UUCUUAAU | 8161 | ATTAAGAA GGCTAGCTACAACGA TAATTATT | 17873 |
| 6445 | AAUUCUUA A UCAUUAAG | 8162 | CTTAATGA GGCTAGCTACAACGA TAAGAATT | 17874 |
| 6448 | UCUUAAUC A UUAAGAGA | 545 | UCTCTTAA GGCTAGCTACAACGA GATTAAGA | 17875 |
| 6456 | AUUAAGAG A CCAUAAUA | 8163 | TATTATGG GGCTAGCTACAACGA CTCTTAAT | 17876 |
| 6459 | AAGAGACC A UAAUAAAU | 5453 | ATTTATTA GGCTAGCTACAACGA GGTCTCTT | 17877 |
| 6462 | AGACCAUA A UAAAUACU | 8164 | AGTATTTA GGCTAGCTACAACGA TATGGTCT | 17878 |
| 6466 | CAUAAUAA A UACUCCUU | 8165 | AAGGAGTA GGCTAGCTACAACGA TTATTATG | 17879 |
| 6468 | UAAUAAAU A CUCCUUUU | 1111 | AAAAGGAG GGCTAGCTACAACGA ATTTATTA | 17880 |
| 6487 | AGAGAAAA G CAAAACCA | 8166 | TGGTTTTG GGCTAGCTACAACGA TTTTCTCT | 17881 |
| 6492 | AAAGCAAA A CCAUUAGA | 8167 | TCTAATGG GGCTAGCTACAACGA TTTGCTTT | 17882 |
| 6495 | GCAAAACC A UUAGAAUU | 5460 | AATTCTAA GGCTAGCTACAACGA GGTTTTGC | 17883 |
| 6501 | CCAUUAGA A UUGUUACU | 8168 | AGTAACAA GGCTAGCTACAACGA TCTAATGG | 17884 |
| 6504 | UUAGAAUU G UUACUCAG | 8169 | CTGAGTAA GGCTAGCTACAACGA AATTCTAA | 17885 |
| 6507 | GAAUUGUU A CUCAGCUC | 1121 | GAGCTGAG GGCTAGCTACAACGA AACAATTC | 17886 |
| 6512 | GUUACUCA G CUCCUUCA | 8170 | TGAAGGAG GGCTAGCTACAACGA TGAGTAAC | 17887 |
| 6522 | UCCUUCAA A CUCAGGUU | 8171 | AACCTGAG GGCTAGCTACAACGA TTGAAGGA | 17888 |
| 6528 | AAACUCAG G UUUGUAGC | 8172 | GCTACAAA GGCTAGCTACAACGA CTGAGTTT | 17889 |
| 6532 | UCAGGUUU G UAGCAUAC | 8173 | GTATGCTA GGCTAGCTACAACGA AAACCTGA | 17890 |
| 6535 | GGUUUGUA G CAUACAUG | 8174 | CATGTATG GGCTAGCTACAACGA TACAAACC | 17891 |
| 6537 | UUUGUAGC A UACAUGAG | 5469 | CTCATGTA GGCTAGCTACAACGA GCTACAAA | 17892 |
| 6539 | UGUAGCAU A CAUGAGUC | 1130 | GACTCATG GGCTAGCTACAACGA ATGCTACA | 17893 |
| 6541 | UAGCAUAC A UGAGUCCA | 5470 | TGGACTCA GGCTAGCTACAACGA GTATGCTA | 17894 |
| 6545 | AUACAUGA G UCCAUCCA | 8175 | TGGATGGA GGCTAGCTACAACGA TCATGTAT | 17895 |
| 6549 | AUGAGUCC A UCCAUCAG | 5472 | CTGATGGA GGCTAGCTACAACGA GGACTCAT | 17896 |
| 6553 | GUCCAUCC A UCAGUCAA | 5474 | TTGACTGA GGCTAGCTACAACGA GGATGGAC | 17897 |
| 6557 | AUCCAUCA G UCAAAGAA | 8176 | TTCTTTGA GGCTAGCTACAACGA TGATGGAT | 17898 |
| 6565 | GUCAAAGA A UGGUUCCA | 8177 | TGGAACCA GGCTAGCTACAACGA TCTTTGAC | 17899 |
| 6568 | AAAGAAUG G UUCCAUCU | 8178 | AGATGGAA GGCTAGCTACAACGA CATTCTTT | 17900 |
| 6573 | AUGGUUCC A UCUGGAGU | 5478 | ACTCCAGA GGCTAGCTACAACGA GGAACCAT | 17901 |
| 6580 | CAUCUGGA G UCUUAAUG | 8179 | CATTAAGA GGCTAGCTACAACGA TCCAGATG | 17902 |
| 6586 | GAGUCUUA A UGUAGAAA | 8180 | TTTCTACA GGCTAGCTACAACGA TAAGACTC | 17903 |
| 6588 | GUCUUAAU G UAGAAAGA | 818 | UCTTTCTA GGCTAGCTACAACGA ATTAAGAC | 17904 |
| 6600 | AAAGAAAA A UGGAGACU | 8182 | AGTCTCCA GGCTAGCTACAACGA TTTTCTTT | 17905 |
| 6606 | AAAUGGAG A CUUGUAAU | 8183 | ATTACAAG GGCTAGCTACAACGA CTCCATTT | 17906 |

TABLE XVIII-continued

Human FLT DNAzyme and Substrate Sequence

| Pos | Substrate | Seq ID No | DNAzyme | Seq ID No |
|---|---|---|---|---|
| 6610 | GGAGACUU G UAAUAAUG | 8184 | CATTATTA GGCTAGCTACAACGA AAGTCTCC | 17907 |
| 6613 | GACUUGUA A UAUGAGC | 8185 | GCTCATTA GGCTAGCTACAACGA TACAAGTC | 17908 |
| 6616 | UUGUAAUA A UGAGCUAG | 8186 | CTAGCTCA GGCTAGCTACAACGA TATTACAA | 17909 |
| 6620 | AAUAAUGA G CUAGUUAC | 8187 | GTAACTAG GGCTAGCTACAACGA TCATTATT | 17910 |
| 6624 | AUGAGCUA G UUACAAAG | 8188 | CTTTGTAA GGCTAGCTACAACGA TAGCTCAT | 17911 |
| 6627 | AGCUAGUU A CAAAGUGC | 1147 | GCACTTTG GGCTAGCTACAACGA AACTAGCT | 17912 |
| 6632 | GUUACAAA G UGCUUGUU | 8189 | AACAAGCA GGCTAGCTACAACGA TTTGTAAC | 17913 |
| 6634 | UACAAAGU G CUUGUUCA | 8190 | TGAACAAG GGCTAGCTACAACGA ACTTTGTA | 17914 |
| 6638 | AAGUGCUU G UUCAUUAA | 819 | UTAATGAA GGCTAGCTACAACGA AAGCACTT | 17915 |
| 6642 | GCUUGUUC A UUAAAAUA | 5485 | TATTTTAA GGCTAGCTACAACGA GAACAAGC | 17916 |
| 6648 | UCAUUAAA A UAGCACUG | 8192 | CAGTGCTA GGCTAGCTACAACGA TTTAATGA | 17917 |
| 6651 | UUAAAAUA G CACUGAAA | 8193 | TTTCAGTG GGCTAGCTACAACGA TATTTTAA | 17918 |
| 6653 | AAAAUAGC A CUGAAAAU | 5486 | ATTTTCAG GGCTAGCTACAACGA GCTATTTT | 17919 |
| 6660 | CACUGAAA A UUGAAACA | 8194 | TGTTTCAA GGCTAGCTACAACGA TTTCAGTG | 17920 |
| 6666 | AAAUUGAA A CAUGAAUU | 8195 | AATTCATG GGCTAGCTACAACGA TTCAATTT | 17921 |
| 6668 | AUUGAAAC A UGAAUUAA | 5488 | TTAATTCA GGCTAGCTACAACGA GTTTCAAT | 17922 |
| 6672 | AAACAUGA A UUAACUGA | 8196 | TCAGTTAA GGCTAGCTACAACGA TCATGTTT | 17923 |
| 6676 | AUGAAUUA A CUGAUAAU | 8197 | ATTATCAG GGCTAGCTACAACGA TAATTCAT | 17924 |
| 6680 | AUUAACUG A UAAUAUUC | 8198 | GAATATTA GGCTAGCTACAACGA CAGTTAAT | 17925 |
| 6683 | AACUGAUA A UAUUCCAA | 8199 | TTGGAATA GGCTAGCTACAACGA TATCAGTT | 17926 |
| 6685 | CUGAUAAU A UUCCAAUC | 1158 | GATTGGAA GGCTAGCTACAACGA ATTATCAG | 17927 |
| 6691 | AUAUUCCA A UCAUUUGC | 8200 | GCAAATGA GGCTAGCTACAACGA TGGAATAT | 17928 |
| 6694 | UUCCAAUC A UUUGCCAU | 5492 | ATGGCAAA GGCTAGCTACAACGA GATTGGAA | 17929 |
| 6698 | AAUCAUUU G CCAUUUAU | 8201 | ATAAATGG GGCTAGCTACAACGA AAATGATT | 17930 |
| 6701 | CAUUUGCC A UUUAUGAC | 5494 | GTCATAAA GGCTAGCTACAACGA GGCAAATG | 17931 |
| 6705 | UGCCAUUU A UGACAAAA | 1166 | TTTTGTCA GGCTAGCTACAACGA AAATGGCA | 17932 |
| 6708 | CAUUUAUG A CAAAAAUG | 8202 | CATTTTTG GGCTAGCTACAACGA CATAAATG | 17933 |
| 6714 | UGACAAAA A UGGUUGGC | 8203 | GCCAACCA GGCTAGCTACAACGA TTTTGTCA | 17934 |
| 6717 | CAAAAUUG G UUGGCACU | 8204 | AGTGCCAA GGCTAGCTACAACGA CATTTTTG | 17935 |
| 6721 | AAUGGUUG G CACUAACA | 8205 | TGTTAGTG GGCTAGCTACAACGA CAACCATT | 17936 |
| 6723 | UGGUUGGC A CUAACAAA | 5496 | TTTGTTAG GGCTAGCTACAACGA GCCAACCA | 17937 |
| 6727 | UGGCACUA A CAAAGAAC | 8206 | GTTCTTTG GGCTAGCTACAACGA TAGTGCCA | 17938 |
| 6734 | AACAAAGA A CGAGCACU | 8207 | AGTGCTCG GGCTAGCTACAACGA TCTTTGTT | 17939 |
| 6738 | AAGAACGA G CACUUCCU | 8208 | AGGAAGTG GGCTAGCTACAACGA TCGTTCTT | 17940 |
| 6740 | GAACGAGC A CUUCCUUU | 5499 | AAAGGAAG GGCTAGCTACAACGA GCTCGTTC | 17941 |
| 6753 | CUUUCAGA G UUUCUGAG | 8209 | CTCAGAAA GGCTAGCTACAACGA TCTGAAAG | 17942 |
| 6762 | UUUCUGAG A UAAUGUAC | 8210 | GTACATTA GGCTAGCTACAACGA CTCAGAAA | 17943 |

TABLE XVIII-continued

Human FLT DNAzyme and Substrate Sequence

| Pos | Substrate | Seq ID No | DNAzyme | Seq ID No |
|---|---|---|---|---|
| 6765 | CUGAGAUA A UGUACGUG | 8211 | CACGTACA GGCTAGCTACAACGA TATCTCAG | 17944 |
| 6767 | GAGAUAAU G UACGUGGA | 8212 | TCCACGTA GGCTAGCTACAACGA ATTATCTC | 17945 |
| 6769 | GAUAAUGU A CGUGGAAC | 1178 | GTTCCACG GGCTAGCTACAACGA ACATTATC | 17946 |
| 6771 | UAAUGUAC G UGGAACAG | 8213 | CTGTTCCA GGCTAGCTACAACGA GTACATTA | 17947 |
| 6776 | UACGUGGA A CAGUCUGG | 8214 | CCAGACTG GGCTAGCTACAACGA TCCACGTA | 17948 |
| 6779 | GUGGAACA G UCUGGGUG | 8215 | CACCCAGA GGCTAGCTACAACGA TGTTCCAC | 17949 |
| 6785 | CAGUCUGG G UGGAAUGG | 8216 | CCATTCCA GGCTAGCTACAACGA CCAGACTG | 17950 |
| 6790 | UGGGUGGA A UGGGGCUG | 8217 | CAGCCCCA GGCTAGCTACAACGA TCCACCCA | 17951 |
| 6795 | GGAAUGGG G CUGAAACC | 8218 | GGTTTCAG GGCTAGCTACAACGA CCCATTCC | 17952 |
| 6801 | GGGCUGAA A CCAUGUGC | 8219 | GCACATGG GGCTAGCTACAACGA TTCAGCCC | 17953 |
| 6804 | CUGAAACC A UGUGCAAG | 5509 | CTTGCACA GGCTAGCTACAACGA GGTTTCAG | 17954 |
| 6806 | GAAACCAU G UGCAAGUC | 8220 | GACTTGCA GGCTAGCTACAACGA ATGGTTTC | 17955 |
| 6808 | AACCAUGU G CAAGUCUG | 8221 | CAGACTTG GGCTAGCTACAACGA ACATGGTT | 17956 |
| 6812 | AUGUGCAA G UCUGUGUC | 8222 | GACACAGA GGCTAGCTACAACGA TTGCACAT | 17957 |
| 6816 | GCAAGUCU G UGUCUUGU | 8223 | ACAAGACA GGCTAGCTACAACGA AGACTTGC | 17958 |
| 6818 | AAGUCUGU G UCUUGUCA | 8224 | TGACAAGA GGCTAGCTACAACGA ACAGACTT | 17959 |
| 6823 | UGUGUCUU G UCAGUCCA | 8225 | TGGACTGA GGCTAGCTACAACGA AAGACACA | 17960 |
| 6827 | UCUUGUCA G UCCAAGAA | 8226 | TTCTTGGA GGCTAGCTACAACGA TGACAAGA | 17961 |
| 6836 | UCCAAGAA C UGACACCG | 8227 | CGGTGTCA GGCTAGCTACAACGA TTCTTGGA | 17962 |
| 6839 | AAGAAGUG A CACCGAGA | 8228 | TCTCGGTG GGCTAGCTACAACGA CACTTCTT | 17963 |
| 6841 | GAAGUGAC A CCGAGAUG | 5516 | CATCTCGG GGCTAGCTACAACGA GTCACTTC | 17964 |
| 6847 | ACACCGAG A UGUUAAUU | 8229 | AATTAACA GGCTAGCTACAACGA CTCGGTGT | 17965 |
| 6849 | ACCGAGAU C UUAAUUUU | 8230 | AAAATTAA GGCTAGCTACAACGA ATCTCGGT | 17966 |
| 6853 | AGAUGUUA A UUUUAGGG | 8231 | CCCTAAAA GGCTAGCTACAACGA TAACATCT | 17967 |
| 6862 | UUUUAGGG A CCCGUGCC | 8232 | GGCACGGG GGCTAGCTACAACGA CCCTAAAA | 17968 |
| 6866 | AGGGACCC G UGCCUUGU | 8233 | ACAAGCA GGCTAGCTACAACGA GGGTCCCT | 17969 |
| 6868 | GGACCCGU C CUUGUUU | 8234 | AAACAAGG GGCTAGCTACAACGA ACGGGTCC | 17970 |
| 6873 | CGUGCCUU G UUUCCUAG | 8235 | CTAGGAAA GGCTAGCTACAACGA AAGGCACG | 17971 |
| 6881 | GUUUCCUA G CCCACAAG | 8236 | CTTGTGGG GGCTAGCTACAACGA TAGGAAAC | 17972 |
| 6885 | CCUAGCCC A CAAGAAUG | 5526 | CATTCTTG GGCTAGCTACAACGA GCGCTAGG | 17973 |
| 6891 | CCACAAGA A UGCAAACA | 8237 | TGTTTGCA GGCTAGCTACAACGA TCTTGTGG | 17974 |
| 6893 | ACAAGAAU G CAAACAUC | 8238 | GATGTTTG GGCTAGCTACAACGA ATTCTTGT | 17975 |
| 6897 | GAAUGCAA A CAUCAAAC | 8239 | GTTTGATG GGCTAGCTACAACGA TTGCATTC | 17976 |
| 6899 | AUGCAAAC A UCAAACAG | 5529 | CTCTTTGA GGCTAGCTACAACGA GTTTGCAT | 17977 |
| 6904 | AACAUCAA A CAGAUACU | 8240 | AGTATCTG GGCTAGCTACAACGA TTGATGTT | 17978 |
| 6908 | UCAAACAG A UACUCGCU | 8241 | AGCGAGTA GGCTAGCTACAACGA CTGTTTGA | 17979 |
| 6910 | AAACAGAU A CUCGCUAG | 1197 | CTAGCGAG GGCTAGCTACAACGA ATCTGTTT | 17980 |

TABLE XVIII-continued

Human FLT DNAzyme and Substrate Sequence

| Pos | Substrate | Seq ID No | DNAzyme | Seq ID No |
|---|---|---|---|---|
| 6914 | AGAUACUC G CUAGCCUC | 8242 | GAGGCTAG GGCTAGCTACAACGA GAGTATCT | 17981 |
| 6918 | ACUCGCUA G CCUCAUUU | 8243 | AAATGAGG GGCTAGCTACAACGA TAGCGAGT | 17982 |
| 6923 | CUAGCCUC A UUUAAAUU | 5536 | AATTTAAA GGCTAGCTACAACGA GAGGCTAG | 17983 |
| 6929 | UCAUUUAA A UUGAUUAA | 8244 | TTAATCAA GGCTAGCTACAACGA TTAAATGA | 17984 |
| 6933 | UUAAAUUG A UUAAAGGA | 8245 | TCCTTTAA GGCTAGCTACAACGA CAATTTAA | 17985 |
| 6945 | AAGGAGGA G UGCAUCUU | 8246 | AAGATGCA GGCTAGCTACAACGA TCCTCCTT | 17986 |
| 6947 | GGAGGAGU G CAUCUUUG | 8247 | CAAAGATG GGCTAGCTACAACGA ACTCCTCC | 17987 |
| 6949 | AGGAGUGC A UCUUUGGC | 5537 | GCCAAAGA GGCTAGCTACAACGA GCACTCCT | 17988 |
| 6956 | CAUCUUUG G CCGACAGU | 8248 | ACTGTCGG GGCTAGCTACAACGA CAAAGATG | 17989 |
| 6960 | UUUGGCCG A CAGUGGUG | 8249 | CACCACTG GGCTAGCTACAACGA CGGCCAAA | 17990 |
| 6963 | GGCCGACA G UGGUGUAA | 8250 | TTACACCA GGCTAGCTACAACGA TGTCGGCC | 17991 |
| 6966 | CGACAGUG G UGUAACUG | 8251 | CAGTTACA GGCTAGCTACAACGA CACTGTCG | 17992 |
| 6968 | ACAGUGGU C UAACUGUG | 8252 | CACAGTTA GGCTAGCTACAACGA ACCACTGT | 17993 |
| 6971 | GUGGUGUA A CUGUGUGU | 8253 | ACACACAG GGCTAGCTACAACGA TACACCAC | 17994 |
| 6974 | GUGUAACU G UGUGUGU | 8254 | CACACACA GGCTAGCTACAACGA AGTTACAC | 17995 |
| 6976 | GUAACUGU G UGUGUGUG | 8255 | CACACACA GGCTAGCTACAACGA ACAGTTAC | 17996 |
| 6978 | AACUGUGU G UGUGUGUG | 8256 | CACACACA GGCTAGCTACAACGA ACACAGTT | 17997 |
| 6980 | CUGUGUGU G UGUGUGUG | 8257 | CACACACA GGCTAGCTACAACGA ACACACAG | 17998 |
| 6982 | GUGUGUGU G UGUGUGUG | 8258 | CACACACA GGCTAGCTACAACGA ACACACAC | 17999 |
| 6984 | GUGUGUGU G UGUGUGUG | 8258 | CACACACA GGCTAGCTACAACGA ACACACAC | 17999 |
| 6986 | GUGUGUGU G UGUGUGUG | 8258 | CACACACA GGCTAGCTACAACGA ACACACAC | 17999 |
| 6988 | GUGUGUGU G UGUGUGUG | 8258 | CACACACA GGCTAGCTACAACGA ACACACAC | 17999 |
| 6990 | GUGUGUGU G UGUGUGUG | 8258 | CACACACA GGCTAGCTACAACGA ACACACAC | 17999 |
| 6992 | GUGUGUGU G UGUGUGUG | 8258 | CACACACA GGCTAGCTACAACGA ACACACAC | 17999 |
| 6994 | GUGUGUGU G UGUGUGUG | 8258 | CACACACA GGCTAGCTACAACGA ACACACAC | 17999 |
| 6996 | GUGUGUGU G UGUGUGUG | 8258 | CACACACA GGCTAGCTACAACGA ACACACAC | 17999 |
| 6998 | GUGUGUGU G UGUGUGUG | 8258 | CACACACA GGCTAGCTACAACGA ACACACAC | 17999 |
| 7000 | GUGUGUGU C UGUGUGUG | 8258 | CACACACA GGCTAGCTACAACGA ACACACAC | 17999 |
| 7002 | GUGUGUGU G UGUGUGUG | 8258 | CACACACA GGCTAGCTACAACGA ACACACAC | 17999 |
| 7004 | GUGUGUGU G UGUGUGUG | 8258 | CACACACA GGCTAGCTACAACGA ACACACAC | 17999 |
| 7006 | GUGUGUGU G UGUGUGUG | 8258 | CACACACA GGCTAGCTACAACGA ACACACAC | 17999 |
| 7008 | GUGUGUGU C UGUGUGGG | 8259 | CCCACACA GGCTAGCTACAACGA ACACACAC | 18000 |
| 7010 | GUGUGUGU G UGUGGGUG | 8260 | CACCCACA GGCTAGCTACAACGA ACACACAC | 18001 |
| 7012 | GUGUGUGU G UGGGUGUG | 8261 | CACACCCA GGCTAGCTACAACGA ACACACAC | 18002 |
| 7016 | GUGUGUGG C UGUGGGUG | 8262 | CACCCACA GGCTAGCTACAACGA CCACACAC | 18003 |
| 7018 | GUGUGGGU G UGGGUGUA | 8263 | TACACCCA GGCTAGCTACAACGA ACCCACAC | 18004 |
| 7022 | GGGUGUGG C UGUAUGUG | 8264 | CACATACA GGCTAGCTACAACGA CCACACCC | 18005 |

TABLE XVIII-continued

Human FLT DNAzyme and Substrate Sequence

| Pos | Substrate | Seq ID No | DNAzyme | Seq ID No |
|---|---|---|---|---|
| 7024 | GUGUGGGU G UAUGUGUG | 8265 | CACACATA GGCTAGCTACAACGA ACCCACAC | 18006 |
| 7026 | GUGGGUGU A UGUGUGUU | 1211 | AACACACA GGCTAGCTACAACGA ACACCCAC | 18007 |
| 7028 | GGGUGUAU C UGUGUUUU | 8266 | AAAACACA GGCTAGCTACAACGA ATACACCC | 18008 |
| 7030 | GUGUAUGU C UGUUUUGU | 8267 | ACAAACA GGCTAGCTACAACGA ACATACAC | 18009 |
| 7032 | GUAUGUGU G UUUUGUGC | 8268 | GCACAAAA GGCTAGCTACAACGA ACACATAC | 18010 |
| 7037 | UGUGUUUU C UGCAUAAC | 8269 | GTTATGCA GGCTAGCTACAACGA AAAACACA | 18011 |
| 7039 | UGUUUUGU C CAUAACUA | 8270 | TAGTTATG GGCTAGCTACAACGA ACAAAACA | 18012 |
| 7041 | UUUUGUGC A UAACUAUU | 5542 | AATAGTTA GGCTAGCTACAACGA GCACAAAA | 18013 |
| 7044 | UGUGCAUA A CUAUUUAA | 827 | UTAAATAG GGCTAGCTACAACGA TATGCACA | 18014 |
| 7047 | GCAUAACU A UUUAAGGA | 1216 | TCCTTAAA GGCTAGCTACAACGA AGTTATGC | 18015 |
| 7057 | UUAAGGAA A CUGGAAUU | 8272 | AATTCCAG GGCTAGCTACAACGA TTCCTTAA | 18016 |
| 7063 | AAACUGGA A UUUAAAG | 8273 | CTTTAAAA GGCTAGCTACAACGA TCCAGTTT | 18017 |
| 7071 | AUUUAAAA G UUACUUUU | 8274 | AAAAGTAA GGCTAGCTACAACGA TTTAAAAT | 18018 |
| 7074 | UUAAAGUU A CUUUUAUA | 1225 | TATAAAAG GGCTAGCTACAACGA AACTTTAA | 18019 |
| 7080 | UUACUUUU A UACAAACC | 1229 | GGTTTGTA GGCTAGCTACAACGA AAAAGTAA | 18020 |
| 7082 | ACUUUUAU A CAAACCAA | 1230 | TTGGTTTG GGCTAGCTACAACGA ATAAAAGT | 18021 |
| 7086 | UUAUACAA A CCAAGAAU | 8275 | ATTCTTGG GGCTAGCTACAACGA TTGTATAA | 18022 |
| 7093 | AACCAAGA A UAUAUGCU | 8276 | AGCATATA GGCTAGCTACAACGA TCTTGGTT | 18023 |
| 7095 | CCAAGAAU A UAUGCUAC | 1231 | GTAGCATA GGCTAGCTACAACGA ATTCTTGG | 18024 |
| 7097 | AAGAAUAU A UGCUACAG | 1232 | CTGTAGCA GGCTAGCTACAACGA ATATTCTT | 18025 |
| 7099 | GAAUAUAU G CUACAGAU | 8277 | ATCTGTAG GGCTAGCTACAACGA ATATATTC | 18026 |
| 7102 | UAUAUGCU A CAGAUAUA | 1233 | TATATCTG GGCTAGCTACAACGA AGCATATA | 18027 |
| 7106 | UGCUACAG A UAUAAGAC | 8278 | GTCTTATA GGCTAGCTACAACGA CTGTAGCA | 18028 |
| 7108 | CUACAGAD A UAAGACAG | 1234 | CTGTCTTA GGCTAGCTACAACGA ATCTGTAG | 18029 |
| 7113 | GAUAUAAG A CAGACAUG | 8279 | CATGTCTG GGCTAGCTACAACGA CTTATATC | 18030 |
| 7117 | UAAGACAG A CAUGGUUU | 8280 | AAACCATG GGCTAGCTACAACGA CTGTCTTA | 18031 |
| 7119 | AGACAGAC A UGGUUUGG | 5552 | CCAAACCA GGCTAGCTACAACGA GTCTGTCT | 18032 |
| 7122 | CAGACAUG G UUUGGUCC | 8281 | GGACCAAA GGCTAGCTACAACGA CATGTCTG | 18033 |
| 7127 | AUGGUUUG G UCCUAUAU | 8282 | ATATAGGA GGCTAGCTACAACGA CAAACCAT | 18034 |
| 7132 | UUGGUCCU A UAUUUCUA | 1239 | TAGAAATA GGCTAGCTACAACGA AGGACCAA | 18035 |
| 7134 | GGUCCUAU A UUUCUAGU | 1240 | ACTAGAAA GGCTAGCTACAACGA ATAGGACC | 18036 |
| 7141 | UAUUUCUA G UCAUGAUG | 8283 | CATCATGA GGCTAGCTACAACGA TAGAAATA | 18037 |
| 7144 | UUCUAGUC A UGAUGAAU | 5556 | ATTCATCA GGCTAGCTACAACGA GACTAGAA | 18038 |
| 7147 | UAGUCAUG A UGAAUGUA | 8284 | TACATTCA GGCTAGCTACAACGA CATGACTA | 18039 |
| 7151 | CAUGAUGA A UGUAUUUU | 8285 | AAAATACA GGCTAGCTACAACGA TCATCATG | 18040 |
| 7153 | UGAUGAAU G UAUUUUGU | 8286 | ACAAAATA GGCTAGCTACAACGA ATTCATCA | 18041 |
| 7155 | AUGAAUGU A UUUUGUAU | 1246 | ATACAAAA GGCTAGCTACAACGA ACATTCAT | 18042 |

TABLE XVIII-continued

Human FLT DNAzyme and Substrate Sequence

| Pos | Substrate | Seq ID No | DNAzyme | Seq ID No |
|---|---|---|---|---|
| 7160 | UGUAUUUU G UAUACCAU | 8287 | ATGGTATA GGCTAGCTACAACGA AAAATACA | 18043 |
| 7162 | UAUUUUGU A UACCAUCU | 1250 | AGATGGTA GGCTAGCTACAACGA ACAAAATA | 18044 |
| 7164 | UUUUGUAU A CCAUCUUC | 1251 | GAAGATGG GGCTAGCTACAACGA ATACAAAA | 18045 |
| 7167 | UGUAUACC A UCUUCAUA | 5558 | TATGAAGA GGCTAGCTACAACGA GGTATACA | 18046 |
| 7173 | CCAUCUUC A UAUAAUAU | 5560 | ATATTATA GGCTAGCTACAACGA GAAGATGG | 18047 |
| 7175 | AUCUUCAU A UAAUAUAC | 1255 | GTATATTA GGCTAGCTACAACGA ATGAAGAT | 18048 |
| 7178 | UUCAUAUA A UAUACUUA | 8288 | TAAGTATA GGCTAGCTACAACGA TATATGAA | 18049 |
| 7180 | CAUAUAAU A UACUUAAA | 1257 | TTTAAGTA GGCTAGCTACAACGA ATTATATG | 18050 |
| 7182 | UAUAAUAU A CUUAAAAA | 1258 | TTTTTAAG GGCTAGCTACAACGA ATATTATA | 18051 |
| 7190 | ACUUAAAA A UAUUUCUU | 8289 | AAGAAATA GGCTAGCTACAACGA TTTTAAGT | 18052 |
| 7192 | UUAAAAAU A UUUCUUAA | 126 | UTAAGAAA GGCTAGCTACAACGA ATTTTTAA | 18053 |
| 7200 | AUUUCUUA A UUGGGAUU | 8290 | AATCCCAA GGCTAGCTACAACGA TAAGAAAT | 18054 |
| 7206 | UAAUUGGG A UUUGUAAU | 8291 | ATTACAAA GGCTAGCTACAACGA CCCAATTA | 18055 |
| 7210 | UGGGAUUU G UAAUCGUA | 8292 | TAGGATTA GGCTAGCTACAACGA AAATCCCA | 18056 |
| 7213 | GAUUUGUA A UCGUACCA | 8293 | TGGTACGA GGCTAGCTACAACGA TACAAATC | 18057 |
| 7216 | UUGUAAUC G UACCAACU | 8294 | AGTTGGTA GGCTAGCTACAACGA GATTACAA | 18058 |
| 7218 | GUAAUCGU A CCAACUUA | 1272 | TAAGTTGG GGCTAGCTACAACGA ACGATTAC | 18059 |
| 7222 | UCGUACCA A CUUAAUUG | 8295 | CAATTAAG GGCTAGCTACAACGA TGGTACGA | 18060 |
| 7227 | CCAACUUA A UUGAUAUA | 8296 | TTTATCAA GGCTAGCTACAACGA TAAGTTGG | 18061 |
| 7231 | CUUAAUUG A UAAACUUG | 8297 | CAAGTTTA GGCTAGCTACAACGA CAATTAAG | 18062 |
| 7235 | AUUGAUAA A CUUGGCAA | 8298 | TTGCCAAG GGCTAGCTACAACGA TTATCAAT | 18063 |
| 7240 | UAAACUUG G CAACUGCU | 8299 | AGCAGTTG GGCTAGCTACAACGA CAAGTTTA | 18064 |
| 7243 | ACUUGGCA A CUGCUUUU | 8300 | AAAAGCAG GGCTAGCTACAACGA TGCCAAGT | 18065 |
| 7246 | UGGCAACU G CUUUUAUG | 8301 | CATAAAAG GGCTAGCTACAACGA AGTTGCCA | 18066 |
| 7252 | CUGCUUUU A UGUUCUGU | 1281 | ACAGAACA GGCTAGCTACAACGA AAAAGCAG | 18067 |
| 7254 | GCUUUUAU G UUCUGUCU | 8302 | AGACAGAA GGCTAGCTACAACGA ATAAAAGC | 18068 |
| 7259 | UAUGUUCU G UCUCCUUC | 8303 | GAAGGAGA GGCTAGCTACAACGA AGAACATA | 18069 |
| 7269 | CUCCUUCC A UAAAUUUU | 5575 | AAAATTTA GGCTAGCTACAACGA GGAAGGAG | 18070 |
| 7273 | UUCCAUAA A UUUUUCAA | 8304 | TTGAAAAA GGCTAGCTACAACGA TTATGGAA | 18071 |
| 7283 | UUUUUCAA A UACUAAUU | 8305 | AATTAGTA GGCTAGCTACAACGA TTTGAAAA | 18072 |
| 7285 | UUCAAAAU A CUAAUUCA | 1294 | TGAATTAG GGCTAGCTACAACGA ATTTTGAA | 18073 |
| 7289 | AAAUACUA A UUCAACAA | 8306 | TTGTTGAA GGCTAGCTACAACGA TAGTATTT | 18074 |
| 7294 | CUAAUUCA A CAAAGAAA | 8307 | TTTCTTTG GGCTAGCTACAACGA TGAATTAG | 18075 |
| 7305 | AAGAAAAA G CUCUUUUU | 8308 | AAAAAGAG GGCTAGCTACAACGA TTTTTCTT | 18076 |
| 7323 | UUCCUAAA A UAAACUCA | 8309 | TGAGTTTA GGCTAGCTACAACGA TTTAGGAA | 18077 |
| 7327 | UAAAAUAA A CUCAAAUU | 8310 | AATTTGAG GGCTAGCTACAACGA TTATTTTA | 18078 |
| 7333 | AAACUCAA A UUUAUCCU | 8311 | AGGATAAA GGCTAGCTACAACGA TTGAGTTT | 18079 |

TABLE XVIII-continued

Human FLT DNAzyme and Substrate Sequence

| Pos | Substrate | Seq ID No | DNAzyme | Seq ID No |
|---|---|---|---|---|
| 7337 | UCAAAUUU A UCCUUGUU | 1312 | AACAAGGA GGCTAGCTACAACGA AAATTTGA | 18080 |
| 7343 | UUAUCCUU G UUUAGAGC | 8312 | GCTCTAAA GGCTAGCTACAACGA AAGGATAA | 18081 |
| 7350 | UGUUUAGA G CAGAGAAA | 8313 | TTTCTCTG GGCTAGCTACAACGA TCTAAACA | 18082 |
| 7360 | AGAGAAAA A UUAAGAAA | 8314 | TTTCTTAA GGCTAGCTACAACGA TTTTCTCT | 18083 |
| 7370 | UAAGAAAA A CUUUGAAA | 8315 | TTTCAAAG GGCTAGCTACAACGA TTTTCTTA | 18084 |
| 7378 | ACUUUGAA A UGGUCUCA | 8316 | TGAGACCA GGCTAGCTACAACGA TTCAAAGT | 18085 |
| 7381 | UUGAAAUG G UCUCAAAA | 8317 | TTTTGAGA GGCTAGCTACAACGA CATTTCAA | 18086 |
| 7391 | CUCAAAAA A UUGCUAAA | 8318 | TTTAGCAA GGCTAGCTACAACGA TTTTTGAG | 18087 |
| 7394 | AAAAAAUU G CUAAAUAU | 8319 | ATATTTAG GGCTAGCTACAACGA AATTTTTT | 18088 |
| 7399 | AUUGCUAA A UAUUUCA | 8320 | TGAAAATA GGCTAGCTACAACGA TTAGCAAT | 18089 |
| 7401 | UGCUAAAU A UUUUCAAU | 1326 | ATTGAAAA GGCTAGCTACAACGA ATTTAGCA | 18090 |
| 7408 | UAUUUUCA A UGGAAAAC | 8321 | GTTTTCCA GGCTAGCTACAACGA TGAAAATA | 18091 |
| 7415 | AAUGGAAA A CUAAAUGU | 8322 | ACATTTAG GGCTAGCTACAACGA TTTCCATT | 18092 |
| 7420 | AAAACUAA A UGUUAGUU | 8323 | AACTAACA GGCTAGCTACAACGA TTAGTTTT | 18093 |
| 7422 | AACUAAAU G UUAGUUUA | 8324 | TAAACTAA GGCTAGCTACAACGA ATTTAGTT | 18094 |
| 7426 | AAAUGUUA G UUUAGCUG | 8325 | CAGCTAAA GGCTAGCTACAACGA TAACATTT | 18095 |
| 7431 | UUAGUUUA G CUGAUUGU | 8326 | ACAATCAG GGCTAGCTACAACGA TAAACTAA | 18096 |
| 7435 | UUUAGCUG A UUGUAUGG | 8327 | CCATACAA GGCTAGCTACAACGA CAGCTAAA | 18097 |
| 7438 | AGCUGAUU G UAUGGGGU | 8328 | ACCCCATA GGCTAGCTACAACGA AATCAGCT | 18098 |
| 7440 | CUGAUUGU A UGGGGUUU | 1338 | AAACCCCA GGCTAGCTACAACGA ACAATCAG | 18099 |
| 7445 | UGUAUGGG G UUUCGAA | 8329 | TTCGAAAA GGCTAGCTACAACGA CCCATACA | 18100 |
| 7453 | GUUUCGA A CCUUUCAC | 8330 | GTGAAAGG GGCTAGCTACAACGA TCGAAAAC | 18101 |
| 7460 | AACCUUUC A CUUUUUGU | 5598 | ACAAAAAG GGCTAGCTACAACGA GAAAGGTT | 18102 |
| 7467 | CACUUUUU G UUUUGUUU | 8331 | AAAACAAA GGCTAGCTACAACGA AAAAAGTG | 18103 |
| 7471 | UUUUGUUU G UUUUACCU | 8332 | AGGTAAAA GGCTAGCTACAACGA AAACAAAA | 18104 |
| 7476 | UUUGUUUU A CCUAUUUC | 1355 | GAAATAGG GGCTAGCTACAACGA AAAACAAA | 18105 |
| 7480 | UUUUACCU A UUUCACAA | 1356 | TTGTGAAA GGCTAGCTACAACGA AGGTAAAA | 18106 |
| 7485 | CCUAUUUC A CAACUGUG | 5602 | CACAGTTG GGCTAGCTACAACGA GAAATAGG | 18107 |
| 7488 | AUUUCACA A CUGUGUAA | 8333 | TTACACAG GGCTAGCTACAACGA TGTGAAAT | 18108 |
| 7491 | UCACAACU G UGUAAAUU | 8334 | AATTTACA GGCTAGCTACAACGA AGTTGTGA | 18109 |
| 7493 | ACAACUGU G UAAAUUGC | 8335 | GCAATTTA GGCTAGCTACAACGA ACAGTTGT | 18110 |
| 7497 | CUGUGUAA A UUGCCAAU | 8336 | ATTGGCAA GGCTAGCTACAACGA TTACACAG | 18111 |
| 7500 | UGUAAAUU G CCAAUAAU | 8337 | ATTATTGG GGCTAGCTACAACGA AATTTACA | 18112 |
| 7504 | AAUUGCCA A UAAUUCCU | 8338 | AGGAATTA GGCTAGCTACAACGA TGGCAATT | 18113 |
| 7507 | UGCCAAUA A UUCCUGUC | 8339 | GACAGGAA GGCTAGCTACAACGA TATTGGCA | 18114 |
| 7513 | UAAUUCCU G UCCAUGAA | 8340 | TTCATGGA GGCTAGCTACAACGA AGGAATTA | 18115 |
| 7517 | UCCUGUCC A UGAAAUG | 5610 | CATTTTCA GGCTAGCTACAACGA GGACAGGA | 18116 |

TABLE XVIII-continued

Human FLT DNAzyme and Substrate Sequence

| Pos | Substrate | Seq ID No | DNAzyme | Seq ID No |
|---|---|---|---|---|
| 7523 | CCAUGAAA A UGCAAAUU | 8341 | AATTTGCA GGCTAGCTACAACGA TTTCATGG | 18117 |
| 7525 | AUGAAAAU G CAAAUUAU | 8342 | ATAATTTG GGCTAGCTACAACGA ATTTTCAT | 18118 |
| 7529 | AAAUGCAA A UUAUCCAG | 8343 | CTGGATAA GGCTAGCTACAACGA TTGCATTT | 18119 |
| 7532 | UGCAAAUU A UCCAGUGU | 1367 | ACACTGGA GGCTAGCTACAACGA AATTTGCA | 18120 |
| 7537 | AUUAUCCA G GUAGAUA | 8344 | TATCTACA GGCTAGCTACAACGA TGGATAAT | 18121 |
| 7539 | UAUCCAGU G UAGAUAUA | 8345 | TATATCTA GGCTAGCTACAACGA ACTGGATA | 18122 |
| 7543 | CAGUGUAG A UAUAUUUG | 8346 | CAAATATA GGCTAGCTACAACGA CTACACTG | 18123 |
| 7545 | GUGUAGAU A UAUUUGAC | 1370 | GTCAAATA GGCTAGCTACAACGA ATCTACAC | 18124 |
| 7547 | GUAGAUAU A UUUGACCA | 137 | UGGTCAAA GGCTAGCTACAACGA ATATCTAC | 18125 |
| 7552 | UAUAUUUG A CCAUCACC | 8347 | GGTGATGG GGCTAGCTACAACGA CAAATATA | 18126 |
| 7555 | AUUUGACC A UCACCCUA | 5615 | TAGGGTGA GGCTAGCTACAACGA GGTCAAAT | 18127 |
| 7558 | UGACCAUC A CCCUAUGG | 5616 | CCATAGGG GGCTAGCTACAACGA GATGGTCA | 18128 |
| 7563 | AUCACCCU A UGGAUAUU | 1375 | AATATCCA GGCTAGCTACAACGA AGGGTGAT | 18129 |
| 7567 | CCCUAUGG A UAUUGGCU | 8348 | AGCCAATA GGCTAGCTACAACGA CCATAGGG | 18130 |
| 7569 | CUAUGGAU A UUGGCUAG | 1376 | CTAGCCAA GGCTAGCTACAACGA ATCCATAG | 18131 |
| 7573 | GGAUAUUG G CUAGUUUU | 8349 | AAAACTAG GGCTAGCTACAACGA CAATATCC | 18132 |
| 7577 | AUUGGCUA G UUUUGCCU | 8350 | AGGCAAAA GGCTAGCTACAACGA TAGCCAAT | 18133 |
| 7582 | CUAGUUUU G CCUUUAUU | 8351 | AATAAAGG GGCTAGCTACAACGA AAAACTAG | 18134 |
| 7588 | UUGCCUUU A UUAAGCAA | 1384 | TTGCTTAA GGCTAGCTACAACGA AAAGGCAA | 18135 |
| 7593 | UUUAUUAA G CAAAUUCA | 8352 | TGAATTTG GGCTAGCTACAACGA TTAATAAA | 18136 |
| 7597 | UUAAGCAA A UUCAUUUC | 8353 | GAAATGAA GGCTAGCTACAACGA TTGCTTAA | 18137 |
| 7601 | GCAAAUUC A UUUCAGCC | 5624 | GGCTGAUA GGCTAGCTACAACGA GAATTTGC | 18138 |
| 7607 | UCAUUUCA G CCUGAAUG | 8354 | CATTCAGG GGCTAGCTACAACGA TGAAATGA | 18139 |
| 7613 | CAGGCUGA A UGUCUGCC | 8355 | GGCAGACA GGCTAGCTACAACGA TCAGGCTG | 18140 |
| 7615 | GCCUGAAU G UCUGCCUA | 8356 | TAGGGAGA GGCTAGCTACAACGA ATTCAGGC | 18141 |
| 7619 | GAAUGUCU G CCUAUAUA | 8357 | TATATAGG GGCTAGCTACAACGA AGACATTC | 18142 |
| 7623 | GUCUGCCU A UAUAUUCU | 1393 | AGAATATA GGCTAGCTACAACGA AGGCAGAC | 18143 |
| 7625 | CUGCCUAU A UAUUCUCU | 1394 | AGAGAATA GGCTAGCTACAACGA ATAGGCAG | 18144 |
| 7627 | GCCUAUAU A UUCUCUGC | 1395 | GCAGAGAA GGCTAGCTACAACGA ATATAGGC | 18145 |
| 7634 | UAUUCUCU G CUCUUUGU | 8358 | ACAAAGAG GGCTAGCTACAACGA AGAGAATA | 18146 |
| 7641 | UGCUCUUU G UAUUCUCC | 8359 | GGAGAATA GGCTAGCTACAACGA AAAGAGCA | 18147 |
| 7643 | CUCUUUGU A UUCUCCUU | 1402 | AAGGAGAA GGCTAGCTACAACGA ACAAAGAG | 18148 |
| 7655 | UCCUUUGA A CCCGUUAA | 8360 | TTAACGGG GGCTAGCTACAACGA TCAAAGGA | 18149 |
| 7659 | UUGAACCC G UUAAAACA | 836 | UGTTTTAA GGCTAGCTACAACGA GGGTTCAA | 18150 |
| 7665 | CCGUUAAA A CAUCCUGU | 8362 | ACAGGATG GGCTAGCTACAACGA TTTAACGG | 18151 |

TABLE XVIII-continued

Human FLT DNAzyme and Substrate Sequence

| Pos | Substrate | Seq ID No | DNAzyme | Seq ID No |
|---|---|---|---|---|
| 7667 | GUUAAAAC A UCCUGUGG | 5640 | CCACAGGA GGCTAGCTACAACGA GTTTTAAC | 18152 |
| 7672 | AACAUCCU G UGGCACUC | 8363 | GAGTGCCA GGCTAGCTACAACGA AGGATGTT | 18153 |

Input Sequence = HSFLT.
Cut Gite = R/Y
Arm Length = 8.
Core Sequence = GGCTAGCTACAACGA (SEQ ID NO. 20828)
HSFLT (Human flt mRNA for receptor-related tyrosine kinase.; Acc# X51602; 7680 bp)

TABLE XIX

Human FLT Zinzyme and Substrate Sequence

| Pos | Substrate | Seq ID No | Zinzyme | Seq ID No |
|---|---|---|---|---|
| 17 | UCCUCUCG G CUCCUCCC | 7143 | GGGAGGAG GCCGAAAGGCGAGUGAGGUCU CGAGAGGA | 18154 |
| 28 | CCUCCCCG G CAGCGGCG | 7144 | CGCCGCUG GCCGAAAGGCGAGUGAGGUCU CGGGGAGG | 18155 |
| 31 | CCCCGGCA G CGGCGGCG | 7145 | CGCCGCCG GCCGAAAGGCGAGUGAGGUCU UGCCGGGG | 18156 |
| 34 | CGGCAGCG G CGGCGGCU | 7146 | AGCCGCCG GCCGAAAGGCGAGUGAGGUCU CGCUGCCG | 18157 |
| 37 | CAGCGGCG G CGGCUCGG | 7147 | CCGAGCCG GCCGAAAGGCGAGUGAGGUCU CGCCGCUG | 18158 |
| 40 | CGGCGGCG G CUCGGAGC | 7148 | GCUCCGAG GCCGAAAGGCGAGUGAGGUCU CGCCGCCG | 18159 |
| 47 | GGCUCGGA G CGGGCUCC | 7149 | GGAGCCCG GCCGAAAGGCGAGUGAGGUCU UCCGAGCC | 18160 |
| 51 | CGGAGCGG G CUCCGGGG | 7150 | CCCCGGAG GCCGAAAGGCGAGUGAGGUCU CCGCUCCG | 18161 |
| 59 | GCUCCGGG G CUCGGGUG | 7151 | CACCCGAG GCCGAAAGGCGAGUGAGGUCU CCCGGAGC | 18162 |
| 65 | GGGCUCGG G UGCAGCGG | 7152 | CCGCUGCA GCCGAAAGGCGAGUGAGGUCU CCGAGCCC | 18163 |
| 67 | GCUCGGGU G CAGCGCC | 7153 | GGCCGCUG GCCGAAAGGCGAGUGAGGUCU ACCCGAGC | 18164 |
| 70 | CGGGUGCA G CGGCCAGC | 7154 | GCUGGCCG GCCGAAAGGCGAGUGAGGUCU UGCACCCG | 18165 |
| 73 | GUGCAGCG G CCAGCGGG | 7155 | CCCGCUGG GCCGAAAGGCGAGUGAGGUCU CGCUGCAC | 18166 |
| 77 | AGCGGCCA G CGGGCCUG | 7156 | CAGGCCCG GCCGAAAGGCGAGUGAGGUCU UGGCCGCU | 18167 |
| 81 | GCCAGCGG G CCUGGCGG | 7157 | CCGCCAGG GCCGAAAGGCGAGUGAGGUCU CCGCUGGC | 18168 |
| 86 | CGGGCCUG G CGGCGAGG | 7158 | CCUCGCCG GCCGAAAGGCGAGUGAGGUCU CAGGCCCG | 18169 |
| 89 | GCCUGGCG G CGAGGAUU | 7159 | AAUCCUCG GCCGAAAGGCGAGUGAGGUCU CGCCAGGC | 18170 |
| 108 | CCGGGGAA G UGGUUGUC | 7161 | CACAACCA GCCGAAAGGCGAGUGAGGUCU UUCCCCGG | 18171 |
| 111 | GGGAAGUG G UUGUCUCC | 7162 | GGAGACAA GCCGAAAGGCGAGUGAGGUCU CACUUCCC | 18172 |
| 114 | AAGUGGUU G UCUCCUGG | 7163 | CCAGGAGA GCCGAAAGGCGAGUGAGGUCU AACCACUU | 18173 |
| 122 | GUCUCCUG G CUGGAGCC | 7164 | GGCUCCAG GCCGAAAGGCGAGUGAGGUCU CAGGAGAC | 18174 |
| 128 | UGGCUGGA G CCGCGAGA | 7165 | UCUCGCGG GCCGAAAGGCGAGUGAGGUCU UCCAGCCA | 18175 |
| 131 | CUGGAGCC G CGAGACGG | 7166 | CCGUCUCG GCCGAAAGGCGAGUGAGGUCU GGCUCCAG | 18176 |
| 140 | CGAGACGG G CGCUCAGG | 7168 | CCUGAGCG GCCGAAAGGCGAGUGAGGUCU CCGUCUCG | 18177 |
| 142 | AGACGGGC G CUCAGGGC | 7169 | GCCCUGAG GCCGAAAGGCGAGUGAGGUCU GCCCGUCU | 18178 |
| 149 | CGCUCAGG G CGCGGGGC | 7170 | GCCCCGCG GCCGAAAGGCGAGUGAGGUCU CCUGAGCG | 18179 |
| 151 | CUCAGGGC G CGGGGCCG | 7171 | CGGCCCCG GCCGAAAGGCGAGUGAGGUCU GCCCUGAG | 18180 |

TABLE XIX-continued

Human FLT Zinzyme and Substrate Sequence

| Pos | Substrate | Seq ID No | Zinzyme | Seq ID No |
|---|---|---|---|---|
| 156 | GGCGCGGG G CCGGCGGC | 7172 | GCCGCCGG GCCGAAAGGCGAGUGAGGUCU CCCGCGCC | 18181 |
| 160 | CGGGGCCG G CGGCGGCG | 7173 | CGCCGCCG GCCGAAAGGCGAGUGAGGUCU CGGCCCCG | 18182 |
| 163 | GGCCGGCG G CGGCGAAC | 7174 | GUUCGCCG GCCGAAAGGCGAGUGAGGUCU CGCCGGCC | 18183 |
| 166 | CGGCGGCG G CGAACGAG | 7175 | CUCGUUCG GCCGAAAGGCGAGUGAGGUCU CGCCGGCC | 18184 |
| 188 | GCAGUCUG G CGGCCGGG | 7179 | CCCGGCCG GCCGAAAGGCGAGUGAGGUCU CAGAGUCC | 18185 |
| 191 | CUCUGGCG G CCGGGUCG | 7180 | CGACCCGG GCCGAAAGGCGAGUGAGGUCU CGCCAGAG | 18186 |
| 196 | GCGGCCGG G UCGUUGGC | 7181 | GCCAACGA GCCGAAAGGCGAGUGAGGUCU CCGGCCGC | 18187 |
| 199 | GCCGGGUC G UUGGCCGG | 7182 | CCGGCCAA GCCGAAAGGCGAGUGAGGUCU GACCCGGC | 18188 |
| 203 | GGUCGUUG G CCGGGGGA | 7183 | UCCCCCGG GCCGAAAGGCGAGUGAGGUCU CAACGACC | 18189 |
| 212 | CCGGGGGA G CGCGGGCA | 7184 | UGCCCGCG GCCGAAAGGCGAGUGAGGUCU UCCCCCGG | 18190 |
| 214 | GGGGGAGC G CGGGCACC | 7185 | GGUGCCCG GCCGAAAGGCGAGUGAGGUCU GCUCCCCC | 18191 |
| 218 | GAGCGCGG G CACCGGGC | 7186 | GCCCGGUG GCCGAAAGGCGAGUGAGGUCU CCGCGCUC | 18192 |
| 225 | GGCACCGG G CGAGCAGG | 7187 | CCUGCUCG GCCGAAAGGCGAGUGAGGUCU CCGGUGCC | 18193 |
| 229 | CCGGGCGA G CAGGCCGC | 7188 | GCGGCCUG GCCGAAAGGCGAGUGAGGUCU UCGCCCGG | 18194 |
| 233 | GCGAGCAG G CCGCGUCG | 7189 | CGACGCGG GCCGAAAGGCGAGUGAGGUCU CUGCUCGC | 18195 |
| 236 | AGCAGGCC G CGUCGCGC | 7190 | GCGCGACG GCCGAAAGGCGAGUGAGGUCU GGCCUGCU | 18196 |
| 238 | CAGGCCGC G UCGCGCUC | 7191 | GAGCGCGA GCCGAAAGGCGAGUGAGGUCU GCGGCCUG | 18197 |
| 241 | GCCGCGUC G CGCUCACC | 7192 | GGUGAGCG GCCGAAAGGCGAGUGAGGUCU GACGCGGC | 18198 |
| 243 | CGCGUCGC G CUCACCAU | 7193 | AUGGUGAG GCCGAAAGGCGAGUGAGGUCU GCGACGCG | 18199 |
| 253 | UCACCAUG G UCAGCUAC | 7194 | GUAGCUGA GCCGAAAGGCGAGUGAGGUCU CAUGGUGA | 18200 |
| 257 | CAUGGUCA G CUACUGGG | 7195 | CCCAGUAG GCCGAAAGGCGAGUGAGGUCU UGACCAUG | 18201 |
| 274 | ACACCGGG G UCCUGCUG | 7197 | CAGCAGGA GCCGAAAGGCGAGUGAGGUCU CCCGGUGU | 18202 |
| 279 | GGGGUCCU G CUGUGCGC | 7198 | GCGCACAG GCCGAAAGGCGAGUGAGGUCU AGGACCCC | 18203 |
| 282 | GUCCUGCU G UGCGCGCU | 7199 | AGCGCGCA GCCGAAAGGCGAGUGAGGUCU AGCAGGAC | 18204 |
| 284 | CCUGCUGU G CGCGCUGC | 7200 | GCAGCGCG GCCGAAAGGCGAGUGAGGUCU ACAGCAGG | 18205 |
| 286 | UGCUGUGC G CGCUGCUC | 7201 | GAGCAGCG GCCGAAAGGCGAGUGAGGUCU GCACAGCA | 18206 |
| 288 | CUGUGCGC G CUGCUCAG | 7202 | CUGAGCAG GCCGAAAGGCGAGUGAGGUCU GCGCACAG | 18207 |
| 291 | UGCGCGCU G CUCAGCUG | 7203 | CAGCUGAG GCCGAAAGGCGAGUGAGGUCU AGCGCGCA | 18208 |
| 296 | GCUGCUCA G CUGUCUGC | 7204 | GCAGACAG GCCGAAAGGCGAGUGAGGUCU UGAGCAGC | 18209 |
| 299 | GCUCAGCU G UCUGCUUC | 7205 | GAAGCAGA GCCGAAAGGCGAGUGAGGUCU AGCUGAGC | 18210 |
| 303 | AGCUGUCU G CUUCUCAC | 7206 | GUGAGAAG GCCGAAAGGCGAGUGAGGUCU AGACAGCU | 18211 |
| 320 | AGGAUCUA G UUCAGGUU | 7208 | AACCUGAA GCCGAAAGGCGAGUGAGGUCU UAGAUCCU | 18212 |
| 326 | UAGUUCAG G UUCAAAAU | 7209 | AUUUUGAA GCCGAAAGGCGACUGAGGUCU CUGAACUA | 18213 |
| 353 | UGAACUGA G UUUAAAAG | 7213 | CUUUUAAA GCCGAAAGGCGAGUGAGGUCU UCAGUUCA | 18214 |
| 362 | UUUAAAAG G CACCCAGC | 7214 | GCUGGGUG GCCGAAAGGCGAGUGAGGUCU CUUUUAAA | 18215 |
| 369 | GGCACCCA G CACAUCAU | 7215 | AUGAUGUG GCCGAAAGGCGAGUGAGGUCU UGGGUGCC | 18216 |
| 378 | CACAUCAU G CAAGCAGG | 7216 | CCUGCUUG GCCGAAAGGCGAGUGAGGUCU AUGAUGUG | 18217 |

TABLE XIX-continued

Human FLT Zinzyme and Substrate Sequence

| Pos | Substrate | Seq ID No | Zinzyme | Seq ID No |
|---|---|---|---|---|
| 382 | UCAUGCAA G CAGGCCAG | 7217 | CUGGCCUG GCCGAAAGGCGAGUGAGGUCU UUGCAUGA | 18218 |
| 386 | GCAAGCAG G CCAGACAC | 7218 | GUGUCUGG GCCGAAAGGCGAGUGAGGUCU CUGCUUGC | 18219 |
| 396 | CAGACACU G CAUCUCCA | 7220 | UGGAGAUG GCCGAAAGGCGACUGAGGUCU AGUGUCUG | 18220 |
| 407 | UCUCCAAU G CAGGGGGG | 7222 | CCCCCCUG GCCGAAAGGCGAGUGAGGUCU AUUGGAGA | 18221 |
| 418 | GGGGGGAA G CAGCCCAU | 7223 | AUGGGCUG GCCGAAAGGCGAGUGAGGUCU UUCCCCCC | 18222 |
| 421 | GGGAAGCA G CCCAUAAA | 7224 | UUUAUGGG GCCGAAAGGCGAGUGAGGUCU UGCUUCCC | 18223 |
| 432 | CAUAAAUG G UCUUUGCC | 7226 | GGCAAAGA GCCGAAAGGCGAGUGAGGUCU CAUUUAUG | 18224 |
| 438 | UGGUCUUU G CCUGAAAU | 7227 | AUUUCAGG GCCGAAAGGCGAGUGAGGUCU AAAGACCA | 18225 |
| 448 | CUGAAAUG G UGAGUAAG | 7229 | CUUACUCA GCCGAAAGGCGAGUGAGGUCU CAUUUCAG | 18226 |
| 452 | AAUGGUGA G UAAGGAAA | 7230 | UUUCCUUA GCCGAAAGGCGAGUGAGGUCU UCACCAUU | 18227 |
| 461 | UAAGGAAA G CGAAAGGC | 7231 | GCCUUUCG GCCGAAAGGCGACUGAGGUCU UUUCCUUA | 18228 |
| 468 | AGCGAAAG G CUGAGCAU | 7232 | AUGCUCAG GCCGAAAGGCGAGUGAGGUCU CUUUCGCU | 18229 |
| 473 | AAGGCUGA G CAUAACUA | 7233 | UAGUUAUG GCCGAAAGGCGAGUGAGGUCU UCAGCCUU | 18230 |
| 487 | CUAAAUCU G CCUGUGGA | 7236 | UCCACAGG GCCGAAAGGCGAGUGAGGUCU AGAUUUAG | 18231 |
| 491 | AUCUGCCU G UGGAAGAA | 7237 | UUCUUCCA GCCGAAAGGCGAGUGAGGUCU AGGCAGAU | 18232 |
| 503 | AAGAAAUG G CAAACAAU | 7239 | AUUGUUUG GCCGAAAGGCGAGUGAGGUCU CAUUUCUU | 18233 |
| 515 | ACAAUUCU G CAGUACUU | 7242 | AAGUACUG GCCGAAAGGCGAGUGAGGUCU AGAAUUGU | 18234 |
| 518 | AUUCUGCA G UACUUUAA | 7243 | UUAAAGUA GCCGAAAGGCGAGUGAGGUCU UGCAGAAU | 18235 |
| 538 | UGAACACA G CUCAAGCA | 7246 | UGCUUGAG GCCGAAAGGCGAGUGAGGUCU UGUGUUCA | 18236 |
| 544 | CAGCUCAA G CAAACCAC | 7247 | GUGGUUUG GCCGAAAGGCGAGUGAGGUCU UUGAGCUG | 18237 |
| 557 | CCACACUG G CUUCUACA | 7249 | UGUAGAAG GCCGAAAGGCGAGUGAGGUCU CAGUGUGG | 18238 |
| 566 | CUUCUACA G CUGCAAAU | 7250 | AUUUGCAG GCCGAAAGGCGAGUGAGGUCU UGUAGAAG | 18239 |
| 569 | CUACAGCU G CAAAUAUC | 7251 | GAUAUUUG GCCGAAAGGCGAGUGAGGUCU AGCUGUAG | 18240 |
| 580 | AAUAUCUA G CUGUACCU | 7253 | AGGUACAG GCCGAAAGGCGAGUGAGGUCU UAGAUAUU | 18241 |
| 583 | AUCUAGCU G UACCUACU | 7254 | AGUAGGUA GCCGAAAGGCGAGUGAGGUCU AGCUAGAU | 18242 |
| 616 | CAGAAUCU G CAAUCUAU | 7257 | AUAGAUUG GCCGAAAGGCGAGUGAGGUCU AGAUUCUG | 18243 |
| 635 | AUUUAUUA G UGAUACAG | 7259 | CUGUAUCA GCCGAAAGGCGAGUGAGGUCU UAAUAAAU | 18244 |
| 644 | UGAUACAG G UAGACCUU | 7261 | AAGGUCUA GCCGAAAGGCGAGUGAGGUCU CUGUAUCA | 18245 |
| 855 | GACCUUUC G UAGAGAUG | 7263 | CAUCUCUA GCCGAAAGGCGAGUGAGGUCU GAAAGGUC | 18246 |
| 663 | GUAGAGAU G UACAGUGA | 7265 | UCACUGUA GCCGAAAGGCGAGUGAGGUCU AUCUCUAC | 18247 |
| 668 | GAUGUACA G UGAAAUCC | 7266 | GGAUUUCA GCCGAAAGGCGAGUGAGGUCU UGUACAUC | 18248 |
| 708 | GGAAGGGA G CUCGUCAU | 7270 | AUGACGAG GCCGAAAGGCGAGUGAGGUCU UCCCUUCC | 18249 |
| 712 | GGGAGCUC G UCAUUCCC | 7271 | GGGAAUGA GCCGAAAGGCGAGUGAGGUCU GAGCUCCC | 18250 |
| 722 | CAUUCCCU G CCGGGUUA | 7272 | UAACCCGG GCCGAAAGGCGAGUGAGGUCU AGGGAAUG | 18251 |
| 727 | CCUGCCGG G UUACGUCA | 7273 | UGACGUAA GCCGAAAGGCGAGUGAGGUCU CCGGCAGG | 18252 |
| 732 | CGGGUUAC G UCACCUAA | 7274 | UUAGGUGA GCCGAAAGGCGAGUGAGGUCU GUAACCCG | 18253 |
| 748 | ACAUCACU G UUACUUUA | 7276 | UAAAGUAA GCCGAAAGGCGAGUGAGGUCU AGUGAUGU | 18254 |

TABLE XIX-continued

Human FLT Zinzyme and Substrate Sequence

| Pos | Substrate | Seq ID No | Zinzyme | Seq ID No |
|---|---|---|---|---|
| 762 | UUAAAAAA G UUUCCACU | 7277 | AGUGGAAA GCCGAAAGGCGAGUGAGGUCU UUUUUUAA | 18255 |
| 797 | UGGAAAAC G CAUAAUCU | 7282 | AGAUUAUG GCCGAAAGGCGAGUGAGGUCU GUUUUCCA | 18256 |
| 812 | CUGGGACA G UAGAAAGG | 7285 | CCUUUCUA GCCGAAAGGCGAGUGAGGUCU UGUCCCAG | 18257 |
| 821 | UAGAAAGG G CUUCAUCA | 7286 | UGAUGAAG GCCGAAAGGCGAGUGAGGUCU CCUUUCUA | 18258 |
| 838 | UAUCAAAU G CAACGUAC | 7288 | GUACGUUG GCCGAAAGGCGAGUGAGGUCU AUUUGAUA | 18259 |
| 843 | AAUGCAAC G UACAAAGA | 7290 | UCUUUGUA GCCGAAAGGCGAGUGAGGUCU GUUGCAUU | 18260 |
| 858 | GAAAUAGG G CUUCUGAC | 7292 | GUCAGAAG GCCGAAAGCCGAGUGAGGUCU CCUAUUUC | 18261 |
| 869 | UCUGACCU G UGAAGCAA | 7294 | UUGCUUCA GCCGAAAGGCGACUGAGGUCU AGGUCAGA | 18262 |
| 874 | CCUGUGAA G CAACAGUC | 7295 | GACUGUUG GCCGAAAGGCGAGUGAGGUCU UUCACAGG | 18263 |
| 880 | AAGCAACA G UCAAUGGG | 7297 | CCCAUUGA GCCGAAAGGCGAGUGAGGUCU UGUUGCUU | 18264 |
| 888 | GUCAAUGG G CAUUUGUA | 7299 | UACAAAUG GCCGAAAGGCGAGUGAGGUCU CCAUUGAC | 18265 |
| 894 | GGGCAUUU G UAUAAGAC | 7300 | GUCUUAUA GCCGAAAGGCGAGUGAGGUCU AAAUGCCC | 18266 |
| 943 | UCAUAGAU G UCCAAAUA | 7308 | UAUUUGGA GCCGAAAGGCGAGUGAGGUCU AUCUAUGA | 18267 |
| 953 | CCAAAUAA G CACACCAC | 7310 | GUGGUGUG GCCGAAAGGCGAGUGAGGUCU UUAUUUGG | 18268 |
| 962 | CACACCAC G CCCAGUCA | 7311 | UGACUGGG GCCGAAAGGCGAGUGAGGUCU GUGGUGUG | 18269 |
| 967 | CACGCCCA G UCAAAUUA | 7312 | UAAUUUGA GCCGAAAGCCGACUCAGCUCU UGGGCGUG | 18270 |
| 983 | ACUUAGAG G CCAUACUC | 7314 | GAGUAUGG GCCGAAAGGCGAGUGAGGUCU CUCUAAGU | 18271 |
| 994 | AUACUCUU G UCCUCAAU | 7315 | AUUGAGGA GCCGAAAGGCGAGUGAGGUCU AAGAGUAU | 18272 |
| 1004 | CCUCAAUU G UACUGCUA | 7317 | UAGCAGUA GCCGAAAGGCGAGUGAGGUCU AAUUGAGG | 18273 |
| 1009 | AUUGUACU G CUACCACU | 7318 | AGUGGUAG GCCGAAAGGCGAGUGAGGUCU AGUACAAU | 18274 |
| 1033 | ACACGAGA G UUCAAAUG | 7320 | CAUUUGAA GCCGAAAGGCGAGUGAGGUCU UCUCGUGU | 18275 |
| 1049 | GACCUGGA G UUACCCUG | 7323 | CAGGGUAA GCCGAAAGGCGAGUGAGGUCU UCCAGGUC | 18276 |
| 1075 | AUAAGAGA G CUUCCGUA | 7326 | UACGGAAG GCCGAAAGGCGAGUGAGGUCU UCUCUUAU | 18277 |
| 1081 | GAGCUUCC G UAAGGCGA | 7327 | UCGCCUUA GCCGAAAGGCGAGUGAGGUCU GGAAGCUC | 18278 |
| 1086 | UCCGUAAG G CGACGAAU | 7328 | AUUCGUCG GCCGAAAGGCGAGUGAGGUCU CUUACGGA | 18279 |
| 1103 | UGACCAAA G CAAUUCCC | 7332 | GGGAAUUG GCCGAAAGGCGAGUGAGGUCU UUUGGUCA | 18280 |
| 1114 | AUUCCCAU G CCAACAUA | 7334 | UAUGUUGG GCCGAAAGGCGAGUGAGGUCU AUGGGAAU | 18281 |
| 1130 | AUUCUACA G UGUUCUUA | 7336 | UAAGAACA GCCGAAAGGCGAGUGAGGUCU UGUAGAAU | 18282 |
| 1132 | UCUACAGU G UUCUUACU | 7337 | AGUAAGAA GCCGAAAGGCGAGUGAGGUCU ACUGUAGA | 18283 |
| 1152 | GACAAAAU G CAGAACAA | 7340 | UUGUUCUG GCCGAAAGGCGAGUGAGGUCU AUUUUGUC | 18284 |
| 1181 | UUAUACUU G UCGUGUAA | 7344 | UUACACGA GCCGAAAGGCGAGUGAGGUCU AAGUAUAA | 18285 |
| 1184 | UACUUGUC G UGUAAGGA | 7345 | UCCUUACA GCCGAAAGGCGAGUGAGGUCU GACAAGUA | 18286 |
| 1186 | CUUGUCGU G UAAGGAGU | 7346 | ACUCCUUA GCCGAAAGGCGAGUGAGGUCU ACGACAAG | 18287 |
| 1193 | UGUAAGGA G UGGACCAU | 7347 | AUGGUCCA GCCGAAAGGCGAGUGAGGUCU UCCUUACA | 18288 |
| 1213 | UCAAAUCU G UUAACACC | 7350 | GGUGUUAA GCCGAAAGGCGAGUGAGGUCU AGAUUUGA | 18289 |
| 1225 | ACACCUCA G UGCAUAUA | 7352 | UAUAUGCA GCCGAAAGGCGAGUGAGGUCU UGAGGUGU | 18290 |
| 1227 | ACCUCAGU G CAUAUAUA | 7353 | UAUAUAUG GCCGAAAGGCGAGUGAGGUCU ACUGAGGU | 18291 |

TABLE XIX-continued

Human FLT Zinzyme and Substrate Sequence

| Pos | Substrate | Seq ID No | Zinzyme | Seq ID No |
|---|---|---|---|---|
| 1243 | AUGAUAAA G CAUUCAUC | 7355 | GAUGAAUG GCCGAAAGGCGAGUGAGGUCU UUUAUCAU | 18292 |
| 1255 | UCAUCACU G UGAAACAU | 7356 | AUGUUUCA GCCGAAAGGCGACUGAGGUCU AGUGAUGA | 18293 |
| 1272 | CGAAAACA G CAGGUGCU | 7359 | AGCACCUG GCCGAAAGGCGAGUGAGGUCU UGUUUUCG | 18294 |
| 1276 | AACAGCAG G UGCUUGAA | 7360 | UUCAAGCA GCCGAAAGGCGAGUGAGGUCU CUGCUGUU | 18295 |
| 1278 | CAGCAGGU G CUUGAAAC | 7361 | GUUUCAAG GCCGAAAGGCGAGUGAGGUCU ACCUGCUG | 18296 |
| 1288 | UUGAAACC G UAGCUGGC | 7363 | GCCAGCUA GCCGAAAGGCGAGUGAGGUCU GGUUUCAA | 18297 |
| 1291 | AAACCGUA G CUGGCAAG | 7364 | CUUGCCAG GCCGAAAGGCGAGUGAGGUCU UACGGUUU | 18298 |
| 1295 | CGUAGCUG G CAAGCGGU | 7365 | ACCGCUUG GCCGAAAGGCGAGUGAGGUCU CAGCUACG | 18299 |
| 1299 | GCUGGCAA G CGGUCUUA | 7366 | UAAGACCG GCCGAAAGGCGAGUGAGGUCU UUGCCAGC | 18300 |
| 1302 | GGCAAGCG G UCUUACCG | 7367 | CGGUAAGA GCCGAAAGGCGAGUGAGGUCU CGCUUGCC | 18301 |
| 1311 | UCUUACCG G CUCUCUAU | 7368 | AUAGAGAG GCCGAAAGGCGAGUGAGGUCU CGGUAAGA | 18302 |
| 1324 | CUAUGAAA G UGAAGGCA | 7369 | UGCCUUCA GCCGAAAGGCGAGUGAGGUCU UUUCAUAG | 18303 |
| 1330 | AAGUGAAG G CAUUUCCC | 7370 | GGGAAAUG GCCGAAAGGCGAGUGAGGUCU CUUCACUU | 18304 |
| 1341 | UUUCCCUC G CCGGAAGU | 7371 | ACUUCCGG GCCGAAAGGCGAGUGAGGUCU GAGGGAAA | 18305 |
| 1348 | CGCCGGAA G UUGUAUGG | 7372 | CCAUACAA GCCGAAAGGCGAGUGAGGUCU UUCCGGCG | 18306 |
| 1351 | CGGAAGUU G UAUGGUUA | 7373 | UAACCAUA GCCGAAAGGCGAGUGAGGUCU AACUUCCG | 18307 |
| 1356 | GUUGUAUG G UUAAAAGA | 7374 | UCUUUUAA GCCGAAAGGCGAGUGAGGUCU CAUACAAC | 18308 |
| 1368 | AAAGAUGG G UUACCUGC | 7376 | GCAGGUAA GCCGAAAGGCGAGUGAGGUCU CCAUCUUU | 18309 |
| 1375 | GGUUACCU G CGACUGAG | 7377 | CUCAGUCG GCCGAAAGGCGAGUGAGGUCU AGGUAACC | 18310 |
| 1390 | AGAAAUCU G CUCGCUAU | 7380 | AUAGCGAG GCCGAAAGGCGAGUGAGGUCU AGAUUUCU | 18311 |
| 1394 | AUCUGCUC G CUAUUUGA | 7381 | UCAAAUAG GCCGAAAGGCGAGUGAGGUCU GAGCAGAU | 18312 |
| 1406 | UUUGACUC G UGGCUACU | 7383 | AGUAGCCA GCCGAAAGGCGAGUGAGGUCU GAGUCAAA | 18313 |
| 1409 | GACUCGUG G CUACUCGU | 7384 | ACGAGUAG GCCGAAAGGCGAGUUAGGUCU CACGAGUC | 18314 |
| 1416 | GGCUACUC G UUAAUUAU | 7385 | AUAAUUAA GCCGAAAGGCGAGUGAGGUCU GAGUAGCC | 18315 |
| 1432 | UCAAGGAC G UAACUGAA | 7388 | UUCAGUUA GCCGAAAGGCGAGUGAUGUCU GUCCUUGA | 18316 |
| 1447 | AAGAGGAU G CAGGGAAU | 7391 | AUUCCCUG GCCGAAAGGCGAGUGAGGUCU AUCCUCUU | 18317 |
| 1467 | ACAAUCUU G CUGAGCAU | 7394 | AUGCUCAG GCCGAAAGGCGAGUGAGGUCU AAGAUUGU | 18318 |
| 1472 | CUUGCUGA G CAUAAAAC | 7395 | GUUUUAUG GCCGAAAGGCGAGUGAGGUCU UCAGCAAG | 18319 |
| 1482 | AUAAAACA G UCAAAUGU | 7397 | ACAUUUGA GCCGAAAGGCGAGUGAGGUCU UGUUUUAU | 18320 |
| 1489 | AGUCAAAU G UGUUUAAA | 7399 | UUUAAACA GCCGAAAGGCGAGUGAGGUCU AUUUGACU | 18321 |
| 1491 | UCAAAUGU G UUUAAAAA | 7400 | UUUUUAAA GCCGAAAGGCGAGUGAGGUCU ACAUUUGA | 18322 |
| 1507 | ACCUCACU G CCACUCUA | 7402 | UAGAGUGG GCCGAAAGGCGAGUGAGGUCU AGUGAGGU | 18323 |
| 1519 | CUCUAAUU G UCAAUGUG | 7404 | CACAUUGA GCCGAAAGGCGAGUGAGGUCU AAUUAGAG | 18324 |
| 1525 | UUGUCAAU G UGAAACCC | 7406 | GGGUUUCA GCCGAAAGGCGAGUGAUGUCU AUUGACAA | 18325 |
| 1549 | ACGAAAAG G CCGUGUCA | 7409 | UGACACGG GCCGAAAGGCGAGUGAGGUCU CUUUUCGU | 18326 |
| 1552 | AAAAGGCC G UGUCAUCG | 7410 | CGAUGACA GCCGAAAGGCGAGUGAGGUCU GGCCUUUU | 18327 |
| 1554 | AAGGCCGU G UCAUCGUU | 7411 | AACGAUGA GCCGAAAGGCGAGUGAGGUCU ACGGCCUU | 18328 |

TABLE XIX-continued

Human FLT Zinzyme and Substrate Sequence

| Pos | Substrate | Seq ID No | Zinzyme | Seq ID No |
|---|---|---|---|---|
| 1560 | GUGUCAUC G UUUCCAGA | 7412 | UCUGGAAA GCCGAAAGGCGAGUGAGGUCU GAUGACAC | 18329 |
| 1573 | CAGACCCG G CUCUCUAC | 7414 | GUAGAGAG GCCGAAAGGCGAGUGAGGUCU CGGGUCUG | 18330 |
| 1589 | CCCACUGG G CAGCAGAC | 7415 | GUCUGCUG GCCGAAAGGCGAGUGAGGUCU CCAGUGGG | 18331 |
| 1592 | ACUGGGCA G CAGACAAA | 7416 | UUUGUCUG GCCGAAAGGCGAGUGAGGUCU UGCCCAGU | 18332 |
| 1610 | CCUGACUU G UACCGCAU | 7420 | AUGCGGUA GCCGAAAGGCGAGUGAGGUCU AAGUCAGG | 18333 |
| 1615 | CUUGUACC G CAUAUGGU | 7421 | ACCAUAUG GCCGAAAGGCGAGUGAGGUCU GGUACAAG | 18334 |
| 1622 | CGCAUAUU G UAUCCCUC | 7422 | GAGGGAUA GCCGAAAGGCGAGUGAGGUCU CAUAUGCG | 18335 |
| 1644 | ACAAUCAA G UGGUUCUG | 7425 | CAGAACCA GCCGAAAGGCGAGUGAGGUCU UUGAUUGU | 18336 |
| 1647 | AUCAAGUG G UUCGGUCA | 7426 | UGCCAGAA GCCGAAAGGCGAGUGAGGUCU CACUUGAU | 18337 |
| 1653 | UGGUUCUG G CACCCCUG | 7427 | CAGGGGUG GCCGAAAGGCGAGUGAGGUCU CAGAACCA | 18338 |
| 1661 | GCACCCCU G UAACCAUA | 7428 | UAUGGUUA GCCGAAAGGCGAGUGAGGUCU AGGGGUGC | 18339 |
| 1681 | AUUCCGAA G CAAGGUGU | 7431 | ACACCUUG GCCGAAAGGCGAGUGAGGUCU UUCGGAAU | 18340 |
| 1686 | GAAGCAAG G UGUGACUU | 7432 | AAGUCACA GCCGAAAGGCGAGUGAGGUCU CUUGCUUC | 18341 |
| 1688 | AGCAAGGU G UGACUUUU | 7433 | AAAAGUCA GCCGAAAGGCGAGUGAGGUCU ACCUUGCU | 18342 |
| 1697 | UGACUUUU G UUCCAAUA | 7435 | UAUUGGAA GCCGAAAGGCGAGUGAGGUCU AAAAGUCA | 18343 |
| 1713 | AAUGAAGA G UCCUUUAU | 7438 | AUAAAGGA GCCGAAAGGCGAGUGAGGUCU UCUUCAUU | 18344 |
| 1729 | UCCUGGAU G CUGACAGC | 7440 | GCUGUCAG GCCGAAAGGCGAGUGAGGUCU AUCCAGGA | 18345 |
| 1736 | UGCUGACA G CAACAUGG | 7442 | CCAUGUUG GCCGAAAGGCGAGUGAGGUCU UGUCAGCA | 18346 |
| 1760 | AAUUGAGA G CAUCACUC | 7446 | GAGUGAUG GCCGAAAGGCGAGUGAGGUCU UCUCAAUU | 18347 |
| 1770 | AUCACUCA G CGCAUGGC | 7447 | GCCAUGCG GCCGAAAGGCGAGUGAGGUCU UGAGUGAU | 18348 |
| 1772 | CACUCAGC G CAUGGCAA | 7448 | UUGCCAUG GCCGAAAGGCGAGUGAGGUCU GCUGAGUG | 18349 |
| 1777 | AGCGCAUG G CAAUAAUA | 7449 | UAUUAUUG GCCGAAAGGCGAGUGAGGUCU CAUGCGCU | 18350 |
| 1804 | AUAAGAUG G CUAGCACC | 7454 | GGUGCUAG GCCGAAAGGCGAGUGAGGUCU CAUCUUAU | 18351 |
| 1808 | GAUGGCUA G CACCUUGG | 7455 | CCAAGGUG GCCGAAAGGCGAGUGAGGUCU UAGCCAUC | 18352 |
| 1816 | GCACCUUG G UUGUGGCU | 7456 | AGCCACAA GCCGAAAGGCGAGUGAGGUCU CAAGGUGC | 18353 |
| 1819 | CCUUGGUU G UGGCUGAC | 7457 | GUCAGCCA GCCGAAAGGCGAGUGAGGUCU AACCAAGG | 18354 |
| 1822 | UGGUUGUG G CUGACUCU | 7458 | AGAGUCAG GCCGAAAGGCGAGUGAGGUCU CACAACCA | 18355 |
| 1853 | CUACAUUU G CAUAGCUU | 7462 | AAGCUAUG GCCGAAAGGCGAGUGAGGUCU AAAUGUAG | 18356 |
| 1858 | UUUGCAUA G CUUCCAAU | 7463 | AUUGGAAG GCCGAAAGGCGAGUGAGGUCU UAUGCAAA | 18357 |
| 1870 | CCAAUAAA G UUGGGACU | 7465 | AGUCCCAA GCCGAAAGGCGAGUGAGGUCU UUUAUUGG | 18358 |
| 1879 | UUGGGACU G UGGGAAGA | 7467 | UCUUCCCA GCCGAAAGGCGAGUGAGGUCU AGUCCCAA | 18359 |
| 1895 | AAACAUAA G CUUUUAUA | 7469 | UAUAAAAG GCCGAAAGGCGAGUGAGGUCU UUAUGUUU | 18360 |
| 1912 | UCACAGAU G UGCCAAAU | 7471 | AUUUGGCA GCCGAAAGGCGAGUGAGGUCU AUCUGUGA | 18361 |
| 1914 | ACAGAUGU G CCAAAUGG | 7472 | CCAUUUGG GCCGAAAGGCGAGUGAGGUCU ACAUCUGU | 18362 |
| 1923 | CCAAAUGG G UUUCAUGU | 7474 | ACAUGAAA GCCGAAAGGCGAGUGAGGUCU CCAUUUGG | 18363 |
| 1930 | GGUUUCAU G UUAACUUG | 7475 | CAAGUUAA GCCGAAAGGCGAGUGAGGUCU AUGAAACC | 18364 |
| 1947 | GAAAAAAU G CCGACGGA | 7478 | UCCGUCGG GCCGAAAGGCGAGUGAGGUCU AUUUUUUC | 18365 |

TABLE XIX-continued

Human FLT Zinzyme and Substrate Sequence

| Pos | Substrate | Seq ID No | Zinzyme | Seq ID No |
|---|---|---|---|---|
| 1974 | CUGAAACU G UCUUGCAC | 7482 | GUGCAAGA GCCGAAAGGCGAGUGAGGUCU AGUUUCAG | 18366 |
| 1979 | ACUGUCUU G CACAGUUA | 7483 | UAACUGUG GCCGAAAGGCGAGUGAGGUCU AAGACAGU | 18367 |
| 1984 | CUUGCACA G UUAACAAG | 7484 | CUUGUUAA GCCGAAAGGCGAGUGAGGUCU UGUGCAAG | 18368 |
| 1992 | GUUAACAA G UUCUUAUA | 7486 | UAUAAGAA GCCGAAAGGCGAGUGAGGUCU UUGUUAAC | 18369 |
| 2008 | ACAGAGAC G UUACUUGG | 7488 | CCAAGUAA GCCGAAAGGCGAGUGAGGUCU GUCUCUGU | 18370 |
| 2025 | AUUUUACU G CGGACAGU | 7490 | ACUGUCCG GCCGAAAGGCGAGUGAGGUCU AGUAAAAU | 18371 |
| 2032 | UGCGGACA G UUAAUAAC | 7492 | GUUAUUAA GCCGAAAGGCGAGUGAGGUCU UGUCCGCA | 18372 |
| 2049 | AGAACAAU G CACUACAG | 7497 | CUGUAGUG GCCGAAAGGCGAGUGAGGUCU AUUGUUCU | 18373 |
| 2057 | GCACUACA G UAUUAGCA | 7498 | UGCUAAUA GCCGAAAGGCGAGUGAGGUCU UGUAGUGC | 18374 |
| 2063 | CAGUAUUA G CAAGCAAA | 7499 | UUUGCUUG GCCGAAAGGCGAGUGAGGUCU UAAUACUG | 18375 |
| 2067 | AUUAGCAA G CAAAAAAU | 7500 | AUUUUUUG GCCGAAAGGCGAGUGAGGUCU UUGCUAAU | 18376 |
| 2077 | AAAAAAUG G CCAUCACU | 7502 | AGUGAUGG GCCGAAAGGCGAGUGAGGUCU CAUUUUUU | 18377 |
| 2091 | ACUAAGGA G CACUCCAU | 7503 | AUGGAGUG GCCGAAAGGCGAGUGAGGUCU UCCUUAGU | 18378 |
| 2125 | UCAUGAAU G UUUCCCUG | 7506 | CAGGGAAA GCCGAAAGGCGAGUGAGGUCU AUUCAUGA | 18379 |
| 2133 | GUUUCCCU G CAAGAUUC | 7507 | GAAUCUUG GCCGAAAGGCGAGUGAGGUCU AGGGAAAC | 18380 |
| 2144 | AGAUUCAG G CACCUAUG | 7509 | CAUAGGUG GCCGAAAGGCGAGUGAGGUCU CUGAAUCU | 18381 |
| 2152 | GCACCUAU G CCUGCAGA | 7510 | UCUGCAGG GCCGAAAGGCGAGUGAGGUCU AUAGGUGC | 18382 |
| 2156 | CUAUGCCU G CAGAGCCA | 7511 | UGGCUCUG GCCGAAAGGCGAGUGAGGUCU AGGCAUAG | 18383 |
| 2161 | CCUGCAGA G CCAGGAAU | 7512 | AUUCCUGG GCCGAAAGGCGAGUGAGGUCU UCUGCAGG | 18384 |
| 2170 | CCAGGAAU G UAUACACA | 7514 | UGUGUAUA GCCGAAAGGCGAGUGAGGUCU AUUCCUGG | 18385 |
| 2227 | AUCAGGAA G CACCAUAC | 7519 | GUAUGGUG GCCGAAAGGCGAGUGAGGUCU UUCCUGAU | 18386 |
| 2241 | UACCUCCU G CGAAACCU | 7520 | AGGUUUCG GCCGAAAGGCGAGUGAGGUCU AGGAGGUA | 18387 |
| 2252 | AAACCUCA G UGAUCACA | 7522 | UGUGAUCA GCCGAAAGGCGAGUGAGGUCU UGAGGUUU | 18388 |
| 2263 | AUCACACA G UGGCCAUC | 7524 | GAUGGCCA GCCGAAAGGCGAGUGAGGUCU UGUGUGAU | 18389 |
| 2266 | ACACAGUG G CCAUCAGC | 7525 | GCUGAUGG GCCGAAAGGCGAGUGAGGUCU CACUGUGU | 18390 |
| 2273 | GGCCAUCA G CAGUUCCA | 7526 | UGGAACUG GCCGAAAGGCGAGUGAGGUCU UGAUGGCC | 18391 |
| 2276 | CAUCAGCA G UUCCACCA | 7527 | UGGUGGAA GCCGAAAGGCGAGUGAGGUCU UGCUGAUG | 18392 |
| 2294 | UUUAGACU G UCAUGCUA | 7529 | UAGCAUGA GCCGAAAGGCGAGUGAGGUCU AGUCUAAA | 18393 |
| 2299 | ACUGUCAU G CUAAUGGU | 7530 | ACCAUUAG GCCGAAAGGCGAGUGAGGUCU AUGACAGU | 18394 |
| 2306 | UGCUAAUG G UGUCCCCG | 7532 | CGGGGACA GCCGAAAGGCGAGUGAGGUCU CAUUAGCA | 18395 |
| 2308 | CUAAUGGU G UCCCCGAG | 7533 | CUCGGGGA GCCGAAAGGCGAGUGAGGUCU ACCAUUAG | 18396 |
| 2316 | GUCCCCGA G CCUCAGAU | 7534 | AUCUGAGG GCCGAAAGGCGAGUGAGGUCU UCGGGGAC | 18397 |
| 2331 | AUCACUUG G UUUAAAAA | 7536 | UUUUUAAA GCCGAAAGGCGAGUGAGGUCU CAAGUGAU | 18398 |
| 2361 | CAACAAGA G CCUGGAAU | 7541 | AUUCCAGG GCCGAAAGGCGAGUGAGGUCU UCUUGUUG | 18399 |
| 2387 | ACCAGGAA G CAGCACGC | 7544 | GCGUGCUG GCCGAAAGGCGAGUGAGGUCU UUCCUGGU | 18400 |
| 2390 | AGGAAGCA G CACGCUGU | 7545 | ACAGCGUG GCCGAAAGGCGAGUGAGGUCU UGCUUCCU | 18401 |
| 2394 | AGCAGCAC G CUGUUUAU | 7546 | AUAAACAG GCCGAAAGGCGAGUGAGGUCU GUGCUGCU | 18402 |

TABLE XIX-continued

Human FLT Zinzyme and Substrate Sequence

| Pos | Substrate | Seq ID No | Zinzyme | Seq ID No |
|---|---|---|---|---|
| 2397 | AGCACGCU G UUUAUUGA | 7547 | UCAAUAAA GCCGAAAGGCGAGUGAGGUCU AGCGUGCU | 18403 |
| 2410 | UUGAAAGA G UCACAGAA | 7548 | UUCUGUGA GCCGAAAGGCGAGUGAGGUCU UCUUUCAA | 18404 |
| 2429 | GGAUGAAG G UGUCUAUC | 7550 | GAUAGACA GCCGAAAGGCGAGUGAGGUCU CUUCAUCC | 18405 |
| 2431 | AUGAAGGU G UCUAUCAC | 7551 | GUGAUAGA GCCGAAAGGCGAGUGAGGUCU ACCUUCAU | 18406 |
| 2441 | CUAUCACU G CAAAGCCA | 7552 | UGGCUUUG GCCGAAAGGCGAGUGAGGUCU AGUGAUAG | 18407 |
| 2446 | ACUGCAAA G CCACCAAC | 7553 | GUUGGUGG GCCGAAAGGCGAGUGAGGUCU UUUGCAGU | 18408 |
| 2462 | CCAGAAGG G CUCUGUGG | 7555 | CCACAGAG GCCGAAAGGCGAGUGAGGUCU CCUUCUGG | 18409 |
| 2467 | AGGGCUCU G UGGAAAGU | 7556 | ACUUUCCA GCCGAAAGGCGAGUGAGGUCU AGAGCCCU | 18410 |
| 2474 | UGUGGAAA G UUCAGCAU | 7557 | AUGCUGAA GCCGAAAGGCGAGUGAGGUCU UUUCCACA | 18411 |
| 2479 | AAAGUUCA G CAUACCUC | 7558 | GAGGUAUG GCCGAAAGGCGAGUGAGGUCU UGAACUUU | 18412 |
| 2491 | ACCUCACU G UUCAAGGA | 7559 | UCCUUGAA GCCGAAAGGCGAGUGAGGUCU AGUGAGGU | 18413 |
| 2511 | UCGGACAA G UCUAAUCU | 7562 | AGAUUAGA GCCGAAAGGCGAGUGAGGUCU UUGUCCGA | 18414 |
| 2523 | AAUCUGGA G CUGAUCAC | 7564 | GUGAUCAG GCCGAAAGGCGAGUGAGGUCU UCCAGAUU | 18415 |
| 2540 | UCUAACAU G CACCUGUG | 7567 | CACAGGUG GCCGAAAGGCGAGUGAGGUCU AUGUUAGA | 18416 |
| 2546 | AUGCACCU G UGUGGCUG | 7568 | CAGCCACA GCCGAAAGGCGAGUGAGGUCU AGGUGCAU | 18417 |
| 2548 | GCACCUGU G UGGCUGCG | 7569 | CGCAGCCA GCCGAAAGGCGAGUGAGGUCU ACAGGUGC | 18418 |
| 2551 | CCUGUGUG G CUGCGACU | 7570 | AGUCGCAG GCCGAAAGGCGAGUGAGGUCU CACACAGG | 18419 |
| 2554 | GUGUGGCU G CGACUCUC | 7571 | GAGAGUCG GCCGAAAGGCGAGUGAGGUCU AGCCACAC | 18420 |
| 2568 | CUCUUCUG G CUCCUAUU | 7573 | AAUAGGAG GCCGAAAGGCGAGUGAGGUCU CAGAAGAG | 18421 |
| 2604 | AUGAAAAG G UCUUCUUC | 7576 | GAAGAAGA GCCGAAAGGCGAGUGAGGUCU CUUUUCAU | 18422 |
| 2659 | CAGAUGAA G UUCCUUUG | 7584 | CAAAGGAA GCCGAAAGGCGAGUGAGGUCU UUCAUCUG | 18423 |
| 2673 | UUGGAUGA G CAGUGUGA | 7586 | UCACACUG GCCGAAAGGCGAGUGAGGUCU UCAUCCAA | 18424 |
| 2676 | GAUGAGCA G UGUGAGCG | 7587 | CGCUCACA GCCGAAAGGCGAGUGAGGUCU UGCUCAUC | 18425 |
| 2678 | UGAGCAGU G UGAGCGGC | 7588 | GCCGCUCA GCCGAAAGGCGAGUGAGGUCU ACUGCUCA | 18426 |
| 2682 | CAGUGUGA G CGGCUCCC | 7589 | GGGACCCG GCCGAAAGGCGAGUGAGGUCU UCACACUG | 18427 |
| 2685 | UGUGAGCG G CUCCCUUA | 7590 | UAAGGGAG GCCGAAAGGCGAGUGAGGUCU CGCUCACA | 18428 |
| 2698 | CUUAUGAU G CCAGCAAG | 7592 | CUUGCUGG GCCGAAAGGCGAGUGAGGUCU AUCAUAAG | 18429 |
| 2702 | UGAUGCCA G CAAGUGGG | 7593 | CCCACUUG GCCGAAAGGCGAGUGAGGUCU UGGCAUCA | 18430 |
| 2706 | GCCAGCAA G UGGGAGUU | 7594 | AACUCCCA GCCGAAAGGCGAGUGAGGUCU UUGCUGGC | 18431 |
| 2712 | AAGUGGGA G UUUGCCCG | 7595 | CGGGCAAA GCCGAAAGGCGAGUGAGGUCU UCCCACUU | 18432 |
| 2716 | GGGAGUUU G CCCGGGAG | 7596 | CUCCCGGG GCCGAAAGGCGAGUGAGGUCU AAACUCCC | 18433 |
| 2738 | UAAACUGG G CAAAUCAC | 7599 | GUGAUUUC GCCGAAAGGCGAGUGAGGUCU CCAGUUUA | 18434 |
| 2758 | GAAGAGGG G CUUUUGGA | 7601 | UCCAAAAG GCCGAAAGGCGAGUGAGGUCU CCCUCUUC | 18435 |
| 2770 | UUGGAAAA G UGGUUCAA | 7602 | UUGAACCA GCCGAAAGGCGAGUGAGGUCU UUUUCCAA | 18436 |
| 2773 | GAAAAGUG G UUCAAGCA | 7603 | UGCUUGAA GCCGAAAGGCGAGUGAGGUCU CACUUUUC | 18437 |
| 2779 | UGGUUCAA G CAUCAGCA | 7604 | UGCUGAUG GCCGAAAGGCGAGUGAGGUCU UUGAACCA | 18438 |
| 2785 | AAGCAUCA G CAUUUGGC | 7605 | GCCAAAUG GCCGAAAGGCGAGUGAGGUCU UGAUGCUU | 18439 |

TABLE XIX-continued

Human FLT Zinzyme and Substrate Sequence

| Pos | Substrate | Seq ID No | Zinzyme | Seq ID No |
|---|---|---|---|---|
| 2792 | AGCAUUUG G CAUUAAGA | 7606 | UCUUAAUG GCCGAAAGGCGAGUGAGGUCU CAAAUGCU | 18440 |
| 2811 | UCACCUAC G UGCCGGAC | 7608 | GUCCGGCA GCCGAAAGGCGAGUGAGGUCU GUAGGUGA | 18441 |
| 2813 | ACCUACGU G CCGGACUG | 7609 | CAGUCCGG GCCGAAAGGCGAGUGAGGUCU ACGUAGGU | 18442 |
| 2821 | GCCGGACU G UGGCUGUG | 7611 | CACAGCCA GCCGAAAGGCGAGUGAGGUCU AGUCCGGC | 18443 |
| 2824 | GGACUGUG G CUGUGAAA | 7612 | UUUCACAG GCCGAAAGGCGAGUGAGGUCU CACAGUCC | 18444 |
| 2827 | CUGUGGCU G UGAAAAUG | 7613 | CAUUUUCA GCCGAAAGGCGAGUGAGGUCU AGCCACAG | 18445 |
| 2835 | GUGAAAAU G CUGAAAGA | 7615 | UCUUUCAG GCCGAAAGGCGAGUGAGGUCU AUUUUCAC | 18446 |
| 2848 | AAGAGGGG G CCACGGCC | 7616 | GGCCGUGG GCCGAAAGGCGAGUGAGGUCU CCCCUCUU | 18447 |
| 2854 | GGGCCACG G CCAGCGAG | 7617 | CUCGCUGG GCCGAAAGGCGAGUGAGGUCU CGUGGCCC | 18448 |
| 2858 | CACGGCCA G CGAGUACA | 7618 | UGUACUCG GCCGAAAGGCGAGUGAGGUCU UGGCCGUG | 18449 |
| 2862 | GCCAGCGA G UACAAAGC | 7619 | GCUUUGUA GCCGAAAGGCGAGUGAGGUCU UCGCUGGC | 18450 |
| 2869 | AGUACAAA G CUCUGAUG | 7620 | CAUCAGAG GCCGAAAGGCGAGUGAGGUCU UUUGUACU | 18451 |
| 2883 | AUGACUGA G CUAAAAAU | 7623 | AUUUUUAG GCCGAAAGGCGAGUGAGGUCU UCAGUCAU | 18452 |
| 2906 | CCACAUUG G CCACCAUC | 7626 | GAUGGUGG GCCGAAAGGCGAGUGAGGUCU CAAUGUGG | 18453 |
| 2920 | AUCUGAAC G UGGUUAAC | 7628 | GUUAACCA GCCGAAAGGCGAGUGAGGUCU GUUCAGAU | 18454 |
| 2923 | UGAACGUG G UUAACCUG | 7629 | CAGGUUAA GCCGAAAGGCGAGUGAGGUCU CACGUUCA | 18455 |
| 2931 | GUUAACCU G CUGGGAGC | 7631 | GCUCCCAG GCCGAAAGGCGAGUGAGGUCU AGGUUAAC | 18456 |
| 2938 | UGCUGGGA G CCUGCACC | 7632 | GGUGCAGG GCCGAAAGGCGAGUGAGGUCU UCCCAGCA | 18457 |
| 2942 | GGGAGCCU G CACCAAGC | 7633 | GCUUGGUG GCCGAAAGGCGAGUGAGGUCU AGGCUCCC | 18458 |
| 2949 | UGCACCAA G CAAGGAGG | 7634 | CCUCCUUG GCCGAAAGGCGAGUGAGGUCU UUGGUGCA | 18459 |
| 2958 | CAAGGAGG G CCUCUGAU | 7635 | AUCAGAGG GCCGAAAGGCGAGUGAGGUCU CCUCCUUG | 18460 |
| 2968 | CUCUGAUG G UGAUUGUU | 7637 | AACAAUCA GCCGAAAGGCGAGUGAGGUCU CAUCAGAG | 18461 |
| 2974 | UGGUGAUU G UUGAAUAC | 7639 | GUAUUCAA GCCGAAAGGCGAGUGAGGUCU AAUCACCA | 18462 |
| 2984 | UGAAUACU G CAAAUAUG | 7641 | CAUAUUUG GCCGAAAGGCGAGUGAGGUCU AGUAUUCA | 18463 |
| 3017 | CCUCAAGA G CAAACGUG | 7645 | CACGUUUG GCCGAAAGGCGAGUGAGGUCU UCUUGAGG | 18464 |
| 3023 | GAGCAAAC G UGACUUAU | 7647 | AUAAGUCA GCCGAAAGGCGAGUGAGGUCU GUUUGCUC | 18465 |
| 3049 | ACAAGGAU G CAGCACUA | 7651 | UAGUGCUG GCCGAAAGGCGAGUGAGGUCU AUCCUUGU | 18466 |
| 3052 | AGGAUGCA G CACUACAC | 7652 | GUGUAGUG GCCGAAAGGCGAGUGAGGUCU UGCAUCCU | 18467 |
| 3066 | CACAUGGA G CCUAAGAA | 7653 | UUCUUAGG GCCGAAAGGCGAGUGAGGUCU UCCAUGUG | 18468 |
| 3087 | AAAAUGGA G CCAGGCCU | 7655 | AGGCCUGG GCCGAAAGGCGAGUGAGGUCU UCCAUUUU | 18469 |
| 3092 | GGAGCCAG G CCUGGAAC | 7656 | GUUCCAGG GCCGAAAGGCGAGUGAGGUCU CUGGCUCC | 18470 |
| 3104 | GGAACAAG G CAAGAAAC | 7658 | GUUUCUUG GCCGAAAGGCGAGUGAGGUCU CUUGUUCC | 18471 |
| 3125 | ACUAGAUA G CGUCACCA | 7662 | UGGUGACG GCCGAAAGGCGAGUGAGGUCU UAUCUAGU | 18472 |
| 3127 | UAGAUAGC G UCACCAGC | 7663 | GCUGGUGA GCCGAAAGGCGAGUGAGGUCU GCUAUCUA | 18473 |
| 3134 | CGUCACCA G CAGCGAAA | 7664 | UUUCGCUG GCCGAAAGGCGAGUGAGGUCU UGGUGACG | 18474 |
| 3137 | CACCAGCA G CGAAAGCU | 7665 | AGCUUUCG GCCGAAAGGCGAGUGAGGUCU UGCUGGUG | 18475 |
| 3143 | CAGCGAAA G CUUUGCGA | 7666 | UCGCAAAG GCCGAAAGGCGAGUGAGGUCU UUUCGCUG | 18476 |

TABLE XIX-continued

Human FLT Zinzyme and Substrate Sequence

| Pos | Substrate | Seq ID No | Zinzyme | Seq ID No |
|---|---|---|---|---|
| 3148 | AAAGCUUU G CGAGCUCC | 7667 | GGAGCUCG GCCGAAAGGCGAGUGAGGUCU AAAGCUUU | 18477 |
| 3152 | CUUUGCGA G CUCCGGCU | 7668 | AGCCGGAG GCCGAAAGGCGAGUGAGGUCU UCGCAAAG | 18478 |
| 3158 | GAGCUCCG G CUUUCAGG | 7669 | CCUGAAAG GCCGAAAGGCGAGUGAGGUCU CGGAGCUC | 18479 |
| 3176 | AGAUAAAA G UCUGAGUG | 7671 | CACUCAGA GCCGAAAGGCGAGUGAGGUCU UUUUAUCU | 18480 |
| 3182 | AAGUCUGA G UGAUGUUG | 7672 | CAACAUCA GCCGAAAGGCGAGUGAGGUCU UCAGACUU | 18481 |
| 3187 | UGAGUGAU G UUGAGGAA | 7674 | UUCCUCAA GCCGAAAGGCGAGUGAGGUCU AUCACUCA | 18482 |
| 3212 | UUCUGACG G UUUCUACA | 7677 | UGUAGAAA GCCGAAAGGCGAGUGAGGUCU CGUCAGAA | 18483 |
| 3225 | UACAAGGA G CCCAUCAC | 7678 | GUGAUGGG GCCGAAAGGCGAGUGAGGUCU UCCUUGUA | 18484 |
| 3257 | UUCUUACA G UUUUCAAG | 7681 | CUUGAAAA GCCGAAAGGCGAGUGAGGUCU UGUAAGAA | 18485 |
| 3265 | GUUUUCAA G UGGCCAGA | 7682 | UCUGGCCA GCCGAAAGGCGAGUGAGGUCU UUGAAAAC | 18486 |
| 3268 | UUCAAGUG G CCAGAGGC | 7683 | GCCUCUGG GCCGAAAGGCGAGUGAGGUCU CACUUGAA | 18487 |
| 3275 | GGCCAGAG G CAUGGAGU | 7684 | ACUCCAUG GCCGAAAGGCGAGUGAGGUCU CUCUGGCC | 18488 |
| 3282 | GGCAUGGA G UUCCUGUC | 7685 | GACAGGAA GCCGAAAGGCGAGUGAGGUCU UCCAUGCC | 18489 |
| 3288 | GAGUUCCU G UCUUCCAG | 7686 | CUGGAAGA GCCGAAAGGCGAGUGAGGUCU AGGAACUC | 18490 |
| 3300 | UCCAGAAA G UGCAUUCA | 7687 | UGAAUGCA GCCGAAAGGCGAGUGAGGUCU UUUCUGGA | 18491 |
| 3302 | CAGAAAGU G CAUUCAUC | 7688 | GAUGAAUG GCCGAAAGGCGAGUGAGGUCU ACUUUCUG | 18492 |
| 3319 | GGGACCUG G CAGCGAGA | 7690 | UCUCGCUG GCCGAAAGGCGAGUGAGGUCU CAGGUCCC | 18493 |
| 3322 | ACCUGGCA G CGAGAAAC | 7691 | GUUUCUCG GCCGAAAGGCGAGUGAGGUCU UGCCAGGU | 18494 |
| 3352 | AGAACAAC G UGGUGAAG | 7695 | CUUCACCA GCCGAAAGGCGAGUGAGGUCU GUUGUUCU | 18495 |
| 3355 | ACAACGUG G UGAAGAUU | 7696 | AAUCUUCA GCCGAAAGGCGAGUGAGGUCU CACGUUGU | 18496 |
| 3365 | GAAGAUUU G UGAUUUUG | 7698 | CAAAAUCA GCCGAAAGGCGAGUGAGGUCU AAAUCUUC | 18497 |
| 3374 | UGAUUUUG G CCUUGCCC | 7700 | GGGCAAGG GCCGAAAGGCGAGUGAGGUCU CAAAAUCA | 18498 |
| 3379 | UUGGCCUU G CCCGGGAU | 7701 | AUCCCGGG GCCGAAAGGCGAGUGAGGUCU AAGGCCAA | 18499 |
| 3409 | CCGAUUAU G UGAGAAAA | 7705 | UUUUCUCA GCCGAAAGGCGAGUGAGGUCU AUAAUCGG | 18500 |
| 3448 | AAUGGAUG G CUCCCGAA | 7710 | UUCGGGAG GCCGAAAGGCGAGUGAGGUCU CAUCCAUU | 18501 |
| 3479 | AAUCUACA G CACCAAGA | 7714 | UCUUGGUG GCCGAAAGGCGAGUGAGGUCU UGUAGAUU | 18502 |
| 3488 | CACCAAGA G CGACGUGU | 7715 | ACACGUCG GCCGAAAGGCGAGUGAGGUCU UCUUGGUG | 18503 |
| 3493 | AGAGCGAC G UGGUCUA | 7717 | AGACCACA GCCGAAAGGCGAGUGAGGUCU GUCGCUCU | 18504 |
| 3495 | AGCGACGU G GUCUUA | 7718 | UAAGACCA GCCGAAAGGCGAGUGAGGUCU ACGUCGCU | 18505 |
| 3498 | GACGUGUG G UCUUACGG | 7719 | CCGUAAGA GCCGAAAGGCGAGUGAGGUCU CACACGUC | 18506 |
| 3508 | CUUACGGA G UAUUGCUG | 7720 | CAGCAAUA GCCGAAAGGCGAGUGAGGUCU UCCGUAAG | 18507 |
| 3513 | GGAGUAUU G CUGUGGGA | 7721 | UCCCACAG GCCGAAAGGCGAGUGAGGUCU AAUACUCC | 18508 |
| 3516 | GUAUUGCU G UGGGAAAU | 7722 | AUUUCCCA GCCGAAAGGCGAGUGAGGUCU AGCAAUAC | 18509 |
| 3536 | CUCCUUAG G UGGGUCUC | 7724 | GAGACCCA GCCGAAAGGCGAGUGAGGUCU CUAAGGAG | 18510 |
| 3540 | UUAGGUGG G UCUCCAUA | 7725 | UAUGGAGA GCCGAAAGGCGAGUGAGGUCU CCACCUAA | 18511 |
| 3556 | ACCCAGGA G UACAAAUG | 7726 | CAUUUGUA GCCGAAAGGCGAGUGAGGUCU UCCUGGGU | 18512 |
| 3578 | GGACUUUU G CAGUCGCC | 7730 | GGCGACUG GCCGAAAGGCGAGUGAGGUCU AAAAGUCC | 18513 |

TABLE XIX-continued

Human FLT Zinzyme and Substrate Sequence

| Pos | Substrate | Seq ID No | Zinzyme | Seq ID No |
|---|---|---|---|---|
| 3581 | CUUUUGCA G UCGCCUGA | 7731 | UCAGGCGA GCCGAAAGGCGAGUGAGGUCU UGCAAAAG | 18514 |
| 3584 | UUGCAGUC G CCUGAGGG | 7732 | CCCUCAGG GCCGAAAGGCGAGUGAGGUCU GACUGCAA | 18515 |
| 3596 | GAGGGAAG G CAUGAGGA | 7733 | UCCUCAUG GCCGAAAGGCGAGUGAGGUCU CUUCCCUC | 18516 |
| 3610 | GGAUGAGA G CUCCUGAG | 7735 | CUCAGGAG GCCGAAAGGCGAGUGAGGUCU UCUCAUCC | 18517 |
| 3618 | GCUCCUGA G UACUCUAC | 7736 | GUAGAGUA GCCGAAAGGCGAGUGAGGUCU UCAGGAGC | 18518 |
| 3648 | CAGAUCAU G CUGGACUG | 7739 | CAGUCCAG GCCGAAAGGCGAGUGAGGUCU AUGAUCUG | 18519 |
| 3656 | GCUGGACU G CUGGCACA | 7741 | UGUGCCAG GCCGAAAGGCGAGUGAGGUCU AGUCCAGC | 18520 |
| 3660 | GACUGCUG G CACAGAGA | 7742 | UCUCUGUG GCCGAAAGGCGAGUGAGGUCU CAGCAGUC | 18521 |
| 3681 | AAAGAAAG G CCAAGAUU | 7744 | AAUCUUGG GCCGAAAGGCGAGUGAGGUCU CUUUCUUU | 18522 |
| 3691 | CAAGAUUU G CAGAACUU | 7746 | AAGUUCUG GCCGAAAGGCGAGUGAGGUCU AAAUCUUG | 18523 |
| 3700 | CAGAACUU G UGGAAAAA | 7748 | UUUUUCCA GCCGAAAGGCGAGUGAGGUCU AAGUUCUG | 18524 |
| 3713 | AAAACUAG G UGAUUUGC | 7750 | GCAAAUCA GCCGAAAGGCGAGUGAGGUCU CUAGUUUU | 18525 |
| 3720 | GGUGAUUU G CUUCAAGC | 7752 | GCUUGAAG GCCGAAAGGCGAGUGAGGUCU AAAUCACC | 18526 |
| 3727 | UGCUUCAA G CAAAUGUA | 7753 | UACAUUUG GCCGAAAGGCGAGUGAGGUCU UUGAAGCA | 18527 |
| 3733 | AAGCAAAU G UACAACAG | 7755 | CUGUUGUA GCCGAAAGGCGAGUGAGGUCU AUUUGCUU | 18528 |
| 3746 | ACAGGAUG G UAAAGACU | 7758 | AGUCUUUA GCCGAAAGGCGAGUGAGGUCU CAUCCUGU | 18529 |
| 3769 | CAAUCAAU G CCAUACUG | 7762 | CAGUAUGG GCCGAAAGGCGAGUGAGGUCU AUUGAUUG | 18530 |
| 3788 | AGGAAAUA G UGGGUUUA | 7765 | UAAACCCA GCCGAAAGGCGAGUGAGGUCU UAUUUCCU | 18531 |
| 3792 | AAUAGUGG G UUUACAUA | 7766 | UAUGUAAA GCCGAAAGGCGAGUGAGGUCU CCACUAUU | 18532 |
| 3811 | CAACUCCU G CCUUCUCU | 7768 | AGAGAAGG GCCGAAAGGCGAGUGAGGUCU AGGAGUUG | 18533 |
| 3839 | CAAGGAAA G UAUUUCAG | 7770 | CUGAAAUA GCCGAAAGGCGAGUGAGGUCU UUUCCUUG | 18534 |
| 3847 | GUAUUUCA G CUCCGAAG | 7771 | CUUCGGAG GCCGAAAGGCGAGUGAGGUCU UGAAAUAC | 18535 |
| 3855 | GCUCCGAA G UUUAAUUC | 7772 | GAAUUAAA GCCGAAAGGCGAGUGAGGUCU UUCGGAGC | 18536 |
| 3869 | UUCAGGAA G CUCUGAUG | 7774 | CAUCAGAG GCCGAAAGGCGAGUGAGGUCU UUCCUGAA | 18537 |
| 3880 | CUGAUGAU G UCAGAUAU | 7777 | AUAUCUGA GCCGAAAGGCGAGUGAGGUCU AUCAUCAG | 18538 |
| 3889 | UCAGAUAU G UAAAUGCU | 7779 | AGCAUUUA GCCGAAAGGCGAGUGAGGUCU AUAUCUGA | 18539 |
| 3895 | AUGUAAAU G CUUUCAAG | 7781 | CUUGAAAG GCCGAAAGGCGAGUGAGGUCU AUUUACAU | 18540 |
| 3903 | GCUUUCAA G UUCAUGAG | 7782 | CUCAUGAA GCCGAAAGGCGAGUGAGGUCU UUGAAAGC | 18541 |
| 3911 | GUUCAUGA G CCUGGAAA | 7783 | UUUCCAGG GCCGAAAGGCGAGUGAGGUCU UCAUGAAC | 18542 |
| 3952 | UACCGAAU G CCACCUCC | 7788 | GGAGGUGG GCCGAAAGGCGAGUGAGGUCU AUUCGGUA | 18543 |
| 3963 | ACCUCCAU G UUUGAUGA | 7789 | UCAUCAAA GCCGAAAGGCGAGUGAGGUCU AUGGAGGU | 18544 |
| 3980 | CUACCAGG G CGACAGCA | 7792 | UGCUGUCG GCCGAAAGGCGAGUGAGGUCU CCUGGUAG | 18545 |
| 3986 | GGGCGACA G CAGCACUC | 7794 | GAGUGCUG GCCGAAAGGCGAGUGAGGUCU UGUCGCCC | 18546 |
| 3989 | CGACAGCA G CACUCUGU | 7795 | ACAGAGUG GCCGAAAGGCGAGUGAGGUCU UGCUGUCG | 18547 |
| 3996 | AGCACUCU G UUGGCCUC | 7796 | GAGGCCAA GCCGAAAGGCGAGUGAGGUCU AGAGUGCU | 18548 |
| 4000 | CUCUGUUG G CCUCUCCC | 7797 | GGGAGAGG GCCGAAAGGCGAGUGAGGUCU CAACAGAG | 18549 |
| 4011 | UCUCCCAU G CUGAAGCG | 7798 | CGCUUCAG GCCGAAAGGCGAGUGAGGUCU AUGGGAGA | 18550 |

TABLE XIX-continued

Human FLT Zinzyme and Substrate Sequence

| Pos | Substrate | Seq ID No | Zinzyme | Seq ID No |
|---|---|---|---|---|
| 4017 | AUGCUGAA G CGCUUCAC | 7799 | GUGAAGCG GCCGAAAGGCGAGUGAGGUCU UUCAGCAU | 18551 |
| 4019 | GCUGAAGC G CUUCACCU | 7800 | AGGUGAAG GCCGAAAGGCGAGUGAGGUCU GCUUCAGC | 18552 |
| 4037 | GACUGACA G CAAACCCA | 7803 | UGGGUUUG GCCGAAAGGCGAGUGAGGUCU UGUCAGUC | 18553 |
| 4048 | AACCCAAG G CCUCGCUC | 7805 | GAGCGAGG GCCGAAAGGCGAGUGAGGUCU CUUGGGUU | 18554 |
| 4053 | AAGGCCUC G CUCAAGAU | 7806 | AUCUUGAG GCCGAAAGGCGAGUGAGGUCU GAGGCCUU | 18555 |
| 4072 | ACUUGAGA G UAACCAGU | 7809 | ACUGGUUA GCCGAAAGGCGAGUGAGGUCU UCUCAAGU | 18556 |
| 4079 | AGUAACCA G UAAAAGUA | 7811 | UACUUUUA GCCGAAAGGCGAGUGAGGUCU UGGUUACU | 18557 |
| 4085 | CAGUAAAA G UAAGGAGU | 7812 | ACUCCUUA GCCGAAAGGCGAGUGAGGUCU UUUUACUG | 18558 |
| 4092 | AGUAAGGA G UCGGGCU | 7813 | AGCCCCGA GCCGAAAGGCGAGUGAGGUCU UCCUUACU | 18559 |
| 4098 | GAGUCGGG G CUGUCUGA | 7814 | UCAGACAG GCCGAAAGGCGAGUGAGGUCU CCCGACUC | 18560 |
| 4101 | UCGGGGCU G UCUGAUGU | 7815 | ACAUCAGA GCCGAAAGGCGAGUGAGGUCU AGCCCCGA | 18561 |
| 4108 | UGUCUGAU G UCAGCAGG | 7817 | CCUGCUGA GCCGAAAGGCGAGUGAGGUCU AUCAGACA | 18562 |
| 4112 | UGAUGUCA G CAGGCCCA | 7818 | UGGGCCUG GCCGAAAGGCGAGUGAGGUCU UGACAUCA | 18563 |
| 4116 | GUCAGCAG G CCCAGUUU | 7819 | AAACUGGG GCCGAAAGGCGAGUGAGGUCU CUGCUGAC | 18564 |
| 4121 | CAGGCCCA G UUUCUGCC | 7820 | GGCAGAAA GCCGAAAGGCGAGUGAGGUCU UGGGCCUG | 18565 |
| 4127 | CAGUUUCU G CCAUUCCA | 7821 | UGGAAUGG GCCGAAAGGCGAGUGAGGUCU AGAAACUG | 18566 |
| 4136 | CCAUUCCA G CUGUGGGC | 7822 | GCCCACAG GCCGAAAGGCGAGUGAGGUCU UGGAAUGG | 18567 |
| 4139 | UUCCAGCU G UGGGCACG | 7823 | CGUGCCCA GCCGAAAGGCGAGUGAGGUCU AGCUGGAA | 18568 |
| 4143 | AGCUGUGG G CACGUCAG | 7824 | CUGACGUG GCCGAAAGGCGAGUGAGGUCU CCACAGCU | 18569 |
| 4147 | GUGGGCAC G UCAGCGAA | 7825 | UUCGCUGA GCCGAAAGGCGAGUGAGGUCU GUGCCCAC | 18570 |
| 4151 | GCACGUCA G CGAAGGCA | 7826 | UGCCUUCG GCCGAAAGGCGAGUGAGGUCU UGACGUGC | 18571 |
| 4157 | CAGCGAAG G CAAGCGCA | 7827 | UGCGCUUG GCCGAAAGGCGAGUGAGGUCU CUUCGCUG | 18572 |
| 4161 | GAAGGCAA G CGCAGGUU | 7828 | AACCUGCG GCCGAAAGGCGAGUGAGGUCU UUGCCUUC | 18573 |
| 4163 | AGGCAAGC G CAGGUUCA | 7829 | UGAACCUG GCCGAAAGGCGAGUGAGGUCU GCUUGCCU | 18574 |
| 4167 | AAGCGCAG G UUCACCUA | 7830 | UAGGUGAA GCCGAAAGGCGAGUGAGGUCU CUGCGCUU | 18575 |
| 4183 | ACGACCAC G CUGAGCUG | 7832 | CAGCUCAG GCCGAAAGGCGAGUGAGGUCU GUGGUCGU | 18576 |
| 4188 | CACGCUGA G CUGGAAAG | 7833 | CUUUCCAG GCCGAAAGGCGAGUGAGGUCU UCAGCGUG | 18577 |
| 4204 | GGAAAAUC G CGUGCUGC | 7835 | GCAGCACG GCCGAAAGGCGAGUGAGGUCU GAUUUUCC | 18578 |
| 4206 | AAAAUCGC G UGCUGCUC | 7836 | GAGCAGCA GCCGAAAGGCGAGUGAGGUCU GCGAUUUU | 18579 |
| 4208 | AAUCGCGU G CUGCUCCC | 7837 | GGGAGCAG GCCGAAAGGCGAGUGAGGUCU ACGCGAUU | 18580 |
| 4211 | CGCGUGCU G CUCCCCGC | 7838 | GCGGGGAG GCCGAAAGGCGAGUGAGGUCU AGCACGCG | 18581 |
| 4218 | UGCUCCCC G CCCCCAGA | 7839 | UCUGGGGG GCCGAAAGGCGAGUGAGGUCU GGGGAGCA | 18582 |
| 4237 | ACAACUCG G UGGUCCUG | 7842 | CAGGACCA GCCGAAAGGCGAGUGAGGUCU CGAGUUGU | 18583 |
| 4240 | ACUCGGUG G UCCUGUAC | 7843 | GUACAGGA GCCGAAAGGCGAGUGAGGUCU CACCGAGU | 18584 |
| 4245 | GUGGUCCU G UACCCAC | 7844 | GUGGAGUA GCCGAAAGGCGAGUGAGGUCU AGGACCAC | 18585 |
| 4268 | CAUCUAGA G UUUGACAC | 7845 | GUGUCAAA GCCGAAAGGCGAGUGAGGUCU UCUAGAUG | 18586 |
| 4280 | GACACGAA C CCUUAUUU | 7847 | AAAUAAGG GCCGAAAGGCGAGUGAGGUCU UUCGUGUC | 18587 |

TABLE XIX-continued

Human FLT Zinzyme and Substrate Sequence

| Pos | Substrate | Seq ID No | Zinzyme | Seq ID No |
|---|---|---|---|---|
| 4295 | UUCUAGAA G CACAUGUG | 7848 | CACAUGUG GCCGAAAGGCGAGUGAGGUCU UUCUAGAA | 18588 |
| 4301 | AAGCACAU G UGUAUUUA | 7849 | UAAAUACA GCCGAAAGGCGAGUGAGGUCU AUGUGCUU | 18589 |
| 4303 | GCACAUGU G UAUUUAUA | 7850 | UAUAAAUA GCCGAAAGGCGAGUGAGGUCU ACAUGUGC | 18590 |
| 4326 | GGAAACUA G CUUUUGCC | 7852 | GGCAAAAG GCCGAAAGGCGAGUGAGGUCU UAGUUUCC | 18591 |
| 4332 | UAGCUUUU G CCAGUAUU | 7853 | AAUACUGG GCCGAAAGGCGAGUGAGGUCU AAAAGCUA | 18592 |
| 4336 | UUUUGCCA G UAUUAUGC | 7854 | GCAUAAUA GCCGAAAGGCGAGUGAGGUCU UGGCAAAA | 18593 |
| 4343 | AGUAUUAU G CAUAUAUA | 7855 | UAUAUAUG GCCGAAAGGCGAGUGAGGUCU AUAAUACU | 18594 |
| 4353 | AUAUAUAA G UUUACACC | 7856 | GGUGUAAA GCCGAAAGGCGAGUGAGGUCU UUAUAUAU | 18595 |
| 4379 | CCAUGGGA G CCAGCUGC | 7857 | GCAGCUGG GCCGAAAGGCGAGUGAGGUCU UCCCAUGG | 18596 |
| 4383 | GGGAGCCA G CUGCUUUU | 7858 | AAAAGCAG GCCGAAAGGCGAGUGAGGUCU UGGCUCCC | 18597 |
| 4386 | AGCCAGCU G CUUUUUGU | 7859 | ACAAAAAG GCCGAAAGGCGAGUGAGGUCU AGCUGGCU | 18598 |
| 4393 | UGCUUUUU G UGAUUUUU | 7860 | AAAAAUCA GCCGAAAGGCGAGUGAGGUCU AAAAAGCA | 18599 |
| 4408 | UUUUAAUA G UGCUUUUU | 7863 | AAAAAGCA GCCGAAAGGCGAGUGAGGUCU UAUUAAAA | 18600 |
| 4410 | UUAAUAGU G CUUUUUUU | 7864 | AAAAAAAG GCCGAAAGGCGAGUGAGGUCU ACUAUUAA | 18601 |
| 4336 | ACAAGAAU G UAACUCCA | 7868 | UGGAGUUA GCCGAAAGGCGAGUGAGGUCU AUUCUUGU | 18602 |
| 4457 | GAGAAAUA G UGACAAGU | 7872 | ACUUGUCA GCCGAAAGGCGAGUGAGGUCU UAUUUCUC | 18603 |
| 4464 | AGUGACAA G UGAAGAAC | 7874 | GUUCUUCA GCCGAAAGGCGAGUGAGGUCU UUGUCACU | 18604 |
| 4479 | ACACUACU G CUAAAUCC | 7876 | GGAUUUAG GCCGAAAGGCGAGUGAGGUCU AGUAGUGU | 18605 |
| 4492 | AUCCUCAU G UUACUCAG | 7878 | CUGAGUAA GCCGAAAGGCGAGUGAGGUCU AUGAGGAU | 18606 |
| 4500 | GUUACUCA G UGUUAGAG | 7879 | CUCUAACA GCCGAAAGGCGAGUGAGGUCU UGAGUAAC | 18607 |
| 4502 | UACUCAGU G UUAGAGAA | 7880 | UUCUCUAA GCCGAAAGGCGACUGAGUCU ACUGAGUA | 18608 |
| 4538 | ACUUCCCU G CUCCAACC | 7885 | GGUUGGAG GCCGAAAGGCGAGUGAGGUCU AGGGAAGU | 18609 |
| 4550 | CAACCCCC G CCACCUCA | 7887 | UGAGGUGG GCCGAAAGGCGAGUGAGGUCU GGGGGUUG | 18610 |
| 4561 | ACCUCAGG G CACGCAGG | 7888 | CCUGCGUG GCCGAAAGGCGAGUGAGGUCU CCUGAGGU | 18611 |
| 4565 | CAGGGCAC G CAGGACCA | 7889 | UGGUCCUG GCCGAAAGGCGAGUGAGGUCU GUGCCCUG | 18612 |
| 4574 | CAGGACCA G UUUGAUUG | 7891 | CAAUCAAA GCCGAAAGGCGAGUGAGGUCU UGGUCCUG | 18613 |
| 4587 | AUUGAGGA G CUGCACUG | 7893 | CAGUGCAG GCCGAAAGGCGAGUGAGGUCU UCCUCAAU | 18614 |
| 4590 | GAGGAGCU G CACUGAUC | 7894 | GAUCAGUG GCCGAAAGGCGAGUGAGGUCU AGCUCCUC | 18615 |
| 4606 | CACCCAAU G CAUCACGU | 7897 | ACGUGAUG GCCGAAAGGCGAGUGAGGUCU AUUGGGUG | 18616 |
| 4613 | UGCAUCAC G UACCCCAC | 7898 | GUGGGGUA GCCGAAAGGCGAGUGAGGUCU GUGAUGCA | 18617 |
| 4625 | CCCACUGG G CCAGCCCU | 7899 | AGGGCUGG GCCGAAAGGCGAGUGAGGUCU CCAGUGGG | 18618 |
| 4629 | CUGGGCCA G CCCUGCAG | 7900 | CUGCAGGG GCCGAAAGGCGAGUGAGGUCU UGGCCCAG | 18619 |
| 4634 | CCAGCCCU G CAGCCCAA | 7901 | UUGGGCUG GCCGAAAGGCGAGUGAGGUCU AGGGCUGG | 18620 |
| 4637 | GCCCUGCA G CCCAAAAC | 7902 | GUUUUGGG GCCGAAAGGCGAGUGAGGUCU UGCAGGGC | 18621 |
| 4651 | AACCCAGG G CAACAAGC | 7904 | GCUUGUUG GCCGAAAGGCGAGUGAGGUCU CCUGGGUU | 18622 |
| 4658 | GGCAACAA G CCCGUUAG | 7906 | CUAACGGG GCCGAAAGGCGAGUGAGGUCU UUGUUGCC | 18623 |
| 4662 | ACAAGCCC G UUAGCCCC | 7907 | GGGGCUAA GCCGAAAGGCGAGUGAGGUCU GGGCUUGU | 18624 |

TABLE XIX-continued

Human FLT Zinzyme and Substrate Sequence

| Pos | Substrate | Seq ID No | Zinzyme | Seq ID No |
|---|---|---|---|---|
| 4666 | GCCCGUUA G CCCCAGGG | 7908 | CCCUGGGG GCCGAAAGGCGAGUGAGGUCU UAACGGGC | 18625 |
| 4683 | GAUCACUG G CUGGCCUG | 7910 | CAGGCCAC GCCGAAAGGCGAGUGAGGUCU CAGUGAUC | 18626 |
| 4687 | ACUGGCUG G CCUGAGCA | 7911 | UGCUCAGG GCCGAAAGGCGAGUGAGGUCU CAGCCAGU | 18627 |
| 4693 | UGGCCUGA G CAACAUCU | 7912 | AGAUGUUG GCCGAAAGGCGAGUGAGGUCU UCAGGCCA | 18628 |
| 4707 | UCUCGGGA G UCCUCUAC | 7914 | CUAGAGGA GCCGAAAGGCGAGUGAGGUCU UCCCGAGA | 18629 |
| 4715 | GUCCUCUA G CAGGCCUA | 7915 | UAGGCCUG GCCGAAAGGCGAGUGAGGUCU UAGAGGAC | 18630 |
| 4719 | UCUAGCAG G CCUAAGAC | 7916 | GUCUUAGG GCCGAAAGGCGAGUGAGGUCU CUGCUAGA | 18631 |
| 4730 | UAAGACAU G UGAGGAGG | 7918 | CCUCCUCA GCCGAAAGGCGAGUGAGGUCU AUGUCUUA | 18632 |
| 4752 | GAAAAAAA G CAAAAAGC | 7919 | GCUUUUUG GCCGAAAGGCGAGUGAGGUCU UUUUUUUC | 18633 |
| 4759 | AGCAAAAA G CAAGGGAG | 7920 | CUCCCUUG GCCGAAAGGCGAGUGAGGUCU UUUUUGCU | 18634 |
| 4788 | GGGAGAAG G CAUGAGAA | 7922 | UUCUCAUG GCCGAAAGGCGAGUGAGGUCU CUUCUCCC | 18635 |
| 4809 | UUUGAGAC G CACCAUGU | 7925 | ACAUGGUG GCCGAAAGGCGAGUGAGGUCU GUCUCAAA | 18636 |
| 4816 | CGCACCAU G UGGGCACG | 7926 | CGUGCCCA GCCGAAAGGCGAGUGAGGUCU AUGGUGCG | 18637 |
| 4820 | CCAUGUGG G CACGGAGG | 7927 | CCUCCGUG GCCGAAAGGCGAGUGAGGUCU CCACAUGG | 18638 |
| 4837 | GGGACGGG G CUCAGCAA | 7929 | UUGCUGAG GCCGAAAGGCGAGUGAGGUCU CCCGUCCC | 18639 |
| 4842 | GGGGCUCA G CAAUGCCA | 7930 | UGGCAUUG GCCGAAAGGCGAGUGAGGUCU UGAGCCCC | 18640 |
| 4847 | UCAGCAAU G CCAUUUCA | 7932 | UGAAAUGG GCCGAAAGGCGAGUGAGGUCU AUUGCUGA | 18641 |
| 4856 | CCAUUUCA G UGGCUUCC | 7933 | GGAAGCCA GCCGAAAGGCGAGUGAGGUCU UGAAAUGG | 18642 |
| 4859 | UUUCAGUG G CUUCCCAG | 7934 | CUGGGAAG GCCGAAAGGCGAGUGAGGUCU CACUGAAA | 18643 |
| 4867 | GCUUCCCA G CUCUGACC | 7935 | GGUCAGAG GCCGAAAGGCGAGUGAGGUCU UGGGAAGC | 18644 |
| 4891 | AUUUGAGG G CCCAGCCA | 7937 | UGGCUGGG GCCGAAAGGCGAGUGAGGUCU CCUCAAAU | 18645 |
| 4896 | AGGGCCCA G CCAGGAGC | 7938 | GCUCCUGG GCCGAAAGGCGAGUGAGGUCU UGGGCCCU | 18646 |
| 4903 | AGCCAGGA G CAGAUGGA | 7939 | UCCAUCUG GCCGAAAGGCGAGUGAGGUCU UCCUGGCU | 18647 |
| 4914 | GAUGGACA G CGAUGAGG | 7942 | CCUCAUCG GCCGAAAGGCGAGUGAGGUCU UGUCCAUC | 18648 |
| 4946 | UCUGGGAG G CAAGAAAA | 7946 | UUUUCUUG GCCGAAAGGCGAGUGAGGUCU CUCCCAGA | 18649 |
| 4981 | GAACUAAA G CAAAUUUU | 7950 | AAAAUUUG GCCGAAAGGCGAGUGAGGUCU UUUAGUUC | 18650 |
| 5008 | CUAUGGAA G UGGUUCUA | 7953 | UAGAACCA GCCGAAAGGCGAGUGAGGUCU UUCCAUAG | 18651 |
| 5011 | UGGAAGUG G UUCUAUGU | 7954 | ACAUAGAA GCCGAAAGGCGAGUGAGGUCU CACUUCCA | 18652 |
| 5018 | GGUUCUAU G UCCAUUCU | 7955 | AGAAUGGA GCCGAAAGGCGAGUGAGGUCU AUAGAACC | 18653 |
| 5032 | UCUCAUUC G UGGCAUGU | 7956 | ACAUGCCA GCCGAAAGGCGAGUGAGGUCU GAAUGAGA | 18654 |
| 5035 | CAUUCGUG G CAUGUUUU | 7957 | AAAACAUG GCCGAAAGGCGAGUGAGGUCU CACGAAUG | 18655 |
| 5039 | CGUGGCAU G UUUUGAUU | 7958 | AAUCAAAA GCCGAAAGGCGAGUGAGGUCU AUGCCACG | 18656 |
| 5049 | UUUGAUUU G UAGCACUG | 7960 | CAGUGCUA GCCGAAAGGCGAGUGAGGUCU AAAUCAAA | 18657 |
| 5052 | GAUUUGUA G CACUGAGG | 7961 | CCUCAGUG GCCGAAAGGCGAGUGAGGUCU UACAAAUC | 18658 |
| 5061 | CACUGAGG G UGGCACUC | 7962 | GAGUGCCA GCCGAAAGGCGAGUGAGGUCU CCUCAGUG | 18659 |
| 5064 | UGAGGGUG G CACUCAAC | 7963 | GUUGAGUG GCCGAAAGGCGAGUGAGGUCU CACCCUCA | 18660 |
| 5078 | AACUCUGA G CCCAUACU | 7965 | AGUAUGGG GCCGAAAGGCGAGUGAGGUCU UCAGAGUU | 18661 |

TABLE XIX-continued

Human FLT Zinzyme and Substrate Sequence

| Pos | Substrate | Seq ID No | Zinzyme | Seq ID No |
|---|---|---|---|---|
| 5091 | UACUUUUG G CUCCUCUA | 7966 | UAGAGGAG GCCGAAAGGCGAGUGAGGUCU CAAAAGUA | 18662 |
| 5100 | CUCCUCUA G UAAGAUGC | 7967 | GCAUCUUA GCCGAAAGGCGAGUGAGGUCU UAGAGGAG | 18663 |
| 5107 | AGUAAGAU G CACUGAAA | 7969 | UUUCAGUG GCCGAAAGGCGAGUGAGGUCU AUCUUACU | 18664 |
| 5121 | AAAACUUA G CCAGAGUU | 7971 | AACUCUGG GCCGAAAGGCGAGUGAGGUCU UAAGUUUU | 18665 |
| 5127 | UAGCCAGA G UUAGGUUG | 7972 | CAACCUAA GCCGAAAGGCGAGUGAGGUCU UCUGGCUA | 18666 |
| 5132 | AGAGUUAG G UUGUCUCC | 7973 | GGAGACAA GCCGAAAGGCGAGUGAGGUCU CUAACUCU | 18667 |
| 5135 | GUUAGGUU G UCUCCAGG | 7974 | CCUGGAGA GCCGAAAGGCGAGUGAGGUCU AACCUAAC | 18668 |
| 5143 | GUCUCCAG G CCAUGAUG | 7975 | CAUCAUGG GCCGAAAGGCGAGUGAGGUCU CUGGAGAC | 18669 |
| 5152 | CCAUGAUG G CCUUACAC | 7977 | GUGUAAGG GCCGAAAGGCGAGUGAGGUCU CAUCAUGG | 18670 |
| 5168 | CUGAAAAU G UCACAUUC | 7979 | GAAUGUGA GCCGAAAGGCGAGUGAGGUCU AUUUUCAG | 18671 |
| 5185 | UAUUUUGG G UAUUAAUA | 7980 | UAUUAAUA GCCGAAAGGCGAGUGAGGUCU CCAAAAUA | 18672 |
| 5198 | AAUAUAUA G UCCAGACA | 7982 | UGUCUGGA GCCGAAAGGCGAGUGAGGUCU UAUAUAUU | 18673 |
| 5224 | AUUUCUUG G UAUUAUUC | 7986 | GAAUAAUA GCCGAAAGGCGAGUGAGGUCU CAAGAAAU | 18674 |
| 5234 | AUUAUUCU G UUUUGCAC | 7987 | GUGCAAAA GCCGAAAGGCGAGUGAGGUCU AGAAUAAU | 18675 |
| 5239 | UCUGUUUU G CACAGUUA | 7988 | UAACUGUG GCCGAAAGGCGAGUGAGGUCU AAAACAGA | 18676 |
| 5244 | UUUGCACA G UUAGUUGU | 7989 | ACAACUAA GCCGAAAGGCGAGUGAGGUCU UGUGCAAA | 18677 |
| 5248 | CACAGUUA G UUGUGAAA | 7990 | UUUCACAA GCCGAAAGGCGAGUGAGGUCU UAACUGUG | 18678 |
| 5251 | AGUUAGUU G UGAAAGAA | 7991 | UUCUUUCA GCCGAAAGGCGAGUGAGGUCU AACUAACU | 18679 |
| 5261 | GAAAGAAA G CUGAGAAG | 7992 | CUUCUCAG GCCGAAAGGCGAGUGAGGUCU UUUCUUUC | 18680 |
| 5279 | AUGAAAAU G CAGUCCUG | 7995 | CAGGACUG GCCGAAAGGCGAGUGAGGUCU AUUUUCAU | 18681 |
| 5282 | AAAAUGCA G UCCUGAGG | 7996 | CCUCAGGA GCCGAAAGGCGAGUGAGGUCU UGCAUUUU | 18682 |
| 5294 | UGAGGAGA G UUUUCUCC | 7997 | GGAGAAAA GCCGAAAGGCGAGUGAGGUCU UCUCCUCA | 18683 |
| 5317 | AAACGAGG G CUGAUGGA | 7999 | UCCAUCAG GCCGAAAGGCGAGUGAGGUCU CCUCGUUU | 18684 |
| 5334 | GGAAAAAG G UCAAUAAG | 8001 | CUUAUUGA GCCGAAAGGCGAGUGAGGUCU CUUUUUCC | 18685 |
| 5343 | UCAAUAAG G UCAAGGGA | 8003 | UCCCUUGA GCCGAAAGGCGAGUGAGGUCU CUUAUUGA | 18686 |
| 5359 | AAGACCCC G UCUCUAUA | 8005 | UAUAGAGA GCCGAAAGGCGAGUGAGGUCU GGGGUCUU | 18687 |
| 5393 | CCAACACA G UUGGGACC | 8010 | GGUCCCAA GCCGAAAGGCGAGUGAGGUCU UGUGUUGG | 18688 |
| 5415 | CACAGGAA G UCAGUCAC | 8013 | GUGACUGA GCCGAAAGGCGAGUGAGGUCU UUCCUGUG | 18689 |
| 5419 | GGAAGUCA G UCACGUUU | 8014 | AAACGUGA GCCGAAAGGCGAGUGAGGUCU UGACUUCC | 18690 |
| 5424 | UCAGUCAC G UUUCCUUU | 8015 | AAAGGAAA GCCGAAAGGCGAGUGAGGUCU GUGACUGA | 18691 |
| 5477 | GAAAGGAU G UGGAAGAG | 8020 | CUCUUCCA GCCGAAAGGCGAGUGAGGUCU AUCCUUUC | 18692 |
| 5485 | GUGGAAGA G CAUUAGCU | 8021 | AGCUAAUG GCCGAAAGGCGAGUGAGGUCU UCUUCCAC | 18693 |
| 5491 | GAGCAUUA G CUGGCGCA | 8022 | UGCGCCAG GCCGAAAGGCGAGUGAGGUCU UAAUGCUC | 18694 |
| 5495 | AUUAGCUG G CGCAUAUU | 8023 | AAUAUGCG GCCGAAAGGCGAGUGAGGUCU CAGCUAAU | 18695 |
| 5497 | UAGCUGGC G CAUAUUAA | 8024 | UUAAUAUG GCCGAAAGGCGAGUGAGGUCU GCCAGCUA | 18696 |
| 5506 | CAUAUUAA G CACUUUAA | 8025 | UUAAAGUG GCCGAAAGGCGAGUGAGGUCU UUAAUAUG | 18697 |
| 5515 | CACUUUAA G CUCCUUGA | 8026 | UCAAGGAG GCCGAAAGGCGAGUGAGGUCU UUAAAGUG | 18698 |

TABLE XIX-continued

Human FLT Zinzyme and Substrate Sequence

| Pos | Substrate | Seq ID No | Zinzyme | Seq ID No |
|---|---|---|---|---|
| 5524 | CUCCUUGA G UAAAAAGG | 8027 | CCUUUUUA GCCGAAAGGCGAGUGAGGUCU UCAAGGAG | 18699 |
| 5532 | GUAAAAAG G UGGUAUGU | 8028 | ACAUACCA GCCGAAAGGCGAGUGAGGUCU CUUUUUAC | 18700 |
| 5535 | AAAAGGUG G UAUGUAAU | 8029 | AUUACAUA GCCGAAAGGCGAGUGAGGUCU CACCUUUU | 18701 |
| 5539 | GGUGGUAU G UAAUUUAU | 8030 | AUAAAUUA GCCGAAAGGCGAGUGAGGUCU AUACCACC | 18702 |
| 5548 | UAAUUUAU G CAAGGUAU | 8032 | AUACCUUG GCCGAAAGGCGAGUGAGGUCU AUAAAUUA | 18703 |
| 5553 | UAUGCAAG G UAUUUCUC | 8033 | GAGAAAUA GCCGAAAGGCGAGUGAGGUCU CUUGCAUA | 18704 |
| 5564 | UUUCUCCA G UUGGGACU | 8034 | AGUCCCAA GCCGAAAGGCGAGUGAGGUCU UGGAGAAA | 18705 |
| 5583 | GGAUAUUA G UUAAUGAG | 8037 | CUCAUUAA GCCGAAAGGCGAGUGAGGUCU UAAUAUCC | 18706 |
| 5591 | GUUAAUGA G CCAUCACU | 8039 | AGUGAUGG GCCGAAAGGCGAGUGAGGUCU UCAUUAAC | 18707 |
| 5609 | GAAGAAAA G CCCAUUUU | 8040 | AAAAUGGG GCCGAAAGGCGAGUGAGGUCU UUUUCUUC | 18708 |
| 5623 | UUUCAACU G CUUUGAAA | 8042 | UUUCAAAG GCCGAAAGGCGAGUGAGGUCU AGUUGAAA | 18709 |
| 5635 | UGAAACUU G CCUGGGGU | 8044 | ACCCCAGG GCCGAAAGGCGAGUGAGGUCU AAGUUUCA | 18710 |
| 5642 | UGCCUGGG G UCUGAGCA | 8045 | UGCUCAGA GCCGAAAGGCGAGUGAGGUCU CCCAGGCA | 18711 |
| 5648 | GGGUCUGA G CAUGAUGG | 8046 | CCAUCAUG GCCGAAAGGCGAGUGAGGUCU UCAGACCC | 18712 |
| 5672 | GAGACAGG G UAGGAAAG | 8050 | CUUUCCUA GCCGAAAGGCGAGUGAGGUCU CCUGUCUC | 18713 |
| 5682 | AGGAAAGG G CGCCUACU | 8051 | AGUAGGCG GCCGAAAGGCGAGUGAGGUCU CCUUUCCU | 18714 |
| 5684 | GAAAGGGC G CCUACUCU | 8052 | AGAGUAGG GCCGAAAGGCGAGUGAGGUCU GCCCUUUC | 18715 |
| 5698 | UCUUCAGG G UCUAAAGA | 8053 | UCUUUAGA GCCGAAAGGCGAGUGAGGUCU CCUGAAGA | 18716 |
| 5711 | AAGAUCAA G UGGGCCUU | 8055 | AAGGCCCA GCCGAAAGGCGAGUGAGGUCU UUGAUCUU | 18717 |
| 5715 | UCAAGUGG G CCUUGGAU | 8056 | AUCCAAGG GCCGAAAGGCGAGUGAGGUCU CCACUUGA | 18718 |
| 5725 | CUUGGAUC G CUAAGCUG | 8058 | CAGCUUAG GCCGAAAGGCGAGUGAGGUCU GAUCCAAG | 18719 |
| 5730 | AUCGCUAA G CUGGCUCU | 8059 | AGAGCCAG GCCGAAAGGCGAGUGAGGUCU UUAGCGAU | 18720 |
| 5734 | CUAAGCUG G CUCUGUUU | 8060 | AAACAGAG GCCGAAAGGCGAGUGAGGUCU CAGCUUAG | 18721 |
| 5739 | CUGGCUCU G UUUGAUGC | 8061 | GCAUCAAA GCCGAAAGGCGAGUGAGGUCU AGAGCCAG | 18722 |
| 5746 | UGUUUGAU G CUAUUUAU | 8063 | AUAAAUAG GCCGAAAGGCGAGUGAGGUCU AUCAAACA | 18723 |
| 5755 | CUAUUUAU G CAAGUUAG | 8064 | CUAACUUG GCCGAAAGGCGAGUGAGGUCU AUAAAUAG | 18724 |
| 5759 | UUAUGCAA G UUAGGGUC | 8065 | GACCCUAA GCCGAAAGGCGAGUGAGGUCU UUGCAUAA | 18725 |
| 5765 | AAGUUAGG G UCUAUGUA | 8066 | UACAUAGA GCCGAAAGGCGAGUGAGGUCU CCUAACUU | 18726 |
| 5771 | GGGUCUAU G UAUUUAGG | 8067 | CCUAAAUA GCCGAAAGGCGAGUGAGGUCU AUAGACCC | 18727 |
| 5782 | UUUAGGAU G CGCCUACU | 8069 | AGUAGGCG GCCGAAAGGCGAGUGAGGUCU AUCCUAAA | 18728 |
| 5784 | UAGGAUGC G CCUACUCU | 8070 | AGAGUAGG GCCGAAAGGCGAGUGAGGUCU GCAUCCUA | 18729 |
| 5798 | UCUUCAGG G UCUAAAGA | 8053 | UCUUUAGA GCCGAAAGGCGAGUGAGGUCU CCUGAAGA | 18716 |
| 5811 | AAGAUCAA G UGGGCCUU | 8055 | AAGGCCCA GCCGAAAGGCGAGUGAGGUCU UUGAUCUU | 18717 |
| 5815 | UCAAGUGG G CCUUGGAU | 8056 | AUCCAAGG GCCGAAAGGCGAGUGAGGUCU CCACUUGA | 18718 |
| 5825 | CUUGGAUC G CUAAGCUG | 8058 | CAGCUUAG GCCGAAAGGCGAGUGAGGUCU GAUCCAAG | 18719 |
| 5830 | AUCGCUAA G CUGGCUCU | 8059 | AGAGCCAG GCCGAAAGGCGAGUGAGGUCU UUAGCGAU | 18720 |
| 5834 | CUAAGCUG G CUCUGUUU | 8060 | AAACAGAG GCCGAAAGGCGAGUGAGGUCU CAGCUUAG | 18721 |

TABLE XIX-continued

Human FLT Zinzyme and Substrate Sequence

| Pos | Substrate | Seq ID No | Zinzyme | Seq ID No |
|---|---|---|---|---|
| 5839 | CUGGCUCU G UUUGAUGC | 8061 | GCAUCAAA GCCGAAAGGCGAGUGAGGUCU AGAGCCAG | 18722 |
| 5846 | UGUUUGAU G CUAUUUAU | 8063 | AUAAAUAG GCCGAAAGGCGAGUGAGGUCU AUCAAACA | 18723 |
| 5855 | CUAUUUAU G CAAGUUAG | 8064 | CUAACUUG GCCGAAAGGCGAGUGAGGUCU AUAAAUAG | 18724 |
| 5859 | UUAUGCAA G UUAGGGUC | 8065 | GACCCUAA GCCGAAAGGCGAGUGAGGUCU UUGCAUAA | 18725 |
| 5865 | AAGUUAGG G UCUAUGUA | 8066 | UACAUAGA GCCGAAAGGCGAGUGAGGUCU CCUAACUU | 18726 |
| 5871 | GGGUCUAU G UAUUUAGG | 8067 | CCUAAAUA GCCGAAAGGCGAGUGAGGUCU AUAGACCC | 18727 |
| 5882 | UUUAGGAU G UCUGCACC | 8072 | GGUGCAGA GCCGAAAGGCGAGUGAGGUCU AUCCUAAA | 18730 |
| 5886 | GGAUGUCU G CACCUUCU | 8073 | AGAAGGUG GCCGAAAGGCGACUGAGGUCU AGACAUCC | 18731 |
| 5895 | CACCUUCU G CAGCCAGU | 8074 | ACUGGCUG GCCGAAAGGCGAGUGAGGUCU AGAAGGUG | 18732 |
| 5898 | CUUCUGCA G CCAGUCAG | 8075 | CUGACUGG GCCGAAAGGCGAGUGAGGUCU UGCAGAAG | 18733 |
| 5902 | UGCAGCCA G UCAGAAGC | 8076 | GCUUCUGA GCCGAAAGGCGAGUGAGGUCU UGGCUGCA | 18734 |
| 5909 | AGUCAGAA G CUGGAGAG | 8077 | CUCUCCAG GCCGAAAGGCGAGUGAGGUCU UUCUGACU | 18735 |
| 5918 | CUGGAGAG G CAACAGUG | 8078 | CACUGUUG GCCGAAAGGCGAGUGAGGUCU CUCUCCAG | 18736 |
| 5924 | AGGCAACA G UGGAUUGC | 8080 | GCAAUCCA GCCGAAAGGCGAGUGAGGUCU UGUUGCCU | 18737 |
| 5931 | AGUGGAUU G CUGCUUCU | 8082 | AGAAGCAG GCCGAAAGGCGAGUGAGGUCU AAUCCACU | 18738 |
| 5934 | GGAUUGCU G CUUCUUGG | 8083 | CCAAGAAG GCCGAAAGGCGAGUGAGGUCU AGCAAUCC | 18739 |
| 5951 | GGAGAAGA G UAUGCUUC | 8084 | GAAGCAUA GCCGAAAGGCGAGUGAGGUCU UCUUCUCC | 18740 |
| 5955 | AAGAGUAU G CUUCCUUU | 8085 | AAAGGAAG GCCGAAAGGCGAGUGAGGUCU AUACUCUU | 18741 |
| 5971 | UUAUCCAU G UAAUUUAA | 8086 | UUAAAUUA GCCGAAAGGCGAGUGAGGUCU AUGGAUAA | 18742 |
| 5982 | AUUUAACU G UAGAACCU | 8089 | AGGUUCUA GCCGAAAGGCGAGUGAGGUCU AGUUAAAU | 18743 |
| 5993 | GAACCUGA G CUCUAAGU | 8091 | ACUUAGAG GCCGAAAGGCGAGUGAGGUCU UCAGGUUC | 18744 |
| 6000 | AGCUCUAA G UAACCGAA | 8092 | UUCGGUUA GCCGAAAGGCGAGUGAGGUCU UUAGAGCU | 18745 |
| 6013 | CGAAGAAU G UAUGCCUC | 8095 | GAGGCAUA GCCGAAAGGCGAGUGAGGUCU AUUCUUCG | 18746 |
| 6017 | GAAUGUAU G CCUCUGUU | 8096 | AACAGAGG GCCGAAAGGCGAGUGAGGUCU AUACAUUC | 18747 |
| 6023 | AUGCCUCU G UUCUUAUG | 8097 | CAUAAGAA GCCGAAAGGCGAGUGAGGUCU AGAGGCAU | 18748 |
| 6031 | GUUCUUAU G UGCACAU | 8098 | AUGUGGCA GCCGAAAGGCGAGUGAGGUCU AUAAGAAC | 18749 |
| 6033 | UCUUAUGU G CCACAUCC | 8099 | GGAUGUGG GCCGAAAGGCGAGUGAGGUCU ACAUAAGA | 18750 |
| 6044 | ACAUCCUU G UUUAAAGG | 8100 | CCUUUAAA GCCGAAAGGCGAGUGAGGUCU AAGGAUGU | 18751 |
| 6052 | GUUUAAAG G CUCUCUGU | 8101 | ACAGAGAG GCCGAAAGGCGAGUGAGGUCU CUUUAAAC | 18752 |
| 6059 | GGCUCUCU G UAUGAAGA | 8102 | UCUUCAUA GCCGAAAGGCGAGUGAGGUCU AGAGAGCC | 18753 |
| 6077 | AUGGGACC G UCAUCAGC | 8105 | GCUGAUGA GCCGAAAGGCGAGUGAGGUCU GGUCCCAU | 18754 |
| 6084 | CGUCAUCA G CACAUUCC | 8106 | GGAAUGUG GCCGAAAGGCGAGUGAGGUCU UGAUGACG | 18755 |
| 6096 | AUUCCCUA G UGAGCCUA | 8107 | UAGGCUCA GCCGAAAGGCGAGUGAGGUCU UAGGGAAU | 18756 |
| 6100 | CCUAGUGA G CCUACUGG | 8108 | CCAGUAGG GCCGAAAGGCGAGUGAGGUCU UCACUAGG | 18757 |
| 6108 | GCCUACUG G CUCCUGGC | 8109 | GCCAGGAG GCCGAAAGGCGAGUGAGGUCU CAGUAGGC | 18758 |
| 6115 | GGCUCCUG G CAGCGGCU | 8110 | AGCCGCUG GCCGAAAGGCGAGUGAGGUCU CAGGAGCC | 18759 |
| 6118 | UCCUGGCA G CGGCUUUU | 8111 | AAAAGCCG GCCGAAAGGCGAGUGAGGUCU UGCCAGGA | 18760 |

TABLE XIX-continued

Human FLT Zinzyme and Substrate Sequence

| Pos | Substrate | Seq ID No | Zinzyme | Seq ID No |
|---|---|---|---|---|
| 6121 | UGGCAGCG G CUUUUGUG | 8112 | CACAAAAG GCCGAAAGGCGAGUGAGGUCU CGCUGCCA | 18761 |
| 6127 | CGGCUUUU G UGGAAGAC | 8113 | GUCUUCCA GCCGAAAGGCGAGUGAGGUCU AAAAGCCG | 18762 |
| 6142 | ACUCACUA G CCAGAAGA | 8115 | UCUUCUGG GCCGAAAGGCGAGUGAGGUCU UAGUGAGU | 18763 |
| 6156 | AGAGAGGA G UGGGACAG | 8116 | CUGUCCCA GCCGAAAGGCGAGUGAGGUCU UCCUCUCU | 18764 |
| 6164 | GUGGGACA G UCCUCUCC | 8118 | GGAGAGGA GCCGAAAGGCGAGUGAGGUCU UGUCCCAC | 18765 |
| 6197 | AAACAAAA G CAGGCUAG | 8122 | CUAGCCUG GCCGAAAGGCGAGUGAGGUCU UUUUGUUU | 18766 |
| 6201 | AAAAGCAG G CUAGAGCC | 8123 | GGCUCUAG GCCGAAAGGCGAGUGAGGUCU CUGCUUUU | 18767 |
| 6207 | AGGCUAGA G CCAGAAGA | 8124 | UCUUCUGG GCCGAAAGGCGAGUGAGGUCU UCUAGCCU | 18768 |
| 6230 | AAAUCUUU G UUGUUCCU | 8127 | AGGAACAA GCCGAAAGGCGAGUGAGGUCU AAAGAUUU | 18769 |
| 6233 | UCUUUGUU G UUCCUCUU | 8128 | AAGAGGAA GCCGAAAGGCGAGUGAGGUCU AACAAAGA | 18770 |
| 6254 | ACACAUAC G CAAACCAC | 8129 | GUGGUUUG GCCGAAAGGCGAGUGAGGUCU GUAUGUGU | 18771 |
| 6265 | AACCACCU G UGACAGCU | 8131 | AGCUGUCA GCCGAAAGGCGAGUGAGGUCU AGGUGGUU | 18772 |
| 6271 | CUGUGACA G CUGGCAAU | 8133 | AUUGCCAG GCCGAAAGGCGAGUGAGGUCU UGUCACAG | 18773 |
| 6275 | GACAGCUG G CAAUUUUA | 8134 | UAAAAUUG GCCGAAAGGCGAGUGAGGUCU CAGCUGUC | 18774 |
| 6292 | UAAAUCAG G UAACUGGA | 8137 | UCCAGUUA GCCGAAAGGCGAGUGAGGUCU CUGAUUUA | 18775 |
| 6306 | GGAAGGAG G UUAAACUC | 8139 | GAGUUUAA GCCGAAAGGCGAGUGAGGUCU CUCCUUCC | 18776 |
| 6333 | AGACCUCA G UCAAUUCU | 8142 | AGAAUUGA GCCGAAAGGCGAGUGAGGUCU UGAGGUCU | 18777 |
| 6377 | AGAUAAUA G CCCAGCAA | 8147 | UUGCUGGG GCCGAAAGGCGAGUGAGGUCU UAUUAUCU | 18778 |
| 6382 | AUAGCCCA G CAAAUAGU | 8148 | ACUAUUUG GCCGAAAGGCGAGUGAGGUCU UGGGCUAU | 18779 |
| 6389 | AGCAAAUA G UGAUAACA | 8150 | UGUUAUCA GCCGAAAGGCGAGUGAGGUCU UAUUUGCU | 18780 |
| 6410 | AAACCUUA G CUGUUCAU | 8155 | AUGAACAG GCCGAAAGGCGAGUGAGGUCU UAAGGUUU | 18781 |
| 6413 | CCUUAGCU G UUCAUGUC | 8156 | GACAUGAA GCCGAAAGGCGAGUGAGGUCU AGCUAAGG | 18782 |
| 6419 | CUGUUCAU G UCUUGAUU | 8157 | AAUCAAGA GCCGAAAGGCGAGUGAGGUCU AUGAACAG | 18783 |
| 6487 | AGAGAAAA G CAAAACCA | 8166 | UGGUUUUG GCCGAAAGGCGAGUGAGGUCU UUUUCUCU | 18784 |
| 6504 | UUAGAAUU G UUACUCAG | 8169 | CUGAGUAA GCCGAAAGGCGAGUGAGGUCU AAUUCUAA | 18785 |
| 6512 | GUUACUCA G CUCCUUCA | 8170 | UGAAGGAG GCCGAAAGGCGAGUGAGGUCU UGAGUAAC | 18786 |
| 6528 | AAACUCAG G UUUGUAGC | 8172 | GCUACAAA GCCGAAAGGCGAGUGAGGUCU CUGAGUUU | 18787 |
| 6532 | UCAGGUUU G UAGCAUAC | 8173 | GUAUGCUA GCCGAAAGGCGAGUGAGGUCU AAACCUGA | 18788 |
| 6535 | GGUUUGUA G CAUACAUG | 8174 | CAUGUAUG GCCGAAAGGCGAGUGAGGUCU UACAAACC | 18789 |
| 6545 | AUACAUGA G UCCAUCCA | 8175 | UGGAUGGA GCCGAAAGGCGAGUGAGGUCU UCAUGUAU | 18790 |
| 6557 | AUCCAUCA G UCAAAGAA | 8176 | UUCUUUGA GCCGAAAGGCGAGUGAGGUCU UGAUGGAU | 18791 |
| 6568 | AAAGAAUG G UUCCAUCU | 8178 | AGAUGGAA GCCGAAAGGCGAGUGAGGUCU CAUUCUUU | 18792 |
| 6580 | CAUCUGGA G UCUUAAUG | 8179 | CAUUAAGA GCCGAAAGGCGAGUGAGGUCU UCCAGAUG | 18793 |
| 6588 | GUCUUAAU G UAGAAAGA | 8181 | UCUUUCUA GCCGAAAGGCGAGUGAGGUCU AUUAAGAC | 18794 |
| 6610 | GGAGACUU G UAAUAAUG | 8184 | CAUUAUUA GCCGAAAGGCGAGUGAGGUCU AAGUCUCC | 18795 |
| 6620 | AAUAAUGA G CUAGUCAC | 8187 | GUAACUAG GCCGAAAGGCGAGUGAGGUCU UCAUUAUU | 18796 |
| 6624 | AUGAGCUA G UUACAAAG | 8188 | CUUUGUAA GCCGAAAGGCGAGUGAGGUCU UAGCUCAU | 18797 |

TABLE XIX-continued

Human FLT Zinzyme and Substrate Sequence

| Pos | Substrate | Seq ID No | Zinzyme | Seq ID No |
|---|---|---|---|---|
| 6632 | GUUACAAA G UGCUUGUU | 8189 | AACAAGCA GCCGAAAGGCGAGUGAGGUCU UUUGUAAC | 18798 |
| 6634 | UACAAAGU G CUUGUUCA | 8190 | UGAACAAG GCCGAAAGGCGAGUGAGGUCU ACUUUGUA | 18799 |
| 6638 | AAGUGCUU G UUCAUUAA | 8191 | UUAAUGAA GCCGAAAGGCGAGUGAGGUCU AAGCACUU | 18800 |
| 6651 | UUAAAAUA G CACUGAAA | 8193 | UUUCAGUG GCCGAAAGGCGAGUGAGGUCU UAUUUUAA | 18801 |
| 6698 | AAUCAUUU G CCAUUUAU | 8201 | AUAAAUGG GCCGAAAGGCGAGUGAGGUCU AAAUGAUU | 18802 |
| 6717 | CAAAAAUG G UUGGCACU | 8204 | AGUGCCAA GCCGAAAGGCGAGUGAGGUCU CAUCUUUG | 18803 |
| 6721 | AAUGGUUG G CACUAACA | 8205 | UGUUAGUG GCCGAAAGGCGAGUGAGGUCU CAACCAUU | 18804 |
| 6738 | AAGAACGA G CACUUCCU | 8208 | AGGAAGUG GCCGAAAGGCGAGUGAGGUCU UCGUUCUU | 18805 |
| 6753 | CUUUCAGA G UCUCUGAG | 8209 | CUCAGAAA GCCGAAAGCCGAGUGAGGUCU UCUGAAAG | 18806 |
| 6767 | GAGAUAAU G UACGUGGA | 8212 | UCCACGUA GCCGAAAGGCGAGUGAGGUCU AUUAUCUC | 18807 |
| 6771 | UAAUGUAC G UGGAACAG | 8213 | CUGUUCCA GCCGAAAGGCGAGUGAGGUCU GUACAUUA | 18808 |
| 6779 | GUGGAACA G UCUGGGUG | 8215 | CACCCAGA GCCGAAAGGCGAGUGAGGUCU UGUUCCAC | 18809 |
| 6785 | CAGUCUGG G UGGAAUGG | 8216 | CCAUUCCA GCCGAAAGGCGAGUGAGGUCU CCAGACUG | 18810 |
| 6795 | GGAAUGGG G CUGAAACC | 8218 | GGUUUCAG GCCGAAAGGCGAGUGAGGUCU CCCAUUCC | 18811 |
| 6806 | GAAACCAU G UGCAAGUC | 8220 | GACUUGCA GCCGAAAGGCGAGUGAGGUCU AUGGUUUC | 18812 |
| 6808 | AACCAUGU G CAAGUCUG | 8221 | CAGACUUG GCCGAAAGGCGAGUGAGGUCU ACAUGGUU | 18813 |
| 6812 | AUGUGCAA G UCUGUGUC | 8222 | GACACAGA GCCGAAAGGCGAGUGAGGUCU UUGCACAU | 18814 |
| 6816 | GCAAGUCU G UGUCUUGU | 8223 | ACAAGACA GCCGAAAGGCGAGUGAGGUCU AGACUUGC | 18815 |
| 6818 | AAGUCUGU G UCUUGUCA | 8224 | UGACAAGA GCCGAAAGGCGAGUGAGGUCU ACAGACUU | 18816 |
| 6823 | UGUGUCUU G UCAGUCCA | 8225 | UGGACUGA GCCGAAAGGCGAGUGAGGUCU AAGACACA | 18817 |
| 6827 | UCUUGUCA G UCCAAGAA | 8226 | UUCUUGGA GCCGAAAGGCGAGUGAGGUCU UGACAAGA | 18818 |
| 6836 | UCCAAGAA G UGACACCG | 8227 | CGGUGUCA GCCGAAAGGCGAGUGAGGUCU UUCUUGGA | 18819 |
| 6849 | ACCGAGAU G UUAAUUUU | 8230 | AAAAUUAA GCCGAAAGGCGAGUGAGGUCU AUCUCGGU | 18820 |
| 6866 | AGGGACCC G UGCCUUGU | 8233 | ACAAGGCA GCCGAAAGGCGAGUGAGGUCU GGGUCCCU | 18821 |
| 6868 | GGACCCGU G CCUUGUUU | 8234 | AAACAAGG GCCGAAAGGCGAGUGAGGUCU ACGGGUCC | 18822 |
| 6873 | CGUGCCUU G UUUCCUAG | 8235 | CUAGGAAA GCCGAAAGGCGAGUGAGGUCU AAGGCACG | 18823 |
| 6881 | GUUUCCUA G CCCACAAG | 8236 | CUUGUGGG GCCGAAAGGCGAGUGAGGUCU UAGGAAAC | 18824 |
| 6893 | ACAAGAAU G CAAACAUC | 8238 | GAUGUUUG GCCGAAAGGCGAGUGAGGUCU AUUCUUGU | 18825 |
| 6914 | AGAUACUC G CUAGCCUC | 8242 | GAGGCUAG GCCGAAAGGCGAGUGAGGUCU CAGUAUCU | 18826 |
| 6918 | ACUCGCUA G CCUCAUUU | 8243 | AAAUGAGG GCCGAAAGGCGAGUGAGGUCU UAGCGAGU | 18827 |
| 6945 | AAGGAGGA G UGCAUCUU | 8246 | AAGAUGCA GCCGAAAGGCGAGUGAGGUCU UCCUCCUU | 18828 |
| 6947 | GGAGGAGU G CAUCUUUG | 8247 | CAAAGAUG GCCGAAAGGCGAGUGAGGUCU ACUCCUCC | 18829 |
| 6956 | CAUCUUUG G CCGACAGU | 8248 | ACUGUCGG GCCGAAAGGCGAGUGAGGUCU CAAAGAUG | 18830 |
| 6963 | GGCCGACA G UGGUGUAA | 8250 | UUACACCA GCCGAAAGGCGAGUGAGGUCU UGUCGGCC | 18831 |
| 6966 | CGACAGUG G UGUAACUG | 8251 | CAGUUACA GCCGAAAGGCGAGUGAGGUCU CACUGUCG | 18832 |
| 6968 | ACAGUGGU G UAACUGUG | 8252 | CACAGUUA GCCGAAAGGCGAGUGAGGUCU ACCACUGU | 18833 |
| 6974 | GUGUAACU G UGUGUGUG | 8254 | CACACACA GCCGAAAGGCGAGUGAGGUCU AGUUACAC | 18834 |

TABLE XIX-continued

Human FLT Zinzyme and Substrate Sequence

| Pos | Substrate | Seq ID No | Zinzyme | Seq ID No |
|---|---|---|---|---|
| 6976 | GUAACUGU G UGUGUGUG | 8255 | CACACACA GCCGAAAGGCGAGUGAGGUCU ACAGUUAC | 18835 |
| 6978 | AACUGUGU G UGUGUGUG | 8256 | CACACACA GCCGAAAGGCGAGUGAGGUCU ACACAGUU | 18836 |
| 6980 | CUGUGUGU G UGUGUGUG | 8257 | CACACACA GCCGAAAGGCGAGUGAGGUCU ACACACAG | 18837 |
| 6982 | GUGUGUGU G UGUGUGUG | 8258 | CACACACA GCCGAAAGGCGAGUGAGGUCU ACACACAC | 18838 |
| 6984 | GUGUGUGU G UGUGUGUG | 8258 | CACACACA GCCGAAAGGCGAGUGAGGUCU ACACACAC | 18838 |
| 6986 | GUGUGUGU G UGUCUGUG | 8258 | CACACACA GCCGAAAGGCGAGUGAGGUCU ACACACAC | 18838 |
| 6988 | GUGUGUGU G UGUGUGUG | 8258 | CACACACA GCCGAAAGGCGAGUGAGGUCU ACACACAC | 18838 |
| 6990 | GUGUGUGU G UGUGUGUG | 8258 | CACACACA GCCGAAAGGCGAGUGAGGUCU ACACACAC | 18838 |
| 6992 | GUGUGUGU G UGUGUGUG | 8258 | CACACACA GCCGAAAGGCGAGUGAGGUCU ACACACAC | 18838 |
| 6994 | GUGUGUGU G UGUGUGUG | 8258 | CACACACA GCCGAAAGGCGAGUGAGGUCU ACACACAC | 18838 |
| 6996 | GUGUGUGU G UGUGUGUG | 8258 | CACACACA GCCGAAAGGCGAGUGAGGUCU ACACACAC | 18838 |
| 6998 | GUGUGUGU G UGUGUGUG | 8258 | CACACACA GCCGAAAGGCGAGUGAGGUCU ACACACAC | 18838 |
| 7000 | GUCUGUGU G UGUGUGUC | 8258 | CACACACA GCCGAAAGGCGAGUGAGGUCU ACACACAC | 18838 |
| 7002 | GUGUGUGU G UGUGUGUG | 8258 | CACACACA GCCGAAAGGCGAGUGAGGUCU ACACACAC | 18838 |
| 7004 | GUGUGUGU G UGUCUGUG | 8258 | CACACACA GCCGAAAGGCGAGUGAGCUCU ACACACAC | 18838 |
| 7006 | GUGUGUGU G UGUCUGUG | 8258 | CACACACA GCCGAAAGGCGAGUGAGGUCU ACACACAC | 18838 |
| 7008 | GUGUGUGU G UGUGUGGG | 8259 | CCCACACA GCCGAAAGGCGAGUGAGGUCU ACACACAC | 18839 |
| 7010 | GUGUGUGU G UGUGGGUG | 8260 | CACCCACA GCCGAAAGGCGAGUGAGGUCU ACACACAC | 18840 |
| 7012 | GUGUGUGU G UGGGUGUG | 8261 | CACACCCA GCCGAAAGGCGAGUGAGGUCU ACACACAC | 18841 |
| 7016 | GUGUGUGG G UGUGGGUG | 8262 | CACCCACA GCCGAAAGGCGAGUGAGGUCU CCACACAC | 18842 |
| 7018 | GUGUGGGU G UGGGUGUA | 8263 | UACACCCA GCCGAAAGGCGAGUGAGGUCU ACCCACAC | 18843 |
| 7022 | GGGUGUGG G UGUAUGUG | 8264 | CACAUACA GCCGAAAGGCGAGUGAGGUCU CCACACCC | 18844 |
| 7024 | GUGUGGGU G UAUGUGUG | 8265 | CACACAUA GCCGAAAGGCGAGUGAGGUCU ACCCACAC | 18845 |
| 7028 | GGGUGUAU G UGUGUUUU | 8266 | AAAACACA GCCGAAAGGCGAGUGAGGUCU AUACACCC | 18846 |
| 7030 | GUGUAUGU G UGUUUUGU | 8267 | ACAAAACA GCCGAAAGGCGAGUGAGGUCU ACAUACAC | 18847 |
| 7032 | GUAUGUGU G UUUUGUGC | 8268 | GCACAAAA GCCGAAAGGCGAGUGAGGUCU ACACAUAC | 18848 |
| 7037 | UGUGUUUU G UGCAUAAC | 8269 | GUUAUGCA GCCGAAAGGCGAGUGAGGUCU AAAACACA | 18849 |
| 7039 | UGUUUUGU G CAUAACUA | 8270 | UAGUUAUG GCCGAAAGGCGAGUGAGGUCU ACAAAACA | 18850 |
| 7071 | AUUUUAAA G UUACUUUU | 8274 | AAAAGUAA GCCGAAAGGCGAGUGAGGUCU UUUAAAAU | 18851 |
| 7099 | GAAUAUAU G CUACAGAU | 8277 | AUCUGUAG GCCGAAAGGCGAGUGAGGUCU AUAUAUUC | 18852 |
| 7122 | CAGACAUG G UUUGGUCC | 8281 | GGACCAAA GCCGAAAGGCGAGUGAGGUCU CAUGUCUG | 18853 |
| 7127 | AUGGUUUG G UCCUAUAU | 8282 | AUAUAGGA GCCGAAAGGCGAGUGAGGUCU CAAACCAU | 18854 |
| 7141 | UAUUUCUA G UCAUGAUG | 8283 | CAUCAUGA GCCGAAAGGCGAGUGAGGUCU UAGAAAUA | 18855 |
| 7153 | UGAUGAAU G UAUUUUGU | 8286 | ACAAAAUA GCCGAAAGGCGAGUGAGGUCU AUUCAUCA | 18856 |
| 7160 | UGUAUUUU G UAUACCAU | 8287 | AUGGUAUA GCCGAAAGGCGAGUGAGGUCU AAAAUACA | 18857 |
| 7210 | UGGGAUUU G UAAUCGUA | 8292 | UACGAUUA GCCGAAAGGCGAGUGAGGUCU AAAUCCCA | 18858 |
| 7216 | UUGUAAUC G UACCAACU | 8294 | AGUUGGUA GCCGAAAGGCGAGUGAGGUCU GAUUACAA | 18859 |

TABLE XIX-continued

Human FLT Zinzyme and Substrate Sequence

| Pos | Substrate | Seq ID No | Zinzyme | Seq ID No |
|---|---|---|---|---|
| 7240 | UAAACUUG G CAACUGCU | 8299 | AGCAGUUG GCCGAAAGGCGAGUGAGGUCU CAAGUUUA | 18860 |
| 7246 | UGGCAACU G CUUUUAUG | 8301 | CAUAAAAG GCCGAAAGGCGAGUGAGGUCU AGUUGCCA | 18861 |
| 7254 | GCUUUUAU G UUCUGUCU | 8302 | AGACAGAA GCCGAAAGGCGAGUGAGGUCU AUAAAAGC | 18862 |
| 7259 | UAUGUUCU G UCUCCUUC | 8303 | GAAGGAGA GCCGAAAGGCGAGUGAGGUCU AGAACAUA | 18863 |
| 7305 | AAGAAAAA G CUCUUUUU | 8308 | AAAAAGAG GCCGAAAGGCGAGUGAGGUCU UUUUUCUU | 18864 |
| 7343 | UUAUCCUU G UUUAGAGC | 8312 | GCUCUAAA GCCGAAAGGCGAGUGAGGUCU AAGGAUAA | 18865 |
| 7350 | UGUUUAGA G CAGAGAAA | 8313 | UUUCUCUG GCCGAAAGGCGAGUGAGGUCU UCUAAACA | 18866 |
| 7381 | UUGAAAUG G UCUCAAAA | 8317 | UUUUGAGA GCCGAAAGGCGAGUGAGGUCU CAUUUCAA | 18867 |
| 7394 | AAAAAAUU G CUAAAUAU | 8319 | AUAUUUAG GCCGAAAGGCGAGUGAGGUCU AAUUUUUU | 18868 |
| 7422 | AACUAAAU G UUAGUUUA | 8324 | UAAACUAA GCCGAAAGGCGAGUGAGGUCU AUUUAGUU | 18869 |
| 7426 | AAAUGUUA G UUUAGCUG | 8325 | CAGCUAAA GCCGAAAGGCGAGUGAGGUCU UAACAUUU | 18870 |
| 7431 | UUAGUUUA G CUGAUUGU | 8326 | ACAAUCAG GCCGAAAGGCGAGUGAGGUCU UAAACUAA | 18871 |
| 7438 | AGCUGAUU G UAUGGGGU | 8328 | ACCCCAUA GCCGAAAGGCGAGUGAGGUCU AAUCAGCU | 18872 |
| 7445 | UGUAUGGG G UUUUCGAA | 8329 | UUCGAAAA GCCGAAAGGCGAGUGAGGUCU CCCAUACA | 18873 |
| 7467 | CACUUUUU G UUUGUUUU | 8331 | AAAACAAA GCCGAAAGGCGAGUGAGGUCU AAAAAGUG | 18874 |
| 7471 | UUUUGUUU G UUUUACCU | 8332 | AGGUAAAA GCCGAAAGGCGAGUGAGGUGU AAACAAAA | 18875 |
| 7491 | UCACAACU G UGUAAAUU | 8334 | AAUUUACA GCCGAAAGGCGAGUGAGGUCU AGUUGUGA | 18876 |
| 7493 | ACAACUGU G UAAAUUGC | 8335 | GCAAUUUA GCCGAAAGGCGAGUGAGGUCU ACAGUUGU | 18877 |
| 7500 | UGUAAAUU G CCAAUAAU | 8337 | AUUAUUGG GCCGAAAGGCGAGUGAGGUCU AAUUUACA | 18878 |
| 7513 | UAAUUCCU G UCCAUGAA | 8340 | UUCAUGGA GCCGAAAGGCGAGUGAGGUCU AGGAAUUA | 18879 |
| 7525 | AUGAAAAU G CAAAUUAU | 8342 | AUAAUUUG GCCGAAAGGCGAGUGAGGUCU AUUUUCAU | 18880 |
| 7537 | AUUAUCCA G UGUAGAUA | 8344 | UAUCUACA GCCGAAAGGCGAGUGAGGUCU UGGAUAAU | 18881 |
| 7539 | UAUCCAGU G UAGAUAUA | 8345 | UAUAUCUA GCCGAAAGGCGAGUGAGGUCU ACUGGAUA | 18882 |
| 7573 | GGAUAUUG G CUAGUUUU | 8349 | AAAACUAG GCCGAAAGGCGAGUGAGGUCU CAAUAUCC | 18883 |
| 7577 | AUUGGCUA G UUUUGCCU | 8350 | AGGCAAAA GCCGAAAGGCGAGUGAGGUCU UAGCCAAU | 18884 |
| 7582 | CUAGUUUU G CCUUUAUU | 8351 | AAUAAAGG GCCGAAAGGCGAGUGAGGUCU AAAACUAG | 18885 |
| 7593 | UUUAUUAA G CAAAUUCA | 8352 | UGAAUUUG GCCGAAAGGCGAGUGAGGUCU UUAAUAAA | 18886 |
| 7607 | UCAUUUCA G CCUGAAUG | 8354 | CAUUCAGG GCCGAAAGGCGAGUGAGGUCU UGAAAUGA | 18887 |
| 7615 | GCCUGAAU G UCUGCCUA | 8356 | UAGGCAGA GCCGAAAGGCGAGUGAGGUCU AUUCAGGC | 18888 |
| 7619 | GAAUGUCU G CCUAUAUA | 8357 | UAUAUAGG GCCGAAAGGCGAGUGAGGUCU AGACAGUC | 18889 |
| 7634 | UAUUCUCU G CUCUUUGU | 8358 | ACAAAGAG GCCGAAAGGCGAGUGAGGUCU AGAGAAUA | 18890 |
| 7641 | UGCUCUUU G UAUUCUCC | 8359 | GGAGAAUA GCCGAAAGGCGAGUGAGGUCU AAAGAGCA | 18891 |
| 7659 | UUGAACCC G UUAAAACA | 8361 | UGUUUUAA GCCGAAAGGCGAGUGAGGUCU GGGUUCAA | 18892 |
| 7672 | AACAUCCU G UGGCACUC | 8363 | GAGUGCCA GCCGAAAGGCGAGUGAGGUCU AGGAUGUU | 18893 |

Input Sequence = HSFLT. Cut Site = G/Y
Arm Length = 8. Core Sequence = GCcgaaagGCGaGuCaaGGuCu (SEQ ID NO. 20829).
HSFLT (Human flt mRNA for receptor-related tyrosine kinase; Acc# X51602; 7680 bp)

TABLE XX

Patient Demographics

| Dose cohort (mg/m²) | Pt# | Age | Sex | Diagnosis | Status | Doses |
|---|---|---|---|---|---|---|
| 10 | 1001 | 49 | F | NSC Lung | PD | 29 |
| 10 | 1002 | 65 | F | liposarcoma | PD | 120 |
| 10 | 1003 | 49 | M | nasopharyngeal CA | WD | 109 |
| 30 | 1004* | | | | | |
| 30 | 1005 | 45 | F | melanoma (ocular) | PD | 113 |
| 30 | 1006 | 57 | M | colon | PD | 199 |
| 30 | 1007 | 39 | F | epitheliod hemangioendothelioma | PD | 198 |
| 100 | 1008 | 52 | M | adrenal ca | PD | 57 |
| 100 | 1009 | 44 | F | breast | PD | 35 |
| 100 | 1010 | 62 | F | renal | PD | 134 |
| 300 | 1011 | 24 | F | melanoma | PD | 31 |
| 300 | 1012 | 57 | M | renal cell | PD | 178 |
| 300 | 1013 | 53 | M | nasopharyngeal SCCA | PD | 29 |
| 300 | 1014 | 64 | F | peritoneal mesothelioma | stable | 236** |
| 100 | 1015 | 65 | M | melanoma | PD | 140 |
| 100 | 1016 | 77 | F | breast | stable | 231** |
| 100 | 1017 | | F | melanoma | PD | 35 |
| 100 | 1018* | | | | | |
| 100 | 1019 | 69 | F | endometrial sarcoma | stable | 212** |
| 100 | 1020 | 65 | M | carcinoid | PD | 124 |
| 100 | 1021 | 59 | M | gallbladder adeno carcinoma | PD | 34 |
| 100 | 1022* | | | | | |
| 100 | 1023 | 78 | F | breast | PD | 50 |
| 100 | 1024 | 40 | F | parotid adenocarcinoma | stable | 161** |
| 100 | 1025 | 52 | F | breast | WD | 71 |
| 100 | 1026 | 39 | F | breast | PD | 34 |
| 100 | 1027 | 55 | F | breast | PD | 36 |
| 100 | 1028 | 52 | M | melanoma | PD | 29 |
| 100 | 1029 | 38 | M | pancreatic | PD | 36 |
| 100 | 1030 | 83 | M | melanoma | PD | 41 |
| 100 | 1031 | 50 | M | medullary thyroid | WD | 108 |

PD = progressive disease; WD = withdrawal. 4 patients remain on study.
*Inappropriate enrollment, patient withdrawn
**As of Jan. 11, 2000

TABLE XXI

Pharmacokinetic parameters of ANGIOZYME after bolus subcutaneous administration.

| | 10 mg/m² | | 30 mg/m² | | 100 mg/m² | | 300 mg/m² | |
|---|---|---|---|---|---|---|---|---|
| | Mean | SD | Mean | SD | Mean | SD | Mean | SD |
| Day 1 | | | | | | | | |
| Cmax (ug/mL) | 0.43 | 0.07 | 0.62 | 0.28 | 3.17 | 0.69 | 8.91 | 2.93 |
| AUCt (ug*hr/mL) | 2.60 | 1.43 | 6.04 | 2.70 | 34.14 | 2.28 | 89.87 | 21.68 |
| AUCinf (ug*hr/mL) | 4.40 | 0.06 | 7.99 | 1.66 | 37.51 | 1.91 | 101.57 | 13.47 |
| t(1/2) (hr) | 3.62 | 0.79 | 7.32 | 6.94 | 4.58 | 0.02 | 9.26 | 6.20 |
| CL/F (L/hr/m²) | 2.24 | 0.08 | 3.73 | 0.92 | 2.96 | 0.61 | 2.99 | 0.43 |
| Day 29 | | | | | | | | |
| Cmax (ug/mL) | 0.35 | 0.19 | 1.17 | 0.53 | 3.23 | 0.35 | 8.93 | 6.71 |
| AUCt (ug*hr/mL) | 2.11 | 1.31 | 7.29 | 1.16 | 31.87 | 1.91 | 119.42 | 65.84 |
| AUCinf (ug*hr/mL) | 3.38 | 1.31 | 8.54 | 2.46 | 33.61 | 2.16 | 132.73 | 67.82 |
| t(1/2) (hr) | 4.49 | 1.60 | 3.26 | 1.01 | 4.66 | 0.35 | 7.24 | 0.70 |
| CL/F (L/hr/m²) | 2.49 | 1.48 | 3.69 | 0.94 | 3.21 | 0.56 | 2.72 | 1.40 |

TABLE XXII

Human KDR DNAzyme and Substrate sequence

| Pos | Substrate | Seq ID No | DNAzyme | Seq ID No |
|---|---|---|---|---|
| 14 | GUCCCGGG A CCCCGGGA | 8364 | TCCCGGGG GGCTAGCTACAACGA CCCGGGAC | 18894 |
| 25 | CCGGGAGA G CGGUCAGU | 8365 | ACTGACCG GGCTAGCTACAACGA TCTCCCGG | 18895 |
| 28 | GGAGAGCG G UCAGUGUG | 8366 | CACACTGA GGCTAGCTACAACGA CGCTCTCC | 18896 |
| 32 | AGCGGUCA G UGUGGUGGU | 8367 | ACCACACA GGCTAGCTACAACGA TGACCGCT | 18897 |
| 34 | CGGUCAGU G UGGUCG | 8368 | CGACCACA GGCTAGCTACAACGA ACTGACCG | 18898 |
| 36 | GUCAGUGU G UGGUCGCU | 8369 | AGCGACCA GGCTAGCTACAACGA ACACTGAC | 18899 |
| 39 | AGUGUGUG G UCGCUGCG | 8370 | CGCAGCGA GGCTAGCTACAACGA CACACACT | 18900 |
| 42 | GUGUGGUC G CUGCGUUU | 8371 | AAACGCAG GGCTAGCTACAACGA GACCACAC | 18901 |
| 45 | UGGUCGCU G CGUUUCCU | 8372 | AGGAAACG GGCTAGCTACAACGA AGCGACCA | 18902 |
| 47 | GUCGCUGC G UUUCCUCU | 8373 | AGAGGAAA GGCTAGCTACAACGA GCAGCGAC | 18903 |

TABLE XXII-continued

Human KDR DNAzyme and Substrate sequence

| Pos | Substrate | Seq ID No | DNAzyme | Seq ID No |
|---|---|---|---|---|
| 56 | UUUCCUCU G CCUGCGCC | 8374 | GGCGCAGG GGCTAGCTACAACGA AGAGGAAA | 18904 |
| 60 | CUCUGCCU G CGCCGGGC | 8375 | GCCCGGCG GGCTAGCTACAACGA AGGCAGAG | 18905 |
| 62 | CUGCCUGC G CCGGGCAU | 8376 | ATGCCCGG GGCTAGCTACAACGA GCAGGCAG | 18906 |
| 67 | UGCGCCGG G CAUCACUU | 8377 | AAGTGATG GGCTAGCTACAACGA CCGGCGCA | 18907 |
| 69 | CGCCGGGC A UCACUUGC | 8378 | GCAAGTGA GGCTAGCTACAACGA GCCCGGCG | 18908 |
| 72 | CGGGCAUC A CUUGCGCG | 8379 | CGCGCAAG GGCTAGCTACAACGA GATGCCCG | 18909 |
| 76 | CAUCACUU G CGCCGCGC | 8380 | GCGGCGCG GGCTAGCTACAACGA AAGTGATG | 18910 |
| 78 | UCACUUGC G CGCCGCAG | 8381 | CTGCGGCG GGCTAGCTACAACGA GCAAGTGA | 18911 |
| 80 | ACUUGCGC G CCGCAGAA | 8382 | TTCTGCGG GGCTAGCTACAACGA GCGCAAGT | 18912 |
| 83 | UGCGCGCC G CAGAAAGU | 8383 | ACTTTCTG GGCTAGCTACAACGA GGCGCGCA | 18913 |
| 90 | CGCAGAAA G UCCGUCUG | 8384 | CAGACGGA GGCTAGCTACAACGA TTTCTGCG | 18914 |
| 94 | GAAAGUCC G UCUGGCAG | 8385 | CTGCCAGA GGCTAGCTACAACGA GGACTTTC | 18915 |
| 99 | UCCGUCUG G CAGCCUGG | 8386 | CCAGGCTG GGCTAGCTACAACGA CAGACGGA | 18916 |
| 102 | GUCUGGCA G CCUGGAUA | 8387 | TATCCAGG GGCTAGCTACAACGA TGCCAGAC | 18917 |
| 108 | CAGCCUGG A UAUCCUCU | 8388 | AGAGGATA GGCTAGCTACAACGA CCAGGCTG | 18918 |
| 110 | GCCUGGAU A UCCUCUCC | 8389 | GGAGAGGA GGCTAGCTACAACGA ATCCAGGC | 18919 |
| 120 | CCUCUCCU A CCGGCACC | 8390 | GGTGCCGG GGCTAGCTACAACGA AGGAGAGG | 18920 |
| 124 | UCCUACCG G CACCCGCA | 8391 | TGCGGGTG GGCTAGCTACAACGA CGGTAGGA | 18921 |
| 126 | CUACCGGC A CCCGCAGA | 8392 | TCTGCGGG GGCTAGCTACAACGA GCCGGTAG | 18922 |
| 130 | CGGCACCC G CAGACGCC | 8393 | GGCGTCTG GGCTAGCTACAACGA GGGTGCCG | 18923 |
| 134 | ACCCGCAG A CGCCCUG | 8394 | CAGGGGCG GGCTAGCTACAACGA CTGCGGGT | 18924 |
| 136 | CCGCAGAC G CCCCUGCA | 8395 | TGCAGGGG GGCTAGCTACAACGA GTCTGCGG | 18925 |
| 142 | ACGCCCCU G CAGCCGCC | 8396 | GGCGGCTG GGCTAGCTACAACGA AGGGGCGT | 18926 |
| 145 | CCCCUGCA G CCGCCGGU | 8397 | ACCGGCGG GGCTAGCTACAACGA TGCAGGGG | 18927 |
| 148 | CUGCAGCC G CCGGUCGG | 8398 | CCGACCGG GGCTAGCTACAACGA GGCTGCAG | 18928 |
| 152 | AGCCGCCG G UCGGCGCC | 8399 | GGCGCCGA GGCTAGCTACAACGA CGGCGGCT | 18929 |
| 156 | GCCGGUCG G CGCCCGGG | 8400 | CCCGGGCG GGCTAGCTACAACGA CGACCGGC | 18930 |
| 158 | CGGUCGGC G CCCGGGCU | 8401 | AGCCCGGG GGCTAGCTACAACGA GCCGACCG | 18931 |
| 164 | GCGCCCGG G CUCCCUAG | 8402 | CTAGGGAG GGCTAGCTACAACGA CCGGGCGC | 18932 |
| 172 | GCUCCCUA G CCCUGUGC | 8403 | GCACAGGG GGCTAGCTACAACGA TAGGGAGC | 18933 |
| 177 | CUAGCCCU G UGCGCUCA | 8404 | TGAGCGCA GGCTAGCTACAACGA AGGGCTAG | 18934 |
| 179 | AGCCCUGU G CGCUCAAC | 8405 | GTTGAGCG GGCTAGCTACAACGA ACAGGGCT | 18935 |
| 181 | CCCUGUGC G CUCAACUG | 8406 | CAGTTGAG GGCTAGCTACAACGA GCACAGGG | 18936 |
| 186 | UGCGCUCA A CUGUCCUG | 8407 | CAGGACAG GGCTAGCTACAACGA TGAGCGCA | 18937 |
| 189 | GCUCAACU G UCCGCGC | 8408 | GCGCAGGA GGCTAGCTACAACGA AGTTGAGC | 18938 |
| 194 | ACUGUCCU G CGCUGCGG | 8409 | CCGCAGCG GGCTAGCTACAACGA AGGACAGT | 18939 |
| 196 | UGUCCUGC G CUGCGGGG | 8410 | CCCCGCAG GGCTAGCTACAACGA GCAGGACA | 18940 |

TABLE XXII-continued

Human KDR DNAzyme and Substrate sequence

| Pos | Substrate | Seq ID No | DNAzyme | Seq ID No |
|---|---|---|---|---|
| 199 | CCUGCGCU G CGGGGUGC | 8411 | GCACCCCG GGCTAGCTACAACGA AGCGCAGG | 18941 |
| 204 | GCUGCGGG G UGCCGCGA | 8412 | TCGCGGCA GGCTAGCTACAACGA CCCGCAGC | 18942 |
| 206 | UGCGGGGU G CCGCGAGU | 8413 | ACTCGCGG GGCTAGCTACAACGA ACCCCGCA | 18943 |
| 209 | GGGGUGCC G CGAGUUCC | 8414 | GGAACTCG GGCTAGCTACAACGA GGCACCCC | 18944 |
| 213 | UGCCGCGA G UUCCACCU | 8415 | AGGTGGAA GGCTAGCTACAACGA TCGCGGCA | 18945 |
| 218 | CGAGUUCC A CCUCCGCG | 8416 | CGCGGAGG GGCTAGCTACAACGA GGAACTCG | 18946 |
| 224 | CCACCUCC G CGCCUCCU | 8417 | AGGAGGCG GGCTAGCTACAACGA GGAGGTGG | 18947 |
| 226 | ACCUCCGC G CCUCCUUC | 8418 | GAAGGAGG GGCTAGCTACAACGA GCGGAGGT | 18948 |
| 240 | UUCUCUAG A CAGGCGCU | 8419 | AGCGCCTG GGCTAGCTACAACGA CTAGAGAA | 18949 |
| 244 | CUAGACAG G CGCUGGGA | 8420 | TCCCAGCG GGCTAGCTACAACGA CTGTCTAG | 18950 |
| 246 | AGACAGGC G CUGGGAGA | 8421 | TCTCCCAG GGCTAGCTACAACGA GCCTGTCT | 18951 |
| 259 | GAGAAAGA A CCGGCUCC | 8422 | GGAGCCGG GGCTAGCTACAACGA TCTTTCTC | 18952 |
| 263 | AAGAACCG G CUCCCGAG | 8423 | CTCGGGAG GGCTAGCTACAACGA CGGTTCTT | 18953 |
| 271 | GCUCCCGA G UUCUGGGC | 8424 | GCCCAGAA GGCTAGCTACAACGA TCGGGAGC | 18954 |
| 278 | AGUUCUGG G CAUUUCGC | 8425 | GCGAAATG GGCTAGCTACAACGA CCAGAACT | 18955 |
| 280 | UUCUGGGC A UUUCGCCC | 8426 | GGGCGAAA GGCTAGCTACAACGA GCCCAGAA | 18956 |
| 285 | GGCAUUUC G CCCGGCUC | 8427 | GAGCCGGG GGCTAGCTACAACGA GAAATGCC | 18957 |
| 290 | UUCGCCCG G CUCGAGGU | 8428 | ACCTCGAG GGCTAGCTACAACGA CGGGCGAA | 18958 |
| 297 | GGCUCGAG G UGCAGGAU | 8429 | ATCCTGCA GGCTAGCTACAACGA CTCGAGCC | 18959 |
| 299 | CUCGAGGU G CAGGAUGC | 8430 | GCATCCTG GGCTAGCTACAACGA ACCTCGAG | 18960 |
| 304 | GGUGCAGG A UGCAGAGC | 8431 | GCTCTGCA GGCTAGCTACAACGA CCTGCACC | 18961 |
| 306 | UGCAGGAU G CAGAGCAA | 8432 | TTGCTCTG GGCTAGCTACAACGA ATCCTGCA | 18962 |
| 311 | GAUGCAGA G CAAGGUGC | 8433 | GCACCTTG GGCTAGCTACAACGA TCTGCATC | 18963 |
| 316 | AGAGCAAG G UGCUGCUG | 8434 | CAGCAGCA GGCTAGCTACAACGA CTTGCTCT | 18964 |
| 318 | AGCAAGGU G CUGCUGGC | 8435 | GCCAGCAG GGCTAGCTACAACGA ACCTTGCT | 18965 |
| 321 | AAGGUGCU G CUGGCCGU | 8436 | ACGGCCAG GGCTAGCTACAACGA AGCACCTT | 18966 |
| 325 | UGCUGCUG G CCGUCGCC | 8437 | GGCGACGG GGCTAGCTACAACGA CAGCAGCA | 18967 |
| 328 | UGCUGGCC G UCGCCCUG | 8438 | CAGGGCGA GGCTAGCTACAACGA GGCCAGCA | 18968 |
| 331 | UGGCCGUC G CCCUGUGG | 8439 | CCACAGGG GGCTAGCTACAACGA GACGGCCA | 18969 |
| 336 | GUCGCCCU G UGGCUCUG | 8440 | CAGAGCCA GGCTAGCTACAACGA AGGGCGAC | 18970 |
| 339 | GCCCUGUG G CUCUGCGU | 8441 | ACGCAGAG GGCTAGCTACAACGA CACAGGGC | 18971 |
| 344 | GUGGCUCU G CGUGGAGA | 8442 | TCTCCACG GGCTAGCTACAACGA AGAGCCAC | 18972 |
| 346 | GGCUCUGC G UGGAGACC | 8443 | GGTCTCCA GGCTAGCTACAACGA GCAGAGCC | 18973 |
| 352 | GCGUGGAG A CCCGGGCC | 8444 | GGCCCGGG GGCTAGCTACAACGA CTCCACGC | 18974 |
| 358 | AGACCCGG G CCGCCUCU | 8445 | AGAGGCGG GGCTAGCTACAACGA CCGGGTCT | 18975 |
| 361 | CCCGGGCC G CCUCUGUG | 8446 | CACAGAGG GGCTAGCTACAACGA GGCCCGGG | 18976 |
| 367 | CCGCCUCU G UGGGUUUG | 8447 | CAAACCCA GGCTAGCTACAACGA AGAGGCGG | 18977 |

TABLE XXII-continued

Human KDR DNAzyme and Substrate sequence

| Pos | Substrate | Seq ID No | DNAzyme | Seq ID No |
|---|---|---|---|---|
| 371 | CUCUGUGG G UUUGCCUA | 8448 | TAGGCAAA GGCTAGCTACAACGA CCACAGAG | 18978 |
| 375 | GUGGGUUU G CCUAGUGU | 8449 | ACACTAGG GGCTAGCTACAACGA AAACCCAC | 18979 |
| 380 | UUUGCCUA G UGUUUCUC | 8450 | GAGAAACA GGCTAGCTACAACGA TAGGCAAA | 18980 |
| 382 | UGCCUAGU G UUUCUCUU | 8451 | AAGAGAAA GGCTAGCTACAACGA ACTAGGCA | 18981 |
| 392 | UUCUCUUG A UCUGCCCA | 8452 | TGGGCAGA GGCTAGCTACAACGA CAAGAGAA | 18982 |
| 396 | CUUGAUCU G CCCAGGCU | 8453 | AGCCTGGG GGCTAGCTACAACGA AGATCAAG | 18983 |
| 402 | CUGCCCAG G CUCAGCAU | 8454 | ATGCTGAG CCCTAGCTACAACGA CTGGGCAG | 18984 |
| 407 | CAGGCUCA G CAUACAAA | 8455 | TTTCTATG GGCTAGCTACAACGA TGAGCCTG | 18985 |
| 409 | GGCUCAGC A UACAAAAU | 6138 | TTTTTGTA GGCTAGCTACAACGA GCTGAGCC | 18986 |
| 411 | CUCAGCAU A CAAAAGA | 1519 | TCTTTTTG GGCTAGCTACAACGA ATGCTGAG | 18987 |
| 419 | ACAAAAAG A CAUACUUA | 8456 | TAAGTATG GGCTAGCTACAACGA CTTTTTGT | 18988 |
| 421 | AAAAAGAC A UACUUACA | 6140 | TGTAAGTA GGCTAGCTACAACGA GTCTTTTT | 18989 |
| 423 | AAAGACAU A CUUACAAU | 1520 | ATTGTAAG GGCTAGCTACAACGA ATGTCTTT | 18990 |
| 427 | ACAUACUU A CAAUUAAG | 1522 | CTTAATTG GGCTAGCTACAACGA AAGTATGT | 18991 |
| 430 | UACUUACA A UUAAGGCU | 8457 | AGCCTTAA GGCTAGCTACAACGA TGTAAGTA | 18992 |
| 436 | CAAUUAAG G CUAAUACA | 8458 | TGTATTAG GGCTAGCTACAACGA CTTAATTG | 18993 |
| 440 | UAAGGCUA A UACAACUC | 8459 | GAGTTGTA GGCTAGCTACAACGA TAGCCTTA | 18994 |
| 442 | AGGCUAAU A CAACUCUU | 1526 | AAGAGTTG GGCTAGCTACAACGA ATTAGCCT | 18995 |
| 445 | CUAAUACA A CUCUUCAA | 8460 | TTGAAGAG GGCTAGCTACAACGA TGTATTAG | 18996 |
| 454 | CUCUUCAA A UUACUUGC | 8461 | GCAAGTAA GGCTAGCTACAACGA TTGAAGAG | 18997 |
| 457 | UUCAAAUU A CUUGCAGG | 1531 | CCTGCAAG GGCTAGCTACAACGA AATTTGAA | 18998 |
| 461 | AAUUACUU G CAGGGGAC | 8462 | GTCCCCTG GGCTAGCTACAACGA AAGTAATT | 18999 |
| 468 | UGCAGGGG A CAGAGGGA | 8463 | TCCCTCTG GGCTAGCTACAACGA CCCCTGCA | 19000 |
| 476 | ACAGAGGG A CUUGGACU | 8464 | AGTCCAAG GGCTAGCTACAACGA CCCTCTGT | 19001 |
| 482 | GGACUUGG A CUGGCUUU | 8465 | AAAGCCAG GGCTAGCTACAACGA CCAAGTCC | 19002 |
| 486 | UUGGACUG G CUUUGGCC | 8466 | GGCCAAAG GGCTAGCTACAACGA CAGTCCAA | 19003 |
| 492 | UGGCUUUG G CCCAAUAA | 8467 | TTATTGGG GGCTAGCTACAACGA CAAAGCCA | 19004 |
| 497 | UUGGCCCA A UAAUCAGA | 8468 | TCTGATTA GGCTAGCTACAACGA TGGGCCAA | 19005 |
| 500 | GCCCAAUA A UCAGAGUG | 8469 | CACTCTGA GGCTAGCTACAACGA TATTGGGC | 19006 |
| 506 | UAAUCAGA G UGGCAGUG | 8470 | CACTGCCA GGCTAGCTACAACGA TCTGATTA | 19007 |
| 509 | UCAGAGUG G CAGUGAGC | 8471 | GCTCACTG GGCTAGCTACAACGA CACTCTGA | 19008 |
| 512 | GAGUGGCA G UGAGCAAA | 8472 | TTTGCTCA GGCTAGCTACAACGA TGCCACTC | 19009 |
| 516 | GGCAGUGA G CAAAGGGU | 8473 | ACCCTTTG GGCTAGCTACAACGA TCACTGCC | 19010 |
| 523 | AGCAAAGG G UGGAGGUG | 8474 | CACCTCCA GGCTAGCTACAACGA CCTTTGCT | 19011 |
| 529 | GGGUGGAG G UGACUGAG | 8475 | CTCAGTCA GGCTAGCTACAACGA CTCCACCC | 19012 |
| 532 | UGGAGGUG A CUGAGUGC | 8476 | GCACTCAG GGCTAGCTACAACGA CACCTCCA | 19013 |
| 537 | GUGACUGA G UGCAGCGA | 8477 | TCGCTGCA GGCTAGCTACAACGA TCAGTCAC | 19014 |

TABLE XXII-continued

Human KDR DNAzyme and Substrate sequence

| Pos | Substrate | Seq ID No | DNAzyme | Seq ID No |
|-----|-----------|-----------|---------|-----------|
| 539 | GACUGAGU G CAGCGAUG | 8478 | CATCGCTG GGCTAGCTACAACGA ACTCAGTC | 19015 |
| 542 | UGAGUGCA G CGAUGGCC | 8479 | GGCCATCG GGCTAGCTACAACGA TGCACTCA | 19016 |
| 545 | GUGCAGCG A UGGCCUCU | 8480 | AGAGGCCA GGCTAGCTACAACGA CGCTGCAC | 19017 |
| 548 | CAGCGAUG G CCUCUUCU | 8481 | AGAAGAGG GGCTAGCTACAACGA CATCGCTG | 19018 |
| 557 | CCUCUUCU G UAAGACAC | 8482 | GTGTCTTA GGCTAGCTACAACGA AGAAGAGG | 19019 |
| 562 | UCUGUAAG A CACUCACA | 8483 | TGTGAGTG GGCTAGCTACAACGA CTTACAGA | 19020 |
| 564 | UGUAAGAC A CUCACAAU | 6166 | ATTGTGAG GGCTAGCTACAACGA GTCTTACA | 19021 |
| 568 | AGACACUC A CAAUUCCA | 6168 | TGGAATTG GGCTAGCTACAACGA GAGTGTCT | 19022 |
| 571 | CACUCACA A UUCCAAAA | 8484 | TTTTGGAA GGCTAGCTACAACGA TGTGAGTG | 19023 |
| 580 | UUCCAAAA G UGAUCGGA | 8485 | TCCGATCA GGCTAGCTACAACGA TTTTGGAA | 19024 |
| 583 | CAAAAGUG A UCGGAAAU | 8486 | ATTTCCGA GGCTAGCTACAACGA CACTTTTG | 19025 |
| 590 | GAUCGGAA A UGACACUG | 8487 | CAGTGTCA GGCTAGCTACAACGA TTCCGATC | 19026 |
| 593 | CGGAAAUG A CACUGGAG | 8488 | CTCCAGTG GGCTAGCTACAACGA CATTTCCG | 19027 |
| 595 | GAAAUGAC A CUGGAGCC | 6172 | GGCTCCAG GGCTAGCTACAACGA GTCATTTC | 19028 |
| 601 | ACACUGGA G CCUACAAG | 8489 | CTTGTAGG GGCTAGCTACAACGA TCCAGTGT | 19029 |
| 605 | UGGAGCCU A CAAGUGCU | 1546 | AGCACTTG GGCTAGCTACAACGA AGGCTCCA | 19030 |
| 609 | GCCUACAA G UGCUUCUA | 8490 | TAGAAGCA GGCTAGCTACAACGA TTGTAGGC | 19031 |
| 611 | CUACAAGU G CUUCUACC | 8491 | GGTAGAAG GGCTAGCTACAACGA ACTTGTAG | 19032 |
| 617 | GUGCUUCU A CCGGGAAA | 1549 | TTTCCCGG GGCTAGCTACAACGA AGAAGCAC | 19033 |
| 625 | ACCGGGAA A CUGACUUG | 8492 | CAAGTCAG GGCTAGCTACAACGA TTCCCGGT | 19034 |
| 629 | GGAAACUG A CUUGGCCU | 8493 | AGGCCAAG GGCTAGCTACAACGA CAGTTTCC | 19035 |
| 634 | CUGACUUG G CCUCGGUC | 8494 | GACCGAGG GGCTAGCTACAACGA CAAGTCAG | 19036 |
| 640 | UGGCCUCG G UCAUUUAU | 8495 | ATAAATGA GGCTAGCTACAACGA CGAGGCCA | 19037 |
| 643 | CCUCGGUC A UUUAUGUC | 6184 | GACATAAA GGCTAGCTACAACGA GACCGAGG | 19038 |
| 647 | GGUCAUUU A UGUCUAUG | 1555 | CATAGACA GGCTAGCTACAACGA AAATGACC | 19039 |
| 649 | UCAUUUAU G UCUAUGUU | 8496 | AACATAGA GGCTAGCTACAACGA ATAAATGA | 19040 |
| 653 | UUAUGUCU A UGUUCAAG | 1557 | CTTGAACA GGCTAGCTACAACCA AGACATAA | 19041 |
| 655 | AUGUCUAU G UUCAAGAU | 8497 | ATCTTGAA GGCTAGCTACAACGA ATAGACAT | 19042 |
| 662 | UGUUCAAG A UUACAGAU | 8498 | ATCTGTAA GGCTAGCTACAACGA CTTGAACA | 19043 |
| 665 | UCAAGAUU A CAGAUCUC | 1561 | GAGATCTG GGCTAGCTACAACGA AATCTTGA | 19044 |
| 669 | GAUUACAG A UCUCCAUU | 8499 | AATGGAGA GGCTAGCTACAACGA CTGTAATC | 19045 |
| 675 | AGAUCUCC A UUUAUUGC | 6190 | GCAATAAA GGCTAGCTACAACGA GGAGATCT | 19046 |
| 679 | CUCCAUUU A UUGCUUCU | 1566 | AGAAGCAA GGCTAGCTACAACGA AAATGGAG | 19047 |
| 682 | CAUUUAUU G CUUCUGUU | 8500 | AACAGAAG GGCTAGCTACAACGA AATAAATG | 19048 |
| 688 | UUGCUUCU G UUAGUGAC | 8501 | GTCACTAA GGCTAGCTACAACGA AGAAGCAA | 19049 |
| 692 | UUCUGUUA G UGACCAAC | 8502 | GTTGGTCA GGCTAGCTACAACGA TAACAGAA | 19050 |
| 695 | UGUUAGUG A CCAACAUG | 8503 | CATGTTGG GGCTAGCTACAACGA CACTAACA | 19051 |

TABLE XXII-continued

Human KDR DNAzyme and Substrate sequence

| Pos | Substrate | Seq ID No | DNAzyme | Seq ID No |
|---|---|---|---|---|
| 699 | AGUGACCA A CAUGGAGU | 8504 | ACTCCATG GGCTAGCTACAACGA TGGTCACT | 19052 |
| 701 | UGACCAAC A UGGAGUGG | 6195 | CGACTCCA GGCTAGCTACAACGA GTTGGTCA | 19053 |
| 706 | AACAUGGA G UCGUGUAC | 8505 | GTACACGA GGCTAGCTACAACGA TCCATGTT | 19054 |
| 709 | AUGGAGUC G UGUACAUU | 8506 | AATGTACA GGCTAGCTACAACGA GACTCCAT | 19055 |
| 711 | GGAGUCGU G UACAUUAC | 8507 | GTAATGTA GGCTAGCTACAACGA ACGACTCC | 19056 |
| 713 | AGUCGUGU A CAUUACUG | 1573 | CAGTAATG GGCTAGCTACAACGA ACACGACT | 19057 |
| 715 | UCGUGUAC A UUACUGAG | 6196 | CTCAGTAA GGCTAGCTACAACGA GTACACGA | 19058 |
| 718 | UGUACAUU A CUGAGAAC | 1575 | GTTCTCAG GGCTAGCTACAACGA AATGTACA | 19059 |
| 725 | UACUGAGA A CAAAACA | 8508 | TGTTTTTG GGCTAGCTACAACGA TCTCAGTA | 19060 |
| 731 | GAACAAAA A CAAAACUG | 8509 | CAGTTTTG GGCTAGCTACAACGA TTTTGTTC | 19061 |
| 736 | AAAACAAA A CUGUGGUG | 8510 | CACCACAG GGCTAGCTACAACGA TTTGTTTT | 19062 |
| 739 | ACAAAACU G UGGUGAUU | 8511 | AATCACCA GGCTAGCTACAACGA AGTTTTGT | 19063 |
| 742 | AAACUGUG G UGAUUCCA | 8512 | TGGAATCA GGCTAGCTACAACGA CACAGTTT | 19064 |
| 745 | CUGUGGUG A UUCCAUGU | 8513 | ACATGGAA GGCTAGCTACAACGA CACCACAG | 19065 |
| 750 | GUGAUUCC A UGUCUCGG | 6202 | CCGAGACA GGCTAGCTACAACGA GGAATCAC | 19066 |
| 752 | GAUUCCAU G UCUCGGGU | 8514 | ACCCGAGA GGCTAGCTACAACGA ATGGAATC | 19067 |
| 759 | UGUCUCGG G UCCAUUUC | 8515 | GAAATGGA GGCTAGCTACAACGA CCGAGACA | 19068 |
| 763 | UCGGGUCC A UUUCAAAU | 6205 | ATTTGAAA GGCTAGCTACAACGA GGACCCGA | 19069 |
| 770 | CAUUUCAA A UCUCAACG | 8516 | CGTTGAGA GGCTAGCTACAACGA TTGAAATG | 19070 |
| 776 | AAAUCUCA A CGUGUCAC | 8517 | GTGACACG GGCTAGCTACAACGA TGAGATTT | 19071 |
| 778 | AUCUCAAC G UGUCACUU | 8518 | AAGTGACA GGCTAGCTACAACGA GTTGAGAT | 19072 |
| 780 | CUCAACGU G UCACUUUG | 8519 | CAAAGTGA GGCTAGCTACAACGA ACGTTGAG | 19073 |
| 783 | AACGUGUC A CUUUGUGC | 6209 | GCACAAAG GGCTAGCTACAACGA GACACGTT | 19074 |
| 788 | GUCACUUU G UGCAAGAU | 8520 | ATCTTGCA GGCTAGCTACAACGA AAAGTGAC | 19075 |
| 790 | CACUUUGU G CAAGAUAC | 8521 | GTATCTTG GGCTAGCTACAACGA ACAAAGTG | 19076 |
| 795 | UGUGCAAG A UACCCAGA | 8522 | TCTGGGTA GGCTAGCTACAACGA CTTGCACA | 19077 |
| 797 | UGCAAGAU A CCCAGAAA | 1589 | TTTCTGGG GGCTAGCTACAACGA ATCTTGCA | 19078 |
| 810 | GAAAAGAG A UUUGUUCC | 8523 | GGAACAAA GGCTAGCTACAACGA CTCTTTTC | 19079 |
| 814 | AGAGAUUU G UUCCUGAU | 8524 | ATCAGGAA GGCTAGCTACAACGA AAATCTCT | 19080 |
| 821 | UGUUCCUG A UGGUAACA | 8525 | TGTTACCA GGCTAGCTACAACGA CAGGAACA | 19081 |
| 824 | UCCUGAUG G UAACAGAA | 8526 | TTCTGTTA GGCTAGCTACAACGA CATCAGGA | 19082 |
| 827 | UGAUGGUA A CAGAAUUU | 8527 | AAATTCTG GGCTAGCTACAACGA TACCATCA | 19083 |
| 832 | GUAACAGA A UUUCCUGG | 8528 | CCAGGAAA GGCTAGCTACAACGA TCTGTTAC | 19084 |
| 842 | UUCCUGGG A CAGCAAGA | 8529 | TCTTGCTG GGCTAGCTACAACGA CCCAGGAA | 19085 |
| 845 | CUGGGACA G CAAGAAGG | 8530 | CCTTCTTG GGCTAGCTACAACGA TGTCCCAG | 19086 |
| 854 | CAAGAAGG G CUUUACUA | 8531 | TAGTAAAG GGCTAGCTACAACGA CCTTCTTG | 19087 |
| 859 | AGGGCUUU A CUAUUCCC | 1600 | GGGAATAG GGCTAGCTACAACGA AAAGCCCT | 19088 |

TABLE XXII-continued

Human KDR DNAzyme and Substrate sequence

| Pos | Substrate | Seq ID No | DNAzyme | Seq ID No |
|---|---|---|---|---|
| 862 | GCUUUACU A UUCCCAGC | 1601 | GCTGGGAA GGCTAGCTACAACGA AGTAAAGC | 19089 |
| 869 | UAUUCCCA G CUACAUGA | 8532 | TCATGTAG GGCTAGCTACAACGA TGGGAATA | 19090 |
| 872 | UCCCAGCU A CAUGAUCA | 1604 | TGATCATG GGCTAGCTACAACGA AGCTGGGA | 19091 |
| 874 | CCAGCUAC A UGAUCAGC | 6228 | GCTGATCA GGCTAGCTACAACGA GTAGCTGG | 19092 |
| 877 | GCUACAUG A UCAGCUAU | 8533 | ATAGCTGA GGCTAGCTACAACGA CATGTAGC | 19093 |
| 881 | CAUGAUCA G CUAUGCUG | 8534 | CAGCATAG GGCTAGCTACAACGA TGATCATG | 19094 |
| 884 | GAUCAGCU A UGCUGGCA | 1606 | TGCCAGCA GGCTAGCTACAACGA AGCTGATC | 19095 |
| 886 | UCAGCUAU G CUGGCAUG | 8535 | CATGCCAG GGCTAGCTACAACGA ATAGCTGA | 19096 |
| 890 | CUAUGCUG G CAUGGUCU | 8536 | AGACCATG GGCTAGCTACAACGA CAGCATAG | 19097 |
| 892 | AUGCUGGC A UGGUCUUC | 6232 | GAAGACCA GGCTAGCTACAACGA GCCAGCAT | 19098 |
| 895 | CUGGCAUG G UCUUCUGU | 8537 | ACAGAAGA GGCTAGCTACAACGA CATGCCAG | 19099 |
| 902 | GGUCUUCU G UGAAGCAA | 8538 | TTGCTTCA GGCTAGCTACAACGA AGAAGACC | 19100 |
| 907 | UCUGUGAA G CAAAAAUU | 8539 | AATTTTTG GGCTAGCTACAACGA TTCACAGA | 19101 |
| 913 | AAGCAAAA A UUAAUGAU | 8540 | ATCATTAA GGCTAGCTACAACGA TTTTGCTT | 19102 |
| 917 | AAAAAUUA A UGAUGAAA | 8541 | TTTCATCA GGCTAGCTACAACGA TAATTTTT | 19103 |
| 920 | AAUUAAUG A UGAAAGUU | 8542 | AACTTTCA GGCTAGCTACAACGA CATTAATT | 19104 |
| 926 | UGAUGAAA G UUACCAGU | 8543 | ACTGGTAA GGCTAGCTACAACGA TTTCATCA | 19105 |
| 929 | UGAAAGUU A CCAGUCUA | 1613 | TAGACTGG GGCTAGCTACAACGA AACTTTCA | 19160 |
| 933 | AGUUACCA G UCUAUUAU | 8544 | ATAATAGA GGCTAGCTACAACGA TGGTAACT | 19107 |
| 937 | ACCAGUCU A UUAUGUAC | 1615 | GTACATAA GGCTAGCTACAACGA AGACTGGT | 19108 |
| 940 | AGUCUAUU A UGUACAUA | 1617 | TATGTACA GGCTAGCTACAACGA AATAGACT | 19109 |
| 942 | UCUAUUAU G UACAUAGU | 8545 | ACTATGTA GGCTAGCTACAACGA ATAATAGA | 19110 |
| 944 | UAUUAUGU A CAUAGUUG | 1618 | CAACTATG GGCTAGCTACAACGA ACATAATA | 19111 |
| 946 | UUAUGUAC A UAGUUGUC | 6239 | GACAACTA GGCTAGCTACAACGA GTACATAA | 19112 |
| 949 | UGUACAUA G UUGUCGUU | 8546 | AACGACAA GGCTAGCTACAACGA TATGTACA | 19113 |
| 952 | ACAUAGUU G UCGUUGUA | 8547 | TACAACGA GGCTAGCTACAACGA AACTATGT | 19114 |
| 955 | UAGUUGUC G UUGUAGGG | 8548 | CCCTACAA GGCTAGCTACAACGA GACAACTA | 19115 |
| 958 | UUGUCGUU G UAGGGUAU | 8549 | ATACCCTA GGCTAGCTACAACGA AACGACAA | 19116 |
| 963 | GUUGUAGG G UAUAGGAU | 8550 | ATCCTATA GGCTAGCTACAACGA CCTACAAC | 19117 |
| 965 | UGUAGGGU A UAGGAUUU | 1624 | AAATCCTA GGCTAGCTACAACGA ACCCTACA | 19118 |
| 970 | GGUAUAGG A UUUAUGAU | 8551 | ATCATAAA GGCTAGCTACAACGA CCTATACC | 19119 |
| 974 | UAGGAUUU A UGAUGUGG | 1628 | CCACATCA GGCTAGCTACAACGA AAATCCTA | 19120 |
| 977 | GAUUUAUG A UGUGGUUC | 8552 | GAACCACA GGCTAGCTACAACGA CATAAATC | 19121 |
| 979 | UUUAUGAU G UGGUUCUG | 8553 | CAGAACCA GGCTAGCTACAACGA ATCATAAA | 19122 |
| 982 | AUGAUGUG G UUCUGAGU | 8554 | ACTCAGAA GGCTAGCTACAACGA CACATCAT | 19123 |
| 989 | GGUUCUGA G UCCGUCUC | 8555 | GAGACGGA GGCTAGCTACAACGA TCAGAACC | 19124 |
| 993 | CUGAGUCC G UCUCAUGG | 8556 | CCATGAGA GGCTAGCTACAACGA GGACTCAG | 19125 |

TABLE XXII-continued

Human KDR DNAzyme and Substrate sequence

| Pos | Substrate | Seq ID No | DNAzyme | Seq ID No |
|---|---|---|---|---|
| 998 | UCCGUCUC A UGGAAUUG | 6243 | CAATTCCA GGCTAGCTACAACGA GAGACGGA | 19126 |
| 1003 | CUCAUGGA A UUGAACUA | 8557 | TAGTTCAA GGCTAGCTACAACGA TCCATGAG | 19127 |
| 1008 | GGAAUUGA A CUAUCUGU | 8558 | ACAGATAG GGCTAGCTACAACGA TCAATTCC | 19128 |
| 1011 | AUUGAACU A UCUGUUGG | 1635 | CCAACAGA GGCTAGCTACAACGA AGTTCAAT | 19129 |
| 1015 | AACUAUCU G UUGGAGAA | 8559 | TTCTCCAA GGCTAGCTACAACGA AGATAGTT | 19130 |
| 1026 | GGAGAAAA G CUUGUCUU | 8560 | AAGACAAG GGCTAGCTACAACGA TTTTCTCC | 19131 |
| 1030 | AAAAGCUU G UCUUAAAU | 8561 | ATTTAAGA GGCTAGCTACAACGA AAGCTTTT | 19132 |
| 1037 | UGUCUUAA A UUGUACAG | 8562 | CTGTACAA GGCTAGCTACAACGA TTAAGACA | 19133 |
| 1040 | CUUAAAUU G UACAGCAA | 8563 | TTGCTGTA GGCTAGCTACAACGA AATTTAAG | 19134 |
| 1042 | UAAAUUGU A CAGCAAGA | 1643 | TCTTGCTG GGCTAGCTACAACGA ACAATTTA | 19135 |
| 1045 | AUUGUACA G CAAGAACU | 8564 | AGTTCTTG GGCTAGCTACAACGA TGTACAAT | 19136 |
| 1051 | CAGCAAGA A CUGAACUA | 8565 | TAGTTCAG GGCTAGCTACAACGA TCTTGCTG | 19137 |
| 1056 | AGAACUGA A CUAAAUGU | 8566 | ACATTTAG GGCTAGCTACAACGA TCAGTTCT | 19138 |
| 1061 | UGAACUAA A UGUGGGA | 8567 | TCCCCACA GGCTAGCTACAACGA TTAGTTCA | 19139 |
| 1063 | AACUAAAU G UGGGGAUU | 8568 | AATCCCCA GGCTAGCTACAACGA ATTTAGTT | 19140 |
| 1069 | AUGUGGGG A UUGACUUC | 8569 | GAAGTCAA GGCTAGCTACAACGA CCCCACAT | 19141 |
| 1073 | CGGGAUUG A CUUCAACU | 8570 | AGTTGAAG GGCTAGCTACAACGA CAATCCCC | 19142 |
| 1079 | UGACUUCA A CUGGGAAU | 8571 | ATTCCCAG GGCTAGCTACAACGA TGAAGTCA | 19143 |
| 1086 | AACUGGGA A UACCCUUC | 8572 | GAAGGGTA GGCTAGCTACAACGA TCCCAGTT | 19144 |
| 1088 | CUGGGAAU A CCCUUCUU | 1648 | AAGAAGGG GGCTAGCTACAACGA ATTCCCAG | 19145 |
| 1101 | UCUUCGAA G CAUCAGCA | 8573 | TGCTGATG GGCTAGCTACAACGA TTCGAAGA | 19146 |
| 1103 | UUCGAAGC A UCAGCAUA | 6259 | TATGCTGA GGCTAGCTACAACGA GCTTCGAA | 19147 |
| 1107 | AAGCAUCA G CAUAAGAA | 8574 | TTCTTATG GGCTAGCTACAACGA TGATGCTT | 19148 |
| 1109 | GCAUCAGC A UAAGAAAC | 6261 | GTTTCTTA GGCTAGCTACAACGA GCTGATGC | 19149 |
| 1116 | CAUAAGAA A CUUGUAAA | 8575 | TTTACAAG GGCTAGCTACAACGA TTCTTATG | 19150 |
| 1120 | AGAAACUU G UAAACCGA | 8576 | TCGGTTTA GGCTAGCTACAACGA AAGTTTCT | 19151 |
| 1124 | ACUUGUAA A CCGAGACC | 8577 | GGTCTCGG GGCTAGCTACAACGA TTACAAGT | 19152 |
| 1130 | AAACCGAG A CCUAAAAA | 8578 | TTTTTAGG GGCTAGCTACAACGA CTCGGTTT | 19153 |
| 1138 | ACCUAAAA A CCCAGUCU | 8579 | AGACTGGG GGCTAGCTACAACGA TTTTAGGT | 19154 |
| 1143 | AAACCCA G UCUGGGAG | 8580 | CTCCCAGA GGCTAGCTACAACGA TGGGTTTT | 19155 |
| 1151 | GUCUGGGA G UGAGAUGA | 8581 | TCATCTCA GGCTAGCTACAACGA TCCCAGAC | 19156 |
| 1156 | GGAGUGAG A UGAAGAAA | 8582 | TTTCTTCA GGCTAGCTACAACGA CTCACTCC | 19157 |
| 1164 | AUGAAGAA A UUUUUGAG | 8583 | CTCAAAAA GGCTAGCTACAACGA TTCTTCAT | 19158 |
| 1172 | AUUUUUGA G CACCUUAA | 8584 | TTAAGGTG GGCTAGCTACAACGA TCAAAAAT | 19159 |
| 1174 | UUUUGAGC A CCUUAACU | 6270 | AGTTAAGG GGCTAGCTACAACGA GCTCAAAA | 19160 |
| 1180 | GCACCUUA A CUAUAGAU | 8585 | ATCTATAG GGCTAGCTACAACGA TAAGGTGC | 19161 |
| 1183 | CCUUAACU A UAGAUGGU | 1665 | ACCATCTA GGCTAGCTACAACGA AGTTAAGG | 19162 |

TABLE XXII-continued

Human KDR DNAzyme and Substrate sequence

| Pos | Substrate | Seq ID No | DNAzyme | Seq ID No |
|---|---|---|---|---|
| 1187 | AACUAUAG A UGGUGUAA | 8586 | TTACACCA GGCTAGCTACAACGA CTATAGTT | 19163 |
| 1190 | UAUAGAUG G UGUAACCC | 8587 | GGGTTACA GGCTAGCTACAACGA CATCTATA | 19164 |
| 1192 | UAGAUGGU G UAACCCGG | 8588 | CCGGGTTA GGCTAGCTACAACGA ACCATCTA | 19165 |
| 1195 | AUGGUGUA A CCCGGAGU | 8589 | ACTCCGGG GGCTAGCTACAACGA TACACCAT | 19166 |
| 1202 | AACCCGGA G UGACCAAG | 8590 | CTTGGTCA GGCTAGCTACAACGA TCCGGGTT | 19167 |
| 1205 | CCGGAGUG A CCAAGGAU | 8591 | ATCCTTGG GGCTAGCTACAACGA CACTCCGG | 19168 |
| 1212 | GACCAAGG A UUGUACAC | 8592 | GTGTACAA GGCTAGCTACAACGA CCTTGGTC | 19169 |
| 1215 | CAAGGAUU G UACACCUG | 8593 | CAGGTGTA GGCTAGCTACAACGA AATCCTTG | 19170 |
| 1217 | AGGAUUGU A CACCUGUG | 1669 | CACAGGTG GGCTAGCTACAACGA ACAATCCT | 19171 |
| 1219 | GAUUGUAC A CCUGUGCA | 6278 | TGCACAGG GGCTAGCTACAACGA GTACAATC | 19172 |
| 1223 | GUACACCU G UGCAGCAU | 8594 | ATGCTGCA GGCTAGCTACAACGA AGGTGTAC | 19173 |
| 1225 | ACACCUGU G CAGCAUCC | 8595 | GGATGCTG GGCTAGCTACAACGA ACAGGTGT | 19174 |
| 1228 | CCUGUGCA G CAUCCAGU | 8596 | ACTGGATG GGCTAGCTACAACGA TGCACAGG | 19175 |
| 1230 | UGUGCAGC A UCCAGUGG | 6282 | CCACTGGA GGCTAGCTACAACGA GCTGCACA | 19176 |
| 1235 | AGCAUCCA G UGGGCUGA | 8597 | TCAGCCCA GGCTAGCTACAACGA TGGATGCT | 19177 |
| 1239 | UCCAGUGG G CUGAUGAC | 8598 | GTCATCAG GGCTAGCTACAACGA CCACTGGA | 19178 |
| 1243 | GUGGGCUG A UGACCAAG | 8599 | CTTGGTCA GGCTAGCTACAACGA CAGCCCAC | 19179 |
| 1246 | GGCUGAUG A CCAAGAAG | 8600 | CTTCTTGG GGCTAGCTACAACGA CATCAGCC | 19180 |
| 1256 | CAAGAAGA A CAGCACAU | 8601 | ATGTGCTG GGCTAGCTACAACGA TCTTCTTG | 19181 |
| 1259 | GAAGAACA G CACAUUUG | 8602 | CAAATGTG GGCTAGCTACAACGA TGTTCTTC | 19182 |
| 1261 | AGAACAGC A CAUUUGUC | 6289 | GACAAATG GGCTAGCTACAACGA GCTGTTCT | 19183 |
| 1263 | AACAGCAC A UUUGUCAG | 6290 | CTGACAAA GGCTAGCTACAACGA GTGCTGTT | 19184 |
| 1267 | GCACAUUU G UCAGGGUC | 8603 | GACCCTGA GGCTAGCTACAACGA AAATGTGC | 19185 |
| 1273 | UUGUCAGG G UCCAUGAA | 8604 | TTCATGGA GGCTAGCTACAACGA CCTGACAA | 19186 |
| 1277 | CAGGGUCC A UGAAAAAC | 6293 | GTTTTTCA GGCTAGCTACAACGA GGACCCTG | 19187 |
| 1284 | CAUGAAAA A CCUUUUGU | 8605 | ACAAAAGG GGCTAGCTACAACGA TTTTCATG | 19188 |
| 1291 | AACCUUUU G UUGCUUUU | 8606 | AAAAGCAA GGCTAGCTACAACGA AAAAGGTT | 19189 |
| 1294 | CUUUUGUU G CUUUUGGA | 8607 | TCCAAAAG GGCTAGCTACAACGA AACAAAAG | 19190 |
| 1304 | UUUUGGAA G UGGCAUGG | 8608 | CCATGCCA GGCTAGCTACAACGA TTCCAAAA | 19191 |
| 1307 | UGGAAGUG G CAUGGAAU | 8609 | ATTCCATG GGCTAGCTACAACGA CACTTCCA | 19192 |
| 1309 | GAAGUGGC A UGGAAUCU | 6297 | AGATTCCA GGCTAGCTACAACGA GCCACTTC | 19193 |
| 1314 | GGCAUGGA A UCUCUGGU | 8610 | ACCAGAGA GGCTAGCTACAACGA TCCATGCC | 19194 |
| 1321 | AAUCUCUG G UGGAAGCC | 8611 | GGCTTCCA GCCTAGCTACAACGA CAGAGATT | 19195 |
| 1327 | UGGUGGAA G CCACGGUG | 8612 | CACCGTGG GGCTAGCTACAACGA TTCCACCA | 19196 |
| 1330 | UGGAAGCC A CGGUGGGG | 6301 | CCCCACCG GGCTAGCTACAACGA GGCTTCCA | 19197 |
| 1333 | AAGCCACG G UGGGGGAG | 8613 | CTCCCCCA GGCTAGCTACAACGA CGTGGCTT | 19198 |
| 1341 | GUGGGGGA G CGUGUCAG | 8614 | CTGACACG GGCTAGCTACAACGA TCCCCCAC | 19199 |

TABLE XXII-continued

Human KDR DNAzyme and Substrate sequence

| Pos | Substrate | Seq ID No | DNAzyme | Seq ID No |
|---|---|---|---|---|
| 1343 | GGGGGAGC G UGUCAGAA | 8615 | TTCTGACA GGCTAGCTACAACGA GCTCCCCC | 19200 |
| 1345 | GGGAGCGU G UCAGAAUC | 8616 | GATTCTGA GGCTAGCTACAACGA ACGCTCCC | 19201 |
| 1351 | GUGUCAGA A UCCCUGCG | 8617 | CGCAGGGA GGCTAGCTACAACGA TCTGACAC | 19202 |
| 1357 | GAAUCCCU G CGAAGUAC | 8618 | GTACTTCG GGCTAGCTACAACGA AGGGATTC | 19203 |
| 1362 | CCUGCGAA U ACCUUGG | 8619 | CCAAGGTA GCCTAGCTACAACGA TTCGCAGG | 19204 |
| 1364 | UGCGAAGU A CCUUGGUU | 1686 | AACCAAGG GCCTAGCTACAACGA ACTTCGCA | 19205 |
| 1370 | GUACCUUG G UUACCCAC | 8620 | GTGGGTAA GGCTAGCTACAACGA CAAGGTAC | 19206 |
| 1373 | CCUUGGUU A CCCACCCC | 1689 | GGGGTGGG GGCTAGCTACAACGA AACCAAGG | 19207 |
| 1377 | GGUUACCC A CCCCCAGA | 6310 | TCTGGGGG GGCTAGCTACAACGA GGGTAACC | 19208 |
| 1387 | CCCCAGAA A UAAAAUGG | 8621 | CCATTTTA GGCTAGCTACAACGA TTCTGGGG | 19209 |
| 1392 | GAAAUAAA A UGGUAUAA | 8622 | TTATACCA GGCTAGCTACAACGA TTTATTTC | 19210 |
| 1395 | AUAAAAUG G UAUAAAA | 8623 | TTTTTATA GGCTAGCTACAACGA CATTTTAT | 19211 |
| 1397 | AAAAUGGU A UAAAAUG | 1691 | CATTTTTA GGCTAGCTACAACGA ACCATTTT | 19212 |
| 1403 | GUAUAAAA A UGGAAUAC | 8624 | GTATTCCA GGCTAGCTACAACGA TTTTATAC | 19213 |
| 1408 | AAAAUGGA A UACCCCUU | 8625 | AAGGGGTA GGCTAGCTACAACGA TCCATTTT | 19214 |
| 1410 | AAUGGAAU A CCCCUUGA | 1693 | TCAAGGGG GGCTAGCTACAACGA ATTCCATT | 19215 |
| 1419 | CCCCUUGA G UCCAAUCA | 8626 | TGATTGGA GGCTAGCTACAACGA TCAAGGGG | 19216 |
| 1424 | UGAGUCCA A UCACACAA | 8627 | TTGTGTGA GGCTAGCTACAACGA TGGACTCA | 19217 |
| 1427 | GUCCAAUC A CACAAUUA | 6322 | TAATTGTG GGCTAGCTACAACGA GATTGGAC | 19218 |
| 1429 | CCAAUCAC A CAAUUAAA | 6323 | TTTAATTG GGCTAGCTACAACGA GTCATTGG | 19219 |
| 1432 | AUCACACA A UUAAAGCG | 8628 | CGCTTTAA GGCTAGCTACAACGA TGTGTGAT | 19220 |
| 1438 | CAAUUAAA G CGGGGCAU | 8629 | ATGCCCCG GGCTAGCTACAACGA TTTAATTG | 19221 |
| 1443 | AAAGCGGG G CAUGUACU | 8630 | AGTACATG GGCTAGCTACAACGA CCCGCTTT | 19222 |
| 1445 | AGCGGGGC A UGUACUGA | 6325 | TCAGTACA GGCTAGCTACAACGA GCCCCGCT | 19223 |
| 1447 | CGGGGCAU G UACUGACG | 8631 | CGTCAGTA GGCTAGCTACAACGA ATGCCCCG | 19224 |
| 1449 | GGGCAUGU A CUGACGAU | 1699 | ATCGTCAG GGCTAGCTACAACGA ACATGCCC | 19225 |
| 1453 | AUGUACUG A CGAUUAUG | 8632 | CATAATCG GCCTAGCTACAACGA CAGTACAT | 19226 |
| 1456 | UACUGACG A UUAUGGAA | 8633 | TTCCATAA GGCTAGCTACAACGA CGTCAGTA | 19227 |
| 1459 | UGACGAUU A UGGAAGUG | 1701 | CACTTCCA GGCTAGCTACAACGA AATCGTCA | 19228 |
| 1465 | UUAUGGAA G UGAGUGAA | 8634 | TTCACTCA GGCTAGCTACAACGA TTCCATAA | 19229 |
| 1469 | GGAAGUGA G UGAAAGAG | 8635 | CTCTTTCA GGCTAGCTACAACGA TCACTTCC | 19230 |
| 1478 | UGAAAGAG A CACAGGAA | 8636 | TTCCTGTG GCCTAGCTACAACGA CTCTTTCA | 19231 |
| 1480 | AAAGAGAC A CAGGAAAU | 6327 | ATTTCCTG GGCTAGCTACAACGA GTCTCTTT | 19232 |
| 1487 | CACAGGAA A UUACACUG | 8637 | CAGTGTAA GGCTAGCTACAACGA TTCCTGTG | 19233 |
| 1490 | AGGAAAUU A CACUGUCA | 1703 | TGACAGTG GGCTAGCTACAACGA AATTTCCT | 19234 |
| 1492 | GAAAUUAC A CUGUCAUC | 6329 | GATGACAG GGCTAGCTACAACGA GTAATTTC | 19235 |
| 1495 | AUUACACU G UCAUCCUU | 8638 | AAGGATGA GGCTAGCTACAACGA AGTGTAAT | 19236 |

TABLE XXII-continued

Human KDR DNAzyme and Substrate sequence

| Pos | Substrate | Seq ID No | DNAzyme | Seq ID No |
|---|---|---|---|---|
| 1498 | ACACUGUC A UCCUUACC | 6331 | GGTAAGGA GGCTAGCTACAACGA GACAGTGT | 19237 |
| 1504 | UCAUCCUU A CCAAUCCC | 1707 | GGGATTGG GGCTAGCTACAACGA AAGGATGA | 19238 |
| 1508 | CCUUACCA A UCCCAUUU | 8639 | AAATGGGA GGCTAGCTACAACGA TGGTAAGG | 19239 |
| 1513 | CCAAUCCC A UUUCAAAG | 6338 | CTTTGAAA GGCTAGCTACAACGA GGGATTGG | 19240 |
| 1527 | AAGGAGAA G CAGAGCCA | 8640 | TGGCTCTG GGCTAGCTACAACGA TTCTCCTT | 19241 |
| 1532 | GAAGCAGA G CCAUGUGG | 8641 | CCACATGG GGCTAGCTACAACGA TCTGCTTC | 19242 |
| 1535 | GCAGAGCC A UGUGGUCU | 6342 | AGACCACA GGCTAGCTACAACGA GGCTCTGC | 19243 |
| 1537 | AGAGCCAU G UGGUCUCU | 8642 | AGAGACCA GGCTAGCTACAACGA ATGGCTCT | 19244 |
| 1540 | GCCAUGUG G UCUCUCUG | 8643 | CAGAGAGA GGCTAGCTACAACGA CACATGGC | 19245 |
| 1549 | UCUCUCUG G UUGUGUAU | 8644 | ATACACAA GGCTAGCTACAACGA CAGAGAGA | 19246 |
| 1552 | CUCUGGUU G UGUAUGUC | 8645 | GACATACA GGCTAGCTACAACGA AACCAGAG | 19247 |
| 1554 | CUGGUUGU G UAUGUCCC | 8646 | GGGACATA GGCTAGCTACAACGA ACAACCAG | 19248 |
| 1556 | GGUUGUGU A UGUCCCAC | 1716 | GTGGGACA GGCTAGCTACAACGA ACACAACC | 19249 |
| 1558 | UUGUGUAU G UCCCACCC | 8647 | GGGTGGGA GGCTAGCTACAACGA ATACACAA | 19250 |
| 1563 | UAUGUCCC A CCCCAGAU | 6348 | ATCTGGGG GGCTAGCTACAACGA GGGACATA | 19251 |
| 1570 | CACCCCAG A UUGGUGAG | 8648 | CTCACCAA GGCTAGCTACAACGA CTGGGGTG | 19252 |
| 1574 | CCAGAUUG G UGAGAAAU | 8649 | ATTTCTCA GGCTAGCTACAACGA CAATCTGG | 19253 |
| 1581 | GGUGAGAA A UCUCUAAU | 8650 | ATTAGAGA GGCTAGCTACAACGA TTCTCACC | 19254 |
| 1588 | AAUCUCUA A UCUCUCCU | 8651 | AGGAGAGA GGCTAGCTACAACGA TAGAGATT | 19255 |
| 1597 | UCUCUCCU G UGGAUUCC | 8652 | GGAATCCA GGCTAGCTACAACGA AGGAGAGA | 19256 |
| 1601 | UCCUGUGG A UUCCUACC | 8653 | GGTAGGAA GGCTAGCTACAACGA CCACAGGA | 19257 |
| 1607 | GGAUUCCU A CCAGUACG | 1727 | CGTACTGG GGCTAGCTACAACGA AGGAATCC | 19258 |
| 1611 | UCCUACCA G UACGGCAC | 8654 | GTGCCGTA GGCTAGCTACAACGA TGGTAGGA | 19259 |
| 1613 | CUACCAGU A CGGCACCA | 1728 | TGGTGCCG GGCTAGCTACAACGA ACTGGTAG | 19260 |
| 1616 | CCAGUACG G CACCACUC | 8655 | GAGTGGTG GGCTAGCTACAACGA CGTACTGG | 19261 |
| 1618 | AGUACGGC A CCACUCAA | 6363 | TTGAGTGG GGCTAGCTACAACGA GCCGTACT | 19262 |
| 1621 | ACGGCACC A CUCAAACG | 6365 | CGTTTGAG GGCTAGCTACAACGA GGTGCCGT | 19263 |
| 1627 | CCACUCAA A CGCUGACA | 8656 | TGTCAGCG GGCTAGCTACAACGA TTGAGTGG | 19264 |
| 1629 | ACUCAAAC G CUGACAUG | 8657 | CATGTCAG GGCTAGCTACAACGA GTTTGAGT | 19265 |
| 1633 | AAACGCUG A CAUGUACG | 8658 | CGTACATG GGCTAGCTACAACGA CAGCGTTT | 19266 |
| 1635 | ACGCUGAC A UGUACGGU | 6369 | ACCGTACA GGCTAGCTACAACGA GTCAGCGT | 19267 |
| 1637 | GCUGACAU G UACGGUCU | 8659 | AGACCGTA GGCTAGCTACAACGA ATGTCAGC | 19268 |
| 1639 | UGACAUGU A CGGUCUAU | 1730 | ATAGACCG GGCTAGCTACAACGA ACATGTCA | 19269 |
| 1642 | CAUGUACG G UCUAUGCC | 8660 | GGCATAGA GGCTAGCTACAACGA CGTACATG | 19270 |
| 1646 | UACGGUCU A UGCCAUUC | 1732 | GAATGGCA GGCTAGCTACAACGA AGACCGTA | 19271 |
| 1648 | CGGUCUAU G CCAUUCCU | 8661 | AGGAATGG GGCTAGCTACAACGA ATAGACCG | 19272 |
| 1651 | UCUAUGCC A UUCCUCCC | 6372 | GGGAGGAA GGCTAGCTACAACGA GGCATAGA | 19273 |

TABLE XXII-continued

Human KDR DNAzyme and Substrate sequence

| Pos | Substrate | Seq ID No | DNAzyme | Seq ID No |
|---|---|---|---|---|
| 1662 | CCUCCCCC G CAUCACAU | 8662 | ATGTGATG GGCTAGCTACAACGA GGGGGAGG | 19274 |
| 1664 | UCCCCCGC A UCACAUCC | 6379 | GGATGTGA GGCTAGCTACAACGA GCGGGGGA | 19275 |
| 1667 | CCCGCAUC A CAUCCACU | 6380 | AGTGGATG GGCTAGCTACAACGA GATGCGGG | 19276 |
| 1669 | CGCAUCAC A UCCACUGG | 6381 | CCAGTGGA GGCTAGCTACAACGA GTGATGCG | 19277 |
| 1673 | UCACAUCC A CUGGUAUU | 6383 | AATACCAG GGCTAGCTACAACGA GGATGTGA | 19278 |
| 1677 | AUCCACUG G UAUUGGCA | 8663 | TGCCAATA GGCTAGCTACAACGA CAGTGGAT | 19279 |
| 1679 | CCACUGGU A UUGGCAGU | 1738 | ACTGCCAA GGCTAGCTACAACGA ACCAGTGG | 19280 |
| 1683 | UGGUAUUG G CAGUUGGA | 8664 | TCCAACTG GGCTAGCTACAACGA CAATACCA | 19281 |
| 1686 | UAUUGGCA G UGGAGGA | 8665 | TCCTCCAA GGCTAGCTACAACGA TGCCAATA | 19282 |
| 1698 | GAGGAAGA G UGCGCCAA | 8666 | TTGGCGCA GGCTAGCTACAACGA TCTTCCTC | 19283 |
| 1700 | GGAAGAGU G CGCCAACG | 8667 | CGTTGGCG GGCTAGCTACAACGA ACTCTTCC | 19284 |
| 1702 | AAGAGUGC G CCAACGAG | 8668 | CTCGTTGC GGCTAGCTACAACGA GCACTCTT | 19285 |
| 1706 | GUGCGCCA A CGAGCCCA | 8669 | TGGGCTCG GGCTAGCTACAACGA TGGCGCAC | 19286 |
| 1710 | GCCAACGA G CCCAGCCA | 8670 | TGGCTGGG GGCTAGCTACAACGA TCGTTGGC | 19287 |
| 1715 | CGAGCCCA G CCAAGCUG | 8671 | CAGCTTGG GGCTAGCTACAACGA TGGGCTCG | 19288 |
| 1720 | CCAGCCAA G CUGUCUCA | 8672 | TGAGACAG GGCTAGCTACAACGA TTGGCTGG | 19289 |
| 1723 | GCCAAGCU G UCUCAGUG | 8673 | CACTGAGA GGCTAGCTACAACGA AGCTTGGC | 19290 |
| 1729 | CUGUCUCA G UGACAAAC | 8674 | GTTTGTCA GGCTAGCTACAACGA TGAGACAG | 19291 |
| 1732 | UCUCAGUG A CAAACCCA | 8675 | TGGGTTTG GGCTAGCTACAACGA CACTGAGA | 19292 |
| 1736 | AGUGACAA A CCCAUACC | 8676 | GGTATGGG GGCTAGCTACAACGA TTGTCACT | 19293 |
| 1740 | ACAAACCC A UACCCUUG | 6399 | CAAGGGTA GGCTAGCTACAACGA GGGTTTGT | 19294 |
| 1742 | AAACCCAU A CCCUUGUG | 1743 | CACAAGGG GGCTAGCTACAACGA ATGGGTTT | 19295 |
| 1748 | AUACCCUU G UGAAGAAU | 8677 | ATTCTTCA GGCTAGCTACAACGA AAGGGTAT | 19296 |
| 1755 | UGUGAAGA A UGGAGAAG | 8678 | CTTCTCCA GGCTAGCTACAACGA TCTTCACA | 19297 |
| 1763 | AUGGAGAA G UGUGGAGG | 8679 | CCTCCACA GGCTAGCTACAACGA TTCTCCAT | 19298 |
| 1765 | GGAGAAGU G UGGAGGAC | 8680 | GTCCTCCA GGCTAGCTACAACGA ACTTCTCC | 19299 |
| 1772 | UGUGGAGG A CUUCCAGG | 8681 | CCTGGAAG GGCTAGCTACAACGA CCTCCACA | 19300 |
| 1787 | GGGAGGAA A UAAAAUUG | 8682 | CAATTTTA GGCTAGCTACAACGA TTCCTCCC | 19301 |
| 1792 | GAAAUAAA A UUGAAGUU | 8683 | AACTTCAA GGCTAGCTACAACGA TTTATTTC | 19302 |
| 1798 | AAAUUGAA G UUAAUAAA | 8684 | TTTATTAA GGCTAGCTACAACGA TTCAATTT | 19303 |
| 1802 | UGAAGUUA A UAAAAAUC | 8685 | GATTTTTA GGCTAGCTACAACGA TAACTTCA | 19304 |
| 1808 | UAAUAAAA A UCAAUUUG | 8686 | CAAATTGA GGCTAGCTACAACGA TTTTATTA | 19305 |
| 1812 | AAAAAUCA A UUUGCUCU | 8687 | AGAGCAAA GGCTAGCTACAACGA TGATTTTT | 19306 |
| 1816 | AUCAAUUU G CUCUAAUU | 8688 | AATTAGAG GGCTAGCTACAACGA AAATTGAT | 19307 |
| 1822 | UUGCUCUA A UUGAAGGA | 8689 | TCCTTCAA GGCTAGCTACAACGA TAGAGCAA | 19308 |
| 1835 | AGGAAAAA A CAAAACUG | 8690 | CAGTTTTG GGCTAGCTACAACGA TTTTTCCT | 19309 |
| 1840 | AAAACAAA A CUGUAAGU | 8691 | ACTTACAG GCCTAGCTACAACGA TTTGTTTT | 19310 |

TABLE XXII-continued

Human KDR DNAzyme and Substrate sequence

| Pos | Substrate | Seq ID No | DNAzyme | Seq ID No |
|---|---|---|---|---|
| 1843 | ACAAAACU G UAAGUACC | 8692 | GGTACTTA GGCTAGCTACAACGA AGTTTTGT | 19311 |
| 1847 | AACUGUAA G UACCCUUG | 8693 | CAAGGGTA GGCTAGCTACAACGA TTACAGTT | 19312 |
| 1849 | CUGUAAGU A CCCUUGUU | 1759 | AACAAGGG GGCTAGCTACAACGA ACTTACAG | 19313 |
| 1855 | GUACCCUU G UUAUCCAA | 8694 | TTGGATAA GGCTAGCTACAACGA AAGGGTAC | 19314 |
| 1858 | CCCUUGUU A UCCAAGCG | 1762 | CGCTTGGA GGCTAGCTACAACGA AACAAGGG | 19315 |
| 1864 | UUAUCCAA G CGGCAAAU | 8695 | ATTTGCCG GGCTAGCTACAACGA TTGGATAA | 19316 |
| 1867 | UCCAAGCG G CAAAUGUG | 8696 | CACATTTG GGCTAGCTACAACGA CGCTTGGA | 19317 |
| 1871 | AGCGGCAA A UCUGUCAG | 8697 | CTGACACA GGCTAGCTACAACGA TTGCCGCT | 19318 |
| 1873 | CGGCAAAU G UGUCAGCU | 8698 | AGCTGACA GGCTAGCTACAACGA ATTTGCCG | 19319 |
| 1875 | GCAAAUGU G UCAGCUUU | 8699 | AAAGCTGA GGCTAGCTACAACGA ACATTTGC | 19320 |
| 1879 | AUGUGUCA G CUUUGUAC | 8700 | GTACAAAG GGCTAGCTACAACGA TGACACAT | 19321 |
| 1884 | UCAGCUUU G UACAAAUG | 8701 | CATTTGTA GGCTAGCTACAACGA AAAGCTGA | 19322 |
| 1886 | AGCUUUGU A CAAAUGUG | 1767 | CACATTTG GGCTAGCTACAACGA ACAAAGCT | 19323 |
| 1890 | UUGUACAA A UGUGAAGC | 8702 | GCTTCACA GGCTAGCTACAACGA TTGTACAA | 19324 |
| 1892 | GUACAAAU G UGAAGCGG | 8703 | CCGCTTCA GGCTAGCTACAACGA ATTTGTAC | 19325 |
| 1897 | AAUGUGAA G CGGUCAAC | 8704 | GTTGACCG GGCTAGCTACAACGA TTCACATT | 19326 |
| 1900 | GUGAAGCG G UCAACAAA | 8705 | TTTGTTGA GGCTAGCTACAACGA CGCTTCAC | 19327 |
| 1904 | AGCGGUCA A CAAAGUCG | 8706 | CGACTTTG GCCTAGCTACAACGA TGACCGCT | 19328 |
| 1909 | UCAACAAA G UCGGGAGA | 8707 | TCTCCCGA GGCTACCTACAACGA TTTGTTGA | 19329 |
| 1927 | GAGAGAGG G UGAUCUCC | 8708 | GGAGATCA GGCTAGCTACAACGA CCTCTCTC | 19330 |
| 1930 | AGAGGGUG A UCUCCUUC | 8709 | GAAGGAGA GGCTAGCTACAACGA CACCCTCT | 19331 |
| 1940 | CUCCUUCC A CGUGACCA | 6426 | TGGTCACG GGCTAGCTACAACGA GGAAGGAG | 19332 |
| 1942 | CCUUCCAC G UGACCAGG | 8710 | CCTGGTCA GGCTAGCTACAACGA GTGGAAGG | 19333 |
| 1945 | UCCACGUG A CCAGGGGU | 8711 | ACCCCTGG GGCTAGCTACAACGA CACGTGGA | 19334 |
| 1952 | GACCAGGG G UCCUGAAA | 8712 | TTTCAGGA GGCTAGCTACAACGA CCCTGGTC | 19335 |
| 1960 | GUCCUGAA A UUACUUUG | 8713 | CAAAGTAA GGCTAGCTACAACGA TTCAGGAC | 19336 |
| 1963 | CUGAAAUU A CUUUGCAA | 1776 | TTGCAAAG GGCTAGCTACAACGA AATTTCAG | 19337 |
| 1968 | AUUACUUU G CAACCUGA | 8714 | TCAGGTTG GGCTAGCTACAACGA AAAGTAAT | 19338 |
| 1971 | ACUUUGCA A CCUGACAU | 8715 | ATGTCAGG GGCTAGCTACAACGA TGCAAAGT | 19339 |
| 1976 | GCAACCUG A CAUGCAGC | 8716 | GCTGCATG GGCTAGCTACAACGA CAGGTTGC | 19340 |
| 1978 | AACCUGAC A UGCAGCCC | 6435 | GGGCTGCA GGCTAGCTACAACGA GTCAGGTT | 19341 |
| 1980 | CCUGACAU G CAGCCCAC | 8717 | GTGGGCTG GGCTAGCTACAACGA ATGTCAGG | 19342 |
| 1983 | GACAUGCA G CCCACUGA | 8718 | TCAGTGGG GGCTAGCTACAACGA TGCATGTC | 19343 |
| 1987 | UGCAGCCC A CUGAGCAG | 6439 | CTGCTCAG GGCTAGCTACAACGA GGGCTGCA | 19344 |
| 1992 | CCCACUGA G CAGGAGAG | 8719 | CTCTCCTG GGCTAGCTACAACGA TCAGTGGG | 19345 |
| 2000 | GCAGGAGA G CGUGUCUU | 8720 | AAGACACG GGCTAGCTACAACGA TCTCCTGC | 19346 |
| 2002 | AGGAGAGC G UGUCUUUG | 8721 | CAAAGACA GGCTAGCTACAACGA GCTCTCCT | 19347 |

TABLE XXII-continued

Human KDR DNAzyme and Substrate sequence

| Pos | Substrate | Seq ID No | DNAzyme | Seq ID No |
|---|---|---|---|---|
| 2004 | GAGAGCGU G UCUUUGUG | 8722 | CACAAAGA GGCTAGCTACAACGA ACGCTCTC | 19348 |
| 2010 | GUGUCUUU G UGGUGCAC | 8723 | GTGCACCA GGCTAGCTACAACGA AAAGACAC | 19349 |
| 2013 | UCUUUGUG G UGCACUGC | 8724 | GCAGTGCA GGCTAGCTACAACGA CACAAAGA | 19350 |
| 2015 | UUUGUGGU G CACUGCAG | 8725 | CTGCAGTG GGCTAGCTACAACGA ACCACAAA | 19351 |
| 2017 | UGUGGUGC A CUGCAGAC | 6443 | GTCTGCAG GGCTAGCTACAACGA GCACCACA | 19352 |
| 2020 | GGUGCACU G CAGACAGA | 8726 | TCTGTCTG GGCTAGCTACAACGA AGTGCACC | 19353 |
| 2024 | CACUGCAG A CAGAUCUA | 8727 | TAGATCTG GGCTAGCTACAACGA CTGCAGTG | 19354 |
| 2028 | GCAGACAG A UCUACGUU | 8728 | AACGTAGA GGCTAGCTACAACGA CTGTCTGC | 19355 |
| 2032 | ACAGAUCU A CGUUUGAG | 1783 | CTCAAACG GGCTAGCTACAACGA AGATCTGT | 19356 |
| 2034 | AGAUCUAC G UUUGAGAA | 8729 | TTCTCAAA GGCTAGCTACAACGA GTAGATCT | 19357 |
| 2042 | GUUUGAGA A CCUCACAU | 8730 | ATGTGAGG GGCTAGCTACAACGA TCTCAAAC | 19358 |
| 2047 | AGAACCUC A CAUGGUAC | 6450 | GTACCATG GGCTAGCTACAACGA GAGGTTCT | 19359 |
| 2049 | AACCUCAC A UGGUACAA | 6451 | TTGTACCA GGCTAGCTACAACGA GTGAGGTT | 19360 |
| 2052 | CUCACAUG G UACAAGCU | 8731 | AGCTTGTA GGCTAGCTACAACGA CATGTGAG | 19361 |
| 2054 | CACAUGGU A CAAGCUUG | 1787 | CAAGCTTG GGCTAGCTACAACGA ACCATGTG | 19362 |
| 2058 | UGGUACAA G CUUGGCCC | 8732 | GGGCCAAG GGCTAGCTACAACGA TTGTACCA | 19363 |
| 2063 | CAAGCUUG G CCCACAGC | 8733 | GCTGTGGG GGCTAGCTACAACGA CAAGCTTG | 19364 |
| 2067 | CUUGGCCC A CAGCCUCU | 6456 | AGAGGCTG GGCTAGCTACAACGA GGGCCAAG | 19365 |
| 2070 | GGCCCACA G CCUCUGCC | 8734 | GGCAGAGG GGCTAGCTACAACGA TGTGGGCC | 19366 |
| 2076 | CAGCCUCU G CCAAUCCA | 8735 | TGGATTGG GGCTAGCTACAACGA AGAGGCTG | 19367 |
| 2080 | CUCUGCCA A UCCAUGUG | 8736 | CACATGGA GGCTAGCTACAACGA TGGCAGAG | 19368 |
| 2084 | GCCAAUCC A UGUGGGAG | 6464 | CTCCCACA GGCTAGCTACAACGA GGATTGGC | 19369 |
| 2086 | CAAUCCAU G UGGGAGAG | 8737 | CTCTCCCA GGCTAGCTACAACGA ATGGATTG | 19370 |
| 2094 | GUGGGAGA G UUGCCCAC | 8738 | GTGGGCAA GGCTAGCTACAACGA TCTCCCAC | 19371 |
| 2097 | GGAGAGUU G CCCACACC | 8739 | GGTGTGGG GGCTAGCTACAACGA AACTCTCC | 19372 |
| 2101 | AGUUGCCC A CACCUGUU | 6467 | AACAGGTG GGCTAGCTACAACGA GGGCAACT | 19373 |
| 2103 | UUGCCCAC A CCUGUUUG | 6468 | CAAACAGG GGCTAGCTACAACGA GTGGGCAA | 19374 |
| 2107 | CCACACCU G UUUGCAAG | 8740 | CTTGCAAA GGCTAGCTACAACGA AGGTGTGG | 19375 |
| 2111 | ACCUGUUU G CAAGAACU | 8741 | AGTTCTTG GGCTAGCTACAACGA AAACAGGT | 19376 |
| 2117 | UUGCAAGA A CUUGGAUA | 8742 | TATCCAAG GGCTAGCTACAACGA TCTTGCAA | 19377 |
| 2123 | GAACUUGG A UACUCUUU | 8743 | AAAGAGTA GGCTAGCTACAACGA CCAAGTTC | 19378 |
| 2125 | ACUUGGAU A CUCUUUGG | 1795 | CCAAAGAG GGCTAGCTACAACGA ATCCAAGT | 19379 |
| 2136 | CUUUGGAA A UUGAAUGC | 8744 | GCATTCAA GGCTAGCTACAACGA TTCCAAAG | 19380 |
| 2141 | GAAAUUGA A UGCCACCA | 8745 | TGGTGGCA GGCTAGCTACAACGA TCAATTTC | 19381 |
| 2143 | AAUUGAAU G CCACCAUG | 8746 | CATGGTGG GGCTAGCTACAACGA ATTCAATT | 19382 |
| 2146 | UGAAUGCC A CCAUGUUC | 6476 | GAACATGG GGCTAGCTACAACGA GGCATTCA | 19383 |
| 2149 | AUGCCACC A UGUUCUCU | 6478 | AGAGAACA GGCTAGCTACAACGA GGTGGCAT | 19384 |

TABLE XXII-continued

Human KDR DNAzyme and Substrate sequence

| Pos | Substrate | Seq ID No | DNAzyme | Seq ID No |
|---|---|---|---|---|
| 2151 | GCCACCAU G UUCUCUAA | 8747 | TTAGAGAA GGCTAGCTACAACGA ATGGTGGC | 19385 |
| 2159 | GUUCUCUA A UAGCACAA | 8748 | TTGTGCTA GGCTAGCTACAACGA TAGAGAAC | 19386 |
| 2162 | CUCUAAUA G CACAAAUG | 8749 | CATTTGTG GGCTAGCTACAACGA TATTAGAG | 19387 |
| 2164 | CUAAUAGC A CAAAUGAC | 6481 | GTCATTTG GGCTAGCTACAACGA GCTATTAG | 19388 |
| 2168 | UAGCACAA A UGACAUUU | 8750 | AAATGTCA GGCTAGCTACAACGA TTGTGCTA | 19389 |
| 2171 | CACAAAUG A CAUUUUGA | 8751 | TCAAAATG GGCTAGCTACAACGA CATTTGTG | 19390 |
| 2173 | CAAAUGAC A UUUUGAUC | 6483 | GATCAAAA GGCTAGCTACAACGA GTCATTTG | 19391 |
| 2179 | ACAUUUUG A UCAUGGAG | 8752 | CTCCATGA GGCTAGCTACAACGA CAAAATGT | 19392 |
| 2182 | UUUUGAUC A UGGAGCUU | 6484 | AAGCTCCA GGCTAGCTACAACGA GATCAAAA | 19393 |
| 2187 | AUCAUGGA G CUUAAGAA | 8753 | TTCTTAAG GGCTAGCTACAACGA TCCATGAT | 19394 |
| 2195 | GCUUAAGA A UGCAUCCU | 8754 | AGGATGCA GGCTAGCTACAACGA TCTTAAGC | 19395 |
| 2197 | UUAAGAAU G CAUCCUUG | 8755 | CAAGGATG GGCTAGCTACAACGA ATTCTTAA | 19396 |
| 2199 | AAGAAUGC A UCCUUGCA | 6486 | TGCAAGGA GGCTAGCTACAACGA GCATTCTT | 19397 |
| 2205 | GCAUCCUU G CAGGACCA | 8756 | TGGTCCTG GGCTAGCTACAACGA AAGGATGC | 19398 |
| 2210 | CUUGCAGG A CCAAGGAG | 8757 | CTCCTTGG GGCTAGCTACAACGA CCTGCAAG | 19399 |
| 2219 | CCAAGGAG A CUAUGUCU | 8758 | AGACATAG GGCTAGCTACAACGA CTCCTTGG | 19400 |
| 2222 | AGGAGACU A UGUCUGCC | 1813 | GGCAGACA GGCTAGCTACAACGA AGTCTCCT | 19401 |
| 2224 | GAGACUAU G UCUGCCUU | 8759 | AAGGCAGA GGCTAGCTACAACGA ATAGTCTC | 19402 |
| 2228 | CUAUGUCU G CCUUGCUC | 8760 | GAGCAAGG GGCTAGCTACAACGA AGACATAG | 19403 |
| 2233 | UCUGCCUU G CUCAAGAC | 8761 | GTCTTGAG GGCTAGCTACAACGA AAGGCAGA | 19404 |
| 2240 | UGCUCAAG A CAGGAAGA | 8762 | TCTTCCTG GGCTAGCTACAACGA CTTGAGCA | 19405 |
| 2248 | ACAGGAAG A CCAAGAAA | 8763 | TTTCTTGG GGCTAGCTACAACGA CTTCCTGT | 19406 |
| 2259 | AAGAAAAG A CAUUGCGU | 8764 | ACGCAATG GGCTAGCTACAACGA CTTTTCTT | 19407 |
| 2261 | GAAAAGAC A UUGCGUGG | 6501 | CCACGCAA GGCTAGCTACAACGA GTCTTTTC | 19408 |
| 2264 | AAGACAUU G CGUGGUCA | 8765 | TGACCACG GGCTAGCTACAACGA AATGTCTT | 19409 |
| 2266 | GACAUUGC G UGGUCAGG | 8766 | CCTGACCA GGCTAGCTACAACGA GCAATGTC | 19410 |
| 2269 | AUUGCGUG G UCAGGCAG | 8767 | CTGCCTGA GGCTAGCTACAACGA CACGCAAT | 19411 |
| 2274 | GUGGUCAG G CAGCUCAC | 8768 | GTGAGCTG GGCTAGCTACAACGA CTGACCAC | 19412 |
| 2277 | GUCAGGCA G CUCACAGU | 8769 | ACTGTGAG GGCTAGCTACAACGA TGCCTGAC | 19413 |
| 2281 | GGCAGCUC A CAGUCCUA | 6505 | TAGGACTG GGCTAGCTACAACGA GAGCTGCC | 19414 |
| 2284 | AGCUCACA G UCCUAGAG | 8770 | CTCTAGGA GGCTAGCTACAACGA TGTGAGCT | 19415 |
| 2292 | GUCCUAGA G CGUGUGGC | 8771 | GCCACACG GGCTAGCTACAACGA TCTAGGAC | 19416 |
| 2294 | CCUAGAGC G UGUGGCAC | 8772 | GTGCCACA GGCTAGCTACAACGA GCTCTAGG | 19417 |
| 2296 | UAGAGCGU G UGGCACCC | 8773 | GGGTGCCA GGCTAGCTACAACGA ACGCTCTA | 19418 |
| 2299 | AGCGUGUG G CACCCACG | 8774 | CGTGGGTG GGCTAGCTACAACGA CACACGCT | 19419 |
| 2301 | CGUGUGGC A CCCACGAU | 6509 | ATCGTGGG GGCTAGCTACAACGA GCCACACG | 19420 |
| 2305 | UGGCACCC A CGAUCACA | 6512 | TGTGATCG GGCTAGCTACAACGA GGGTGCCA | 19421 |

TABLE XXII-continued

Human KDR DNAzyme and Substrate sequence

| Pos | Substrate | Seq ID No | DNAzyme | Seq ID No |
|---|---|---|---|---|
| 2308 | CACCCACG A UCACAGGA | 8775 | TCCTGTGA GGCTAGCTACAACGA CGTGGGTG | 19422 |
| 2311 | CCACGAUC A CAGGAAAC | 6513 | GTTTCCTG GGCTAGCTACAACGA GATCGTGG | 19423 |
| 2318 | CACAGGAA A CCUGGAGA | 8776 | TCTCCAGG GGCTAGCTACAACGA TTCCTGTG | 19424 |
| 2327 | CCUGGAGA A UCAGACGA | 8777 | TCGTCTGA GGCTAGCTACAACGA TCTCCAGG | 19425 |
| 2332 | AGAAUCAG A CGACAAGU | 8778 | ACTTGTCG GGCTAGCTACAACGA CTGATTCT | 19426 |
| 2335 | AUCAGACG A CAAGUAUU | 8779 | AATACTTG GGCTAGCTACAACGA CGTCTGAT | 19427 |
| 2339 | GACGACAA G UAUUGGGG | 8780 | CCCCAATA GGCTAGCTACAACGA TTGTCGTC | 19428 |
| 2341 | CGACAAGU A UUGGGGAA | 1824 | TTCCCCAA GGCTAGCTACAACGA ACTTGTCG | 19429 |
| 2351 | UGGGGAAA G CAUCGAAG | 8781 | CTTCGATG GGCTAGCTACAACGA TTTCCCCA | 19430 |
| 2353 | GGGAAAGC A UCGAAGUC | 6519 | GACTTCGA GGCTAGCTACAACGA GCTTTCCC | 19431 |
| 2359 | GCAUCGAA G UCUCAUGC | 8782 | GCATGAGA GGCTAGCTACAACGA TTCGATGC | 19432 |
| 2364 | GAAGUCUC A UGCACGGC | 6521 | GCCGTGCA GGCTAGCTACAACGA GAGACTTC | 19433 |
| 2366 | AGUCUCAU G CACGGCAU | 8783 | ATGCCGTG GGCTAGCTACAACGA ATGAGACT | 19434 |
| 2368 | UCUCAUGC A CGGCAUCU | 6522 | AGATGCCG GGCTAGCTACAACGA GCATGAGA | 19435 |
| 2371 | CAUGCACG G CAUCUGGG | 8784 | CCCAGATG GGCTAGCTACAACGA CGTGCATG | 19436 |
| 2373 | UGCACGGC A UCUGGGAA | 6523 | TTCCCAGA GGCTAGCTACAACGA GCCGTGCA | 19437 |
| 2381 | AUCUGGGA A UCCCCCUC | 8785 | GAGGGGGA GGCTAGCTACAACGA TCCCAGAT | 19438 |
| 2391 | CCCCCUCC A CAGAUCAU | 6531 | ATGATCTG GGCTAGCTACAACGA GGAGGGGG | 19439 |
| 2395 | CUCCACAG A UCAUGUGG | 8786 | CCACATGA GGCTAGCTACAACGA CTGTGGAG | 19440 |
| 2398 | CACAGAUC A UGUGGUUU | 6533 | AAACCACA GGCTAGCTACAACCA GATCTGTG | 19441 |
| 2400 | CAGAUCAU G UGGUUUAA | 8787 | TTAAACCA GGCTAGCTACAACGA ATGATCTG | 19442 |
| 2403 | AUCAUGUG G UGGAAAGA | 8788 | TCTTTAAA GGCTAGCTACAACGA CACATGAT | 19443 |
| 2411 | GUUUAAAG A UAAUGAGA | 8789 | TCTCATTA GGCTAGCTACAACGA CTTTAAAC | 19444 |
| 2414 | UAAAGAUA A UGAGACCC | 8790 | GGGTCTCA GGCTAGCTACAACGA TATCTTTA | 19445 |
| 2419 | AUAAUGAG A CCCUUCUA | 8791 | TACAAGGG GGCTAGCTACAACGA CTCATTAT | 19446 |
| 2425 | AGACCCUU G UAGAAGAC | 8792 | GTCTTCTA GGCTAGCTACAACGA AAGGGTCT | 19447 |
| 2432 | UGUAGAAG A CUCAGGCA | 8793 | TGCCTGAG GGCTAGCTACAACGA CTTCTACA | 19448 |
| 2438 | AGACUCAG G CAUUGUAU | 8794 | ATACAATG GGCTAGCTACAACGA CTGAGTCT | 19449 |
| 2440 | ACUCAGGC A UUGUAUUG | 6539 | CAATACAA GGCTAGCTACAACGA GCCTGACT | 19450 |
| 2443 | CAGGCAUU G UAUUGAAG | 8795 | CTTCAATA GGCTAGCTACAACGA AATGCCTG | 19451 |
| 2445 | GGCAUUGU A UUGAAGGA | 1841 | TCCTTCAA GGCTAGCTACAACGA ACAATGCC | 19452 |
| 2453 | AUUGAAGG A UGGGAACC | 8796 | GGTTCCCA GGCTAGCTACAACGA CCTTCAAT | 19453 |
| 2459 | GGAUGGGA A CCGGAACC | 8797 | GGTTCCGG GGCTAGCTACAACGA TCCCATCC | 19454 |
| 2465 | GAACCGGA A CCUCACUA | 8798 | TAGTGAGG GGCTAGCTACAACGA TCCGGTTC | 19455 |
| 2470 | GGAACCUC A CUAUCCGC | 6543 | GCGGATAG GGCTAGCTACAACGA GAGGTTCC | 19456 |
| 2473 | ACCUCACU A UCCGCAGA | 1844 | TCTGCGGA GGCTAGCTACAACGA AGTGAGGT | 19457 |
| 2477 | CACUAUCC G CAGAGUGA | 8799 | TCACTCTG GGCTAGCTACAACGA GGATAGTG | 19458 |

TABLE XXII-continued

Human KDR DNAzyme and Substrate sequence

| Pos | Substrate | Seq ID No | DNAzyme | Seq ID No |
|---|---|---|---|---|
| 2482 | UCCGCAGA G UGAGGAAG | 8800 | CTTCCTCA GGCTAGCTACAACGA TCTGCGGA | 19459 |
| 2495 | GAAGGAGG A CGAAGGCC | 8801 | GGCCTTCG GGCTAGCTACAACGA CCTCCTTC | 19460 |
| 2501 | GGACGAAG G CCUCUACA | 8802 | TGTAGAGG GGCTAGCTACAACGA CTTCGTCC | 19461 |
| 2507 | AGGCCUCU A CACCUGCC | 1847 | GGCAGGTG GGCTAGCTACAACGA AGAGGCCT | 19462 |
| 2509 | GCCUCUAC A CCUGCCAG | 6550 | CTGGCAGG GGCTAGCTACAACGA GTAGAGGC | 19463 |
| 2513 | CUACACCU G CCAGGCAU | 8803 | ATGCCTGG GGCTAGCTACAACGA AGGTGTAG | 19464 |
| 2518 | CCUGCCAG G CAUGCAGU | 8804 | ACTGCATG GGCTAGCTACAACGA CTGGCAGG | 19465 |
| 2520 | UGCCAGGC A UGCAGUGU | 6555 | ACACTGCA GGCTAGCTACAACGA GCCTGGCA | 19466 |
| 2522 | CCAGGCAU G CAGUGUUC | 8805 | GAACACTG GGCTAGCTACAACGA ATGCCTGG | 19467 |
| 2525 | GGCAUGCA G UGUUCUUG | 8806 | CAAGAACA GGCTAGCTACAACGA TGCATGCC | 19468 |
| 2527 | CAUGCAGU G UUCUUGGC | 8807 | GCCAAGAA GGCTAGCTACAACGA ACTGCATG | 19469 |
| 2534 | UGUUCUUG G CUGUGCAA | 8808 | TTGCACAG GGCTAGCTACAACGA CAAGAACA | 19470 |
| 2537 | UCUUGGCU G UGCAAAAG | 8809 | CTTTTGCA GGCTAGCTACAACGA AGCCAAGA | 19471 |
| 2539 | UUGGCUGU G CAAAAGUG | 8810 | CACTTTTG GGCTAGCTACAACGA ACAGCCAA | 19472 |
| 2545 | GUGCAAAA G UGGAGGCA | 8811 | TGCCTCCA GGCTAGCTACAACGA TTTTGCAC | 19473 |
| 2551 | AAGUGGAG G CAUUUUUC | 8812 | GAAAAATG GGCTAGCTACAACGA CTCCACTT | 19474 |
| 2553 | GUGGAGGC A UUUUUCAU | 6560 | ATGAAAAA GGCTAGCTACAACGA GCCTCCAC | 19475 |
| 2560 | CAUUUUUC A UAAUAGAA | 6561 | TTCTATTA GGCTAGCTACAACGA GAAAAATG | 19476 |
| 2563 | UUUUCAUA A UAGAAGGU | 8813 | ACCTTCTA GGCTAGCTACAACGA TATGAAAA | 19477 |
| 2570 | AAUAGAAG G UGCCCAGG | 8814 | CCTGGGCA GGCTAGCTACAACGA CTTCTATT | 19478 |
| 2572 | UAGAAGGU G CCCAGGAA | 8815 | TTCCTGGG GGCTAGCTACAACGA ACCTTCTA | 19479 |
| 2584 | AGGAAAAG A CGAACUUG | 8818 | CAAGTTCG GGCTAGCTACAACGA CTTTTCCT | 19480 |
| 2588 | AAAGACGA A CUUGGAAA | 8817 | TTTCCAAG GGCTAGCTACAACGA TCGTCTTT | 19481 |
| 2596 | ACUUGGAA A UCAUUAUU | 8818 | AATAATGA GGCTAGCTACAACGA TTCCAAGT | 19482 |
| 2599 | UGGAAAUC A UUAUUCUA | 6568 | TAGAATAA GGCTAGCTACAACGA GATTTCCA | 19483 |
| 2602 | AAAUCAUU A UUCUAGUA | 1861 | TACTAGAA GGCTAGCTACAACGA AATGATTT | 19484 |
| 2608 | UUAUUCUA G UAGGCACG | 8819 | CGTGCCTA GGCTAGCTACAACGA TAGAATAA | 19485 |
| 2612 | UCUAGUAG G CACGGCGG | 8820 | CCGCCGTG GGCTAGCTACAACGA CTACTAGA | 19486 |
| 2614 | UAGUAGGC A CGGCGGUG | 8821 | CACCGCCG GGCTAGCTACAACGA GCCTACTA | 19487 |
| 2617 | UAGGCACG G CGGUGAUU | 8822 | AATCACCG GGCTAGCTACAACGA CGTGCCTA | 19488 |
| 2620 | GCACGGCG G UGAUUGCC | 8823 | GGCAATCA GGCTAGCTACAACGA CGCCGTGC | 19489 |
| 2623 | CGGCGGUG A UUGCCAUG | 8824 | CATGGCAA GGCTAGCTACAACGA CACCGCCG | 19490 |
| 2626 | CGGUGAUU G CCAUGUUC | 8825 | GAACATCG GGCTAGCTACAACGA AATCACCG | 19491 |
| 2629 | UGAUUGCC A UGUUCUUC | 6570 | GAAGAACA GGCTAGCTACAACGA GGCAATCA | 19492 |
| 2631 | AUUGCCAU G UUCUUCUG | 8826 | CAGAAGAA GGCTAGCTACAACGA ATGGCAAT | 19493 |
| 2640 | UUCUUCUG G UACUUCUU | 8827 | ACAAGTAG GGCTAGCTACAACGA CAGAACAA | 19494 |
| 2643 | UUCUGGCU A CUUCUUGU | 1871 | ACAAGAAG GGCTAGCTACAACGA AGCCACAA | 19495 |

TABLE XXII-continued

Human KDR DNAzyme and Substrate sequence

| Pos | Substrate | Seq ID No | DNAzyme | Seq ID No |
|---|---|---|---|---|
| 2650 | UACUUCUU G UCAUCAUC | 8828 | GATGATGA GGCTAGCTACAACGA AAGAACTA | 19496 |
| 2653 | UUCUUGUC A UCAUCCUA | 8576 | TAGGATGA GGCTAGCTACAACGA GACAAGAA | 19497 |
| 2656 | UUGUCAUC A UCCUACGG | 8829 | CCCTAGGA GGCTAGCTACAACGA GATGACAA | 19498 |
| 2661 | AUCAUCCU A CGGACCGU | 8830 | ACGGTCCG GGCTAGCTACAACGA AGGATGAT | 19499 |
| 2665 | UCCUACGG A CCGUUAAG | 8831 | CTTAACGG GGCTAGCTACAACGA CCCTAGGA | 19500 |
| 2668 | UACCCACC G UUAAGCGG | 8832 | CCGCTTAA GGCTAGCTACAACGA CGTCCGTA | 19501 |
| 2673 | ACCCUUAA G CCGGCCAA | 8833 | TTCGCCCG GGCTAGCTACAACGA TTAACGGT | 19502 |
| 2677 | UUAACCCG G CCAAUCGA | 8834 | TCCATTGG GGCTAGCTACAACGA CCGCTTAA | 19503 |
| 2681 | GCGGGCCA A UGGAGGGG | 8835 | CCCCTCCA GGCTAGCTACAACGA TGGCCCGC | 19504 |
| 2691 | GCACGGCA A CUGAACAC | 8836 | GTCTTCAG GGCTAGCTACAACGA TCCCCTCC | 19505 |
| 2698 | AACUGAAG A CAGGCUAC | 8837 | GTAGCCTG GGCTAGCTACAACGA CTTCAGTT | 19506 |
| 2702 | GAAGACAG G CUACUUGU | 8838 | ACAAGTAG GGCTAGCTACAACGA CTCTCTTC | 19507 |
| 2705 | GACAGGCU A CUUGUCCA | 1881 | TGGACAAG GGCTAGCTACAACGA ACCCTGTC | 19508 |
| 2709 | GGCUACUU G UCCAUCGU | 8839 | ACGATGCA GGCTAGCTACAACGA AACTAGCC | 19509 |
| 2713 | ACUUCUCC A UCGUCAUC | 6588 | CATCACCA GGCTAGCTACAACGA GGACAAGT | 19510 |
| 2716 | UCUCCAUC G UCAUGGAU | 8840 | ATCCATCA GGCTAGCTACAACGA GATGGACA | 19511 |
| 2719 | CCAUCGUC A UGGAUCCA | 8589 | TGCATCCA GGCTAGCTACAACGA CACGATGC | 19512 |
| 2723 | CCUCAUCC A UCCACAUG | 8841 | CATCTGCA GGCTAGCTACAACGA CCATCACC | 19513 |
| 2729 | CCAUCCAG A UGAACUCC | 8842 | CGACTTCA GGCTAGCTACAACGA CTGCATCC | 19514 |
| 2733 | CCAGAUGA A CUCCCAUU | 8843 | AATCCCAC GGCTAGCTACAACGA TCATCTGG | 19515 |
| 2739 | GAACUCCC A CUGGAUGA | 8595 | TCATCCAA GGCTAGCTACAACGA CCCAGTTC | 19516 |
| 2744 | CCCAUUGG A UGAACAUU | 8844 | AATCTTCA GGCTAGCTACAACGA CCAATGGC | 19517 |
| 2748 | UUGCAUGA A CACUCUGA | 8845 | TCACAATG GGCTAGCTACAACGA TCATCCAA | 19518 |
| 2750 | GGAUGAAC A UUCUGAAC | 6596 | GTTCACAA GGCTAGCTACAACGA GTTCATCC | 19519 |
| 2753 | UGAACAUU G UGAACCAC | 8848 | GTCCTTCA GGCTAGCTACAACGA AATGTTCA | 19520 |
| 2757 | CAUUGUGA A CCACUGCC | 8847 | CGCACTCC GGCTAGCTACAACGA TCACAATC | 19521 |
| 2760 | UGUCAACG A CUGCCUUA | 8848 | TAAGCCAG GGCTAGCTACAACGA CGTTCACA | 19522 |
| 2763 | CAACGACU G CCUUAUCA | 8849 | TCATAACC GGCTAGCTACAACGA AGTCGTTC | 19523 |
| 2768 | ACUGCCUU A UGAUGCCA | 1891 | TGGCATCA GGCTAGCTACAACGA AAGCCACT | 19524 |
| 2771 | CCCUUAUC A UCCCAGCA | 8850 | TGCTCGCA GGCTAGCTACAACGA CATAACGC | 19525 |
| 2773 | CUUAUGAU G CCAGCAAA | 8851 | TTTCCTGC GGCTAGCTACAACGA ATCATAAG | 19526 |
| 2777 | UGAUGCCA G CAAAUGGG | 8852 | CCCATTTG GGCTAGCTACAACGA TGGCATCA | 19527 |
| 2781 | GCCAGCAA A UGGGAAUU | 8853 | AATTCCCA GGCTAGCTACAACGA TTGCTGGC | 19528 |
| 2787 | AAAUGGGA A UUCCCCAG | 8854 | CTGGGGAA GGCTAGCTACAACGA TCCCATTT | 19529 |
| 2798 | CCCCAGAG A CCGGCUGA | 8855 | TCAGCCGG GGCTAGCTACAACGA CTCTGGGG | 19530 |
| 2802 | AGAGACCG G CUGAAGCU | 8856 | AGCTTCAG GGCTAGCTACAACGA CGGTCTCT | 19531 |
| 2808 | CGGCUGAA G CUAGGUAA | 8857 | TTACCTAG GGCTAGCTACAACGA TTCAGCCG | 19532 |

TABLE XXII-continued

Human KDR DNAzyme and Substrate sequence

| Pos | Substrate | Seq ID No | DNAzyme | Seq ID No |
|---|---|---|---|---|
| 2813 | GAAGCUAG G UAAGCCUC | 8858 | GAGGCTTA GGCTAGCTACAACGA CTAGCTTC | 19533 |
| 2817 | CUAGGUAA G CCUCUUGG | 8859 | CCAAGAGG GGCTAGCTACAACGA TTACCTAG | 19534 |
| 2825 | GCCUCUUG G GCCUGGUG | 8860 | CACCACGG GGCTAGCTACAACGA CAAGAGGC | 19535 |
| 2828 | UCUUGGCC G UGGUGCCU | 8881 | AGGCACCA GGCTAGCTACAACGA GGCCAAGA | 19536 |
| 2831 | UCGCCGUG G UGCCUUUG | 8862 | CAAAGGCA GGCTAGCTACAACGA CACGGCCA | 19537 |
| 2833 | GCCGUGGU G CCUUUGGC | 8863 | GCCAAAGG GGCTAGCTACAACGA ACCACGGC | 19538 |
| 2840 | UGCCUUUG G CCAAGUGA | 8884 | TCACTTGG GGCTAGCTACAACGA CAAAGGCA | 19539 |
| 2845 | UUGGCCAA G UGAUUGAA | 8865 | TTCAATCA GGCTAGCTACAACGA TTGGCCAA | 19540 |
| 2848 | GCCAAGUG A UUGAAGCA | 8866 | TGCTTCAA GGCTAGCTACAACGA CACTTGGC | 19541 |
| 2854 | UGAUUGAA G CAGAUGCC | 8867 | GGCATCTG GGCTAGCTACAACGA TTCAATCA | 19542 |
| 2858 | UGAAGCAG A UGCCUUUG | 8868 | CAAAGGCA GGCTAGCTACAACGA CTCCTTCA | 19543 |
| 2860 | AAGCAGAU G CCUUUGGA | 8869 | TCCAAACG GGCTAGCTACAACGA ATCTCCTT | 19544 |
| 2869 | CCUUUGGA A UUCACAAG | 8870 | CTTCTCAA GGCTAGCTACAACGA TCCAAAGC | 19545 |
| 2873 | UGGAAUUG A CAAGACAG | 8871 | CTGTCTTG GGCTAGCTACAACGA CAATTCCA | 19546 |
| 2878 | UUGACAAG A CAGCAACU | 8872 | AGTTGCTG GGCTAGCTACAACGA CTTGTCAA | 19547 |
| 2881 | ACAAGACA G CAACUUGC | 8873 | GCAAGTTG GGCTAGCTACAACGA TGTCTTGT | 19548 |
| 2884 | ACACACCA A CUUGCAGG | 8874 | CCTCCAAG GGCTAGCTACAACGA TGCTGTCT | 19549 |
| 2888 | ACCAACUU G CAGGACAC | 8875 | CTGTCCTG GGCTAGCTACAACGA AAGTTGCT | 19550 |
| 2893 | CUUGCAGG A CACUAGCA | 8876 | TCCTACTC GGCTAGCTACAACGA CCTCCAAG | 19551 |
| 2896 | GCAGGACA G UAGCAGUC | 8877 | GACTCCTA GGCTAGCTACAACGA TCTCCTGC | 19552 |
| 2899 | GGACAGUA G CAGUCAAA | 8878 | TTTCACTC GGCTAGCTACAACGA TACTGTCC | 19553 |
| 2902 | CACUAGCA G UCAAAAUG | 8879 | CATTTTGA GGCTAGCTACAACGA TGCTACTC | 19554 |
| 2908 | CAGUCAAA A UGUUGAAA | 8880 | TTTCAACA GGCTAGCTACAACGA TTTGACTG | 19555 |
| 2910 | GUCAAAAU G UUGAAAGA | 8881 | TCTTTCAA GGCTAGCTACAACGA ATTTTGAC | 19556 |
| 2923 | AAGAAGGA G CAACACAC | 8882 | CTGTGTTG GGCTAGCTACAACGA TCCTTCTT | 19557 |
| 2926 | AAGGAGCA A CACACAGU | 8883 | ACTGTGTG GGCTAGCTACAACGA TCCTCCTT | 19558 |
| 2928 | GGAGCAAC A CACAGUGA | 6631 | TCACTCTC GGCTAGCTACAACGA GTTGCTCC | 19559 |
| 2930 | AGCAACAC A CAGUGAGC | 6632 | GCTCACTG GGCTAGCTACAACGA GTGTTGCT | 19560 |
| 2933 | AACACACA G UGAGCAUC | 8884 | GATGCTCA GGCTAGCTACAACGA TGTGTGTT | 19561 |
| 2937 | CACAGUGA G CAUCGAGC | 8885 | GCTCGATG GGCTAGCTACAACGA TCACTGTG | 19562 |
| 2939 | CACUGAGC A UCCACCUC | 6634 | GAGCTCGA GGCTAGCTACAACGA GCTCACTG | 19563 |
| 2944 | ACCAUCCA G CUCUCAUG | 8886 | CATGAGAG GGCTAGCTACAACGA TCCATGCT | 19564 |
| 2950 | GACCUCUC A UGUCUGAA | 6637 | TTCAGACA GGCTAGCTACAACGA GACAGCTC | 19565 |
| 2952 | CCUCUCAU G UCUCAACU | 8887 | ACTTCAGA GGCTAGCTACAACGA ATCACAGC | 19566 |
| 2958 | AUGUCUGA A CUCAAGAU | 8888 | ATCTTGAG GGCTAGCTACAACGA TCACACAT | 19567 |
| 2965 | AACUCAAG A UCCUCAUU | 8889 | AATCACGA GGCTAGCTACAACGA CTTCAGTT | 19568 |
| 2971 | ACAUCCUC A UUCAUAUU | 6643 | AATATGAA GGCTAGCTACAACGA GAGGATCT | 19569 |

TABLE XXII-continued

Human KDR DNAzyme and Substrate sequence

| Pos | Substrate | Seq ID No | DNAzyme | Seq ID No |
|---|---|---|---|---|
| 2975 | CCUCAUUC A UAUUCGUC | 6644 | GACCAATA GGCTAGCTACAACGA GAATCACG | 19570 |
| 2977 | UCAUUCAU A UUCCUCAC | 1917 | CTCACCAA GGCTAGCTACAACGA ATGAATGA | 19571 |
| 2981 | UCAUAUUG G UCACCAUC | 8890 | GATCGTGA GGCTAGCTACAACGA CAATATGA | 19572 |
| 2984 | UAUUGGUC A CCAUCUCA | 6645 | TCACATGG GGCTAGCTACAACGA CACCAATA | 19573 |
| 2987 | UCGUCACC A UCUCAAUG | 6647 | CATTCACA GGCTAGCTACAACGA CGTGACCA | 19574 |
| 2993 | CCAUCUCA A UGUGGUCA | 8891 | TGACCACA GGCTAGCTACAACGA TCACATGC | 19575 |
| 2995 | AUCUCAAU G UGGUCAAC | 8892 | GTTGACCA GGCTAGCTACAACGA ATTGAGAT | 19576 |
| 2998 | UCAAUGUG G UCAACCUU | 8893 | AAGGTTGA GGCTAGCTACAACGA CACATTGA | 19577 |
| 3002 | UGUGGUCA A CCUUCUAG | 8894 | CTAGAAGG GGCTAGCTACAACGA TGACCACA | 19578 |
| 3011 | CCUUCUAG G UGCCUGUA | 8895 | TACAGGCA GGCTAGCTACAACGA CTAGAAGG | 19579 |
| 3013 | UUCUAGGU G CCUGUACC | 8896 | GGTACAGG GGCTAGCTACAACGA ACCTAGAA | 19580 |
| 3017 | AGGUGCCU G UACCAAGC | 8897 | GCTTGGTA GGCTAGCTACAACGA AGGCACCT | 19581 |
| 3019 | GUGCCUGU A CCAAGCCA | 1926 | TGGCTTGG GGCTAGCTACAACGA ACAGGCAC | 19582 |
| 3024 | UGUACCAA G CCAGGAGG | 8898 | CCTCCTGG GGCTAGCTACAACGA TTGGTACA | 19583 |
| 3033 | CCAGGAGG G CCACUCAU | 8899 | ATGAGTGG GGCTAGCTACAACGA CCTCCTGG | 19584 |
| 3036 | GGAGGGCC A CUCAUGGU | 6661 | ACCATGAG GGCTAGCTACAACGA GGCCCTCC | 19585 |
| 3040 | GGCCACUC A UGGUGAUU | 6663 | AATCACCA GGCTAGCTACAACGA GAGTGGCC | 19586 |
| 3043 | CACUCAUG G UGAUUGUG | 8900 | CACAATCA GGCTAGCTACAACGA CATGAGTG | 19587 |
| 3046 | UCAUGGUG A UUGUGGAA | 8901 | TTCCACAA GGCTAGCTACAACGA CACCATGA | 19588 |
| 3049 | UGGUGAUU G UGGAAUUC | 8902 | GAATTCCA GGCTAGCTACAACGA AATCACCA | 19589 |
| 3054 | AUUGUGGA A UUCUGCAA | 8903 | TTGCAGAA GGCTAGCTACAACGA TCCACAAT | 19590 |
| 3059 | GGAAUUCU G CAAAUUUG | 8904 | CAAATTTG GGCTAGCTACAACGA AGAATTCC | 19591 |
| 3063 | UUCUGCAA A UUUGGAAA | 8905 | TTTCCAAA GGCTAGCTACAACGA TTGCAGAA | 19592 |
| 3071 | AUUUGGAA A CCUGUCCA | 8906 | TGGACAGG GGCTAGCTACAACGA TTCCAAAT | 19593 |
| 3075 | GGAAACCU G UCCACUUA | 8907 | TAAGTGGA GGCTAGCTACAACGA AGGTTTCC | 19594 |
| 3079 | ACCUGUCC A CUUACCUG | 6669 | CAGGTAAG GGCTAGCTACAACGA GGACAGGT | 19595 |
| 3083 | GUCCACUU A CCUGAGGA | 1935 | TCCTCAGG GGCTAGCTACAACGA AAGTGGAC | 19596 |
| 3092 | CCUGAGGA G CAAGAGAA | 8908 | TTCTCTTG GGCTAGCTACAACGA TCCTCAGG | 19597 |
| 3101 | CAAGAGAA A UGAAUUUG | 8909 | CAAATTCA GGCTAGCTACAACGA TTCTCTTG | 19598 |
| 3105 | AGAAAUGA A UUUGUCCC | 8910 | GGGACAAA GGCTAGCTACAACGA TCATTTCT | 19599 |
| 3109 | AUGAAUUU G UCCCCUAC | 8911 | GTAGGGGA GGCTAGCTACAACGA AAATTCAT | 19600 |
| 3116 | UGUCCCCU A CAAGACCA | 1939 | TGGTCTTG GGCTAGCTACAACGA AGGGGACA | 19601 |
| 3121 | CCUACAAG A CCAAAGGG | 8912 | CCCTTTGG GGCTAGCTACAACGA CTTGTAGG | 19602 |
| 3130 | CCAAAGGG G CACGAUUC | 8913 | GAATCGTG GGCTAGCTACAACGA CCCTTTGG | 19603 |
| 3132 | AAAGGGGC A CGAUUCCG | 6681 | CGGAATCG GGCTAGCTACAACGA GCCCCTTT | 19604 |
| 3135 | GGGGCACG A UUCCGUCA | 8914 | TGACGGAA GGCTAGCTACAACGA CGTGCCCC | 19605 |
| 3140 | ACGAUUCC G UCAAGGGA | 8915 | TCCCTTGA GGCTAGCTACAACGA GGAATCGT | 19606 |

TABLE XXII-continued

Human KDR DNAzyme and Substrate sequence

| Pos | Substrate | Seq ID No | DNAzyme | Seq ID No |
|---|---|---|---|---|
| 3152 | AGGGAAAG A CUACGUUG | 8916 | CAACGTAG GGCTAGCTACAACGA CTTTCCCT | 19607 |
| 3155 | GAAAGACU A CGUUGGAG | 1943 | CTCCAACG GGCTAGCTACAACGA AGTCTTTC | 19608 |
| 3157 | AAGACUAC G UUGGAGCA | 8917 | TGCTCCAA GGCTAGCTACAACGA GTAGTCTT | 19609 |
| 3163 | ACGUUGGA G CAAUCCCU | 8918 | AGGGATTG GGCTAGCTACAACGA TCCAACGT | 19610 |
| 3166 | UUGGAGCA A UCCCUGUG | 8919 | CACAGGGA GGCTAGCTACAACGA TGCTCCAA | 19611 |
| 3172 | CAAUCCCU G UGGAUCUG | 8920 | CAGATCCA GGCTAGCTACAACGA AGGGATTG | 19612 |
| 3176 | CCCUGUGG A UCUGAAAC | 8921 | GTTTCAGA GGCTAGCTACAACGA CCACAGGG | 19613 |
| 3183 | GAUCUGAA A CGGCGCUU | 8922 | AAGCGCCG GGCTAGCTACAACGA TTCAGATC | 19614 |
| 3186 | CUGAAACG G CGCUUGGA | 8923 | TCCAAGCG GGCTAGCTACAACGA CGTTTCAG | 19615 |
| 3188 | GAAACGGC G CUUGGACA | 8924 | TGTCCAAG GGCTAGCTACAACGA GCCGTTTC | 19616 |
| 3194 | GCGCUUGG A CAGCAUCA | 8925 | TGATGCTG GGCTAGCTACAACGA CCAAGCGC | 19617 |
| 3197 | CUUGGACA G CAUCACCA | 8926 | TGGTGATG GGCTAGCTACAACGA TGTCCAAG | 19618 |
| 3199 | UGGACAGC A UCACCAGU | 6692 | ACTGGTGA GGCTAGCTACAACGA GCTGTCCA | 19619 |
| 3202 | ACAGCAUC A CCAGUAGC | 6693 | GCTACTGG GGCTAGCTACAACGA GATGCTGT | 19620 |
| 3206 | CAUCACCA G UAGCCAGA | 8927 | TCTGGCTA GGCTAGCTACAACGA TGGTGATG | 19621 |
| 3209 | CACCAGUA G CCAGAGCU | 8928 | AGCTCTGG GGCTAGCTACAACGA TACTGGTG | 19622 |
| 3215 | UAGCCAGA G CUCAGCCA | 8929 | TGGCTGAG GGCTAGCTACAACGA TCTGGCTA | 19623 |
| 3220 | AGAGCUCA G CCAGCUCU | 8930 | AGAGCTGG GGCTAGCTACAACGA TGAGCTCT | 19624 |
| 3224 | CUCAGCCA G CUCUGGAU | 8931 | ATCCAGAG GGCTAGCTACAACGA TGGCTGAG | 19625 |
| 3231 | AGCUCUGG A UUUGUGGA | 8932 | TCCACAAA GGCTAGCTACAACGA CCAGAGCT | 19626 |
| 3235 | CUGGAUUU G UGGAGGAG | 8933 | CTCCTCCA GGCTAGCTACAACGA AAATCCAG | 19627 |
| 3246 | GAGGAGAA G UCCCUCAG | 8934 | CTGAGGGA GGCTAGCTACAACGA TTCTCCTC | 19628 |
| 3254 | GUCCCUCA G UGAUGUAG | 8935 | CTACATCA GGCTAGCTACAACGA TGAGGGAC | 19629 |
| 3257 | CCUCAGUG A UGUAGAAG | 8936 | CTTCTACA GGCTAGCTACAACGA CACTGAGG | 19630 |
| 3259 | UCAGUGAU G UAGAAGAA | 8937 | TTCTTCTA GGCTAGCTACAACGA ATCACTGA | 19631 |
| 3274 | AAGAGGAA G CUCCUGAA | 8938 | TTCAGGAG GGCTAGCTACAACGA TTCCTCTT | 19632 |
| 3284 | UCCUGAAG A UCUGUAUA | 8939 | TATACAGA GGCTAGCTACAACGA CTTCAGGA | 19633 |
| 3288 | GAAGAUCU G UAUAAGGA | 8940 | TCCTTATA GGCTAGCTACAACGA AGATCTTC | 19634 |
| 3290 | AGAUCUGU A UAAGGACU | 1959 | AGTCCTTA GGCTAGCTACAACGA ACAGATCT | 19635 |
| 3296 | GUAUAAGG A CUUCCUGA | 8941 | TCAGGAAG GGCTAGCTACAACGA CCTTATAC | 19636 |
| 3304 | ACUUCCUG A CCUUGGAG | 8942 | CTCCAAGG GGCTAGCTACAACGA CAGGAAGT | 19637 |
| 3312 | ACCUUGGA G CAUCUCAU | 8943 | ATGAGATG GGCTAGCTACAACGA TCCAAGGT | 19638 |
| 3314 | CUUGGAGC A UCUCAUCU | 6717 | AGATGAGA GGCTAGCTACAACGA GCTCCAAG | 19639 |
| 3319 | AGCAUCUC A UCUGUUAC | 6719 | GTAACAGA GGCTAGCTACAACGA GAGATGCT | 19640 |
| 3323 | UCUCAUCU G UUACAGCU | 8944 | AGCTGTAA GGCTAGCTACAACGA AGATGAGA | 19641 |
| 3326 | CAUCUGUU A CAGCUUCC | 1968 | GGAAGCTG GGCTAGCTACAACGA AACAGATG | 19642 |
| 3329 | CUGUUACA G CUUCCAAG | 8945 | CTTGGAAG GGCTAGCTACAACGA TGTAACAG | 19643 |

TABLE XXII-continued

Human KDR DNAzyme and Substrate sequence

| Pos | Substrate | Seq ID No | DNAzyme | Seq ID No |
|---|---|---|---|---|
| 3337 | GCUUCCAA G UGGCUAAG | 8946 | CTTAGCCA GGCTAGCTACAACGA TTGGAAGC | 19644 |
| 3340 | UCCAAGUG G CUAAGGGC | 8947 | GCCCTTAG GGCTAGCTACAACGA CACTTGGA | 19645 |
| 3347 | GGCUAAGG G CAUGGAGU | 8948 | ACTCCATG GGCTAGCTACAACGA CCTTAGCC | 19646 |
| 3349 | CUAAGGGC A UGGAGUUC | 6726 | GAACTCCA GGCTAGCTACAACGA GCCCTTAG | 19647 |
| 3354 | GGCAUGGA G UUCUUGGC | 8949 | GCCAAGAA GGCTAGCTACAACGA TCCATGCC | 19648 |
| 3361 | AGUUCUUG G CAUCGCGA | 8950 | TCGCGATG GGCTAGCTACAACGA CAAGAACT | 19649 |
| 3363 | UUCUUGGC A UCGCGAAA | 6728 | TTTCGCGA GGCTAGCTACAACGA GCCAAGAA | 19650 |
| 3366 | UUGGCAUC G CGAAAGUG | 8951 | CACTTTCG GGCTAGCTACAACGA GATGCCAA | 19651 |
| 3372 | UCGCGAAA G UGUAUCCA | 8952 | TGGATACA GGCTAGCTACAACGA TTTCGCGA | 19652 |
| 3374 | GCGAAAGU G UAUCCACA | 8953 | TGTGGATA GGCTAGCTACAACGA ACTTTCGC | 19653 |
| 3376 | GAAAGUGU A UCCACAGG | 1976 | CCTGTGGA GGCTAGCTACAACGA ACACTTTC | 19654 |
| 3380 | GUGUAUCC A CAGGGACC | 6730 | GGTCCCTG GGCTAGCTACAACGA GGATACAC | 19655 |
| 3386 | CCACAGGG A CCUGGCGG | 8954 | CCGCCAGG GGCTAGCTACAACGA CCCTGTGG | 19656 |
| 3391 | GGGACCUG G CGGCACGA | 8955 | TCGTGCCG GGCTAGCTACAACGA CAGGTCCC | 19657 |
| 3394 | ACCUGGCG G CACGAAAU | 8956 | ATTTCGTG GGCTAGCTACAACGA CGCCAGGT | 19658 |
| 3396 | CUGGCGGC A CGAAAUAU | 6734 | ATATTTCG GGCTAGCTACAACGA GCCGCCAG | 19659 |
| 3401 | GGCACGAA A UAUCCUCU | 8957 | AGAGGATA GGCTAGCTACAACGA TTCGTGCC | 19660 |
| 3403 | CACGAAAU A UCCUCUUA | 1978 | TAAGAGGA GGCTAGCTACAACGA ATTTCGTG | 19661 |
| 3411 | AUCCUCUU A UCGGAGAA | 1982 | TTCTCCGA GGCTAGCTACAACGA AAGAGGAT | 19662 |
| 3422 | GGAGAAGA A CGUGGUUA | 8958 | TAACCACG GGCTAGCTACAACGA TCTTCTCC | 19663 |
| 3424 | AGAAGAAC G UGGUUAAA | 8959 | TTTAACCA GGCTAGCTACAACGA GTTCTTCT | 19664 |
| 3427 | AGAACGUG G UUAAAAUC | 8960 | GATTTTAA GGCTAGCTACAACGA CACGTTCT | 19665 |
| 3433 | UGGUUAAA A UCUGUGAC | 8961 | GTCACAGA GGCTAGCTACAACGA TTTAACCA | 19666 |
| 3437 | UAAAAUCU G UGACUUUG | 8962 | CAAAGTCA GGCTAGCTACAACGA AGATTTTA | 19667 |
| 3440 | AAUCUGUG A CUUUGGCU | 8963 | AGCCAAAG GGCTAGCTACAACGA CACAGATT | 19668 |
| 3446 | UGACUUUG G CUUGGCCC | 8964 | GGGCCAAG GGCTAGCTACAACGA CAAAGTCA | 19669 |
| 3451 | UUGGCUUG G CCCGGGAU | 8965 | ATCCCGGG GGCTAGCTACAACGA CAAGCCAA | 19670 |
| 3458 | GGCCCGGG A UAUUUAUA | 8966 | TATAAATA GGCTAGCTACAACGA CCCGGGCC | 19671 |
| 3460 | CCCGGGAU A UUUAUAAA | 1990 | TTTATAAA GGCTAGCTACAACGA ATCCCGGG | 19672 |
| 3464 | GGAUAUUU A UAAAGAUC | 1993 | GATCTTTA GGCTAGCTACAACGA AAATATCC | 19673 |
| 3470 | UUAUAAAG A UCCAGAUU | 8967 | AATCTGGA GGCTAGCTACAACGA CTTTATAA | 19674 |
| 3476 | AGAUCCAG A UUAUGUCA | 8968 | TGACATAA GGCTAGCTACAACGA CTGGATCT | 19675 |
| 3479 | UCCAGAUU A UGUCAGAA | 1997 | TTCTGACA GGCTAGCTACAACGA AATCTGGA | 19676 |
| 3481 | CAGAUUAU G UCAGAAAA | 8969 | TTTTCTGA GGCTAGCTACAACGA ATAATCTG | 19677 |
| 3494 | AAAAGGAG A UGCUCGCC | 8970 | GGCGAGCA GGCTAGCTACAACGA CTCCTTTT | 19678 |
| 3496 | AAGGAGAU G CUCGCCUC | 8971 | GAGGCGAG GGCTAGCTACAACGA ATCTCCTT | 19679 |
| 3500 | AGAUGCUC G CCUCCCUU | 8972 | AAGGGAGG GGCTAGCTACAACGA GAGCATCT | 19680 |

TABLE XXII-continued

Human KDR DNAzyme and Substrate sequence

| Pos | Substrate | Seq ID No | DNAzyme | Seq ID No |
|---|---|---|---|---|
| 3513 | CCUUUGAA A UGGAUGGC | 8973 | GCCATCCA GGCTAGCTACAACGA TTCAAAGG | 19681 |
| 3517 | UGAAAUGG A UGGCCCCA | 8974 | TGGGGCCA GGCTAGCTACAACGA CCATTTCA | 19682 |
| 3520 | AAUGGAUG G CCCCAGAA | 8975 | TTCTGGGG GGCTAGCTACAACGA CATCCATT | 19683 |
| 3529 | CCCCAGAA A CAAUUUUU | 8976 | AAAAATTG GGCTAGCTACAACGA TTCTGGGG | 19684 |
| 3532 | CAGAAACA A UUUUUGAC | 8977 | GTCAAAAA GGCTAGCTACAACGA TGTTTCTG | 19685 |
| 3539 | AAUUUUUG A CAGAGUGU | 8978 | ACACTCTG GGCTAGCTACAACGA CAAAAATT | 19686 |
| 3544 | UUGACAGA G UGUACACA | 8979 | TGTGTACA GGCTAGCTACAACGA TCTGTCAA | 19687 |
| 3546 | GACAGAGU G UACACAAU | 8980 | ATTGTGTA GGCTAGCTACAACGA ACTCTGTC | 19688 |
| 3548 | CAGAGUGU A CACAAUCC | 2007 | GGATTGTG GGCTAGCTACAACGA ACACTCTG | 19689 |
| 3550 | GAGUGUAC A CAAUCCAG | 6758 | CTGGATTG GGCTAGCTACAACGA GTACACTC | 19690 |
| 3553 | UGUACACA A UCCAGAGU | 8981 | ACTCTGGA GGCTAGCTACAACGA TGTGTACA | 19691 |
| 3560 | AAUCCAGA G UGACGUCU | 8982 | AGACGTCA GGCTAGCTACAACGA TCTGGATT | 19692 |
| 3563 | CCAGAGUG A CGUCUGGU | 8983 | ACCAGACG GGCTAGCTACAACGA CACTCTGG | 19693 |
| 3565 | AGAGUGAC G UCUGGUCU | 8984 | AGACCAGA GGCTAGCTACAACGA GTCACTCT | 19694 |
| 3570 | GACGUCUG G UCUUUUGG | 8985 | CCAAAAGA GGCTAGCTACAACGA CAGACGTC | 19695 |
| 3578 | GUCUUUUG G UGUUUUGC | 8986 | GCAAAACA GGCTAGCTACAACGA CAAAAGAC | 19696 |
| 3580 | CUUUUGGU G UUUUGCUG | 8987 | CAGCAAAA GGCTAGCTACAACGA ACCAAAAG | 19697 |
| 3585 | GGUGUUUU G CUGUGGGA | 8988 | TCCCACAG GGCTAGCTACAACGA AAAACACC | 19698 |
| 3588 | GUUUUGCU G UGGGAAAU | 8989 | ATTTCCCA GGCTAGCTACAACGA AGCAAAAC | 19699 |
| 3595 | UGUGGGAA A UAUUUUCC | 8990 | GGAAAATA GGCTAGCTACAACGA TTCCCACA | 19700 |
| 3597 | UGGGAAAU A UUUUCCUU | 2017 | AAGGAAAA GGCTAGCTACAACGA ATTTCCCA | 19701 |
| 3608 | UUCCUUAG G UGCUUCUC | 8991 | GAGAAGCA GGCTAGCTACAACGA CTAAGGAA | 19702 |
| 3610 | CCUUAGGU G CUUCUCCA | 8992 | TGGAGAAG GGCTAGCTACAACGA ACCTAAGG | 19703 |
| 3618 | GCUUCUCC A UAUCCUGG | 6770 | CCAGGATA GGCTAGCTACAACGA GGAGAAGC | 19704 |
| 3620 | UUCUCCAU A UCCUGGGG | 2027 | CCCCAGGA GGCTAGCTACAACGA ATGGAGAA | 19705 |
| 3628 | AUCCUGGG G UAAAGAUU | 8993 | AATCTTTA GGCTAGCTACAACGA CCCAGGAT | 19706 |
| 3634 | GGGUAAAG A UUGAUGAA | 8994 | TTCATCAA GGCTAGCTACAACGA CTTTACCC | 19707 |
| 3638 | AAAGAUUG A UGAAGAAU | 8995 | ATTCTTCA GGCTAGCTACAACGA CAATCTTT | 19708 |
| 3645 | GAUGAAGA A UUUUGUAG | 8996 | CTACAAAA GGCTAGCTACAACGA TCTTCATC | 19709 |
| 3650 | AGAAUUUU G UAGGCGAU | 8997 | ATCGCCTA GGCTAGCTACAACGA AAAATTCT | 19710 |
| 3654 | UUUUGUAG G CGAUUGAA | 8998 | TTCAATCG GGCTAGCTACAACGA CTACAAAA | 19711 |
| 3657 | UGUAGGCG A UUGAAAGA | 8999 | TCTTTCAA GGCTAGCTACAACGA CGCCTACA | 19712 |
| 3670 | AAGAAGGA A CUAGAAUG | 9000 | CATTCTAG GGCTAGCTACAACGA TCCTTCTT | 19713 |
| 3676 | GAACUAGA A UGAGGGCC | 9001 | GGCCCTCA GGCTAGCTACAACGA TCTAGTTC | 19714 |
| 3682 | GAAUGAGG G CCCCUGAU | 9002 | ATCAGGGG GGCTAGCTACAACGA CCTCATTC | 19715 |
| 3689 | GGCCCCUG A UUAUACUA | 9003 | TAGTATAA GGCTAGCTACAACGA CAGGGGCC | 19716 |
| 3692 | CCCUGAUU A UACUACAC | 2038 | GTGTAGTA GGCTAGCTACAACGA AATCAGGG | 19717 |

TABLE XXII-continued

Human KDR DNAzyme and Substrate sequence

| Pos | Substrate | Seq ID No | DNAzyme | Seq ID No |
|---|---|---|---|---|
| 3694 | CUGAUUAU A CUACACCA | 2039 | TGGTGTAG GGCTAGCTACAACGA ATAATCAG | 19718 |
| 3697 | AUUAUACU A CACCAGAA | 2040 | TTCTGGTG GGCTAGCTACAACGA AGTATAAT | 19719 |
| 3699 | UAUACUAC A CCAGAAAU | 6779 | ATTTCTGG GGCTAGCTACAACGA GTAGTATA | 19720 |
| 3706 | CACCAGAA A UGUACCAG | 9004 | CTGGTACA GGCTAGCTACAACGA TTCTGGTG | 19721 |
| 3708 | CCAGAAAU G UACCAGAC | 9005 | GTCTGGTA GGCTAGCTACAACGA ATTTCTGG | 19722 |
| 3710 | AGAAAUGU A CCAGACCA | 2041 | TGGTCTGG GGCTAGCTACAACGA ACATTTCT | 19723 |
| 3715 | UGUACCAG A CCAUGCUG | 9006 | CAGCATGG GGCTAGCTACAACGA CTGGTACA | 19724 |
| 3718 | ACCAGACC A UGCUGGAC | 6785 | GTCCAGCA GGCTAGCTACAACGA GGTCTGGT | 19725 |
| 3720 | CAGACCAU G CUGGACUG | 9007 | CAGTCCAG GGCTAGCTACAACGA ATGGTCTG | 19726 |
| 3725 | CAUGCUGG A CUGCUGGC | 7740 | GCCAGCAG GGCTAGCTACAACGA CCAGCATG | 17305 |
| 3728 | GCUGGACU G CUGGCACG | 9008 | CGTGCCAG GGCTAGCTACAACGA AGTCCAGC | 19727 |
| 3732 | GACUGCUG G CACGGGGA | 9009 | TCCCCGTG GGCTAGCTACAACGA CAGCAGTC | 19728 |
| 3734 | CUGCUGGC A CGGGGAGC | 6788 | GCTCCCCG GGCTAGCTACAACGA GCCAGCAG | 19729 |
| 3741 | CACGGGGA G CCCAGUCA | 9010 | TGACTGGG GGCTAGCTACAACGA TCCCCGTG | 19730 |
| 3746 | GGAGCCCA G UCAGAGAC | 9011 | GTCTCTGA GGCTAGCTACAACGA TGGGCTCC | 19731 |
| 3753 | AGUCAGAG A CCCACGUU | 9012 | AACGTGGG GGCTAGCTACAACGA CTCTGACT | 19732 |
| 3757 | AGAGACCC A CGUUUCA | 6795 | TGAAAACG GGCTAGCTACAACGA GGGTCTCT | 19733 |
| 3759 | AGACCCAC G UUUCAGA | 9013 | TCTGAAAA GGCTAGCTACAACGA GTGGGTCT | 19734 |
| 3768 | UUUUCAGA G UUGGUGGA | 9014 | TCCACCAA GGCTAGCTACAACGA TCTGAAAA | 19735 |
| 3772 | CAGAGUUG G UGGAACAU | 9015 | ATGTTCCA GGCTAGCTACAACGA CAACTCTG | 19736 |
| 3777 | UUGGUGGA A CAUUUGGG | 9016 | CCCAAATG GGCTAGCTACAACGA TCCACCAA | 19737 |
| 3779 | GGUGGAAC A UUUGGGAA | 6797 | TTCCCAAA GGCTAGCTACAACGA GTTCCACC | 19738 |
| 3788 | UUUGGGAA A UCUCUUGC | 9017 | GCAAGAGA GGCTAGCTACAACGA TTCCCAAA | 19739 |
| 3795 | AAUCUCUU G CAAGCUAA | 9018 | TTAGCTTG GGCTAGCTACAACGA AAGAGATT | 19740 |
| 3799 | UCUUGCAA G CUAAUGCU | 9019 | AGCATTAG GGCTAGCTACAACGA TTGCAAGA | 19741 |
| 3803 | GCAAGCUA A UGCUCAGC | 9020 | GCTGAGCA GGCTAGCTACAACGA TAGCTTGC | 19742 |
| 3805 | AAGCUAAU G CUCAGCAG | 9021 | CTGCTGAG GGCTAGCTACAACGA ATTAGCTT | 19743 |
| 3810 | AAUGCUCA G CAGGAUGG | 9022 | CCATCCTG GGCTAGCTACAACGA TGAGCATT | 19744 |
| 3815 | UCAGCAGG A UGGCAAAG | 9023 | CTTTGCCA GGCTAGCTACAACGA CCTGCTGA | 19745 |
| 3818 | GCAGGAUG G CAAAGACU | 9024 | AGTCTTTG GGCTAGCTACAACGA CATCCTGC | 19746 |
| 3824 | UGGCAAAG A CUACAUUG | 9025 | CAATGTAG GGCTAGCTACAACGA CTTTGCCA | 19747 |
| 3827 | CAAAGACU A CAUUGUUC | 2055 | GAACAATG GGCTAGCTACAACGA AGTCTTTG | 19748 |
| 3829 | AAGACUAC A UUGUUCUU | 6807 | AAGAACAA GGCTAGCTACAACGA GTAGTCTT | 19749 |
| 3832 | ACUACAUU G UUCUUCCG | 9026 | CGGAAGAA GGCTAGCTACAACGA AATGTAGT | 19750 |
| 3841 | UUCUUCCG A UAUCAGAG | 9027 | CTCTGATA GGCTAGCTACAACGA CGGAAGAA | 19751 |
| 3843 | CUUCCGAU A UCAGAGAC | 2061 | GTCTCTGA GGCTAGCTACAACGA ATCGGAAG | 19752 |
| 3850 | UAUCAGAG A CUUUGAGC | 9028 | GCTCAAAG GGCTAGCTACAACGA CTCTGATA | 19753 |

TABLE XXII-continued

Human KDR DNAzyme and Substrate sequence

| Pos | Substrate | Seq ID No | DNAzyme | Seq ID No |
|---|---|---|---|---|
| 3857 | GACUUUGA G CAUGGAAG | 9029 | CTTCCATG GGCTAGCTACAACGA TCAAAGTC | 19754 |
| 3859 | CUUUGAGC A UGGAAGAG | 6812 | CTCTTCCA GGCTAGCTACAACGA GCTCAAAG | 19755 |
| 3869 | GCAAGAGC A UUCUCGAC | 9030 | GTCCAGAA GGCTAGCTACAACGA CCTCTTCC | 19756 |
| 3876 | GAUUCUGG A CUCUCUCU | 9031 | AGAGAGAG GGCTAGCTACAACGA CCAGAATC | 19757 |
| 3885 | CUCUCUCU G CCUACCUC | 9032 | GAGGTACG GGCTAGCTACAACGA ACAGACAG | 19758 |
| 3889 | CUCUGCCU A CCUCACCU | 2070 | AGGTGAGG GGCTAGCTACAACGA AGGCAGAG | 19759 |
| 3894 | CCUACCUC A CCUGUUUC | 6822 | GAAACAGG GGCTAGCTACAACGA GAGGTAGG | 19760 |
| 3898 | CCUCACCU G UUUCCUGU | 9033 | ACAGCAAA GGCTAGCTACAACGA AGCTCAGC | 19761 |
| 3905 | UGUUUCCU G UAUCGAGG | 9034 | CCTCCATA GGCTAGCTACAACGA ACGAAACA | 19762 |
| 3907 | UUUCCUGU A UGGAGGAG | 2075 | CTCCTCCA GGCTAGCTACAACGA ACAGGAAA | 19763 |
| 3922 | AGGACGAA G UAUGUCAC | 9035 | CTCACATA GGCTAGCTACAACGA TTCCTCCT | 19764 |
| 3924 | GAGCAAGU A UGUGACCC | 2076 | CGCTCACA GGCTAGCTACAACGA ACTTCCTC | 19765 |
| 3926 | GCAAGUAU G UGACCCCA | 9036 | TGCGCTCA GGCTAGCTACAACGA ATACTTCC | 19766 |
| 3929 | AGUAUCUG A CCCCAAAU | 9037 | ATTTGCCG GGCTAGCTACAACGA CACATACT | 19767 |
| 3936 | GACCCCAA A UUCCAUUA | 9038 | TAATGCAA GGCTAGCTACAACGA TTGCCGTC | 19768 |
| 3941 | CAAAUUCC A UUAUGACA | 6832 | TGTCATAA GGCTAGCTACAACGA CGAATTTG | 19769 |
| 3944 | AUUCCAUU A UGACAACA | 2080 | TCTTGTCA GGCTAGCTACAACGA AATCCAAT | 19770 |
| 3947 | CCAUUAUG A CAACACAG | 9039 | CTGTGTTG GGCTAGCTACAACGA CATAATGG | 19771 |
| 3950 | UUAUGACA A CACAGCAG | 9040 | CTGCTGTG GGCTAGCTACAACGA TGTCATAA | 19772 |
| 3952 | AUGACAAC A CAGCAGGA | 6834 | TCCTGCTG GGCTAGCTACAACGA GTTGTCAT | 19773 |
| 3955 | ACAACACA G CAGGAAUC | 9041 | GATTCCTG GGCTAGCTACAACGA TGTGTTGT | 19774 |
| 3961 | CAGCAGGA A UCAGUCAG | 9042 | CTGACTGA GGCTAGCTACAACGA TCCTGCTG | 19775 |
| 3965 | AGGAAUCA G UCAGUAUC | 9043 | GATACTGA GGCTAGCTACAACGA TGATTCCT | 19776 |
| 3969 | AUCAGUCA G UAUCUGCA | 9044 | TGCAGATA GGCTAGCTACAACGA TGACTGAT | 19777 |
| 3971 | CAGUCAGU A UCUGCAGA | 2083 | TCTGCAGA GGCTAGCTACAACGA ACTGACTG | 19778 |
| 3975 | CAGUAUCU G CAGAACAG | 9045 | CTGTTCTG GGCTAGCTACAACGA AGATACTG | 19779 |
| 3980 | UCUGCAGA A CAGUAAGC | 9046 | GCTTACTG GGCTAGCTACAACGA TCTGCAGA | 19780 |
| 3983 | GCAGAACA G UAAGCGAA | 9047 | TTCGCTTA GGCTAGCTACAACGA TGTTCTGC | 19781 |
| 3987 | AACAGUAA G CGAAAGAG | 9048 | CTCTTTCG GGCTAGCTACAACGA TTACTGTT | 19782 |
| 3995 | GCGAAAGA G CCGGCCUG | 9049 | CAGGCCGG GGCTAGCTACAACGA TCTTTCGC | 19783 |
| 3999 | AAGAGCCG G CCUGUGAG | 9050 | CTCACAGG GGCTAGCTACAACGA CGGCTCTT | 19784 |
| 4003 | GCCGGCCU G UGAGUGUA | 9051 | TACACTCA GGCTAGCTACAACGA AGGCCGGC | 19785 |
| 4007 | GCCUGUGA G UGUAAAAA | 9052 | TTTTTACA GGCTAGCTACAACGA TCACAGGC | 19786 |
| 4009 | CUGUGAGU G UAAAACA | 9053 | TGTTTTTA GGCTAGCTACAACGA ACTCACAG | 19787 |
| 4015 | GUGUAAAA A CAUUUGAA | 9054 | TTCAAATG GGCTAGCTACAACGA TTTTACAC | 19788 |
| 4017 | GUAAAAAC A UUUGAAGA | 6845 | TCTTCAAA GGCTAGCTACAACGA GTTTTTAC | 19789 |
| 4025 | AUUUGAAG A UAUCCCGU | 9055 | ACGGGATA GGCTAGCTACAACGA CTTCAAAT | 19790 |

TABLE XXII-continued

Human KDR DNAzyme and Substrate sequence

| Pos | Substrate | Seq ID No | DNAzyme | Seq ID No |
|---|---|---|---|---|
| 4027 | UUGAAGAU A UCCCGUUA | 2089 | TAACGGGA GGCTAGCTACAACGA ATCTTCAA | 19791 |
| 4032 | GAUAUCCC G UUAGAAGA | 9056 | TCTTCTAA GGCTAGCTACAACGA GGGATATC | 19792 |
| 4041 | UUAGAAGA A CCAGAAGU | 9057 | ACTTCTGG GGCTAGCTACAACGA TCTTCTAA | 19793 |
| 4048 | AACCAGAA G UAAAAGUA | 9058 | TACTTTTA GGCTAGCTACAACGA TTCTGGTT | 19794 |
| 4054 | AAGUAAAA G UAAUCCCA | 9059 | TGGGATTA GGCTAGCTACAACGA TTTTACTT | 19795 |
| 4057 | UAAAAGUA A UCCCAGAU | 9060 | ATCTGGGA GGCTAGCTACAACGA TACTTTTA | 19796 |
| 4064 | AAUCCCAG A UGACAACC | 9061 | GGTTGTCA GGCTAGCTACAACGA CTGGGATT | 19797 |
| 4067 | CCCAGAUG A CAACCAGA | 9062 | ACTGGTTG GGCTAGCTACAACGA CATCTGGG | 19798 |
| 4070 | AGAUGACA A CCAGACGG | 9063 | CCGTCTGG GGCTAGCTACAACGA TGTCATCT | 19799 |
| 4075 | ACAACCAG A CGGACAGU | 9064 | ACTGTCCG GGCTAGCTACAACGA CTGGTTGT | 19800 |
| 4079 | CCAGACGG A CAGUGGUA | 9065 | TACCACTG GGCTAGCTACAACGA CCGTCTGG | 19801 |
| 4082 | GACGGACA G UGGUAUGG | 9066 | CCATACCA GGCTAGCTACAACGA TGTCCGTC | 19802 |
| 4085 | GGACAGUG G UAUGGUUC | 9067 | GAACCATA GGCTAGCTACAACGA CACTGTCC | 19803 |
| 4087 | ACAGUGGU A UGGUUCUU | 2096 | AAGAACCA GGCTAGCTACAACGA ACCACTGT | 19804 |
| 4090 | GUGGUAUG G UUCUUGCC | 9068 | GGCAAGAA GGCTAGCTACAACGA CATACCAC | 19805 |
| 4096 | UGGUUCUU G CCUCAGAA | 9069 | TTCTGAGG GGCTAGCTACAACGA AAGAACCA | 19806 |
| 4107 | UCAGAAGA G CUGAAAAC | 9070 | GTTTTCAG GGCTAGCTACAACGA TCTTCTGA | 19807 |
| 4114 | AGCUGAAA A CUUUGGAA | 9071 | TTCCAAAG GGCTAGCTACAACGA TTTCAGCT | 19808 |
| 4124 | UUUGGAAG A CAGAACCA | 9072 | TGGTTCTG GGCTAGCTACAACGA CTTCCAAA | 19809 |
| 4129 | AAGACAGA A CCAAAUUA | 9073 | TAATTTGG GGCTAGCTACAACGA TCTGTCTT | 19810 |
| 4134 | AGAACCAA A UUAUCUCC | 9074 | GGAGATAA GGCTAGCTACAACGA TTGGTTCT | 19811 |
| 4137 | ACCAAAUU A UCUCCAUC | 2104 | GATGGAGA GGCTAGCTACAACGA AATTTGGT | 19812 |
| 4143 | UUAUCUCC A UCUUUUGG | 6868 | CCAAAAGA GGCTAGCTACAACGA GGAGATAA | 19813 |
| 4151 | AUCUUUUG G UGGAAUGG | 9075 | CCATTCCA GGCTAGCTACAACGA CAAAAGAT | 19814 |
| 4156 | UUGGUGGA A UGGUGCCC | 9076 | GGGCACCA GGCTAGCTACAACGA TCCACCAA | 19815 |
| 4159 | GUGGAAUG G UGCCCAGC | 9077 | GCTGGGCA GGCTAGCTACAACGA CATTCCAC | 19816 |
| 4161 | GGAAUGGU G CCCAGCAA | 9078 | TTGCTGGG GGCTAGCTACAACGA ACCATTCC | 19817 |
| 4166 | GGUGCCCA G CAAAAGCA | 9079 | TGCTTTTG GGCTAGCTACAACGA TGGGCACC | 19818 |
| 4172 | CAGCAAAA G CAGGGAGU | 9080 | ACTCCCTG GGCTAGCTACAACGA TTTTGCTG | 19819 |
| 4179 | AGCAGGGA G UCUGUGGC | 9081 | GCCACAGA GGCTAGCTACAACGA TCCCTGCT | 19820 |
| 4183 | GGGAGUCU G UGGCAUCU | 9082 | AGATGCCA GGCTAGCTACAACGA AGACTCCC | 19821 |
| 4186 | AGUCUGUG G CAUCUGAA | 9083 | TTCAGATG GGCTAGCTACAACGA CACAGACT | 19822 |
| 4188 | UCUGUGGC A UCUGAAGG | 6876 | CCTTCAGA GGCTAGCTACAACGA GCCACAGA | 19823 |
| 4196 | AUCUGAAG G CUCAAACC | 9084 | GGTTTGAG GGCTAGCTACAACGA CTTCAGAT | 19824 |
| 4202 | AGGCUCAA A CCAGACAA | 9085 | TTGTCTGG GGCTAGCTACAACGA TTGAGCCT | 19825 |
| 4207 | CAAACCAG A CAAGCGGC | 9086 | GCCGCTTG GGCTAGCTACAACGA CTGGTTTG | 19826 |
| 4211 | CCAGACAA G CGGCUACC | 9087 | GGTAGCCG GGCTAGCTACAACGA TTGTCTGG | 19827 |

TABLE XXII-continued

Human KDR DNAzyme and Substrate sequence

| Pos | Substrate | Seq ID No | DNAzyme | Seq ID No |
|-----|-----------|-----------|---------|-----------|
| 4214 | GACAAGCG G CUACCAGU | 9088 | ACTGGTAG GGCTAGCTACAACGA CGCTTGTC | 19828 |
| 4217 | AAGCGGCU A CCAGUCCG | 2114 | CGGACTGG GGCTAGCTACAACGA AGCCGCTT | 19829 |
| 4221 | GGCUACCA G UCCGGAUA | 9089 | TATCCGGA GGCTAGCTACAACGA TGGTAGCC | 19830 |
| 4227 | CAGUCCGG A UAUCACUC | 9090 | GAGTGATA GGCTAGCTACAACGA CCGGACTG | 19831 |
| 4229 | GUCCGGAU A UCACUCCG | 2116 | CGGAGTGA GGCTAGCTACAACGA ATCCGGAC | 19832 |
| 4232 | CGGAUAUC A CUCCGAUG | 6887 | CATCGGAG GGCTAGCTACAACGA GATATCCG | 19833 |
| 4238 | UCACUCCG A UGACACAG | 9091 | CTGTGTCA GGCTAGCTACAACGA CGGAGTGA | 19834 |
| 4241 | CUCCGAUG A CACAGACA | 9092 | TGTCTGTG GGCTAGCTACAACGA CATCGGAG | 19835 |
| 4243 | CCGAUGAC A CAGACACC | 6890 | GGTGTCTG GGCTAGCTACAACGA GTCATCGG | 19836 |
| 4247 | UGACACAG A CACCACCG | 9093 | CGGTGGTG GGCTAGCTACAACGA CTGTGTCA | 19837 |
| 4249 | ACACAGAC A CCACCGUG | 6892 | CACGGTGG GGCTAGCTACAACGA GTCTGTGT | 19838 |
| 4252 | CAGACACC A CCGUGUAC | 6894 | GTACACGG GGCTAGCTACAACGA GGTGTCTG | 19839 |
| 4255 | ACACCACC G UGUACUCC | 9094 | GGAGTACA GGCTAGCTACAACGA GGTGGTGT | 19840 |
| 4257 | ACCACCGU G UACUCCAG | 9095 | CTGGAGTA GGCTAGCTACAACGA ACGGTGGT | 19841 |
| 4259 | CACCGUGU A CUCCAGUG | 2119 | CACTGGAG GGCTAGCTACAACGA ACACGGTG | 19842 |
| 4265 | GUACUCCA G UGAGGAAG | 9096 | CTTCCTCA GGCTAGCTACAACGA TGGAGTAC | 19843 |
| 4273 | GUGAGGAA G CAGAACUU | 9097 | AAGTTCTG GGCTAGCTACAACGA TTCCTCAC | 19844 |
| 4278 | GAAGCAGA A CUUUUAAA | 9098 | TTTAAAAG GGCTAGCTACAACGA TCTGCTTC | 19845 |
| 4287 | CUUUUAAA G CUGAUAGA | 9099 | TCTATCAG GGCTAGCTACAACGA TTTAAAAG | 19846 |
| 4291 | UAAAGCUG A UAGAGAUU | 9100 | AATCTCTA GGCTAGCTACAACGA CAGCTTTA | 19847 |
| 4297 | UGAUAGAG A UUGGAGUG | 9101 | CACTCCAA GGCTAGCTACAACGA CTCTATCA | 19848 |
| 4303 | AGAUUGGA G UGCAAACC | 9102 | GGTTTGCA GGCTAGCTACAACGA TCCAATCT | 19849 |
| 4305 | AUUGGAGU G CAAACCGG | 9103 | CCGGTTTG GGCTAGCTACAACGA ACTCCAAT | 19850 |
| 4309 | GAGUGCAA A CCGGUAGC | 9104 | GCTACCGG GGCTAGCTACAACGA TTGCACTC | 19851 |
| 4313 | GCAAACCG G UAGCACAG | 9105 | CTGTGCTA GGCTAGCTACAACGA CGGTTTGC | 19852 |
| 4316 | AACCGGUA G CACAGCCC | 9106 | GGGCTGTG GGCTAGCTACAACGA TACCGGTT | 19853 |
| 4318 | CCGGUAGC A CAGCCCAG | 6904 | CTGGGCTG GGCTAGCTACAACGA GCTACCGG | 19854 |
| 4321 | GUAGCACA G CCCAGAUU | 9107 | AATCTGGG GGCTAGCTACAACGA TGTGCTAC | 19855 |
| 4327 | CAGCCCAG A UUCUCCAG | 9108 | CTGGAGAA GGCTAGCTACAACGA CTGGGCTG | 19856 |
| 4335 | AUUCUCCA G CCUGACUC | 9109 | GAGTCAGG GGCTAGCTACAACGA TGGAGAAT | 19857 |
| 4340 | CCAGCCUG A CUCGGGGA | 9110 | TCCCCGAG GGCTAGCTACAACGA CAGCCTGG | 19858 |
| 4348 | ACUCGGGG A CCACACUG | 9111 | CAGTGTGG GGCTAGCTACAACGA CCCCGAGT | 19859 |
| 4351 | CGGGGACC A CACUGAGC | 6916 | GCTCAGTG GGCTAGCTACAACGA GGTCCCCG | 19860 |
| 4353 | GGGACCAC A CUGAGCUC | 6917 | GAGCTCAG GGCTAGCTACAACGA GTGGTCCC | 19861 |
| 4358 | CACACUGA G CUCUCCUC | 9112 | GAGGAGAG GGCTAGCTACAACGA TCAGTGTG | 19862 |
| 4369 | CUCCUCCU G UUUAAAAG | 9113 | CTTTTAAA GGCTAGCTACAACGA AGGAGGAG | 19863 |
| 4381 | AAAAGGAA G CAUCCACA | 9114 | TGTGGATG GGCTAGCTACAACGA TTCCTTTT | 19864 |

TABLE XXII-continued

Human KDR DNAzyme and Substrate sequence

| Pos | Substrate | Seq ID No | DNAzyme | Seq ID No |
|---|---|---|---|---|
| 4383 | AAGGAAGC A UCCACACC | 6925 | GGTGTGGA GGCTAGCTACAACGA GCTTCCTT | 19865 |
| 4387 | AAGCAUCC A CACCCCAA | 6927 | TTGGGGTG GGCTAGCTACAACGA GGATCCTT | 19866 |
| 4389 | GCAUCCAC A CCCCAACU | 6928 | AGTTGGCG GGCTAGCTACAACGA GTGGATGC | 19867 |
| 4395 | ACACCCCA A CUCCCGGA | 9115 | TCCGGGAG GGCTAGCTACAACGA TGGGGTGT | 19868 |
| 4403 | ACUCCCGG A CAUCACAU | 9116 | ATGTGATG GGCTAGCTACAACGA CCGGGAGT | 19869 |
| 4405 | UCCCGGAC A UCACAUGA | 6936 | TCATGTGA GGCTAGCTACAACGA GTCCGGGA | 19870 |
| 4408 | CGGACAUC A CAUGAGAG | 6937 | CTCTCATG GGCTAGCTACAACGA GATGTCCG | 19871 |
| 4410 | GACAUCAC A UGAGAGGU | 6938 | ACCTCTCA GGCTAGCTACAACGA GTGATGTC | 19872 |
| 4417 | CAUGAGAG G UCUGCUCA | 9117 | TGAGCAGA GGCTAGCTACAACGA CTCTCATG | 19873 |
| 4421 | AGAGGUCU G CUCAGAUU | 9118 | AATCTGAG GGCTAGCTACAACGA AGACCTCT | 19874 |
| 4427 | CUGCUCAG A UUUUGAAG | 9119 | CTTCAAAA GGCTAGCTACAACGA CTGAGCAG | 19875 |
| 4435 | AUUUUGAA G UGUUGUUC | 9120 | GAACAACA GGCTAGCTACAACGA TTCAAAAT | 19876 |
| 4437 | UUUGAAGU G UUGUUCUU | 9121 | AAGAACAA GGCTAGCTACAACGA ACTTCAAA | 19877 |
| 4440 | GAAGUGUU G UUCUUUCC | 9122 | GGAAAGAA GGCTAGCTACAACGA AACACTTC | 19878 |
| 4449 | UUCUUUCC A CCAGCAGG | 6944 | CCTGCTGG GGCTAGCTACAACGA GGAAAGAA | 19879 |
| 4453 | UUCCACCA G CAGGAAGU | 9123 | ACTTCCTG GGCTAGCTACAACGA TGGTGGAA | 19880 |
| 4460 | AGCAGGAA G UAGCCGCA | 9124 | TGCGGCTA GGCTAGCTACAACGA TTCCTGCT | 19881 |
| 4463 | AGGAAGUA G CCGCAUUU | 9125 | AAATGCGG GGCTAGCTACAACGA TACTTCCT | 19882 |
| 4466 | AAGUAGCC G CAUUUGAU | 9126 | ATCAAATG GGCTAGCTACAACGA GGCTACTT | 19883 |
| 4468 | GUAGCCGC A UUUGAUUU | 6949 | AAATCAAA GGCTAGCTACAACGA GCGGCTAC | 19884 |
| 4473 | CGCAUUUG A UUUUCAUU | 9127 | AATGAAAA GGCTAGCTACAACGA CAAATGCG | 19885 |
| 4479 | UGAUUUUC A UUUCGACA | 6950 | TGTCGAAA GGCTAGCTACAACGA GAAAATCA | 19886 |
| 4485 | UCAUUUCG A CAACAGAA | 9128 | TTCTGTTG GGCTAGCTACAACGA CGAAATGA | 19887 |
| 4488 | UUUCGACA A CAGAAAAA | 9129 | TTTTTCTG GGCTAGCTACAACGA TGTCGAAA | 19888 |
| 4499 | GAAAAAGG A CCUCGGAC | 9130 | GTCCGAGG GGCTAGCTACAACGA CCTTTTTC | 19889 |
| 4506 | GACCUCGG A CUGCAGGG | 9131 | CCCTGCAG GGCTAGCTACAACGA CCGAGGTC | 19890 |
| 4509 | CUCGGACU G CAGGGAGC | 9132 | GCTCCCTG GGCTAGCTACAACGA AGTCCGAG | 19891 |
| 4516 | UGCAGGGA G CCAGUCUU | 9133 | AAGACTGG GGCTAGCTACAACGA TCCCTGCA | 19892 |
| 4520 | GGGAGCCA G UCUUCUAG | 9134 | CTAGAAGA GGCTAGCTACAACGA TGGCTCCC | 19893 |
| 4529 | UCUUCUAG G CAUAUCCU | 9135 | AGGATATG GGCTAGCTACAACGA CTAGAAGA | 19894 |
| 4531 | UUCUAGGC A UAUCCUGG | 9136 | CCAGGATA GGCTAGCTACAACGA GCCTAGAA | 19895 |
| 4533 | CUAGGCAU A UCCUGGAA | 9137 | TTCCAGGA GGCTAGCTACAACGA ATGCCTAG | 19896 |
| 4545 | UGGAAGAG G CUUGUGAC | 9138 | GTCACAAG GGCTAGCTACAACGA CTCTTCCA | 19897 |
| 4549 | AGAGGCUU G UGACCCAA | 9139 | TTGGGTCA GGCTAGCTACAACGA AAGCCTCT | 19898 |
| 4552 | GGCUUGUG A CCCAAGAA | 9140 | TTCTTGGG GGCTAGCTACAACGA CACAAGCC | 19899 |
| 4560 | ACCCAAGA A UGUGUCUG | 9141 | CAGACACA GGCTAGCTACAACGA TCTTGGGT | 19900 |
| 4562 | CCAAGAAU G UGUCUGUG | 9142 | CACAGACA GGCTAGCTACAACGA ATTCTTGG | 19901 |

TABLE XXII-continued

Human KDR DNAzyme and Substrate sequence

| Pos | Substrate | Seq ID No | DNAzyme | Seq ID No |
|---|---|---|---|---|
| 4564 | AAGAAUGU G UCUGUGUC | 9143 | GACACAGA GGCTAGCTACAACGA ACATTCTT | 19902 |
| 4568 | AUGUGUCU G UGUCUUCU | 9144 | AGAAGACA GGCTAGCTACAACGA AGACACAT | 19903 |
| 4570 | GUGUCUGU G UCUUCUCC | 9145 | GGAGAAGA GGCTAGCTACAACGA ACAGACAC | 19904 |
| 4581 | UUCUCCCA G UGUUGACC | 9146 | GGTCAACA GGCTAGCTACAACGA TGGGAGAA | 19905 |
| 4583 | CUCCCAGU G UUGACCUG | 9147 | CAGGTCAA GGCTAGCTACAACGA ACTGGGAG | 19906 |
| 4587 | CAGUGUUG A CCUGAUCC | 9148 | GGATCAGG GGCTAGCTACAACGA CAACACTG | 19907 |
| 4592 | UUGACCUG A UCCUCUUU | 9149 | AAAGAGGA GGCTAGCTACAACGA CAGGTCAA | 19908 |
| 4605 | CUUUUUUC A UUCAUUUA | 9150 | TAAATGAA GGCTAGCTACAACGA GAAAAAAG | 19909 |
| 4609 | UUUCAUUC A UUUAAAAA | 9151 | TTTTTAAA GGCTAGCTACAACGA GAATGAAA | 19910 |
| 4618 | UUUAAAAA G CAUUAUCA | 9152 | TGATAATG GGCTAGCTACAACGA TTTTTAAA | 19911 |
| 4620 | UAAAAAGC A UUAUCAUG | 9153 | CATGATAA GGCTAGCTACAACGA GCTTTTTA | 19912 |
| 4623 | AAAGCAUU A UCAUGCCC | 9154 | GGGCATGA GGCTAGCTACAACGA AATGCTTT | 19913 |
| 4626 | GCAUUAUC A UGCCCUG | 9155 | CAGGGGCA GGCTAGCTACAACGA GATAATGC | 19914 |
| 4628 | AUUAUCAU G CCCCUGCU | 9156 | AGCAGGGG GGCTAGCTACAACGA ATGATAAT | 19915 |
| 4634 | AUGCCCCU G CUGCGGGU | 9157 | ACCCGCAG GGCTAGCTACAACGA AGGGGCAT | 19916 |
| 4637 | CCCCUGCU G CGGGUCUC | 9158 | GAGACCCG GGCTAGCTACAACGA AGCAGGGG | 19917 |
| 4641 | UGCUGCGG G UCUCACCA | 9159 | TGGTGAGA GGCTAGCTACAACGA CCGCAGCA | 19918 |
| 4646 | CGGGUCUC A CCAUGGGU | 9160 | ACCCATGG GGCTAGCTACAACGA GAGACCCG | 19919 |
| 4649 | GUCUCACC A UGGGUUUA | 9161 | TAAACCCA GGCTAGCTACAACGA GGTGAGAC | 19920 |
| 4653 | CACCAUGG G UUUAGAAC | 9162 | GTTCTAAA GGCTAGCTACAACGA CCATGGTG | 19921 |
| 4660 | GGUUUAGA A CAAAGAGC | 9163 | GCTCTTTG GGCTAGCTACAACGA TCTAAACC | 19922 |
| 4667 | AACAAAGA G CUUCAAGC | 9164 | GCTTGAAG GGCTAGCTACAACGA TCTTTGTT | 19923 |
| 4674 | AGCUUCAA G CAAUGGCC | 9165 | GGCCATTG GGCTAGCTACAACGA TTGAAGCT | 19924 |
| 4677 | UUCAACCA A UGGCCCCA | 9166 | TGGGGCCA GGCTAGCTACAACGA TGCTTGAA | 19925 |
| 4680 | AAGCAAUG G CCCCAUCC | 9167 | GGATGGGG GGCTAGCTACAACGA CATTGCTT | 19926 |
| 4685 | AUGGCCCC A UCCUCAAA | 9168 | TTTGAGGA GGCTAGCTACAACGA GGGGCCAT | 19927 |
| 4697 | UCAAAGAA G UAGCAGUA | 9169 | TACTGCTA GGCTAGCTACAACGA TTCTTTGA | 19928 |
| 4700 | AAGAAGUA G CAGUACCU | 9170 | AGGTACTG GGCTAGCTACAACGA TACTTCTT | 19929 |
| 4703 | AAGUAGCA G UACCUGGG | 9171 | CCCAGGTA GGCTAGCTACAACGA TGCTACTT | 19930 |
| 4705 | GUAGCAGU A CCUGGGA | 9172 | TCCCCAGG GGCTAGCTACAACGA ACTGCTAC | 19931 |
| 4714 | CCUGGGGA G CUGACACU | 9173 | AGTGTCAG GGCTAGCTACAACGA TCCCCAGG | 19932 |
| 4718 | GGGAGCUG A CACUUCUG | 9174 | CAGAAGTG GGCTAGCTACAACGA CAGCTCCC | 19933 |
| 4720 | GAGCUGAC A CUUCUGUA | 9175 | TACAGAAG GGCTAGCTACAACGA GTCACCTC | 19934 |
| 4726 | ACACUUCU G UAAACUA | 9176 | TAGTTTTA GGCTAGCTACAACGA AGAAGTGT | 19935 |
| 4731 | UCUGUAAA A CUAGAAGA | 9177 | TCTTCTAG GGCTAGCTACAACGA TTTACAGA | 19936 |
| 4739 | ACUAGAAG A UAAACCAG | 9178 | CTGGTTTA GGCTAGCTACAACGA CTTCTAGT | 19937 |
| 4743 | GAAGAUAA A CCAGGCAA | 9179 | TTGCCTGG GGCTAGCTACAACGA TTATCTTC | 19938 |

TABLE XXII-continued

Human KDR DNAzyme and Substrate sequence

| Pos | Substrate | Seq ID No | DNAzyme | Seq ID No |
|---|---|---|---|---|
| 4748 | UAAACCAG G CAACGUAA | 9180 | TTACGTTG GGCTAGCTACAACGA CTGGTTTA | 19939 |
| 4751 | ACCAGGCA A CGUAAGUG | 9181 | CACTTACG GGCTAGCTACAACGA TGCCTGGT | 19940 |
| 4753 | CAGGCAAC G UAAGUGUU | 9182 | AACACTTA GGCTAGCTACAACGA GTTGCCTG | 19941 |
| 4757 | CAACGUAA G UGUUCGAG | 9183 | CTCGAACA GGCTAGCTACAACGA TTACGTTG | 19942 |
| 4759 | ACGUAAGU G UUCGAGGU | 9184 | ACCTCGAA GGCTAGCTACAACGA ACTTACGT | 19943 |
| 4766 | UGUUCGAG G UGUUGAAG | 9185 | CTTCAACA GGCTAGCTACAACGA CTCGAACA | 19944 |
| 4768 | UUCGAGGU G UUGAAGAU | 9186 | ATCTTCAA GGCTAGCTACAACGA ACCTCGAA | 19945 |
| 4775 | UGUUGAAG A UGGGAAGG | 9187 | CCTTCCCA GGCTAGCTACAACGA CTTCAACA | 19946 |
| 4784 | UGGGAAGG A UUUGCAGG | 9188 | CCTGCAAA GGCTAGCTACAACGA CCTTCCCA | 19947 |
| 4788 | AAGGAUUU G CAGGGCUC | 9189 | CAGCCCTG GGCTAGCTACAACGA AAATCCTT | 19948 |
| 4793 | UUUGCAGG G CUGAGUCU | 9190 | AGACTCAG GGCTAGCTACAACGA CCTGCAAA | 19949 |
| 4798 | AGGGCUGA G UCUAUCCA | 9191 | TGGATAGA GGCTAGCTACAACGA TCAGCCCT | 19950 |
| 4802 | CUGACUCU A UCCAAGAG | 9192 | CTCTTGGA GGCTAGCTACAACGA AGACTCAG | 19951 |
| 4811 | UCCAAGAG G CUUUGUUU | 9193 | AAACAAAG GGCTAGCTACAACGA CTCTTGGA | 19952 |
| 4816 | GAGGCUUU G UUUAGGAC | 9194 | GTCCTAAA GGCTAGCTACAACGA AAAGCCTC | 19953 |
| 4823 | UGUUUAGG A CGUGGGUC | 9195 | GACCCACG GGCTAGCTACAACGA CCTAAACA | 19954 |
| 4825 | UUUAGGAC G UGGGUCCC | 9196 | GGGACCCA GGCTAGCTACAACGA GTCCTAAA | 19955 |
| 4829 | CGACGUGG G UCCCAAGC | 9197 | GCTTGGGA GGCTAGCTACAACGA CCACGTCC | 19956 |
| 4836 | GGUCCCAA G CCAAGCCU | 9198 | AGGCTTGG GGCTAGCTACAACGA TTGGGACC | 19957 |
| 4841 | CAACCCAA G CCUUAAGU | 9199 | ACTTAAGG GGCTAGCTACAACGA TTGGCTTG | 19958 |
| 4848 | AGCCUUAA G UGUGGAAU | 9200 | ATTCCACA GGCTAGCTACAACGA TTAAGGCT | 19959 |
| 4850 | CCUUAAGU G UGGAAUUC | 9201 | GAATTCCA GGCTAGCTACAACGA ACTTAAGG | 19960 |
| 4855 | AGUGUCCA A UUCGCAUU | 9202 | AATCCGAA GGCTAGCTACAACGA TCCACACT | 19961 |
| 4861 | GAAUUCGG A UUGAUAGA | 9203 | TCTATCAA GCCTAGCTACAACGA CCGAATTC | 19962 |
| 4865 | UCGGAUUG A UAGAAAGC | 9204 | CCTTTCTA GGCTAGCTACAACGA CAATCCGA | 19963 |
| 4877 | AAAGGAAG A CUAACGUU | 9205 | AACGTTAG GGCTAGCTACAACGA CTTCCTTT | 19964 |
| 4881 | GAAGACUA A CGUUACCU | 9206 | AGGTAACG GGCTAGCTACAACGA TAGTCTTC | 19965 |
| 4883 | AGACUAAC G UUACCUUG | 9207 | CAAGGTAA GCCTAGCTACAACGA GTTAGTCT | 19966 |
| 4886 | CUAACGUU A CCUUGCUU | 9208 | AAGCAAGG GGCTAGCTACAACGA AACGTTAG | 19967 |
| 4891 | GUUACCUU G CUUGGAG | 9209 | CTCCAAAG GGCTAGCTACAACGA AAGGTAAC | 19968 |
| 4901 | UUUGGAGA G UACUGGAG | 9210 | CTCCAGTA GGCTAGCTACAACGA TCTCCAAA | 19969 |
| 4903 | UGGAGAGU A CUGGAGCC | 9211 | GGCTCCAG GGCTAGCTACAACGA ACTCTCCA | 19970 |
| 4909 | GUACUGGA G CCUGCAAA | 9212 | TTTGCAGG GGCTAGCTACAACGA TCCAGTAC | 19971 |
| 4913 | UCGAGCCU G CAAAUGCA | 9213 | TGCATTTG GGCTAGCTACAACGA AGGCTCCA | 19972 |
| 4917 | GCCUGCAA A UGCAUUGU | 9214 | ACAATGCA GGCTAGCTACAACGA TTGCAGGC | 19973 |
| 4919 | CUGCAAAU G CAUUGUGU | 9215 | ACACAATG GGCTAGCTACAACGA ATTTGCAG | 19974 |
| 4921 | GCAAAUGC A UUGUGUUU | 9216 | AAACACAA GGCTAGCTACAACGA GCATTTGC | 19975 |

TABLE XXII-continued

Human KDR DNAzyme and Substrate sequence

| Pos | Substrate | Seq ID No | DNAzyme | Seq ID No |
|---|---|---|---|---|
| 4924 | AAUGCAUU G UCUUUGCU | 9217 | AGCAAACA GGCTAGCTACAACGA AATGCATT | 19976 |
| 4926 | UGCAUUGU G UUUGCUCU | 9218 | AGAGCAAA GGCTAGCTACAACGA ACAATGCA | 19977 |
| 4930 | UUGUGUUU G CUCUGGUG | 9219 | CACCAGAG GGCTAGCTACAACGA AAACACAA | 19978 |
| 4936 | UUGCUCUG G UGGAGGUG | 9220 | CACCTCCA GGCTAGCTACAACGA CAGAGCAA | 19979 |
| 4942 | UGGUGGAG G UGGGCAUG | 9221 | CATGCCCA GGCTAGCTACAACGA CTCCACCA | 19980 |
| 4946 | GGAGGUGG G CAUGGGGU | 9222 | ACCCCATG GGCTAGCTACAACGA CCACCTCC | 19981 |
| 4948 | AGGUGGGC A UGGGGUCU | 9223 | AGACCCCA GGCTAGCTACAACGA GCCCACCT | 19982 |
| 4953 | GGCAUGGG G UCUGUUCU | 9224 | AGAACAGA GGCTAGCTACAACGA CCCATGCC | 19983 |
| 4957 | UGGGGUCU G UUCUGAAA | 9225 | TTTCAGAA GGCTAGCTACAACGA AGACCCCA | 19984 |
| 4965 | GUUCUGAA A UGUAAAGG | 9226 | CCTTTACA GGCTAGCTACAACGA TTCAGAAC | 19985 |
| 4967 | UCUGAAAU G UAAAGGGU | 9227 | ACCCTTTA GGCTAGCTACAACGA ATTTCAGA | 19986 |
| 4974 | UGUAAAGG G UUCAGACG | 9228 | CGTCTGAA GGCTAGCTACAACGA CCTTTACA | 19987 |
| 4980 | GCGUUCAG A CGGGGUUU | 9229 | AAACCCCG GGCTAGCTACAACGA CTGAACCC | 19988 |
| 4985 | CAGACGGG G UUUCUGGU | 9230 | ACCAGAAA GGCTAGCTACAACGA CCCGTCTG | 19989 |
| 4992 | GGUUUCUG G UUUUAGAA | 9231 | TTCTAAAA GGCTAGCTACAACGA CAGAAACC | 19990 |
| 5002 | UUUAGAAG G UUGCGUGU | 9232 | ACACGCAA GGCTAGCTACAACGA CTTCTAAA | 19991 |
| 5005 | AGAAGGUU G CGUGUUCU | 9233 | ACAACACG GGCTAGCTACAACGA AACCTTCT | 19992 |
| 5007 | AAGGUUGC G UGUUCUUC | 9234 | GAAGAACA GGCTAGCTACAACGA GCAACCTT | 19993 |
| 5009 | GGUUGCGU G UUCUUCGA | 9235 | TCGAAGAA GGCTAGCTACAACGA ACGCAACC | 19994 |
| 5018 | UUCUUCGA G UUGGGCUA | 9236 | TACCCCAA GCCTAGCTACAACGA TCGAAGAA | 19995 |
| 5023 | CGAGUUGG G CUAAAGUA | 9237 | TACTTTAG GGCTAGCTACAACGA CCAACTCG | 19996 |
| 5029 | GGGCUAAA G UAGAGUUC | 9238 | GAACTCTA GGCTAGCTACAACGA TTTAGCCC | 19997 |
| 5034 | AAAGUACA G UUCGUUGU | 9239 | ACAACGAA GGCTAGCTACAACGA TCTACTTT | 19998 |
| 5038 | UAGAGUUC G UUGUGCUG | 9240 | CAGCACAA GGCTAGCTACAACGA GAACTCTA | 19999 |
| 5041 | AGUUCGUU G UGCUGUUU | 9241 | AAACAGCA GGCTAGCTACAACGA AACGAACT | 20000 |
| 5043 | UUCGUUGU G CUGUUUCU | 9242 | AGAAACAG GGCTAGCTACAACGA ACAACGAA | 20001 |
| 5046 | GUUGUGCU G UUUCUCAC | 9243 | GTCAGAAA GGCTAGCTACAACGA AGCACAAC | 20002 |
| 5053 | UGUUUCUG A CUCCUAAU | 9244 | ATTAGGAG GGCTAGCTACAACGA CAGAAACA | 20003 |
| 5060 | GACUCCUA A UGAGAGUU | 9245 | AACTCTCA GGCTAGCTACAACGA TAGGAGTC | 20004 |
| 5066 | UAAUGAGA G UUCCUUCC | 9246 | GGAAGGAA GGCTAGCTACAACGA TCTCATTA | 20005 |
| 5077 | CCUUCCAG A CCCUUACC | 9247 | GCTAACCG GGCTAGCTACAACGA CTGGAAGG | 20006 |
| 5080 | UCCAGACC G UUACCGUU | 9248 | ACAGCTAA GGCTAGCTACAACGA GCTCTGGA | 20007 |
| 5084 | GACCGUUA G CUGUCUCC | 9249 | GGAGACAG GGCTAGCTACAACGA TAACGGTC | 20008 |
| 5087 | CCUUACCU G UCUCCUUG | 9250 | CAAGGACA GGCTAGCTACAACGA AGCTAACG | 20009 |
| 5095 | GUCUCCUU G CCAAGCCC | 9251 | GCGCTTGG GGCTAGCTACAACGA AAGGAGAC | 20010 |
| 5100 | CUUGCCAA G CCCCACGA | 9252 | TCCTGGCG GGCTAGCTACAACGA TTCGCAAG | 20011 |
| 5114 | GGAAGAAA A UGAUCCAG | 9253 | CTGCATCA GGCTAGCTACAACGA TTTCTTCC | 20012 |

TABLE XXII-continued

Human KDR DNAzyme and Substrate sequence

| Pos | Substrate | Seq ID No | DNAzyme | Seq ID No |
|---|---|---|---|---|
| 5117 | AGAAAAUG A UCCACCUC | 9254 | GACCTGCA GGCTAGCTACAACGA CATTTTCT | 20013 |
| 5119 | AAAAUGAU G CACCUCUG | 9255 | CAGACCTG GGCTAGCTACAACGA ATCATTTT | 20014 |
| 5122 | AUGAUCCA G CUCUGGCU | 9256 | ACCCAGAG GGCTAGCTACAACGA TGCATCAT | 20015 |
| 5128 | CAGCUCUG G CUCCUUGU | 9257 | ACAAGGAG GGCTAGCTACAACGA CAGAGCTG | 20016 |
| 5135 | GGCUCCUU G UCUCCCAG | 9258 | CTGGGAGA GGCTAGCTACAACGA AAGGAGCC | 20017 |
| 5144 | UCUCCCAG G CUGAUCCU | 9259 | AGGATCAG GGCTAGCTACAACGA CTGGGAGA | 20018 |
| 5148 | CCAGGCUG A UCCUUUAU | 9260 | ATAAAGGA GGCTAGCTACAACGA CAGCCTGG | 20019 |
| 5155 | GAUCCUUU A UUCAGAAU | 9261 | ATTCTGAA GGCTAGCTACAACGA AAAGGATC | 20020 |
| 5162 | UAUUCAGA A UACCACAA | 9262 | TTGTGGTA GGCTAGCTACAACGA TCTGAATA | 20021 |
| 5164 | UUCAGAAU A CCACAAAG | 9263 | CTTTGTGG GGCTAGCTACAACGA ATTCTGAA | 20022 |
| 5167 | AGAAUACC A CAAAGAAA | 9264 | TTTCTTTG GGCTAGCTACAACGA GGTATTCT | 20023 |
| 5178 | AAGAAAGG A CAUUCAGC | 9265 | GCTGAATG GGCTAGCTACAACGA CCTTTCTT | 20024 |
| 5180 | GAAAGGAC A UUCAGCUC | 9266 | GAGCTGAA GGCTAGCTACAACGA GTCCTTTC | 20025 |
| 5185 | GACAUUCA G CUCAAGGC | 9267 | GCCTTGAG GGCTAGCTACAACGA TGAATGTC | 20026 |
| 5192 | AGCUCAAG G CUCCCUGC | 9268 | GCAGGGAG GGCTAGCTACAACGA CTTGAGCT | 20027 |
| 5199 | GGCUCCCU G CCGUGUUG | 9269 | CAACACGG GGCTAGCTACAACGA AGGGAGCC | 20028 |
| 5202 | UCCCUGCC G UGUUGAAG | 9270 | CTTCAACA GGCTAGCTACAACGA GGCAGGGA | 20029 |
| 5204 | CCUGCCGU G UUGAAGAG | 9271 | CTCTTCAA GGCTAGCTACAACGA ACGGCAGG | 20030 |
| 5212 | GUUGAAGA G UUCUGACU | 9272 | AGTCAGAA GGCTAGCTACAACGA TCTTCAAC | 20031 |
| 5218 | GAGUUCUG A CUGCACAA | 9273 | TTGTGCAG GGCTAGCTACAACGA CAGAACTC | 20032 |
| 5221 | UUCUGACU G CACAAACC | 9274 | GGTTTGTG GGCTAGCTACAACGA AGTCAGAA | 20033 |
| 5223 | CUGACUGC A CAAACCAG | 9275 | CTGGTTTG GGCTAGCTACAACGA GCAGTCAG | 20034 |
| 5227 | CUGCACAA A CCAGCUUC | 9276 | GAAGCTGG GGCTAGCTACAACGA TTGTGCAG | 20035 |
| 5231 | ACAAACCA G CUUCUGGU | 9277 | ACCAGAAG GGCTAGCTACAACGA TGGTTTGT | 20036 |
| 5238 | AGCUUCUG G UUUCUUCU | 9278 | AGAAGAAA GGCTAGCTACAACGA CAGAAGCT | 20037 |
| 5250 | CUUCUGGA A UGAAUACC | 9279 | GCTATTCA GGCTAGCTACAACGA TCCAGAAG | 20038 |
| 5254 | UGGAAUGA A UACCCUCA | 9280 | TGAGGGTA GGCTAGCTACAACGA TCATTCCA | 20039 |
| 5256 | GAAUGAAU A CCCUCAUA | 9281 | TATGAGGG GGCTAGCTACAACGA ATTCATTC | 20040 |
| 5262 | AUACCCUC A UAUCUGUC | 9282 | GACAGATA GGCTAGCTACAACGA GAGGGTAT | 20041 |
| 5264 | ACCCUCAU A UCUGUCCU | 9283 | AGGACAGA GGCTAGCTACAACGA ATGAGGGT | 20042 |
| 5268 | UCAUAUCU G UCCUGAUG | 9284 | CATCAGGA GGCTAGCTACAACGA AGATATGA | 20043 |
| 5274 | CUGUCCUG A UGUGAUAU | 9285 | ATATCACA GGCTAGCTACAACGA CAGGACAG | 20044 |
| 5276 | GUCCUGAU G UGAUAUGU | 9286 | ACATATCA GGCTAGCTACAACGA ATCAGGAC | 20045 |
| 5279 | CUGAUGUG A UAUGUCUG | 9287 | CAGACATA GGCTAGCTACAACGA CACATCAG | 20046 |
| 5281 | GAUGUGAU A UGUCUGAG | 9288 | CTCAGACA GGCTAGCTACAACGA ATCACATC | 20047 |
| 5283 | UGUGAUAU G UCUGAGAC | 9289 | GTCTCAGA GGCTAGCTACAACGA ATATCACA | 20048 |
| 5290 | UGUCUGAG A CUGAAUGC | 9290 | GCATTCAG GGCTAGCTACAACGA CTCAGACA | 20049 |

TABLE XXII-continued

Human KDR DNAzyme and Substrate sequence

| Pos | Substrate | Seq ID No | DNAzyme | Seq ID No |
|---|---|---|---|---|
| 5295 | GAGACUGA A UGCGGGAG | 9291 | CTCCCGCA GGCTAGCTACAACGA TCAGTCTC | 20050 |
| 5297 | GACUGAAU G CGGGAGGU | 9292 | ACCTCCCG GGCTAGCTACAACGA ATTCAGTC | 20051 |
| 5304 | UGCGGGAG G UUCAAUGU | 9293 | ACATTGAA GGCTAGCTACAACGA CTCCCGCA | 20052 |
| 5309 | GAGGUUCA A UGUGAAGC | 9294 | GCTTCACA GGCTAGCTACAACGA TGAACCTC | 20053 |
| 5311 | GGUUCAAU G UGAAGCUG | 9295 | CAGCTTCA GGCTAGCTACAACGA ATTGAACC | 20054 |
| 5316 | AAUGUGAA G CUGUGUGU | 9296 | ACACACAG GGCTAGCTACAACGA TTCACATT | 20055 |
| 5319 | GUGAAGCU G UGUGGUGU | 9297 | ACCACACA GGCTAGCTACAACGA AGCTTCAC | 20056 |
| 5321 | GAAGCUGU G UGUGGUGU | 9298 | ACACCACA GGCTAGCTACAACGA ACAGCTTC | 20057 |
| 5323 | AGCUGUGU G UGGUGUCA | 9299 | TGACACCA GGCTAGCTACAACGA ACACAGCT | 20058 |
| 5326 | UGUGUGUG G UGUCAAAG | 9300 | CTTTGACA GGCTAGCTACAACGA CACACACA | 20059 |
| 5328 | UGUGUGGU G UCAAAGUU | 9301 | AACTTTGA GGCTAGCTACAACGA ACCACACA | 20060 |
| 5334 | GUGUCAAA G UUUCAGGA | 9302 | TCCTGAAA GGCTAGCTACAACGA TTTGACAC | 20061 |
| 5346 | CAGGAAGG A UUUUACCC | 9303 | GGGTAAAA GGCTAGCTACAACGA CCTTCCTG | 20062 |
| 5351 | AGGAUUUU A CCCUUUUG | 9304 | CAAAAGGG GGCTAGCTACAACGA AAAATCCT | 20063 |
| 5359 | ACCCUUUU G UUCUUCCC | 9305 | GGGAAGAA GGCTAGCTACAACGA AAAAGGGT | 20064 |
| 5371 | UUCCCCCU G UCCCCAAC | 9306 | GTTGGGGA GGCTAGCTACAACGA AGGGGGAA | 20065 |
| 5378 | UGUCCCCA A CCCACUCU | 9307 | AGAGTGGG GGCTAGCTACAACGA TGGGGACA | 20066 |
| 5382 | CCCAACCC A CUCUCACC | 9308 | GGTGAGAG GGCTAGCTACAACGA GGGTTGGG | 20067 |
| 5388 | CCACUCUC A CCCCGCAA | 9309 | TTGCGGGG GGCTAGCTACAACGA GAGAGTGG | 20068 |
| 5393 | CUCACCCC G CAACCCAU | 9310 | ATGGGTTG GGCTAGCTACAACGA GGGGTGAG | 20069 |
| 5396 | ACCCCGCA A CCCAUCAG | 9311 | CTGATGGG GGCTAGCTACAACGA TGCGGGGT | 20070 |
| 5400 | CGCAACCC A UCAGUAUU | 9312 | AATACTGA GGCTAGCTACAACGA GGGTTGCG | 20071 |
| 5404 | ACCCAUCA G UAUUUUAG | 9313 | CTAAAATA GGCTAGCTACAACGA TGATGGGT | 20072 |
| 5406 | CCAUCAGU A UUUUAGUU | 9314 | AACTAAAA GGCTAGCTACAACGA ACTGATGG | 20073 |
| 5412 | GUAUUUUA G UUAUUUGG | 9315 | CCAAATAA GGCTAGCTACAACGA TAAAATAC | 20074 |
| 5415 | UUUUAGUU A UUUGGCCU | 9316 | AGGCCAAA GGCTAGCTACAACGA AACTAAAA | 20075 |
| 5420 | GUUAUUUG G CCUCUACU | 9317 | AGTAGAGG GGCTAGCTACAACGA CAAATAAC | 20076 |
| 5426 | UGGCCUCU A CUCCAGUA | 9318 | TACTGGAG GGCTAGCTACAACGA AGAGGCCA | 20077 |
| 5432 | CUACUCCA G UAAACCUG | 9319 | CAGGTTTA GGCTAGCTACAACGA TGGAGTAG | 20078 |
| 5436 | UCCAGUAA A CCUGAUUG | 9320 | CAATCAGG GGCTAGCTACAACGA TTACTGGA | 20079 |
| 5441 | UAAACCUG A UUGGGUUU | 9321 | AAACCCAA GGCTAGCTACAACGA CAGGTTTA | 20080 |
| 5446 | CUGAUUGG G UUUGUUCA | 9322 | TGAACAAA GGCTAGCTACAACGA CCAATCAG | 20081 |
| 5450 | UUGGGUUU G UUCACUCU | 9323 | AGAGTGAA GGCTAGCTACAACGA AAACCCAA | 20082 |
| 5454 | GUUUGUUC A CUCUCUGA | 9324 | TCAGAGAG GGCTAGCTACAACGA GAACAAAC | 20083 |
| 5463 | CUCUCUGA A UGAUUAUU | 9325 | AATAATCA GGCTAGCTACAACGA TCAGAGAG | 20084 |
| 5466 | UCUGAAUG A UUAUUAGC | 9326 | GCTAATAA GGCTAGCTACAACGA CATTCAGA | 20085 |
| 5469 | GAAUGAUU A UUAGCCAG | 9327 | CTGGCTAA GGCTAGCTACAACGA AATCATTC | 20086 |

TABLE XXII-continued

Human KDR DNAzyme and Substrate sequence

| Pos | Substrate | Seq ID No | DNAzyme | Seq ID No |
|---|---|---|---|---|
| 5473 | GAUUAUUA G CCAGACUU | 9328 | AAGTCTGG GGCTAGCTACAACGA TAATAATC | 20087 |
| 5478 | UUAGCCAG A CUUCAAAA | 9329 | TTTTGAAG GGCTAGCTACAACGA CTGGCTAA | 20088 |
| 5486 | ACUUCAAA A UUAUUUUA | 9330 | TAAAATAA GGCTAGCTACAACGA TTTGAAGT | 20089 |
| 5489 | UCAAAAUU A UUUUAUAG | 9331 | CTATAAAA GGCTAGCTACAACGA AATTTTGA | 20090 |
| 5494 | AUUAUUUU A UAGCCCAA | 9332 | TTGGGCTA GGCTAGCTACAACGA AAAATAAT | 20091 |
| 5497 | AUUUUAUA G CCCAAAUU | 9333 | AATTTGGG GGCTAGCTACAACGA TATAAAAT | 20092 |
| 5503 | UAGCCCAA U UAUAACA | 9334 | TGTTATAA GGCTAGCTACAACGA TTGGGCTA | 20093 |
| 5506 | CCCAAAUU A UAACAUCU | 9335 | AGATGTTA GGCTAGCTACAACGA AATTTGGG | 20094 |
| 5509 | AAAUUAUA A CAUCUAUU | 9336 | AATAGATG GGCTAGCTACAACGA TATAATTT | 20095 |
| 5511 | AUUAUAAC A UCUAUUGU | 9337 | ACAATAGA GGCTAGCTACAACGA GTTATAAT | 20096 |
| 5515 | UAACAUCU A UUGUAUUA | 9338 | TAATACAA GGCTAGCTACAACGA AGATGTTA | 20097 |
| 5518 | CAUCUAUU G UAUUAUUU | 9339 | AAATAATA GGCTAGCTACAACGA AATAGATG | 20098 |
| 5520 | UCUAUUGU A UUAUUUAG | 9340 | CTAAATAA GGCTAGCTACAACGA ACAATAGA | 20099 |
| 5523 | AUUGUAUU A UUUAGACU | 9341 | AGTCTAAA GGCTAGCTACAACGA AATACAAT | 20100 |
| 5529 | UUAUUUAG A CUUUUAAC | 9342 | GTTAAAAG GGCTAGCTACAACGA CTAAATAA | 20101 |
| 5536 | GACUUUUA A CAUAUAGA | 9343 | TCTATATG GGCTAGCTACAACGA TAAAAGTC | 20102 |
| 5538 | CUUUUAAC A UAUAGAGC | 9344 | GCTCTATA GGCTAGCTACAACGA GTTAAAAG | 20103 |
| 5540 | UUUAACAU A UAGAGCUA | 9345 | TAGCTCTA GGCTAGCTACAACGA ATGTTAAA | 20104 |
| 5545 | CAUAUAGA G CUAUUUCU | 9346 | AGAAATAG GGCTAGCTACAACGA TCTATATG | 20105 |
| 5548 | AUAGAGCU A UUUCUACU | 9347 | AGTAGAAA GGCTAGCTACAACGA AGCTCTAT | 20106 |
| 5554 | CUAUUUCU A CUGAUUUU | 9348 | AAAATCAG GGCTAGCTACAACGA AGAAATAG | 20107 |
| 5558 | UUCUACUG A UUUUGCC | 9349 | GGCAAAAA GGCTAGCTACAACGA CAGTAGAA | 20108 |
| 5564 | UGAUUUUU G CCCUUGUU | 9350 | AACAAGGG GGCTAGCTACAACGA AAAAATCA | 20109 |
| 5570 | UUGCCCUU G UUCUGUCC | 9351 | GGACAGAA GGCTAGCTACAACGA AAGGGCAA | 20110 |
| 5575 | CUUGUUCU G UCCUUUUU | 9352 | AAAAAGGA GGCTAGCTACAACGA AGAACAAG | 20111 |
| 5597 | AAAGAAA A UGUGUUUU | 9353 | AAAACACA GGCTAGCTACAACGA TTTCTTTT | 20112 |
| 5599 | AAGAAAAU G UUUUUUU | 9354 | AAAAAACA GGCTAGCTACAACGA ATTTTCTT | 20113 |
| 5601 | GAAAAUGU G UUUUUUGU | 9355 | ACAAAAAA GGCTAGCTACAACGA ACATTTTC | 20114 |
| 5608 | UGUUUUUU G UUUGGUAC | 9356 | GTACCAAA GGCTAGCTACAACGA AAAAAACA | 20115 |
| 5613 | UUUGUUUG A UACCAUAG | 9357 | CTATGGTA GGCTAGCTACAACGA CAAACAAA | 20116 |
| 5615 | UGUUUGGU A CCAUAGUG | 9358 | CACTATGG GGCTAGCTACAACGA ACCAAACA | 20117 |
| 5618 | UUGGUACC A UAGUGUGA | 9359 | TCACACTA GGCTAGCTACAACGA GGTACCAA | 20118 |
| 5621 | GUACCAUA G UGUGAAAU | 9360 | ATTTCACA GGCTAGCTACAACGA TATGGTAC | 20119 |
| 5623 | ACCAUAGU G UGAAAUGC | 9361 | GCATTTCA GGCTAGCTACAACGA ACTATGGT | 20120 |
| 5628 | AGUGUGAA A UGCUGGGA | 9362 | TCCCAGCA GGCTAGCTACAACGA TTCACACT | 20121 |
| 5630 | UGUGAAAU G CUGGGAAC | 9363 | GTTCCCAG GGCTAGCTACAACGA ATTTCACA | 20122 |
| 5637 | UGCUGGGA A CAAUGACU | 9364 | AGTCATTG GGCTAGCTACAACGA TCCCAGCA | 20123 |

TABLE XXII-continued

Human KDR DNAzyme and Substrate sequence

| Pos | Substrate | Seq ID No | DNAzyme | Seq ID No |
|---|---|---|---|---|
| 5640 | UGGGAACA A UGACUAUA | 9365 | TATAGTCA GGCTAGCTACAACGA TGTTCCCA | 20124 |
| 5643 | GAACAAUG A CUAUAAGA | 9366 | TCTTATAG GGCTAGCTACAACGA CATTGTTC | 20125 |
| 5646 | CAAUGACU A UAAGACAU | 9367 | ATGTCTTA GGCTAGCTACAACGA AGTCATTG | 20126 |
| 5651 | ACUAUAAG A CAUGCUAU | 9368 | ATAGCATG GGCTAGCTACAACGA CTTATAGT | 20127 |
| 5653 | UAUAAGAC A UGCUAUGG | 9369 | CCATAGCA GGCTAGCTACAACGA GTCTTATA | 20128 |
| 5655 | UAAGACAU G CUAUGGCA | 9370 | TGCCATAG GGCTAGCTACAACGA ATGTCTTA | 20129 |
| 5658 | GACAUGCU A UGGCACAU | 9371 | ATGTGCCA GGCTAGCTACAACGA AGCATGTC | 20130 |
| 5661 | AUGCUAUG G CACAUAUA | 9372 | TATATGTG GGCTAGCTACAACGA CATAGCAT | 20131 |
| 5663 | GCUAUGGC A CAUAUAUU | 9373 | AATATATG GGCTAGCTACAACGA GCCATAGC | 20132 |
| 5665 | UAUGGCAC A UAUAUUUA | 9374 | TAAATATA GGCTAGCTACAACGA GTGCCATA | 20133 |
| 5667 | UGGCACAU A UAUUUAUA | 9375 | TATAAATA GGCTAGCTACAACGA ATGTGCCA | 20134 |
| 5669 | GCACAUAU A UUUAUAGU | 9376 | ACTATAAA GGCTAGCTACAACGA ATATGTGC | 20135 |
| 5673 | AUAUAUUU A UAGUCUGU | 9377 | ACAGACTA GGCTAGCTACAACGA AAATATAT | 20136 |
| 5676 | UAUUUAUA G UCUGUUUA | 9378 | TAAACAGA GGCTAGCTACAACGA TATAAATA | 20137 |
| 5680 | UAUAGUCU G UUUAUGUA | 9379 | TACATAAA GGCTAGCTACAACGA AGACTATA | 20138 |
| 5684 | GUCUGUUU A UGUAGAAA | 9380 | TTTCTACA GGCTAGCTACAACGA AAACAGAC | 20139 |
| 5686 | CUGUUUAU G UAGAAACA | 9381 | TGTTTCTA GGCTAGCTACAACGA ATAAACAG | 20140 |
| 5692 | AUGUAGAA A CAAAUGUA | 9382 | TACATTTG GGCTAGCTACAACGA TTCTACAT | 20141 |
| 5696 | AGAAACAA A UGUAAUAU | 9383 | ATATTACA GGCTAGCTACAACGA TTGTTTCT | 20142 |
| 5698 | AAACAAAU G UAAUAUAU | 9384 | ATATATTA GGCTAGCTACAACGA ATTTGTTT | 20143 |
| 5701 | CAAAUGUA A UAUAUUAA | 9385 | TTAATATA GGCTAGCTACAACGA TACATTTG | 20144 |
| 5703 | AAUGUAAU A UAUUAAAG | 9386 | CTTTAATA GGCTAGCTACAACGA ATTACATT | 20145 |
| 5705 | UGUAAUAU A UUAAAGCC | 9387 | GGCTTTAA GGCTAGCTACAACGA ATATTACA | 20146 |
| 5711 | AUAUUAAA G CCUUAUAU | 9388 | ATATAAGG GGCTAGCTACAACGA TTTAATAT | 20147 |
| 5716 | AAAGCCUU A UAUAAUAU | 9389 | ATTATATA GGCTAGCTACAACGA AAGGCTTT | 20148 |
| 5718 | AGCCUUAU A UAUAAUGA | 9390 | TCATTATA GGCTAGCTACAACGA ATAAGGCT | 20149 |
| 5720 | CCUUAUAU A UAAUGAAC | 9391 | GTTCATTA GGCTAGCTACAACGA ATATAAGG | 20150 |
| 5723 | UAUAUAUA A UGAACUUU | 9392 | AAAGTTCA GGCTAGCTACAACGA TATATATA | 20151 |
| 5727 | UAUAAUGA A CUUUGUAC | 9393 | GTACAAAG GGCTAGCTACAACGA TCATTATA | 20152 |
| 5732 | UGAACUUU G UACUAUUC | 9394 | GAATAGTA GGCTAGCTACAACGA AAAGTTCA | 20153 |
| 5734 | AACUUUGU A CUAUUCAC | 9395 | GTGAATAG GGCTAGCTACAACGA ACAAAGTT | 20154 |
| 5737 | UUUGUACU A UUCACAUU | 9396 | AATGTGAA GGCTAGCTACAACGA AGTACAAA | 20155 |
| 5741 | UACUAUUC A CAUUUUGU | 9397 | ACAAAATG GGCTAGCTACAACGA GAATAGTA | 20156 |
| 5743 | CUAUUCAC A UUUUGUAU | 9398 | ATACAAAA GGCTAGCTACAACGA GTGAATAG | 20157 |
| 5748 | CACAUUUU G UAUCAGUA | 9399 | TACTGATA GGCTAGCTACAACGA AAAATGTG | 20158 |
| 5750 | CAUUUUGU A UCAGUAUU | 9400 | AATACTGA GGCTAGCTACAACGA ACAAAATG | 20159 |
| 5754 | UUGUAUCA G UAUUAUGU | 9401 | ACATAATA GGCTAGCTACAACGA TGATACAA | 20160 |

TABLE XXII-continued

Human KDR DNAzyme and Substrate sequence

| Pos | Substrate | Seq ID No | DNAzyme | Seq ID No |
|---|---|---|---|---|
| 5756 | GUAUCAGU A UUAUGUAG | 9402 | CTACATAA GGCTAGCTACAACGA ACTGATAC | 20161 |
| 5759 | UCAGUAUU A UGUAGCAU | 9403 | ATGCTACA GGCTAGCTACAACGA AATACTGA | 20162 |
| 5761 | AGUAUUAU G UAGCAUAA | 9404 | TTATGCTA GGCTAGCTACAACGA ATAATACT | 20163 |
| 5764 | AUUAUGUA G CAUAACAA | 9405 | TTGTTATG GGCTAGCTACAACGA TACATAAT | 20164 |
| 5766 | UAUGUAGC A UAACAAAG | 9406 | CTTTGTTA GGCTAGCTACAACGA GCTACATA | 20165 |
| 5769 | GUAGCAUA A CAAAGGUC | 9407 | GACCTTTG GGCTAGCTACAACGA TATGCTAC | 20166 |
| 5775 | UAACAAAG G UCAUAAUG | 9408 | CATTATGA GGCTAGCTACAACGA CTTTGTTA | 20167 |
| 5778 | CAAAGGUC A UAAUGCUU | 9409 | AAGCATTA GGCTAGCTACAACGA GACCTTTG | 20168 |
| 5781 | AGGUCAUA A UGCUUUCA | 9410 | TGAAAGCA GGCTAGCTACAACGA TATGACCT | 20169 |
| 5783 | GUCAUAAU G CUUUCAGC | 9411 | GCTGAAAG GGCTAGCTACAACGA ATTATGAC | 20170 |
| 5790 | UGCUUUCA G CAAUUGAU | 9412 | ATCAATTG GGCTAGCTACAACGA TGAAAGCA | 20171 |
| 5793 | UUUCAGCA A UUGAUGUC | 9413 | GACATCAA GGCTAGCTACAACGA TGCTGAAA | 20172 |
| 5797 | AGCAAUUG A UGUCAUUU | 9414 | AAATGACA GGCTAGCTACAACGA CAATTGCT | 20173 |
| 5799 | CAAUUGAU G UCAUUUUA | 9415 | TAAAATGA GGCTAGCTACAACGA ATCAATTG | 20174 |
| 5802 | UUGAUGUC A UUUUAUUA | 9416 | TAATAAAA GGCTAGCTACAACGA GACATCAA | 20175 |
| 5807 | GUCAUUUU A UUAAAGAA | 9417 | TTCTTTAA GGCTAGCTACAACGA AAAATGAC | 20176 |
| 5815 | AUUAAAGA A CAUUGAAA | 9418 | TTTCAATG GGCTAGCTACAACGA TCTTTAAT | 20177 |
| 5817 | UAAAGAAC A UUGAAAAA | 9419 | TTTTTCAA GGCTAGCTACAACGA GTTCTTTA | 20178 |

Input Sequence = AF035121. Cut Site = R/Y
Arm Length = 8. Core Sequence = GGCTAGCTACAACGA (SEQ ID NO. 20828).
AF035121 (*Homo sapiens* KDR/flk-1 protein mRNA, complete cds.; Acc# AF035121; 5830 bp)

TABLE XXIII

Human KDR Ziuzyme and Substrate Sequence

| Pos | Substrate | Seq ID No | Zinzyme | Seq ID No |
|---|---|---|---|---|
| 25 | CCGGGAGA G CGGUCAGU | 8365 | ACUGACCG GCCGAAAGGCGAGUGAGGUCU UCUCCCGG | 20179 |
| 28 | GGAGAGCG G UCAGUGUG | 8366 | CACACUGA GCCGAAAGGCGAGUGAGGUCU CGCUCUCC | 20180 |
| 32 | AGCGGUCA G UGUGGUG | 8367 | ACCACACA GCCGAAAGGCGAGUGAGGUCU UGACCGCU | 20181 |
| 34 | CGGUCAGU G UGGUCG | 8368 | CGACCACA GCCGAAAGGCGAGUGAGGUCU ACUGACCG | 20182 |
| 36 | GUCAGUGU G UGGUCGCU | 8369 | AGCGACCA GCCGAAAGGCGAGUGAGGUCU ACACUGAC | 20183 |
| 39 | AGUGUGUG G UCGCUGCG | 8370 | CGCAGCGA GCCGAAAGGCGAGUGAGGUCU CACACACU | 20184 |
| 42 | GUGUGGUC G CUGCGUUU | 8371 | AAACGCAG GCCGAAAGGCGAGUGAGGUCU GACCACAC | 20185 |
| 45 | UGGUCGCU G CGUUUCCU | 8372 | AGGAAACG GCCGAAAGGCGAGUGAGGUCU AGCGACCA | 20186 |
| 47 | GUCGCUGC G UUUCCUCU | 8373 | AGAGGAAA GCCGAAAGGCGAGUGAGGUCU GCAGCGAC | 20187 |
| 56 | UUUCCUCU G CCUGCGCC | 8374 | GGCGCAGG GCCGAAAGGCGAGUGAGGUCU AGAGGAAA | 20188 |
| 60 | CUCUGCCU G CGCCGGGC | 8375 | GCCCGGCG GCCGAAAGGCGAGUGAGGUCU AGGCAGAG | 20189 |
| 62 | CUGCCUGC G CCGGGCAU | 8376 | AUGCCCGG GCCGAAAGGCGAGUGAGGUCU GCAGGCAG | 20190 |

TABLE XXIII-continued

Human KDR Ziuzyme and Substrate Sequence

| Pos | Substrate | Seq ID No | Zinzyme | Seq ID No |
|---|---|---|---|---|
| 67  | UGCGCCGG G CAUCACUU | 8377 | AAGUGAUG GCCGAAAGGCGAGUGAGGUCU CCGGCGCA | 20191 |
| 76  | CAUCACUU G CGCGCCGC | 8380 | GCGGCGCG GCCGAAAGGCGAGUGAGGUCU AAGUGAUG | 20192 |
| 78  | UCACUUGC G CGCCGCAG | 8381 | CUGCGGCG GCCGAAAGGCGAGUGAGGUCU GCAAGUGA | 20193 |
| 80  | ACUUGCGC G CCGCAGAA | 8382 | UUCUGCGG GCCGAAAGGCGAGUGAGGUCU GCGCAAGU | 20194 |
| 83  | UGCGCGCC G CAGAAAGU | 8383 | ACUUUCUG GCCGAAAGGCGAGUGAGGUCU GGCGCGCA | 20195 |
| 90  | CGCAGAAA G UCCGUCUG | 8384 | CAGACGGA GCCGAAAGGCGAGUGAGGUCU UUUCUGCG | 20196 |
| 94  | GAAAGUCC G UCUGGCAG | 8385 | CUGCCAGA GCCGAAAGGCGAGUGAGGUCU GGACUUUC | 20197 |
| 99  | UCCGUCUG G CAGCCUGG | 8386 | CCAGGCUG GCCGAAAGGCGAGUGAGGUCU CAGACGGA | 20198 |
| 102 | GUCUGGCA G CCUGGAUA | 8387 | UAUCCAGG GCCGAAAGGCGAGUGAGGUCU UGCCAGAC | 20199 |
| 124 | UCCUACCG G CACCCGCA | 8391 | UGCGGGUG GCCGAAAGGCGAGUGAGGUCU CGGUAGGA | 20200 |
| 130 | CGGCACCC G CAGACGCC | 8393 | GGCGUCUG GCCGAAAGGCGAGUGAGGUCU GGGUGCCG | 20201 |
| 136 | CCGCAGAC G CCCCUGCA | 8395 | UGCAGGGG GCCGAAAGGCGAGUGAGGUCU GUCUGCGG | 20202 |
| 142 | ACGCCCCU G CAGCCGCC | 8396 | GGCGGCUG GCCGAAAGGCGAGUGAGGUCU AGGGGCGU | 20203 |
| 145 | CCCCUGCA G CCGCCGGU | 8397 | ACCGGCGG GCCGAAAGGCGAGUGAGGUCU UGCAGGGG | 20204 |
| 148 | CUGCAGCC G CCGGUCGG | 8398 | CCGACCGG GCCGAAAGGCGAGUGAGGUCU GGCUGCAG | 20205 |
| 152 | AGCCGCCG G UCGGCGCC | 8399 | GGCGCCGA GCCGAAAGGCGAGUGAGGUCU CGGCGGCU | 20206 |
| 156 | GCCGGUCG G CGCCCGGG | 8400 | CCCGGGCG GCCGAAAGGCGAGUGAGGUCU CGACCGGC | 20207 |
| 158 | CGGUCGGC G CCCGGGCU | 8401 | AGCCCGGG GCCGAAAGGCGAGUGAGGUCU GCCGACCG | 20208 |
| 164 | GCGCCCGG G CUCCCUAG | 8402 | CUAGGGAG GCCGAAAGGCGAGUGAGGUCU CCGGGCGC | 20209 |
| 172 | GCUCCCUA G CCCUGUGC | 8403 | GCACAGGG GCCGAAAGGCGAGUGAGGUCU UAGGGAGC | 20210 |
| 177 | CUAGCCCU G UGCGCUCA | 8404 | UGAGCGCA GCCGAAAGGCGAGUGAGGUCU AGGGCUAG | 20211 |
| 179 | AGCCCUGU G CGCUCAAC | 8405 | GUUGAGCG GCCGAAAGGCGAGUGAGGUCU ACAGGGCU | 20212 |
| 181 | CCCUGUGC G CUCAACUG | 8406 | CAGUUGAG GCCGAAAGGCGAGUGAGGUCU GCACAGGG | 20213 |
| 189 | GCUCAACU G UCCGCGC | 8408 | GCGCAGGA GCCGAAAGGCGAGUGAGGUCU AGUUGAGC | 20214 |
| 194 | ACUGUCCU G CGCUGCGG | 8409 | CCGCAGCG GCCGAAAGGCGAGUGAGGUCU AGGACAGU | 20215 |
| 196 | UGUCCUGC G CUGCGGGG | 8410 | CCCCGCAG GCCGAAAGGCGAGUGAGGUCU GCAGGACA | 20216 |
| 199 | CCUGCGCU G CGGGGUGC | 8411 | GCACCCCG GCCGAAAGGCGAGUGAGGUCU AGCGCAGG | 20217 |
| 204 | GCUGCGGG G UGCCGCGA | 8412 | UCGCGGCA GCCGAAAGGCGAGUGAGGUCU CCCGCAGC | 20218 |
| 206 | UGCGGGGU G CCGCGAGU | 8413 | ACUCGCGG GCCGAAAGGCGAGUGAGGUCU ACCCCGCA | 20219 |
| 209 | GGGGUGCC G CGAGUUCC | 8414 | GGAACUCG GCCGAAAGGCGAGUGAGGUCU GGCACCCC | 20220 |
| 213 | UGCCGCGA G UUCCACCU | 8415 | AGGUGGAA GCCGAAAGGCGAGUGAGGUCU UCGCGGCA | 20221 |
| 224 | CCACCUCC G CGCCUCCU | 8417 | AGGAGGCG GCCGAAAGGCGAGUGAGGUCU GGAGGUGG | 20222 |
| 226 | ACCUCCGC G CCUCCUUC | 8418 | GAAGGAGG GCCGAAAGGCGAGUGAGGUCU GCGGAGGU | 20223 |
| 244 | CUAGACAG G CGCUGGGA | 8420 | UCCCAGCG GCCGAAAGGCGAGUGAGGUCU CUGUCUAG | 20224 |
| 246 | AGACAGGC G CUGGGAGA | 8421 | UCUCCCAG GCCGAAAGGCGAGUGAGGUCU GCCUGUCU | 20225 |
| 263 | AAGAACCG G CUCCCGAG | 8423 | CUCGGGAG GCCGAAAGGCGAGUGAGGUCU CGGUUCUU | 20226 |
| 271 | GCUCCCGA G UUCUGGGC | 8424 | GCCCAGAA GCCGAAAGGCGAGUGAGGUCU UCGGGAGC | 20227 |

TABLE XXIII-continued

Human KDR Ziuzyme and Substrate Sequence

| Pos | Substrate | Seq ID No | Zinzyme | Seq ID No |
|---|---|---|---|---|
| 278 | AGUUCUGG G CAUUUCGC | 8425 | GCGAAAUG GCCGAAAGGCGAGUGAGGUCU CCAGAACU | 20228 |
| 285 | GGCAUUUC G CCCGGCUC | 8427 | GAGCCGGG GCCGAAAGGCGAGUGAGGUCU GAUAUGCC | 20229 |
| 290 | UUCGCCCG G CUCGAGGU | 8428 | ACCUCCAG GCCGAAAGGCGAGUGAGGUCU CGGGCGAA | 20230 |
| 297 | GGCUCGAG G UGCAGGAU | 8429 | AUCCUGCA GCCGAAAGGCGAGUGAGGUCU CUCGAGCC | 20231 |
| 299 | CUCGAGGU G CAGGAUGC | 8430 | GCAUCCUG GCCGAAAGGCGAGUGAGGUCU ACCUCGAG | 20232 |
| 306 | UGCAGGAU G CAGAGCAA | 8432 | UUGCUCUG GCCGAAAGGCGAGUGAGGUCU AUCCUGCA | 20233 |
| 311 | GAUGCAGA G CAAGGUGC | 8433 | GCACCUUG GCCGAAAGGCGAGUGAGGUCU UCUGCAUC | 20234 |
| 316 | AGAGCAAG G UGCUGCUG | 8434 | CAGCAGCA GCCGAAAGGCGAGUGAGGUCU CUUGCUCU | 20235 |
| 318 | AGCAAGGU G CUGCUGGC | 8435 | GCCAGCAG GCCGAAAGGCGAGUGAGGUCU ACCUUGCU | 20236 |
| 321 | AAGGUGCU G CUGGCCGU | 8436 | ACGGCCAG GCCGAAAGGCGAGUGAGGUCU AGCACCUU | 20237 |
| 325 | UGCUGCUG G CCGUCGCC | 8437 | GGCGACGG GCCGAAAGGCGAGUGAGGUCU CAGCAGCA | 20238 |
| 328 | UGCUGGCC G UCGCCCUG | 8438 | CAGGGCGA GCCGAAAGGCGAGUGAGGUCU GGCCAGCA | 20239 |
| 331 | UGGCCGUC G CCCUGUGG | 8439 | CCACAGGG GCCGAAAGGCGAGUGAGGUCU GACGGCCA | 20240 |
| 336 | GUCGCCCU G UGGCUCUG | 8440 | CAGAGCCA GCCGAAAGGCGAGUGAGGUCU AGGGCGAC | 20241 |
| 339 | GCCCUGUG G CUCUGCGU | 8441 | ACGCAGAG GCCGAAAGGCGAGUGAGGUCU CACAGGGC | 20242 |
| 344 | GUGGCUCU G CGUGGAGA | 8442 | UCUCCACG GCCGAAAGGCGAGUGAGGUCU AGAGCCAC | 20243 |
| 346 | GGCUCUGC G UGGAGACC | 8443 | GGUCUCCA GCCGAAAGGCGAGUGAGGUCU GCAGAGCC | 20244 |
| 358 | AGACCCGG G CCGCCUCU | 8445 | AGAGGCGG GCCGAAAGGCGAGUGAGGUCU CCGGGUCU | 20245 |
| 361 | CCCGGGCC G CCUCUGUG | 8446 | CACAGAGG GCCGAAAGGCGAGUGAGGUCU GGCCCGGG | 20246 |
| 367 | CCGCCUCU G UGGGUUUG | 8447 | CAAACCCA GCCGAAAGGCGAGUGAGGUCU AGAGGCGG | 20247 |
| 371 | CUCUGUGG G UUUGCCUA | 8448 | UAGGCAAA GCCGAAAGGCGAGUGAGGUCU CCACAGAG | 20248 |
| 375 | GUGGGUUU G CCUAGUGU | 8449 | ACACUAGG GCCGAAAGGCGAGUGAGGUCU AAACCCAC | 20249 |
| 380 | UUUGCCUA G UGUUCUC | 8450 | GAGAAACA GCCGAAAGGCGAGUGAGGUCU UAGGCAAA | 20250 |
| 382 | UGCCUAGU G UUUCUCUU | 8451 | AAGAGAAA GCCGAAAGGCGAGUGAGGUCU ACUAGGCA | 20251 |
| 396 | CUUGAUCU G CCCAGGCU | 8453 | AGCCUGGG GCCGAAAGGCGAGUGAGGUCU AGAUCAAG | 20252 |
| 402 | CUGCCCAG G CUCAGCAU | 8454 | AUGCUGAG GCCGAAAGGCGAGUGAGGUCU CUGGGCAG | 20253 |
| 407 | CAGGCUCA G CAUACAAA | 8455 | UUUGUAUG GCCGAAAGGCGAGUGAGGUCU UGAGCCUG | 20254 |
| 436 | CAAUUAAG G CUAAUACA | 8458 | UGUAUUAG GCCGAAAGGCGAGUGAGGUCU CUUAAUUG | 20255 |
| 461 | AAUUACUU G CAGGGGAC | 8462 | GUCCCCUG GCCGAAAGGCGAGUGAGGUCU AAGUAAUU | 20256 |
| 486 | UUGGACUG G CUUUGGCC | 8466 | GGCCAAAG GCCGAAAGGCGAGUGAGGUCU CAGUCCAA | 20257 |
| 492 | UGGCUUUG G CCCAAUAA | 8467 | UUAUUGGG GCCGAAAGGCGAGUGAGGUCU CAAAGCCA | 20258 |
| 506 | UAAUCAGA G UGGCAGUG | 8470 | CACUGCCA GCCGAAAGGCGAGUGAGGUCU UCUGAUUA | 20259 |
| 509 | UCAGAGUG G CAGUGAGC | 8471 | GCUCACUG GCCGAAAGGCGAGUGAGGUCU CACUCUGA | 20260 |
| 512 | GAGUGGCA G UGAGCAAA | 8472 | UUUGCUCA GCCGAAAGGCGAGUGAGGUCU UGCCACUC | 20261 |
| 516 | GGCAGUGA G CAAAGGGU | 8473 | ACCCUUUG GCCGAAAGGCGAGUGAGGUCU UCACUGCC | 20262 |
| 523 | AGCAAAGG G UGGAGGUG | 8474 | CACCUCCA GCCGAAAGGCGAGUGAGGUCU CCUUUGCU | 20263 |
| 529 | GGGUGGAG G UGACUGAG | 8475 | CUCAGUCA GCCGAAAGGCGAGUGAGGUCU CUCCACCC | 20264 |

TABLE XXIII-continued

Human KDR Ziuzyme and Substrate Sequence

| Pos | Substrate | Seq ID No | Zinzyme | Seq ID No |
|---|---|---|---|---|
| 537 | GUGACUGA G UGCAGCGA | 8477 | UCGCUGCA GCCGAAAGGCGAGUGAGGUCU UCAGUCAC | 20265 |
| 539 | GACUGAGU G CAGCGAUG | 8478 | CAUCGCUG GCCGAAAGGCGAGUGAGGUCU ACUCAGUC | 20266 |
| 542 | UGAGUGCA G CGAUGGCC | 8479 | GGCCAUCG GCCGAAAGGCGAGUGAGGUCU UGCACUCA | 20267 |
| 548 | CAGCGAUG G CCUCUUCU | 8481 | AGAAGAGG GCCGAAAGGCGAGUGAGGUCU CAUCGCUG | 20268 |
| 557 | CCUCUUCU G UAAGACAC | 8482 | GUGUCUUA GCCGAAAGGCGAGUGAGGUCU AGAAGAGG | 20269 |
| 580 | UUCCAAAA G UGAUCGGA | 8485 | UCCGAUCA GCCGAAAGGCGAGUGAGGUCU UUUUGGAA | 20270 |
| 601 | ACACUGGA G CCUACAAG | 8489 | CUUGUAGG GCCGAAAGGCGAGUGAGGUCU UCCAGUGU | 20271 |
| 609 | GCCUACAA G UGCUUCUA | 8490 | UAGAAGCA GCCGAAAGGCGAGUGAGGUCU UUGUAGGC | 20272 |
| 611 | CUACAAGU G CUUCUACC | 8491 | GGUAGAAG GCCGAAAGGCGAGUGAGGUCU ACUUGUAG | 20273 |
| 634 | CUGACUUG G CCUCGGUC | 8494 | GACCGAGG GCCGAAACGCGAGUGAGGUCU CAAGUCAG | 20274 |
| 640 | UGGCCUCG G UCAUUUAU | 8495 | AUAAAUGA GCCGAAAGGCGAGUGAGGUCU CGAGGCCA | 20275 |
| 649 | UCAUUUUU G UCUAUGUU | 8496 | AACAUAGA GCCGAAAGGCGAGUGAGGUCU AUAAAUGA | 20276 |
| 655 | AUGUCUAU G UUCAAGAU | 8497 | AUCUUGAA GCCGAAAGGCGAGUGAGGUCU AUAGACAU | 20277 |
| 682 | CAUUUAUU G CUUCUGUU | 8500 | AACAGAAG GCCGAAAGGCGAGUGAGGUCU AAUAAAUG | 20278 |
| 688 | UUGCUUCU G UUAGUGAC | 8501 | GUCACUAA GCCGAAAGGCGAGUGAGGUCU AGAAGCAA | 20279 |
| 692 | UUCUGUUA G UGACCAAC | 8502 | GUUGGUCA GCCGAAAGGCGAGUGAGGUCU UAACAGAA | 20280 |
| 706 | AACAUGGA G UCGUGUAC | 8505 | GUACACGA GCCGAAAGGCGAGUGAGGUCU UCCAUGUU | 20281 |
| 709 | AUGGAGUC G UGUACAUU | 8506 | AAUGUACA GCCGAAAGGCGAGUGAGGUCU GACUCCAU | 20282 |
| 711 | GGAGUCGU G UACAUUAC | 8507 | GUAAUGUA GCCGAAAGGCGAGUGAGGUCU ACGACUCC | 20283 |
| 739 | ACAAAACU G UGGUGAUU | 8511 | AAUCACCA GCCGAAAGGCGAGUGAGGUCU AGUUUUGU | 20284 |
| 742 | AAACUGUG G UGAUUCCA | 8512 | UGGAAUCA GCCGAAAGGCGAGUGAGGUCU CACAGUUU | 20285 |
| 752 | GAUUCCAU G UCUCGGGU | 8514 | ACCCGAGA GCCGAAAGGCGAQUGAGGUCU AUGGAAUC | 20286 |
| 759 | UGUCUCGG G UCCAUUUC | 8515 | GAAAUGGA GCCGAAAGGCGAGUGAGGUCU CCGAGACA | 20287 |
| 778 | AUCUCAAC G UGUCACUU | 8518 | AAGUGACA GCCGAAAGGCGAGUGAGGUCU GUUGAGAU | 20288 |
| 780 | CUCAACGU G UCACUUUG | 8519 | CAAAGUGA GCCGAAAGGCGAGUGAGGUCU ACGUUGAG | 20289 |
| 788 | GUCACUUU G UGCAAGAU | 8520 | AUCUUGCA GCCGAAAGGCGAGUGAGGUCU AAAGUGAC | 20290 |
| 790 | CACUUUGU G CAAGAUAC | 8521 | GUAUCUUG GCCGAAAGGCGAGUGAGGUCU ACAAAGUG | 20291 |
| 814 | AGAGAUUU G UUCCUGAU | 8524 | AUCAGGAA GCCGAAAGGCGAGUGAGGUCU AAAUCUCU | 20292 |
| 824 | UCCUGAUG G UAACAGAA | 8526 | UUCUGUUA GCCGAAAGGCGAGUGAGGUCU CAUCAGGA | 20293 |
| 845 | CUGGGACA G CAAGAAGG | 8530 | CCUUCUUG GCCGAAAGGCGAGUGAGGUCU UGUCCCAG | 20294 |
| 854 | CAAGAAGG G CUUUACUA | 8531 | UAGUAAAG GCCGAAAGGCGAGUGAGGUCU CCUUCUUG | 20295 |
| 869 | UAUUCCCA G CUACAUGA | 8532 | UCAUGUAG GCCGAAAGGCGAGUGAGGUCU UGGGAAUA | 20296 |
| 881 | CAUGAUCA G CUAUGCUG | 8534 | CAGCAUAG GCCGAAAGGCGAGUGAGGUCU UGAUCAUG | 20297 |
| 886 | UCAGCUAU G CUGGCAUG | 8535 | CAUGCCAG GCCGAAAGGCGAGUGAGGUCU AUAGCUGA | 20298 |
| 890 | CUAUGCUG G CAUGGUCU | 8536 | AGACCAUG GCCGAAAGGCGAGUGAGGUCU CAGCAUAG | 20299 |
| 895 | CUGGCAUG G UCUUCUGU | 8537 | ACAGAAGA GCCGAAAGGCGAGUGAGGUCU CAUGCCAG | 20300 |
| 902 | GGUCUUCU G UGAAGCAA | 8538 | UUGCUUCA GCCGAAAGGCGAGUGAGGUCU AGAAGACC | 20301 |

TABLE XXIII-continued

Human KDR Ziuzyme and Substrate Sequence

| Pos | Substrate | Seq ID No | Zinzyme | Seq ID No |
|---|---|---|---|---|
| 907 | UCUGUGAA G CAAAAAUU | 8539 | AAUUUUUG GCCGAAAGGCGAGUGAGGUCU UUCACAGA | 20302 |
| 926 | UGAUGAAA G UUACCAGU | 8543 | ACUGGUAA GCCGAAAGGCGAGUGAGGUCU UUUCAUCA | 20303 |
| 933 | AGUUACCA G UCUAUUAU | 8544 | AUAAUAGA GCCGAAAGGCGAGUGAGGUCU UGGUAACU | 20304 |
| 942 | UCUAUUAU G UACAUAGU | 8545 | ACUAUGUA GCCGAAAGGCGAGUGAGGUCU AUAAUAGA | 20305 |
| 949 | UGUACAUA G UUGUCGUU | 8546 | AACGACAA GCCGAAAGGCGAGUGAGGUCU UAUGUACA | 20306 |
| 952 | ACAUAGUU G UCGUUGUA | 8547 | UACAACGA GCCGAAAGGCGAGUGAGGUCU AACUAUGU | 20307 |
| 955 | UAGUUGUC G UUGUAGGG | 8548 | CCCUACAA GCCGAAAGGCGAGUGAGGUCU GACAACUA | 20308 |
| 958 | UUGUCGUU G UAGGGUAU | 8549 | AUACCCUA GCCGAAAGGCGAGUGAGGUCU AACGACAA | 20309 |
| 963 | GUUGUAGG G UAUAGGAU | 8550 | AUCCUAUA GCCGAAAGGCGAGUGAGGUCU CCUACAAC | 20310 |
| 979 | UUUAUGAU G UGGUUCUG | 8553 | CAGAACCA GCCGAAAGGCGAGUGAGGUCU AUCAUAAA | 20311 |
| 982 | AUGAUGUG G UUCUGAGU | 8554 | ACUCAGAA GCCGAAAGGCGAGUGAGGUCU CACAUCAU | 20312 |
| 989 | GGUUCUGA G UCCGUCUC | 8555 | GAGACGGA GCCGAAAGGCGAGUGAGGUCU UCAGAACC | 20313 |
| 993 | CUGAGUCC G UCUCAUGG | 8556 | CCAUGAGA GCCGAAAGGCGAGUGAGGUCU GGACUCAG | 20314 |
| 1015 | AACUAUCU G UUGGAGAA | 8559 | UUCUCCAA GCCGAAAGGCGAGUGAGGUCU AGAUAGUU | 20315 |
| 1026 | GGAGAAAA G CUUGUCUU | 8560 | AAGACAAG GCCGAAAGGCGAGUGAGGUCU UUUUCUCC | 20316 |
| 1030 | AAAAGCUU G UCU1AAAU | 8561 | AUUUAAGA GCCGAAAGGCGAGUGAGGUCU AAGCUUUU | 20317 |
| 1040 | CUUAAAUU G UACAGCAA | 8563 | UUGCUGUA GCCGAAAGGCGAGUGAGGUCU AAUUUAAG | 20318 |
| 1045 | AUUGUACA G CAAGAACU | 8564 | AGUUCUUG GCCGAAAGGCGAGUGAGGUCU UGUACAAU | 20319 |
| 1063 | AACUAAAU G UGGGGAUU | 8568 | AAUCCCCA GCCGAAAGGCGAGUGAGGUCU AUUUAGUU | 20320 |
| 1101 | UCUUCGAA G CAUCAGCA | 8573 | UCCUGAUG GCCGAAAGGCGAGUGAGGUCU UUCGAAGA | 20321 |
| 1107 | AAGCAUCA G CAUAAGAA | 8574 | UUCUUAUG GCCGAAAGGCGAGUGAGGUCU UGAUGCUU | 20322 |
| 1120 | AGAAACUU G UAAACCGA | 8576 | UCGGUUUA GCCGAAAGGCGAGUGAGGUCU AAGUUUCU | 20323 |
| 1143 | AAAACCCA G UCUGGGAG | 8580 | CUCCCAGA GCCGAAAGGCGAGUGAGGUCU UGGGUUUU | 20324 |
| 1151 | GUCUGGGA G UGAGAUGA | 8581 | UCAUCUCA GCCGAAAGGCGAGUGAGGUCU UCCCAGAC | 20325 |
| 1172 | AUUUUUGA G CACCUEUA | 8584 | UUAAGGUG GCCGAAAGGCGAGUGAGGUCU UCAAAAAU | 20326 |
| 1190 | UAUAGAUG G UGUAACCC | 8587 | GGGUUACA GCCGAAAGGCGAGUGAGGUCU CAUCUAUA | 20327 |
| 1192 | UAGAUGGU G UAACCCGG | 8588 | CCGGGUUA GCCGAAAGGCGAGUGAGGUCU ACCAUCUA | 20328 |
| 1202 | AACCCGGA G UGACCAAG | 8590 | CUUGGUCA GCCGAAAGGCGAGUGAGGUCU UCCGGGUU | 20329 |
| 1215 | CAAGGAUU G UACACCUG | 8593 | CAGGUGUA GCCGAAAGGCGAGUGAGGUCU AAUCCUUG | 20330 |
| 1223 | GUACACCU G UGCAGCAU | 8594 | AUGCUGCA GCCGAAAGGCGAGUGAGGUCU AGGUGUAC | 20331 |
| 1225 | ACACCUGU G CAGCAUCC | 8595 | GGAUGCUG GCCGAAAGGCGAGUGAGGUCU ACAGGUGU | 20332 |
| 1228 | CCUGUGCA G CAUCCAGU | 8596 | ACUGGAUG GCCGAAAGGCGAGUGAGGUCU UGCACAGG | 20333 |
| 1235 | AGCAUCCA G UGGGCUGA | 8597 | UCAGCCCA GCCGAAAGGCGAGUGAGGUCU UGGAUGCU | 20334 |
| 1239 | UCCAGUGG G CUGAUGAC | 8598 | GUCAUCAG GCCGAAAGGCGAGUGAG3UCU UCACUGGA | 20335 |
| 1259 | GAAGAACA G CACAUUUG | 8602 | CAAAUGUG GCCGAAAGGCGAGUGAGGUCU UGUUCUUC | 20336 |
| 1267 | GCACAUUU G UCAGGGUC | 8603 | GACCCUGA GCCGAAAGGCGAGUGAGGUCU AAAUGUGC | 20337 |
| 1273 | UUGUCAGG G UCCAUGAA | 8604 | UUCAUGGA GCCGAAAGGCGAGUGAGGUCU CCUGACAA | 20338 |

TABLE XXIII-continued

Human KDR Ziuzyme and Substrate Sequence

| Pos | Substrate | Seq ID No | Zinzyme | Seq ID No |
|---|---|---|---|---|
| 1291 | AACCUUUU G UUGCUUUU | 8606 | AAAAGCAA GCCGAAAGGCGAGUGAGGUCU AAAAGGUU | 20339 |
| 1294 | CUUUUGUU G CUUUUGGA | 8607 | UCCAAAAG GCCGAAAGGCGAGUGAGGUCU AACAAAAG | 20340 |
| 1304 | UUUUGGAA G UGGCAUGG | 8608 | CCAUGCCA GCCGAAAGGCGAGUGAGGUCU UUCCAAAA | 20341 |
| 1307 | UGGAAGUG G CAUGGAAU | 8609 | AUUCCAUG GCCGAAAGGCGAGUGAGGUCU CACUUCCA | 20342 |
| 1321 | AAUCUCUG G UGGAAGCC | 8611 | GGCUUCCA GCCGAAAGGCGAGUGAGGUCU CAGAGAUG | 20343 |
| 1327 | UGGUGGAA G CCACGGUG | 8612 | CACCGUGG GCCGAAAGGCGAGUGAGGUCU UUCCACCA | 20344 |
| 1333 | AAGCCACG G UGGGGGAG | 8613 | CUCCCCCA GCCGAAAGGCGAGUGAGGUCU CGUGGCUU | 20345 |
| 1341 | GUGGGGGA G CGUGUCAG | 8614 | CUGACACG GCCGAAAGGCGAGUGAGGUCU UCCCCCAC | 20346 |
| 1343 | GGGGGAGC G UGUCAGAA | 8615 | UUCUGACA GCCGAAAGGCGAGUGAGGUCU GCUCCCCC | 20347 |
| 1345 | GGGAGCGU G UCAGAAUC | 8616 | GACUCUGA GCCGAAAGGCGAGUGAGGUCU ACGCUCCC | 20348 |
| 1357 | GAAUCCCU G CGAAGUAC | 8618 | GUACUUCG GCCGAAAGGCGAGUGAGGUCU AGGGAUUC | 20349 |
| 1362 | CCUGCGAA G UACCUUGG | 8619 | CCAAGGUA GCCGAAAGGCGAGUGAGGUCU UUCGCAGG | 20350 |
| 1370 | GUACCUUG G UUACCCAC | 8620 | GUGGGUAA GCCGAAAGGCGAGUGAGGUCU CAAGGUAC | 20351 |
| 1395 | AUAAAAUG G UAUAAAAA | 8623 | UUUUUAUA GCCGAAAGGCGAGUGAGGUCU CAUUUUAU | 20352 |
| 1419 | CCCCUUGA G UCCAAUCA | 8626 | UGAUUGGA GCCGAAAGGCGAGUGAGGUCU UCAAGGGG | 20353 |
| 1438 | CAAUEUAA G CGGGGCAU | 8629 | AUGCCCCG GCCGAAAGGCGAGUGAGGUCU UUEUAUUG | 20354 |
| 1443 | AAAGCGGG G CAUGUACU | 8630 | AGUACAUG GCCGA1AGGCGAGUGAGGUCU CCCGCUUU | 20355 |
| 1447 | CGGGGCAU G UACUGACG | 8631 | CGUCAGUA GCCGAAAGGCGAGUGAGGUCU AUGCCCCG | 20356 |
| 1465 | UUAUGGAU G UGAGUGAA | 8634 | UUCACUCA GCCGAAAGGCGAGUGAGGUCU UUCCAUAA | 20357 |
| 1469 | GGAAGUGA G UGAAAGAG | 8635 | CUCUUUCA GCCGAAAGGCGAGUGAGGUCU UCACUUCC | 20358 |
| 1495 | AUUACACU G UCAUCCUG | 8638 | AAGGAUGA GCCGAAAGGCGAGUGAGGUCU AGUGUAAU | 20359 |
| 1527 | AAGGAGAA G CAGAGCCA | 8640 | UGGCUCUG GCCGAAAGGCGAGUGAGGUCU UUCUCCUU | 20360 |
| 1532 | GAAGCAGA G CCAUGUGG | 8641 | CCACAUGG GCCGAAAGGCGAGUGAGGUCU UCUGCUUC | 20361 |
| 1537 | AGAGCCAU G UGGUCUCU | 8642 | AGAGACCA GCCGAAAGGCGAGUGAGGUCU AUGGCUCU | 20362 |
| 1540 | GCCAUGUG G UCUCUCUG | 8643 | CAGAGAGA GCCGAAAGGCGAGUGAGGUCU CACAUGGC | 20363 |
| 1549 | UCUCUCUG G UUGUGUAU | 8644 | AUACACAA GCCGAAAGGCGAGUGAGGUCU CAGAGAGA | 20364 |
| 1552 | CUCUGGUU G UGUAUGUC | 8645 | GACAUACA GCCGAAAGGCGAGUGAGGUCU AACCAGAG | 20365 |
| 1554 | CUGGUUGU G UAUGUCCC | 8646 | GGGACAUA GCCGAAAGGCGAGUGAGGUCU ACAACCAG | 20366 |
| 1558 | UUGUGUAU G UCCCACCC | 8647 | GGCUCGCA GCCGAAACGCGAGUGAGGUCU AUACACAA | 20367 |
| 1574 | CCAGAUUG G UGAGAAAU | 8649 | AUUUCUCA GCCGAAAGGCGAGUGAGGUCU CAAUCUGG | 20368 |
| 1597 | UCUCUCCU G UGGAUUCC | 8652 | GGAAUCCA CCCGAAAGGCGAGUGAGGUCU AGGAGAGA | 20369 |
| 1611 | UCCUACCA G UACGGCAC | 8654 | GUGCCGUA GCCGAAACGCGAGUGAGGUCU UGGUAGGA | 20370 |
| 1616 | CCAGUACG G CACCACUC | 8655 | GAGUGGUG GCCGAAAGGCGAGUGAGGUCU CGUACUGG | 20371 |
| 1629 | ACUCAAAC G CUGACAUG | 8657 | CAUGUCAG GCCGAAAGGCGAGUGAGGUCU GUUUGAGU | 20372 |
| 1637 | GCUGACAU G UACGGUCU | 8659 | AGACCGUA GCCGAAAGGCGAGUGAGGUCU AUGUCAGC | 20373 |
| 1642 | CAUGUACG G UCUAUGCC | 8660 | GGCAUAGA GCCGAAAGGCGAGUGAGGUCU CGUACAUG | 20374 |
| 1648 | CGGUCUAU G CCAUUCCU | 8661 | AGGAAUGG GCCGAAAGGCGAGUGAGGUCU AUAGACCG | 20375 |

TABLE XXIII-continued

Human KDR Ziuzyme and Substrate Sequence

| Pos | Substrate | Seq ID No | Zinzyme | Seq ID No |
|---|---|---|---|---|
| 1662 | CCUCCCCC G CAUCACAU | 8662 | AUGUGAUG GCCGAAAGGCGAGUGAGGUCU GGGGGAGG | 20376 |
| 1677 | AUCCACUG G UAUUGGCA | 8663 | UGCCAAUA GCCGAAAGGCGAGUGAGGUCU CAGUGGAU | 20377 |
| 1683 | UGGUAUUG G CAGUUGGA | 8664 | UCCAACUG GCCGAAAGGCGAGUGAGGUCU CAAUACCA | 20378 |
| 1686 | UAUUGGCA G UUGGAGGA | 8665 | UCCUCCAA GCCGAAAGGCGAGUGAGGUCU UGCCAAUA | 20379 |
| 1698 | GAGGAAGA G UGCGCCAA | 8666 | UUGGCGCA GCCGAAAGGCGAGUGAGGUCU UCUUCCUC | 20380 |
| 1700 | GGAAGAGU G CGCCAACG | 8667 | CGUUGGCG GCCGAAAGGCGAGUGAGGUCU ACUCUUCC | 20381 |
| 1702 | AAGAGUGC G CCAACGAG | 8668 | CUCGUUGG GCCGAAAGGCGAGUGAGGUCU GCACUCUU | 20382 |
| 1710 | GCCAACGA G CCCAGCCA | 8670 | UGGCUGGG GCCGAAAGGCGAGUGAGGUCU UCGUUGGC | 20383 |
| 1715 | CGAGCCCA G CCAAGCUG | 8671 | CAGCUUGG GCCGAAAGGCGAGUGAGGUCU UGGGCUCG | 20384 |
| 1720 | CCAGCCAA G CUGUCUCA | 8672 | UGAGACAG GCCGAAAGGCGAGUGAGGUCU UUGGCUGG | 20385 |
| 1723 | GCCAAGCU G UCUCAGUG | 8673 | CACUGAGA GCCGAAAGGCGAGUGAGGUCU AGCUUGGC | 20386 |
| 1729 | CUGUCUCA G UGACAAAC | 8674 | GUUUGUCA GCCGAAAGGCGAGUGAGGUCU UGAGACAG | 20387 |
| 1748 | AUACCCUU G UGAAGAAU | 8677 | AUUCUUCA GCCGAAAGGCGAGUGAGGUCU AAGGGUAU | 20388 |
| 1763 | AUGGAGAA G UGUGGAGG | 8679 | CCUCCACA GCCGAAAGGCGAGUGAGGUCU UUCUCCAU | 20389 |
| 1765 | GGAGAAGU G UGGAGGAC | 8680 | GUCCUCCA GCCGAAAGGCGAGUGAGGUCU ACUUCUCC | 20390 |
| 1798 | AAAUUGAA G UUAAUAAA | 8684 | UUUAUUAA GCCGAAAGGCGAGUGAGGUCU UUCAAUUU | 20391 |
| 1816 | AUCAAUUU G CUCUAAUU | 8688 | AAUUAGAG GCCGAAAGGCGAGUGAGGUCU AAAUUGAU | 20392 |
| 1843 | ACAAAACU G UAAGUACC | 8692 | GGUACUUA GCCGAAAGGCGAGUGAGGUCU AGUUUUGU | 20393 |
| 1847 | AACUGUAA G UACCCUUG | 8693 | CAAGGGUA GCCGAAAGGCGAGUGAGGUCU UUACAGUU | 20394 |
| 1855 | GUACCCUU G UUAUCCAA | 8694 | UUGGAUAA GCCGAAAGGCGAGUGAGGUCU AAGGGUAC | 20395 |
| 1864 | UUAUCCAA G CGGCAAAU | 8695 | AUUUGCCG GCCGAAAGGCGAGUGAGGUCU UUGGAUAA | 20396 |
| 1867 | UCCAAGCG G CAAAUGUG | 8696 | CACAUUUG GCCGAAAGGCGAGUGAGGUCU CGCUUGGA | 20397 |
| 1873 | CGGCAAAU G UGUCAGCU | 8698 | AGCUGACA GCCGAAAGGCGAGUGAGGUCU AUUUGCCG | 20398 |
| 1875 | GCAAAUGU G UCAGCUUU | 8699 | AAAGCUGA GCCGAAAGGCGAGUGAGGUCU ACAUUUGC | 20399 |
| 1879 | AUGUGUCA G CUUUGUAC | 8700 | GUACAAAG GCCGAAAGGCGAGUGAGGUCU UGACACAU | 20400 |
| 1884 | UCAGCUUU G UACAAAUG | 8701 | CAUUUGUA GCCGAAAGGCGAGUGAGGUCU AAAGCUGA | 20401 |
| 1892 | GUACAAAU G UGAAGCGG | 8703 | CCGCUUCA GCCGAAAGGCGAGUGAGGUCU AUUUGUAC | 20402 |
| 1897 | AAUGUGAA G CGGUCAAC | 8704 | GUUGACCG GCCGAAAGGCGAGUGAGGUCU UUCACAUU | 20403 |
| 1900 | GUGAAGCG G UCAACAAA | 8705 | UUUGUUGA GCCGAAAGGCGAGUGAGGUCU CGCUUCAC | 20404 |
| 1909 | UCAACAAA G UCGGGAGA | 8707 | UCUCCCGA GCCGAAAGGCGAGUGAGGUCU UUUGUUGA | 20405 |
| 1927 | GAGAGAGG G UGAUCUCC | 8708 | GGAGAUCA GCCGAAAGGCGAGUGAGGUCU CCUCUCUC | 20406 |
| 1942 | CCUUCCAC G UGACCAGG | 8710 | CCUGGUCA GCCGAAAGGCGAGUGAGGUCU GUGGAAGG | 20407 |
| 1952 | GACCAGGG G UCCUGAAA | 8712 | UUUCAGGA GCCGAAAGGCGAGUGAGGUCU CCCUGGUC | 20408 |
| 1968 | AUUACUUU G CAACCUGA | 8714 | UCAGGUUG GCCGAAAGGCGAGUGAGGUCU AAAGUAAU | 20409 |
| 1980 | CCUGACAU G CAGCCCAC | 8717 | GUGGGCUG GCCGAAAGGCGAGUGAGGUCU AUGUCAGG | 20410 |
| 1983 | GACAUGCA G CCCACUGA | 8718 | UCAGUGGG GCCGAAAGGCGAGUGAGGUCU UGCAUGUC | 20411 |
| 1992 | CCCACUGA G CAGGAGAG | 8719 | CUCUCCUG GCCGAAAGGCGAGUGAGGUCU UCAGUGGG | 20412 |

TABLE XXIII-continued

Human KDR Ziuzyme and Substrate Sequence

| Pos | Substrate | Seq ID No | Zinzyme | Seq ID No |
|---|---|---|---|---|
| 2000 | GCAGGAGA G CGUGUCUU | 8720 | AAGACACG GCCGAAAGGCGAGUGAGGUCU UCUCCUGC | 20413 |
| 2002 | AGGAGAGC G UGUCUUUG | 8721 | CAAAGACA GCCGAAAGGCGAGUGAGGUCU GCUCUCCU | 20414 |
| 2004 | GAGAGCGU G UCUUUGUG | 8722 | CACAAAGA GCCGAAAGGCGAGUGAGGUCU ACGCUCUC | 20415 |
| 2010 | GUGUCUUU G UGGUGCAC | 8723 | GUGCACCA GCCGAAAGGCGAGUGAGGUCU AAAGACAC | 20416 |
| 2013 | UCUUUGUG G UCCACUGC | 8724 | GCAGUGCA GCCGAAAGGCGAGUGAGGUCU CACAAAGA | 20417 |
| 2015 | UUUGUGGU G CACUGCAG | 8725 | CUGCAGUG GCCGAAAGGCGAGUGAGGUCU ACCACAAA | 20418 |
| 2020 | GGUGCACU G CAGACAGA | 8726 | UCUGUCUG GCCGAAAGGCGAGUGAGGUCU AGUGCACC | 20419 |
| 2034 | AGAUCUAC G UUUGAGAA | 8729 | UUCUCAAA GCCGAAAGGCGAGUGAGGUCU GUAGAUCU | 20420 |
| 2052 | CUCACAUG G UACAAGCU | 8731 | AGCUUGUA GCCGAAAGGCGAGUGAGGUCU CAUGUGAG | 20421 |
| 2058 | UGGUACAA G CUUGGCCC | 8732 | GGGCCAAG GCCGAAAGGCGAGUGAGGUCU UUGUACCA | 20422 |
| 2063 | CAAGCUUG G CCCACAGC | 8733 | GCUGUGGG GCCGAAAGGCGAGUGAGGUCU CAAGCUUG | 20423 |
| 2070 | GGCCCACA G CCUCUGCC | 8734 | GGCAGAGG GCCGAAAGGCGAGUGAGGUCU UGUGGGCC | 20424 |
| 2076 | CAGCCUCU G CCAAUCCA | 8735 | UGGAUUGG GCCGAAAGGCGAGUGAGGUCU AGAGGCUG | 20425 |
| 2086 | CAAUCCAU G UGGGAGAG | 8737 | CUCUCCCA GCCGAAAGGCGAGUGAGGUCU AUGGAUUG | 20426 |
| 2094 | GUGGGAGA G UUGCCCAC | 8738 | GUGGGCAA GCCGAAAGGCGAGUGAGGUCU UCUCCCAC | 20427 |
| 2097 | GGAGAGUU G CCCACACC | 8739 | GGUGUGGG GCCGAAAGGCGAGUGAGGUCU AACUCUCC | 20428 |
| 2107 | CCACACCU G UUUGCAAG | 8740 | CUUGCAAA GCCGAAAGGCGAGUGAGGUCU AGGUGUGG | 20429 |
| 2111 | ACCUGUUU G CAAGAACU | 8741 | AGUUCUUG GCCGAAAGGCGAGUGAGGUCU AAACAGGU | 20430 |
| 2143 | AAUUGAAU G CCACCAUG | 8746 | CAUGGUGG GCCGAAAGGCGAGUGAGGUCU AUUCAAUU | 20431 |
| 2151 | GCCACCAU G UUCUCUAA | 8747 | UUAGAGAA GCCGAAAGGCGAGUGAGGUCU AUGGUGGC | 20432 |
| 2162 | CUCUAAUA G CACAAAUG | 8749 | CAUUUGUG GCCGAAAGGCGAGUGAGGUCU UAUEUGAG | 20433 |
| 2187 | AUCAUGGA G CUUAAGAA | 8753 | UUCUUAAG GCCGAAAGGCGAGUGAGGUCU UCCAUGAU | 20434 |
| 2197 | UUAAGAAU G CAUCCUUG | 8755 | CAAGGAUG GCCGAAAGGCGAGUGAGGUCU AUUCUUAA | 20435 |
| 2205 | GCAUCCUU G CAGGACCA | 8756 | UGGUCCUG GCCGAAAGGCGAGUGAGGUCU AAGGAUGC | 20436 |
| 2224 | GAGACUAU G UCUGCCUU | 8759 | AAGGCAGA GCCGAAAGGCGAGUGAGGUCU AUAGUCUC | 20437 |
| 2228 | CUAUGUCU G CCUUGCUC | 8760 | GAGCAAGG GCCGAAAGGCGAGUGAGGUCU AGACAUAG | 20438 |
| 2233 | UCUGCCUU G CUCAAGAC | 8761 | GUCUUGAG GCCGAAAGGCGAGUGAGGUCU AAGGCAGA | 20439 |
| 2264 | AAGACAUU G CGUGGUCA | 8765 | UGACCACG GCCGAAAGGCGAGUGAGGUCU AAUGUCUU | 20440 |
| 2266 | GACAUUGC G UGGUCAGG | 8766 | CCUGACCA GCCGAAAGGCGAGUGAGGUCU GCAAUGUC | 20441 |
| 2269 | AUUGCGUG G UCAGGCAG | 8767 | CUGCCUGA GCCGAAAGGCGAGUGAGGUCU CACGCAAU | 20442 |
| 2274 | GUGGUCAG G CAGCUCAC | 8768 | GUGAGCUG GCCGAAAGGCGAGUGAGGUCU CUGACCAC | 20443 |
| 2277 | GUCAGGCA G CUCACAGU | 8769 | ACUGUGAG GCCGAAAGGCGAGUGAGGUCU UGCCUGAC | 20444 |
| 2284 | AGCUCACA G UCCUAGAG | 8770 | CUCUAGGA GCCGAAAGGCGAGUGAGGUCU UGUGAGCU | 20445 |
| 2292 | GUCCUAGA G CGUGUGGC | 8771 | GCCACACG GCCGAAAGGCGAGUGAGGUCU UCUAGGAC | 20446 |
| 2294 | CCUAGAGC G UGUGGCAC | 8772 | GUGCCACA GCCGAAAGGCGAGUGAGGUCU GCUCUAGG | 20447 |
| 2296 | UAGAGCGU G UGGCACCC | 8773 | GGGUGCCA GCCGAAAGGCGAGUGAGGUCU ACGCUCUA | 20448 |
| 2299 | AGCGUGUG G CACCCACG | 8774 | CGUGGGUG GCCGAAAGGCGAGUGAGGUCU CACACGCU | 20449 |

TABLE XXIII-continued

Human KDR Ziuzyme and Substrate Sequence

| Pos | Substrate | Seq ID No | Zinzyme | Seq ID No |
|---|---|---|---|---|
| 2339 | GACGACAA G UAUUGGGG | 8780 | CCCCAAUA GCCGAAAGGCGAGUGAGGUCU UUGUCGUC | 20450 |
| 2351 | UGGGGAAA G CAUCGAAG | 8781 | CUUCGAUG GCCGAAAGGCGAGUGAGGUCU UUUCCCCA | 20451 |
| 2359 | GCAUCGAA G UCUCAUGC | 8782 | GCAUGAGA GCCGAAAGGCGAGUGAGGUCU UUCGAUGC | 20452 |
| 2366 | AGUCUCAU G CACGGCAU | 8783 | AUGCCGUG GCCGAAAGGCGAGUGAGGUCU AUGAGACU | 20453 |
| 2371 | CAUGCACG G CAUCUGGG | 8784 | CCCAGAUG GCCGAAAGGCGAGUGAGGUCU CGUGCAUG | 20454 |
| 2400 | CAGAUCAU G UGGUUUAA | 8787 | UUAAACCA GCCGAAAGGCGAGUGAGGUCU AUGAUCUG | 20455 |
| 2403 | AUCAUGUG G UUUAAAGA | 8788 | UCUUUAAA GCCGAAAGGCGAGUGAGGUCU CACAUGAU | 20456 |
| 2425 | AGACCCUU G UAGAAGAC | 8792 | GUCUUCUA GCCGAAAGGCGAGUGAGGUCU AAGGGUCU | 20457 |
| 2438 | AGACUCAG G CAUUGUAU | 8794 | AUACAAUG GCCGAAAGGCGAGUGAGGUCU CUGAGUCU | 20458 |
| 2443 | CAGGCAUU G UAUUGAAG | 8795 | CUUCAAUA GCCGAAAGGCGAGUGAGGUCU AAUGCCUG | 20459 |
| 2477 | CACUAUCC G CAGAGUGA | 8799 | UCACUCUG GCCGAAAGGCGAGUGAGGUCU GGAUAGUG | 20460 |
| 2482 | UCCGCAGA G UGAGGAAG | 8800 | CUUCCUCA GCCGAAAGGCGAGUGAGGUCU UCUGCGGA | 20461 |
| 2501 | GGACGAAG G CCUCUACA | 8802 | UGUAGAGG GCCGAAAGGCGAGUGAGGUCU CUUCGUCC | 20462 |
| 2513 | CUACACCU G CCAGGCAU | 8803 | AUGCCUGG GCCGAAAGGCGAGUGAGGUCU AGGUGUAG | 20463 |
| 2518 | CCUGCCAG G CAUGCAGU | 8804 | ACUGCAUG GCCGAAAGGCGAGUGAGGUCU CUGGCAGG | 20464 |
| 2522 | CCAGGCAU G CAGUGUUC | 8805 | GAACACUG GCCGAAAGGCGAGUGAGGUCU AUGCCUGG | 20465 |
| 2525 | GGCAUGCA G UGUUCUUG | 8806 | CAAGAACA GCCGAAAGGCGAGUGAGGUCU UGCAUGCC | 20466 |
| 2527 | CAUGCAGU G UUCUUGGC | 8807 | GCCAAGAA GCCGAAAGGCGAGUGAGGUCU ACUGCAUG | 20467 |
| 2534 | UGUUCUUG G CUGUGCAA | 8808 | UUGCACAG GCCGAAAGGCGAGUGAGGUCU CAAGAACA | 20468 |
| 2537 | UCUUGGCU G UGCAAAAG | 8809 | CUUUUGCA GCCGAAAGGCGAGUGAGGUCU AGCCAAGA | 20469 |
| 2539 | UUGGCUGU G CAAAAGUG | 8810 | CACUUUUG GCCGAAAGGCGAGUGAGGUCU ACAGCCAA | 20470 |
| 2545 | GUGCAAAA G UGGAGGCA | 8811 | UGCCUCCA GCCGAAAGGCGAGUGAGGUCU UUUUGCAC | 20471 |
| 2551 | AAGUGGAG G CAUUUUUC | 8812 | GAAAAAUG GCCGAAAGGCGAGUGAGGUCU CUCCACUU | 20472 |
| 2570 | AAUAGAAG G UGCCCAGG | 8814 | CCUGGGCA GCCGAAAGGCGAGUGAGGUCU CUUCUAUU | 20473 |
| 2572 | UAGAAGGU G CCCAGGAA | 8815 | UUCCUGGG GCCGAAAGGCGAGUGAGGUCU ACCUUCUA | 20474 |
| 2608 | UUAUUCUA G UAGGCACG | 8819 | CGUGCCUA GCCGAAAGGCGAGUGAGGUCU UAGAAUAA | 20475 |
| 2612 | UCUAGUAG G CACGGCGG | 8820 | CCGCCGUG GCCGAAAGGCGAGUGAGGUCU CUACUAGA | 20476 |
| 2617 | UAGGCACG G CGGUGAUU | 8822 | AAUCACCG GCCGAAAGGCGAGUGAGGUCU CGUGCCUA | 20477 |
| 2620 | GCACGGCG G UGAUUGCC | 8823 | GGCAAUCA GCCGAAAGGCGAGUGAGGUCU CGCCGUGC | 20478 |
| 2626 | CGGUGAUU G CCAUGUUC | 8825 | GAACAUGG GCCGAAAGGCGAGUGAGGUCU AAUCACCG | 20479 |
| 2631 | AUUGCCAU G UUCUUCUG | 8826 | CAGAAGAA GCCGAAAGGCGAGUGAGGUCU AUGGCAAU | 20480 |
| 2640 | UUCUUCUG G CUACUUCU | 8827 | AGAAGUAG GCCGAAAGGCGAGUGAGGUCU CAGAAGAA | 20481 |
| 2650 | UACUUCUU G UCAUCAUC | 8828 | GAUGAUGA GCCGAAAGGCGAGUGAGGUCU AAGAAGUA | 20482 |
| 2668 | UACGGACC G UUAAGCGG | 8832 | CCGCUUAA GCCGAAAGGCGAGUGAGGUCU GGUCCGUA | 20483 |
| 2673 | ACCGUUAA G CGGGCCAA | 8833 | UUGGCCCG GCCGAAAGGCGAGUGAGGUCU UUAACGGU | 20484 |
| 2677 | UUAAGCGG G CCAAUGGA | 8834 | UCCAUUGG GCCGAAAGGCGAGUGAGGUCU CCGCUUAA | 20485 |
| 2702 | GAAGACAG G CUACUUGU | 8838 | ACAAGUAG GCCGAAAGGCGAGUGAGGUCU CUGUCUUC | 20486 |

TABLE XXIII-continued

Human KDR Ziuzyme and Substrate Sequence

| Pos | Substrate | Seq ID No | Zinzyme | Seq ID No |
|---|---|---|---|---|
| 2709 | GGCUACUU G UCCAUCGU | 8839 | ACGAUGGA GCCGAAAGGCGAGUGAGGUCU AAGUAGCC | 20487 |
| 2716 | UGUCCAUC G UCAUGGAU | 8840 | AUCCAUGA GCCGAAAGGCGAGUGAGGUCU GAUGGACA | 20488 |
| 2753 | UGAACAUU G UGAACGAC | 8846 | GUCGUUCA GCCGAAAGGCGAGUGAGGUCU AAUGUUCA | 20489 |
| 2763 | GAACGACU G CCUUAUGA | 8849 | UCAUAAGG GCCGAAAGGCGAGUGAGGUCU AGUCGUUC | 20490 |
| 2773 | CUUAUGAU G CCAGCAAA | 8851 | UUUGCUGG GCCGAAAGGCGAGUGAGGUCU AUCAUAAG | 20491 |
| 2777 | UGAUGCCA G CAAAUGGG | 8852 | CCCAUUUG GCCGAAAGGCGAGUGAGGUCU UGGCAUCA | 20492 |
| 2802 | AGAGACCG G CUGAAGCU | 8856 | AGCUUCAG GCCGAAAGGCGAGUGAGGUCU CGGUCUCU | 20493 |
| 2808 | CGGCUGAA G CUAGGUAA | 8857 | UUACCUAG GCCGAAAGGCGAGUGAGGUCU UUCAGCCG | 20494 |
| 2813 | GAAGCUAG G UAAGCCUC | 8858 | GAGGCUUA GCCGAAAGGCGAGUGAGGUCU CUAGCUUC | 20495 |
| 2817 | CUAGGUAA G CCUCUUGG | 8859 | CCAAGAGG GCCGAAAGGCGAGUGAGGUCU UUACCUAG | 20496 |
| 2825 | GCCUCUUG G CCGUGGUG | 8860 | CACCACGG GCCGAAAGGCGAGUGAGGUCU CAAGAGGC | 20497 |
| 2828 | UCUUGGCC G UGGUGCCU | 8861 | AGGCACCA GCCGAAAGGCGAGUGAGGUCU GGCAAGA | 20498 |
| 2831 | UGGCCGUG G UGCCUUUG | 8862 | CAAAGGCA GCCGAAAGGCGAGUGAGGUCU CACGGCCA | 20499 |
| 2833 | GCCGUGGU G CCUUUGGC | 8863 | GCCAAAGG GCCGAAAGGCGAGUGAGGUCU ACCACGGC | 20500 |
| 2840 | UGCCUUUG G CCAAGUGA | 8864 | UCACUUGG GCCGAAAGGCGAGUGAGGUCU CAAAGGCA | 20501 |
| 2845 | UUGGCCAA G UGAUUGAA | 8865 | UUCAAUCA GCCGAAAGGCGAGUGAGGUCU UUGGCCAA | 20502 |
| 2854 | UGAUUGAA G CAGAUGCC | 8867 | GGCAUCUG GCCGAAAGGCGAGUGAGGUCU UUCAAUCA | 20503 |
| 2860 | AAGCAGAU G CCUUUGGA | 8869 | UCCAAAGG GCCGAAAGGCGAGUGAGGUCU AUCUGCUU | 20504 |
| 2881 | ACAAGACA G CAACUUGC | 8873 | GCAAGUUG GCCGAAAGGCGAGUGAGGUCU UGUCUUGU | 20505 |
| 2888 | AGCAACUU G CAGGACAG | 8875 | CUGUCCUG CCCGAAAGGCGAGUGAGGUCU AAGUUGCU | 20506 |
| 2896 | GCAGGACA G UAGCAGUC | 8877 | GACUGCUA GCCGAAAGGCGAGUGAGGUCU UGUCCUGC | 20507 |
| 2899 | CGACAGUA G CAGUCAAA | 8878 | UUUGACUG GCCGAAAGGCGAGUGAGGUCU UACUGUCC | 20508 |
| 2902 | CAGUAGCA G UCAAAAUG | 8879 | CAUUUUGA GCCGAAAGGCGAGUGAGGUCU UCCUACUG | 20509 |
| 2910 | GUCAAAAU G UUGAAAGA | 8881 | UCUUUCAA GCCGAAAGGCGAGUGACGUCU AUUUUGAC | 20510 |
| 2923 | AAGAACGA G CAACACAC | 8882 | GUGUGUUG GCCGAAAGGCGAGUGAGGUCU UCCUUCUU | 20511 |
| 2933 | AACACACA G UGAGCAUC | 8884 | GAUGCUCA GCCGAAAGGCGAGUGAGGUCU UGUGUGUU | 20512 |
| 2937 | CACAGUGA G CAUCGAGC | 8885 | GCUCCAUG GCCGAAAGGCGAGUGAGCUCU UCACUGUC | 20513 |
| 2944 | ACCAUCCA G CUCUCAUC | 8886 | CAUGAGAC GCCCAAACGCGACUGACGUCU UCCAUGCU | 20514 |
| 2952 | GCUCUCAU G UCUGAACU | 8887 | AGUUCAGA GCCGAAAGGCGACUGAGGUCU AUGAGAGC | 20515 |
| 2981 | UCAUAUUG G UCACCAUC | 8890 | GAUCCUGA GCCCAAACCCGACUGAGGUCU CAAUAUGA | 20516 |
| 2995 | AUCUCAAU G UGGUCAAC | 8892 | GUUGACCA GCCGAAAGGCGAGUGAGGUCU AUUGAGAU | 20517 |
| 2998 | UCAUGUG G UCAACCUU | 8893 | AAGGUUGA GCCGAAAGGCGAGUGAGGUCU CACAUUGA | 20518 |
| 3011 | CCUUCUAG G UGCCUGUA | 8895 | UACAGGCA GCCGAAAGGCGAGUGAGGUCU CUAGAAGG | 20519 |
| 3013 | UUCUAGGU G CCUGUACC | 8896 | GGUACAGG GCCGAAAGGCGAGUGAGGUCU ACCUAGAA | 20520 |
| 3017 | AGGUGCCU G UACCAAGC | 8897 | GCUUGGUA GCCGAAAGGCGAGUGAGGUCU AGGCACCU | 20521 |
| 3024 | UGUACCAA G CCAGGAGG | 8898 | CCUCCUGG GCCGAAAGGCGAGUGAGGUCU UUGGUACA | 20522 |
| 3033 | CCAGGAGG G CCACUCAU | 8899 | AUCAGUGG GCCGAAAGGCGAGUCACGUCU CCUCCUGG | 20523 |

TABLE XXIII-continued

Human KDR Ziuzyme and Substrate Sequence

| Pos | Substrate | | | Seq ID No | Zinzyme | Seq ID No |
|---|---|---|---|---|---|---|
| 3043 | CACUCAUG | G | UGAUUGUG | 8900 | CACAAUCA GCCGAAAGGCGAGUGAGGUCU CAUGAGUG | 20524 |
| 3049 | UGGUGAUU | G | UGGAAUUC | 8902 | GAAUUCCA GCCGAAAGGCGAGUGAGGUCU AAUCACCA | 20525 |
| 3059 | CGAAUUCU | G | CAAAUUUG | 8904 | CAAAUUUG GCCGAAAGCCGAGUGAGGUCU AGAAUUCC | 20526 |
| 3075 | GGAAACCU | G | UCCACUUA | 8907 | UAAGUCGA GCCGAAAGCCGACUGAGGUCU AGGUUUCC | 20527 |
| 3092 | CCUGAGGA | G | CAACAGAA | 8908 | UUCUCUUG GCCGAAAGGCGAGUGAGGUCU UCCUCAGG | 20528 |
| 3109 | AUGAAUUU | G | UCCCCUAC | 8911 | GUAGGGGA GCCGAAAGGCGAGUGAGGUCU AAAUUCAU | 20529 |
| 3130 | CCAAAGGG | G | CACGAUUC | 8913 | GAAUCGUG GCCGAAAGGCCAGUGAGGUCU CCCUUUCG | 20530 |
| 3140 | ACGAUUCC | G | UCAAGGGA | 8915 | UCCCUUCA GCCGAAAGGCGAGUGAGGUCU GGAAUCGU | 20531 |
| 3157 | AAGACUAC | G | UUGGAGCA | 8917 | UGCUCCAA GCCGAAAGGCGAGUGAGGUCU GUAGUCUU | 20532 |
| 3163 | ACGUUGGA | G | CAAUCCCU | 8918 | AGGGAUUG GCCGAAAGGCGAGUGAGCUCU UCCAACGU | 20533 |
| 3172 | CAAUCCCU | G | UGGAUCUG | 8920 | CAGAUCCA GCCGAAAGGCGACUGAGGUCU AGGGAUUG | 20534 |
| 3186 | CUGAAACG | G | CGCUUGGA | 8923 | UCCAACCG GCCGAAAGGCGAGUGAGGUCU CGUUUCAG | 20535 |
| 3188 | CAAACGGC | G | CUUCCACA | 8924 | UGUCCAAG GCCGAAAGGCGAGUGAGGUCU GCCGUUUC | 20536 |
| 3197 | CUUGGACA | G | CAUCACCA | 8926 | UCCUGAUG GCCGAAAGGCGAGUGAGGUCU UGUCCAAG | 20537 |
| 3206 | CAUCACCA | G | UAGCCACA | 8927 | UCUGGCUA GCCGAAACGCGAGUGAGGUCU UGCUGAUG | 20538 |
| 3209 | CACCAGUA | G | CCACAGCU | 8928 | AGCUCUGG CCCGAAAGGCGAGUGAGGUCU UACUGGUG | 20539 |
| 3215 | UAGCCAGA | G | CUCAGCCA | 8929 | UGGCUCAG GCCGAAAGGCGACUGAGGUCU UCUGGCUA | 20540 |
| 3220 | AGACCUCA | G | CCACCUCU | 8930 | AGAGCUGG GCCGAAAGGCGAGUGAGGUCU UCAGCUCU | 20541 |
| 3224 | CUCAGCCA | G | CUCUCCAU | 8931 | AUCCAGAG GCCGAAACGCCAGUGAGGUCU UGGCUGAG | 20542 |
| 3235 | CUGGAUUU | G | UGGAGGAG | 8933 | CUCCUCCA GCCGAAAGGCGAGUGAGCUCU AAAUCCAC | 20543 |
| 3246 | GAGGAGAA | G | UCCCUCAG | 8934 | CUGAGGGA CCCGAAAGGCGAGUGAGGUCU UUCUCCUC | 20544 |
| 3254 | GUCCCUCA | G | UGAUGUAG | 8935 | CUACAUCA GCCGAAAGGCGAGUGAGGUCU UGAGGGAC | 20545 |
| 3259 | UCACUGAU | G | UAGAAGAA | 8937 | UUCUUCUA CCCCAAAGGCCACUGAGGUCU AUCACUGA | 20546 |
| 3274 | AAGAGGAA | G | CUCCUGAA | 8938 | UUCAGCAG GCCGAAAGGCGACUGAGGUCU UUCCUCUU | 20547 |
| 3288 | GAAGAUCU | G | UAUAAGGA | 8940 | UCCUUAUA CCCCAAAGGCCAGUGAGCUCU AGAUCUUC | 20548 |
| 3312 | ACCUUGCA | G | CAUCUCAU | 8943 | AUGAGAUG GCCGAAAGGCGAGUCAGGUCU UCCAAGCU | 20549 |
| 3323 | UCUCAUCU | G | UUACAGCU | 8944 | AGCUGUAA GCCGAAAGGCGACUCAGGUCU AGAUCACA | 20550 |
| 3329 | CUGUUACA | G | CUUCCAAC | 8945 | CUUGGAAG GCCCAAACCCAGUGACCUCU UCUAACAG | 20551 |
| 3337 | GCUUCCAA | G | UGGCUAAG | 8946 | CUUAGCCA CCCCAAACGCCACUGACGUCU UUCGAAGC | 20552 |
| 3340 | UCCAAGUC | G | CUAAGCGC | 8947 | CCCCUUAG GCCCAAAGGCGACUGAGGUCU CACUUGCA | 20553 |
| 3347 | CGCUAAGG | G | CAUGGAGU | 8948 | ACUCCAUC GCCCAAACCCACUCACGUCU CCUUACCC | 20554 |
| 3354 | GCCAUCCA | G | UUCUUCGC | 8949 | CCCAACAA CCCCAAACGCGAGUGAGGUCU UCCAUCCC | 20555 |
| 3361 | AGUUCUUC | G | CAUCCCCA | 8950 | UCGCCAUC CCCCAAAGGCGAGUGAGGUCU CAACAACU | 20556 |
| 3366 | UUGGCAUC | G | CGAAAGUC | 8951 | CACUUUCC CCCCAAAGCCGAGUCACCUCU CAUCCCAA | 20557 |
| 3372 | UCCCCAAA | G | UCUAUCCA | 8952 | UCCAUACA CCCCAAACCCACUCACGUCU UUUCCCCA | 20558 |
| 3374 | GCGAAAGU | G | UAUUCCACA | 8953 | UGUCCAUA CCCCAAACGCGAGUCACCUCU ACUUUCGC | 20559 |
| 3391 | CGGACCUC | G | CGCCACCA | 8955 | UCCUCCCC GCCGAAAGCCGAGUCAGCUCU CACGUCCC | 20560 |

TABLE XXIII-continued

Human KDR Ziuzyme and Substrate Sequence

| Pos | Substrate | Seq ID No | Zinzyme | Seq ID No |
|---|---|---|---|---|
| 3394 | ACCUCCCC G CACCAAAU | 8956 | AUUUCCUG CCCCAAACCCGAGUGACCUCU CGCCAGCU | 20561 |
| 3424 | AGAACAAC G UGGUUAAA | 8959 | UUUAACCA GCCGAAAGGCCAGUGACGUCU CUUCUUCU | 20562 |
| 3427 | ACAACCUG G UUAAAAUC | 8960 | CAUUUUAA CCCCAAACGCCAGUGACGUCU CACCUUCU | 20563 |
| 3437 | UAAAAUCU G UGACUUUC | 8962 | CAAAGUCA GCCGAAAGGCGAGUGAGGUCU ACAUUUUA | 20564 |
| 3446 | UCACUCUC G CUUGCCCC | 8964 | CCGCCAAC CCCCAAACCCACUCACCUCU CAAACUCA | 20565 |
| 3451 | UUCGCUUG G CCCCCGAU | 8965 | AUCCCCCC GCCGAAAGGCGACUGAGGUCU CAAGCCAA | 20566 |
| 3481 | CAGAUUAU G UCAGAAAA | 8969 | UUUUCUGA GCCGAAAGGCGAGUGAGGUCU AUAAUCUG | 20567 |
| 3496 | AAGGAGAU G CUCGCCUC | 8971 | GAGGCGAG GCCGAAAGGCGAGUGAGGUCU AUCUCCUU | 20568 |
| 3500 | AGAUGCUC G CCUCCCUU | 8972 | AAGGGAGG GCCGAAAGGCGAGUGAGGUCU GAGCAUCU | 20569 |
| 3520 | AAUGGAUG G CCCCAGAA | 8975 | UUCUGGGG GCCGAAAGGCGAGUGAGGUCU CAUCCAUU | 20570 |
| 3544 | UUGACAGA G UGUACACA | 8979 | UGUGUACA GCCGAAAGGCGAGUGAGGUCU UCUGUCAA | 20571 |
| 3546 | GACAGAGU G UACACAAU | 8980 | AUUGUGUA GCCGAAAGGCGAGUGAGGUCU ACUCUGUC | 20572 |
| 3560 | AAUCCAGA G UGACGUCU | 8982 | AGACGUCA GCCGAAAGGCGAGUGAGGUCU UCUGGAUU | 20573 |
| 3565 | AGAGUGAC G UCUGGUCU | 8984 | AGACCAGA GCCGAAAGGCGAGUGAGGUCU GUCACUCU | 20574 |
| 3570 | GACGUCUG G UCUUUUGG | 8985 | CCAAAAGA GCCGAAAGGCGAGUGAGGUCU CAGACGUC | 20575 |
| 3578 | GUCUUUUG G UGUUUUGC | 8986 | GCAAAACA GCCGAAAGGCGAGUGAGGUCU CAAAAGAC | 20576 |
| 3580 | CUUUUGGU G UUUUGCUG | 8987 | CAGCAAAA GCCGAAAGGCGAGUGAGGUCU ACCAAAAG | 20577 |
| 3585 | GGUGUUUU G CUGUGGGA | 8988 | UCCCACAG GCCGAAAGGCGAGUGAGGUCU AAAACACC | 20578 |
| 3588 | GUUUUGCU G UGGGAAAU | 8989 | AUUUCCCA GCCGAAAGGCGAGUGAGGUCU AGCAAAAC | 20579 |
| 3608 | UUCCUUAG G UGCUUCUC | 8991 | GAGAAGCA GCCGAAAGGCGAGUGAGGUCU CUAAGGAA | 20580 |
| 3610 | CCUUAGGU G CUUCUCCA | 8992 | UGGAGAAG GCCGAAAGGCGAGUGAGGUCU ACCUAAGG | 20581 |
| 3628 | AUCCUGGG G UAAAGAUU | 8993 | AAUCUUUA GCCGAAAGGCGAGUGAGGUCU CCCAGGAU | 20582 |
| 3650 | AGAAUUUU G UAGGCGAU | 8997 | AUCGCCUA GCCGAAAGGCGAGUGAGGUCU AAAAUUCU | 20583 |
| 3654 | UUUUGUAG G CGAUUGAA | 8998 | UUCAAUCG GCCGAAAGGCGAGUGAGGUCU CUACAAAA | 20584 |
| 3682 | GAAUGAGG G CCCCUGAU | 9002 | AUCAGGGG GCCGAAAGGCGAGUGAGGUCU CCUCAUUC | 20585 |
| 3708 | CCAGAAAU G UACCAGAC | 9005 | GUCUGGUA GCCGAAAGGCGAGUGAGGUCU AUUUCUGG | 20586 |
| 3720 | CAGACCAU G CUGGACUG | 9007 | CAGUCCAG GCCGAAAGGCGAGUGAGGUCU AUGGUCUG | 20587 |
| 3728 | GCUGGACU G CUGGCACG | 9008 | CGUGCCAG GCCGAAAGGCGAGUGAGGUCU AGUCCAGC | 20588 |
| 3732 | GACUGCUG G CACGGGGA | 9009 | UCCCCGUG GCCGAAAGGCGAGUGAGGUCU CAGCAGUC | 20589 |
| 3741 | CACGGGGA G CCCAGUCA | 9010 | UGACUGGG GCCGAAAGGCGAGUGAGGUCU UCCCCGUG | 20590 |
| 3746 | GGAGCCCA G UCAGAGAC | 9011 | GUCUCUGA GCCGAAAGGCGAGUGAGGUCU UGGGCUCC | 20591 |
| 3759 | AGACCCAC G UUUUCAGA | 9013 | UCUGAAAA GCCGAAAGGCGAGUGAGGUCU GUGGGUCU | 20592 |
| 3768 | UUUUCAGA G UUGGUGGA | 9014 | UCCACCAA GCCGAAAGGCGAGUGAGGUCU UCUGAAAA | 20593 |
| 3772 | CAGAGUUG G UGGAACAU | 9015 | AUGUUCCA GCCGAAAGGCGAGUGAGGUCU CAACUCUG | 20594 |
| 3795 | AAUCUCUU G CAAGCUAA | 9018 | UUAGCUUG GCCGAAAGGCGAGUGAGGUCU AAGAGAUU | 20595 |
| 3799 | UCUUGCAA G CUAAUGCU | 9019 | AGCAUUAG GCCGAAAGGCGAGUGAGGUCU UUGCAAGA | 20596 |
| 3805 | AAGCUAAU G CUCAGCAG | 9021 | CUGCUGAG GCCGAAAGGCGAGUGAGGUCU AUUAGCUU | 20597 |

TABLE XXIII-continued

Human KDR Ziuzyme and Substrate Sequence

| Pos | Substrate | Seq ID No | Zinzyme | Seq ID No |
|---|---|---|---|---|
| 3810 | AAUGCUCA G CAGGAUGG | 9022 | CCAUCCUG GCCGAAAGGCGAGUGAGGUCU UGAGCAUU | 20598 |
| 3818 | GCAGGAUG G CAAAGACU | 9024 | AGUCUUUG GCCGAAAGGCGAGUGAGGUCU CAUCCUGC | 20599 |
| 3832 | ACUACAUU G UUCUUCCG | 9026 | CGGAAGAA GCCGAAAGGCGAGUGAGGUCU AAUGUAGU | 20600 |
| 3857 | GACUUUGA G CAUGGAAG | 9029 | CUUCCAUG GCCGAAAGGCGAGUGAGGUCU UCAAAGUC | 20601 |
| 3885 | CUCUCUCU G CCUACCUC | 9032 | GAGGUAGG GCCGAAAGGCGAGUGAGGUCU AGAGAGAG | 20602 |
| 3898 | CCUCACCU G UUUCCUGU | 9033 | ACAGGAAA GCCGAAAGGCGAGUGAGGUCU AGGUGAGG | 20603 |
| 3905 | UGUUUCCU G UAUGGAGG | 9034 | CCUCCAUA GCCGAAAGGCGAGUGAGGUCU AGGAAACA | 20604 |
| 3922 | AGGAGGAA G UAUGUGAC | 9035 | GUCACAUA GCCGAAAGGCGAGUGAGGUCU UUCCUCCU | 20605 |
| 3926 | GGAAGUAU G UGACCCCA | 9036 | UGGGGUCA GCCGAAAGGCGAGUGAGGUCU AUACUUCC | 20606 |
| 3955 | ACAACACA G CAGGAAUC | 9041 | GAUUCCUG GCCGAAAGGCGAGUGAGGUCU UGUGUUGU | 20607 |
| 3965 | AGGAAUCA G UCAGUAUC | 9043 | GAUACUGA GCCGAAAGGCGAGUGAGGUCU UGAUUCCU | 20608 |
| 3969 | AUCAGUCA G UAUCUGCA | 9044 | UGCAGAUA GCCGAAAGGCGAGUGAGGUCU UGACUGAU | 20609 |
| 3975 | CAGUAUCU G CAGAACAG | 9045 | CUGUUCUG GCCGAAAGGCGAGUGAGGUCU AGAUACUG | 20610 |
| 3983 | GCAGAACA G UAAGCGAA | 9047 | UUCGCUUA GCCGAAAGGCGAGUGAGGUCU UGUUCUGC | 20611 |
| 3987 | AACAGUAA G CGAAAGAG | 9048 | CUCUUUCG GCCGAAAGGCGAGUGAGGUCU UUACUGUU | 20612 |
| 3995 | GCGAAAGA G CCGGCCUG | 9049 | CAGGCCGG GCCGAAAGGCGAGUGAGGUCU UCUUUCGC | 20613 |
| 3999 | AAGAGCCG G CCUGUGAG | 9050 | CUCACAGG GCCGAAAGGCGAGUGAGGUCU CGGCUCUU | 20614 |
| 4003 | GCCGGCCU G UGAGUGUA | 9051 | UACACUCA GCCGAAAGGCGAGUGAGGUCU AGGCCGGC | 20615 |
| 4007 | GCCUGUGA G UGUAAAAA | 9052 | UUUUUACA GCCGAAAGGCGAGUGAGGUCU UCACAGGC | 20616 |
| 4009 | CUGUGAGU G UAAAACA | 9053 | UGUUUUA GCCGAAAGGCGAGUGAGGUCU ACUCACAG | 20617 |
| 4032 | GAUAUCCC G UUAGAAGA | 9056 | UCUUCUAA GCCGAAAGGCGAGUGAGGUCU GGGAUAUC | 20618 |
| 4048 | AACCAGAA G UAAAAGUA | 9058 | UACUUUUA GCCGAAAGGCGAGUGAGGUCU UUCGGUU | 20619 |
| 4054 | AAGUAAAA G UAAUCCCA | 9059 | UGGGAUUA GCCGAAAGGCGAGUGAGGUCU UUUUACUU | 20620 |
| 4082 | GACGGACA G UGGUAUGG | 9066 | CCAUACCA GCCGAAAGGCGAGUGAGGUCU UGUCCGUC | 20621 |
| 4085 | GGACAGUG G UAUGGUUC | 9067 | GAACCAUA GCCGAAAGGCGAGUGAGGUCU CACUGUCC | 20622 |
| 4090 | GUGGUAUG G UUCUUGCC | 9068 | GGCAAGAA GCCGAAAGGCGAGUGAGGUCU CAUACCAC | 20623 |
| 4096 | UGGUUCUU G CCUCAGAA | 9069 | UUCUGAGG GCCGAAAGGCGAGUGAGGUCU AAGAACCA | 20624 |
| 4107 | UCAGAAGA G CUGAAAAC | 9070 | GUUUUCAG GCCGAAAGGCGAGUGAGGUCU UCUUCUGA | 20625 |
| 4151 | AUCUUUUG G UGGAAUGG | 9075 | CCAUUCCA GCCGAAAGGCGAGUGAGGUCU CAAAAGAU | 20626 |
| 4159 | GUGGAAUG G UGCCCAGC | 9077 | GCUGGGCA GCCGAAAGGCGAGUGAGGUCU CAUUCCAC | 20627 |
| 4161 | GGAAUGGU G CCCAGCAA | 9078 | UUGCUGGG GCCGAAAGGCGAGUGAGGUCU ACCAUUCC | 20628 |
| 4166 | GGUGCCCA G CAAAAGCA | 9079 | UGCUUUUG GCCGAAAGGCGAGUGAGGUCU UGGGCACC | 20629 |
| 4172 | CAGCAAAA G CAGGGAGU | 9080 | ACUCCCUG GCCGAAAGGCGAGUGAGGUCU UUUUGCUG | 20630 |
| 4179 | AGCAGGGA G UCUGUGGC | 9081 | GCCACAGA GCCGAAAGGCGAGUGAGGUCU UCCCUGCU | 20631 |
| 4183 | GGGAGUCU G UGGCAUCU | 9082 | AGAUGCCA GCCGAAAGGCGAGUGAGGUCU AGACUCCC | 20632 |
| 4186 | AGUCUGUG G CAUCUGAA | 9083 | UUCAGAUG GCCGAAAGGCGAGUGAGGUCU CACAGACU | 20633 |
| 4196 | AUCUGAAG G CUCAAACC | 9084 | GGUUUGAG GCCGAAAGGCGAGUGAGGUCU CUUCAGAU | 20634 |

TABLE XXIII-continued

Human KDR Ziuzyme and Substrate Sequence

| Pos | Substrate | Seq ID No | Zinzyme | Seq ID No |
|---|---|---|---|---|
| 4211 | CCAGACAA G CGGCUACC | 9087 | GGUAGCCG GCCGAAAGGCGAGUGAGGUCU UUGUCUGG | 20635 |
| 4214 | GACAAGCG G CUACCAGU | 9088 | ACUGGUAG GCCGAAAGGCGAGUGAGGUCU CGCUUGUC | 20636 |
| 4221 | GGCUACCA G UCCGGAUA | 9089 | UAUCCGGA GCCGAAAGGCGAGUGAGGUCU UGGUAGCC | 20637 |
| 4255 | ACACCACC G UGUACUCC | 9094 | GGAGUACA GCCGAAAGGCGAGUGAGGUCU GGUGGUGU | 20638 |
| 4257 | ACCACCGU G UACUCCAG | 9095 | CUGGAGUA GCCGAAAGGCGAGUGAGGUCU ACGGUGGU | 20639 |
| 4265 | GUACUCCA G UGAGGAAG | 9096 | CUUCCUCA GCCGAAAGGCGAGUGAGGUCU UGGAGUAC | 20640 |
| 4273 | GUGAGGAA G CAGAACUU | 9097 | AAGUUCUG GCCGAAAGGCGAGUGAGGUCU UUCCUCAC | 20641 |
| 4287 | CUUUUAAA G CUGAUAGA | 9099 | UCUAUCAG GCCGAAAGGCGAGUGAGGUCU UUUAAAAG | 20642 |
| 4303 | AGAUUGGA G UGCAAACC | 9102 | GGUUUGCA GCCGAAAGGCGAGUGAGGUCU UCCAAUCU | 20643 |
| 4305 | AUUGGAGU G CAAACCGG | 9103 | CCGGUUUG GCCGAAAGGCGAGUGAGGUCU ACUCCAAU | 20644 |
| 4313 | GCAAACCG G UAGCACAG | 9105 | CUGUGCUA GCCGAAAGGCGAGUGAGGUCU CGGUUUGC | 20645 |
| 4316 | AACCGGUA G CACAGCCC | 9106 | GGGCUGUG GCCGAAAGGCGAGUGAGGUCU UACCGGUU | 20646 |
| 4321 | GUAGCACA G CCCAGAUU | 9107 | AAUCUGGG GCCGAAAGGCGAGUGAGGUCU UGUGCUAC | 20647 |
| 4335 | AUUCUCCA G CCUGACUC | 9109 | GAGUCAGG GCCGAAAGGCGAGUGAGGUCU UGGAGAAU | 20648 |
| 4358 | CACACUGA G CUCUCCUC | 9112 | GAGGAGAG GCCGAAAGGCGAGUGAGGUCU UCAGUGUG | 20649 |
| 4369 | CUCCUCCU G UUUAAAAG | 9113 | CUUUUAAA GCCGAAAGGCGAGUGAGGUCU AGGAGGAG | 20650 |
| 4381 | AAAAGGAA G CAUCCACA | 9114 | UGUGGAUG GCCGAAAGGCGAGUGAGGUCU UUCCUUUU | 20651 |
| 4417 | CAUGAGAG G UCUGCUCA | 9117 | UGAGCAGA GCCGAAAGGCGAGUGAGGUCU CUCUCAUG | 20652 |
| 4421 | AGAGGUCU G CUCAGAUU | 9118 | AAUCUGAG GCCGAAAGGCGAGUGAGGUCU AGACCUCU | 20653 |
| 4435 | AUUUUGAA G UGUUGUUC | 9120 | GAACAACA GCCGAAAGGCGAGUGAGGUCU UUCAAAAU | 20654 |
| 4437 | UUUGAAGU G UUGUUCUU | 9121 | AAGAACAA GCCGAAAGGCGAGUGAGGUCU ACUUCAAA | 20655 |
| 4440 | GAAGUGUU G UUCUUUCC | 9122 | GGAAAGAA GCCGAAAGGCGAGUGAGGUCU AACACUUC | 20656 |
| 4453 | UUCCACCA G CAGGAAGU | 9123 | ACUUCCUG GCCGAAAGGCGAGUGAGGUCU UGGUGGAA | 20657 |
| 4460 | AGCAGGAA G UAGCCGCA | 9124 | UGCGGCUA GCCGAAAGGCGAGUGAGGUCU UUCCUGCU | 20658 |
| 4463 | AGGAAGUA G CCGCAUUU | 9125 | AAAUGCGG GCCGAAAGGCGAGUGAGGUCU UACUUCCU | 20659 |
| 4466 | AAGUAGCC G CAUUUGAU | 9126 | AUCAAAUG GCCGAAAGGCGAGUGAGGUCU GGCUACUU | 20660 |
| 4509 | CUCGGACU G CAGGGAGC | 9132 | GCUCCCUG GCCGAAAGGCGAGUGAGGUCU AGUCCGAG | 20661 |
| 4516 | UGCAGGGA G CCAGUCUU | 9133 | AAGACUGG GCCGAAAGGCGAGUGAGGUCU UCCCUGCA | 20662 |
| 4520 | GGGAGCCA G UCUUCUAG | 9134 | CUAGAAGA GCCGAAAGGCGAGUGAGGUCU UGGCUCCC | 20663 |
| 4529 | UCUUCUAG G CAUAUCCU | 9135 | AGGAUAUG GCCGAAAGGCGAGUGAGGUCU CUAGAAGA | 20664 |
| 4545 | UGGAAGAG G CUUGUGAC | 9138 | GUCACAAG GCCGAAAGGCGAGUGAGGUCU CUCUUCCA | 20665 |
| 4549 | AGAGGCUU G UGACCCAA | 9139 | UUGGGUCA GCCGAAAGGCGAGUGAGGUCU AAGCCUCU | 20666 |
| 4562 | CCAAGAAU G UGUCUGUG | 9142 | CACAGACA GCCGAAAGGCGAGUGAGGUCU AUUCUUGG | 20667 |
| 4564 | AAGAAUGU G UCUGUGUC | 9143 | GACACAGA GCCGAAAGGCGAGUGAGGUCU ACAUUCUU | 20668 |
| 4566 | AUGUCUGU G UGUCUUCU | 9144 | AGAAGACA GCCGAAAGGCGAGUGAGGUCU AGACACAU | 20669 |
| 4570 | GUCUGUGU G UCUUCUCC | 9145 | GGAGAAGA GCCGAAAGGCGAGUGAGGUCU ACAGACAC | 20670 |
| 4581 | UUCUCCCA G UGUUGACC | 9146 | GGUCAACA GCCGAAAGGCGAGUGAGGUCU UGGGAGAA | 20671 |

TABLE XXIII-continued

Human KDR Ziuzyme and Substrate Sequence

| Pos | Substrate | Seq ID No | Zinzyme | Seq ID No |
|---|---|---|---|---|
| 4583 | CUCCCAGU G UUGACCUG | 9147 | CAGGUCAA GCCGAAAGGCGAGUGAGGUCU ACUGGGAG | 20672 |
| 4618 | UUUAAAAA G CAUUAUCA | 9152 | UGAUAAUG GCCGAAAGGCGAGUGAGGUCU UUUUUAAA | 20673 |
| 4628 | AUUAUCAU G CCCCUGCU | 9156 | AGCAGGGG GCCGAAAGGCGAGUGAGGUCU AUGAUAAU | 20674 |
| 4634 | AUGCCCCU G CUGCGGGU | 9157 | ACCCGCAG GCCGAAAGGCGAGUGAGGUCU AGGGGCAU | 20675 |
| 4637 | CCCCUGCU G CGGGUCUC | 9158 | GAGACCCG GCCGAAAGGCGAGUGAGGUCU AGCAGGGG | 20676 |
| 4641 | UGCUGCGG G UCUCACCA | 9159 | UGGUGAGA GCCGAAAGGCGAGUGAGGUCU CCGCAGCA | 20677 |
| 4653 | CACCAUGG G UUUAGAAC | 9162 | GUUCUAAA GCCGAAAGGCGAGUGAGGUCU CCAUGGUG | 20678 |
| 4667 | AACAAAGA G CUUCAAGC | 9164 | GCUUGAAG GCCGAAAGGCGAGUGAGGUCU UCUUUGUU | 20679 |
| 4674 | AGCUUCAA G CAAUGGCC | 9165 | GGCCAUUG GCCGAAAGGCGAGUGAGGUCU UUGAAGCU | 20680 |
| 4680 | AAGCAAUG G CCCCAUCC | 9167 | GGAUGGGG GCCGAAAGGCGAGUGAGGUCU CAUUGCUU | 20681 |
| 4697 | UCAAAGAA G UAGCAGUA | 9169 | UACUGCUA GCCGAAAGGCGAGUGAGGUCU UUCUUUGA | 20682 |
| 4700 | AAGAAGUA G CAGUACCU | 9170 | AGGUACUG GCCGAAAGGCGAGUGAGGUCU UACUUCUU | 20683 |
| 4703 | AAGUAGCA G UACCUGGG | 9171 | CCCAGGUA GCCGAAAGGCGAGUGAGGUCU UGCUACUU | 20684 |
| 4714 | CCUGGGGA G CUGACACU | 9173 | AGUGUCAG GCCGAAAGGCGAGUGAGGUCU UCCCCAGG | 20685 |
| 4726 | ACACUUCU G UAAAACUA | 9176 | UAGUUUUA GCCGAAAGGCGAGUGAGGUCU AGAAGUGU | 20686 |
| 4748 | UAAACCAG G CAACGUAA | 9180 | UUACGUUG GCCGAAAGGCGAGUGAGGUCU CUGGUUUA | 20687 |
| 4753 | CAGGCAAC G UAAGUGUU | 9182 | AACACUUA GCCGAAAGGCGAGUGAGGUCU GUUGCCUG | 20688 |
| 4757 | CAACGUAA G UGUUCGAG | 9183 | CUCGAACA GCCGAAAGGCGAGUGAGGUCU UUACGUUG | 20689 |
| 4759 | ACGUAAGU G UUCGAGGU | 9184 | ACCUCGAA GCCGAAAGGCGAGUGAGGUCU ACUUACGU | 20690 |
| 4766 | UGUUCGAG G UGUUGAAG | 9185 | CUUCAACA GCCGAAAGGCGAGUGAGGUCU CUCGAACA | 20691 |
| 4768 | UUCGAGGU G UUGAAGAU | 9186 | AUCUUCAA GCCGAAAGGCGAGUGAGGUCU ACCUCGAA | 20692 |
| 4788 | AAGGAUUU G CAGGGCUG | 9189 | CAGCCCUG GCCGAAAGGCGAGUGAGGUCU AAAUCCUU | 20693 |
| 4793 | UUUGCAGG G CUGAGUCU | 9190 | AGACUCAG GCCGAAAGGCGAGUGAGGUCU CCUGCAAA | 20694 |
| 4798 | AGGGCUGA G UCUAUCCA | 9191 | UGGAUAGA GCCGAAAGGCGAGUGAGGUCU UCAGCCCU | 20695 |
| 4811 | UCCAAGAG G CUUUGUUU | 9193 | AAACAAAG GCCGAAAGGCGAGUGAGGUCU CUCUUGGA | 20696 |
| 4816 | GAGGCUUU G UUUAGGAC | 9194 | GUCCUAAA GCCGAAAGGCGAGUGAGGUCU AAAGCCUC | 20697 |
| 4825 | UUEUGGAC G UGGGUCCC | 9196 | GGGACCCA GCCGAAAGGCGAGUGAGGUCU GUCCUAAA | 20698 |
| 4829 | GGACGUGG G UCCCAAGC | 9197 | GCUUGGGA GCCGAAAGGCGAGUGAGGUCU CCACGUCC | 20699 |
| 4836 | GGUCCCAA G CCAAGCCU | 9198 | AGGCUUGG GCCGAAAGGCGAGUGAGGUCU UUGGGACC | 20700 |
| 4841 | CAAGCCAA G CCUUAAGU | 9199 | ACUUAAGG GCCGAAAGGCGAGUGAGGUCU UUGGCUUG | 20701 |
| 4848 | AGCCUUAA G UGGAAUU | 9200 | AUUCCACA GCCGAAAGGCGAGUGAGGUCU UUAAGGCU | 20702 |
| 4850 | CCUUAAGU G UGGAAUUC | 9201 | GAAUUCCA GCCGAAAGGCGAGUGAGGUCU ACUUAAGG | 20703 |
| 4883 | AGACUAAC G UUACCUUG | 9207 | CAAGGUAA GCCGAAAGGCGAGUGAGGUCU GUUAGUCU | 20704 |
| 4891 | GUUACCUU G CUUUGGAG | 9209 | CUCCAAAG GCCGAAAGGCGAGUGAGGUCU AAGGUAAC | 20705 |
| 4901 | UUUGGAGA G UACUGGAG | 9210 | CUCCAGUA GCCGAAAGGCGAGUGAGGUCU UCUCCAAA | 20706 |
| 4909 | GUACUGGA G CCUGCAAA | 9212 | UUUGCAGG GCCGAAAGGCGAGUGAGGUCU UCCAGUAC | 20707 |
| 4913 | UGGAGCCU G CAAAUGCA | 9213 | UGCAUUUG GCCGAAAGGCGAGUGAGGUCU AGGCUCCA | 20708 |

TABLE XXIII-continued

Human KDR Ziuzyme and Substrate Sequence

| Pos | Substrate | Seq ID No | Zinzyme | Seq ID No |
|---|---|---|---|---|
| 4919 | CUGCAAAU G CAUUGUGU | 9215 | ACACAAUG GCCGAAAGGCGAGUGAGGUCU AUUUGCAG | 20709 |
| 4924 | AAUGCAUU G UGUUUGCU | 9217 | AGCAAACA GCCGAAAGGCGAGUGAGGUCU AAUGCAUU | 20710 |
| 4926 | UGCAUUGU G UUUGCUCU | 9218 | AGAGCAAA GCCGAAAGGCGAGUGAGGUCU ACAAUGCA | 20711 |
| 4930 | UUGUGUUU G CUCUGGUG | 9219 | CACCAGAG GCCGAAAGGCGAGUGAGGUCU AAACACAA | 20712 |
| 4936 | UUGCUCUG G UGGAGGUG | 9220 | CACCUCCA GCCGAAAGGCGAGUGAGGUCU CAGAGCAA | 20713 |
| 4942 | UGGUGGAG G UGGGCAUG | 9221 | CAUGCCCA GCCGAAAGGCGAGUGAGGUCU CUCCACCA | 20714 |
| 4946 | GGAGGUGG G CAUGGGGU | 9222 | ACCCCAUG GCCGAAAGGCGAGUGAGGUCU CCACCUCC | 20715 |
| 4953 | GGCAUGGG G UCUGUUCU | 9224 | AGAACAGA GCCGAAAGGCGAGUGAGGUCU CCCAUGCC | 20716 |
| 4957 | UGGGGUCU G UUCUGAAA | 9225 | UUUCAGAA GCCGAAAGGCGAGUGAGGUCU AGACCCCA | 20717 |
| 4967 | UCUGAAAU G UAAAGGGU | 9227 | ACCCUUUA GCCGAAAGGCGAGUGAGGUCU AUUUCAGA | 20718 |
| 4974 | UGUAAAGG G UUCAGACG | 9228 | CGUCUGAA GCCGAAAGGCGAGUGAGGUCU CCUUUACA | 20719 |
| 4985 | CAGACGGG G UUUCUGGU | 9230 | ACCAGAAA GCCGAAAGGCGAGUGAGGUCU CCCGUCUG | 20720 |
| 4992 | GGUUUCUG G UUUUAGAA | 9231 | UUCUAAAA GCCGAAAGGCGAGUGAGGUCU CAGAAACC | 20721 |
| 5002 | UUUAGAAG G UUGCGUGU | 9232 | ACACGCAA GCCGAAAGGCGAGUGAGGUCU CUUCUAAA | 20722 |
| 5005 | AGAAGGUU G CGUGUUCU | 9233 | AGAACACG GCCGAAAGGCGAGUGAGGUCU AACCUUCU | 20723 |
| 5007 | AAGGUUGC G UGUUCUUC | 9234 | GAAGAACA GCCGAAAGGCGAGUGAGGUCU GCAACCUU | 20724 |
| 5009 | GGUUGCGU G UUCUUCGA | 9235 | UCGAAGAA GCCGAAAGGCGAGUGAGGUCU ACGCAACC | 20725 |
| 5018 | UUCUUCGA G UUGGGCUA | 9236 | UACCCCAA GCCGAAAGGCGAGUGAGGUCU UCGAAGAA | 20726 |
| 5023 | CGAGUUGG G CUAAAGUA | 9237 | UACUUUAG GCCGAAAGGCGAGUGAGGUCU CCAACUCG | 20727 |
| 5029 | GGGCUAAA G UAGAGUUC | 9238 | GAACUCUA GCCGAAAGGCGAGUGAGGUCU UUUAGCCC | 20728 |
| 5034 | AAAGUAGA G UUCGUUGU | 9239 | ACAACGAA GCCGAAAGGCGAGUGAGGUCU UCUACUUU | 20729 |
| 5038 | UAGAGUUC G UUGUGCUG | 9240 | CAGCACAA GCCGAAAGGCGAGUGAGGUCU GAACUCUA | 20730 |
| 5041 | AGUUCGUU G UGCUGUUU | 9241 | AAACAGCA GCCGAAAGGCGAGUGAGGUCU AACGAACU | 20731 |
| 5043 | UUCGUUGU G CUGUUUCU | 9242 | AGAAACAG GCCGAAAGGCGAGUGAGGUCU ACAACGAA | 20732 |
| 5046 | GUUGUGCU G UUUCUGAC | 9243 | GUCAGAAA GCCGAAAGGCGAGUGAGGUCU AGCACAAC | 20733 |
| 5066 | UAAUGAGA G UUCCUUCC | 9246 | GGAAGGAA GCCGAAAGGCGAGUGAGGUCU UCUCAUUA | 20734 |
| 5080 | UCCAGACC G UUAGCUGU | 9248 | ACAGCUAA GCCGAAAGGCGAGUGAGGUCU GGUCUGGA | 20735 |
| 5084 | GACCGUUA G CUGUCUCC | 9249 | GGAGACAG GCCGAAAGGCGAGUGAGGUCU UAACGGUC | 20736 |
| 5087 | CGUUAGCU G UCUCCUUG | 9250 | CAAGGAGA GCCGAAAGGCGAGUGAGGUCU AGCUAACG | 20737 |
| 5095 | GUCUCCUU G CCAAGCCC | 9251 | GGGCUUGG GCCGAAAGGCGAGUGAGGUCU AAGGAGAC | 20738 |
| 5100 | CUUGCCAA G CCCCAGGA | 9252 | UCCUGGGG GCCGAAAGGCGAGUGAGGUCU UUGGCAAG | 20739 |
| 5119 | AAAAUGAU G CAGCUCUG | 9255 | CAGAGCUG GCCGAAAGGCGAGUGAGGUCU AUCAUUUU | 20740 |
| 5122 | AUGAUGCA G CUCUGGCU | 9256 | AGCCAGAG GCCGAAAGGCGAGUGAGGUCU UGCAUCAU | 20741 |
| 5128 | CAGCUCUG G CUCCUUGU | 9257 | ACAAGGAG GCCGAAAGGCGAGUGAGGUCU CAGAGCUG | 20742 |
| 5135 | GGCUCCUU G UCUCCCAG | 9258 | CUGGGAGA GCCGAAAGGCGAGUGAGGUCU AAGGAGCC | 20743 |
| 5144 | UCUCCCAG G CUGAUCCU | 9259 | AGGAUCAG GCCGAAAGGCGAGUGAGGUCU CUGGGAGA | 20744 |
| 5185 | GACAUUCA G CUCAAGGC | 9267 | GCCUUGAG GCCGAAAGGCGAGUGAGGUCU UGAAUGUC | 20745 |

TABLE XXIII-continued

Human KDR Ziuzyme and Substrate Sequence

| Pos | Substrate | Seq ID No | Zinzyme | Seq ID No |
|---|---|---|---|---|
| 5192 | AGCUCAAG G CUCCCUGC | 9268 | GCAGGGAG GCCGAAAGGCGAGUGAGGUCU CUUGAGCU | 20746 |
| 5199 | GGCUCCCU G CCGUGUUG | 9269 | CAACACGG GCCGAAAGGCGAGUGAGGUCU AGGGAGCC | 20747 |
| 5202 | UCCCUGCC G UGUUGAAG | 9270 | CUUCAACA GCCGAAAGGCGAGUGAGGUCU GGCAGGGA | 20748 |
| 5204 | CCUGCCGU G UUGAAGAG | 9271 | CUCUUCAA GCCGAAAGGCGAGUGAGGUCU ACGGCAGG | 20749 |
| 5212 | GUUGAAGA G UUCUGACU | 9272 | AGUCAGAA GCCGAAAGGCGAGUGAGGUCU UCUUCAAC | 20750 |
| 5221 | UUCUGACU G CACAAACC | 9274 | GGUUUGUG GCCGAAAGGCGAGUGAGGUCU AGUCAGAA | 20751 |
| 5231 | ACAAACCA G CUUCUGGU | 9277 | ACCAGAAG GCCGAAAGGCGAGUGAGGUCU UGGUUUGU | 20752 |
| 5238 | AGCUUCUG G UUUCUUCU | 9278 | AGAAGAAA GCCGAAAGGCGAGUGAGGUCU CAGAAGCU | 20753 |
| 5268 | UCAUAUCU G UCCUGAUG | 9284 | CAUCAGGA GCCGAAAGGCGAGUGAGGUCU AGAUAUGA | 20754 |
| 5276 | GUCCUGAU G UGAUAUGU | 9286 | ACAUAUCA GCCGAAAGGCGAGUGAGGUCU AUCAGGAC | 20755 |
| 5283 | UGUGAUAU G UCUGAGAC | 9289 | GUCUCAGA GCCGAAAGGCGAGUGAGGUCU AUAUCACA | 20756 |
| 5297 | GACUGAAU G CGGGAGGU | 9292 | ACCUCCCG GCCGAAAGGCGAGUGAGGUCU AUUCAGUC | 20757 |
| 5304 | UGCGGGAG G UUCAAUGU | 9293 | ACAUUGAA GCCGAAAGGCGAGUGAGGUCU CUCCCGCA | 20758 |
| 5311 | GGUUCAAU G UGAAGCUG | 9295 | CAGCUUCA GCCGAAAGGCGAGUGAGGUCU AUUGAACC | 20759 |
| 5316 | AAUGUGAA G CUGUGUGU | 9296 | ACACACAG GCCGAAAGGCGAGUGAGGUCU UUCACAUU | 20760 |
| 5319 | GUGAAGCU G UGUGGGU | 9297 | ACCACACA GCCGAAAGGCGAGUGAGGUCU AGCUUCAC | 20761 |
| 5321 | GAAGCUGU G UGGGUGU | 9298 | ACACCACA GCCGAAAGGCGAGUGAGGUCU ACAGCUUC | 20762 |
| 5323 | AGCUGUGU G UGGGUCA | 9299 | UGACACCA GCCGAAAGGCGAGUGAGGUCU ACACAGCU | 20763 |
| 5326 | UGUGUGUG G UGUCAAAG | 9300 | CUUUGACA GCCGAAAGGCGAGUGAGGUCU CACACACA | 20764 |
| 5329 | UGUGUGGU G UCAAAGUU | 9301 | AACUUUGA GCCGAAAGGCGAGUGAGGUCU ACCACACA | 20765 |
| 5334 | GUGUCAAA G UUUCAGGA | 9302 | UCCUGAAA GCCGAAAGGCGAGUGAGGUCU UUUGACAC | 20766 |
| 5359 | ACCCUUUU G UUCUUCCC | 9305 | GGGAAGAA GCCGAAAGGCGAGUGAGGUCU AAAAGGGU | 20767 |
| 5371 | UUCCCCCU G UCCCCAAC | 9306 | GUUGGGGA GCCGAAAGGCGAGUGAGGUCU AGGGGAA | 20768 |
| 5393 | CUCACCCC G CAACCCAU | 9310 | AUGGGUUG GCCGAAAGGCGAGUGAGGUCU GGGGUGAG | 20769 |
| 5404 | ACCCAUCA G UAUUUUAG | 9313 | CUAAAAUA GCCGAAAGGCGAGUGAGGUCU UGAUGGGU | 20770 |
| 5412 | GUAUUUUA G UUAUUUGG | 9315 | CCAAAUAA GCCGAAAGGCGAGUGAGGUCU UAAAAUAC | 20771 |
| 5420 | GUUAUUUG G CCUCUACU | 9317 | AGUAGAGG GCCGAAAGGCGAGUGAGGUCU CAAAUAAC | 20772 |
| 5432 | CUACUCCA G UAAACCUG | 9319 | CAGGUUUA GCCGAAAGGCGAGUGAGGUCU UGGAGUAG | 20773 |
| 5446 | CUGAUUGG G UUUGUUCA | 9322 | UGAACAAA GCCGAAAGGCGAGUGAGGUCU CCAAUCAG | 20774 |
| 5450 | UUGGGUUU G UUCACUCU | 9323 | AGAGUGAA GCCGAAAGGCGAGUGAGGUCU AAACCCAA | 20775 |
| 5473 | GAUUAUUA G CCAGACUU | 9326 | AAGUCUGG GCCGAAAGGCGAGUGAGGUCU UAAUAAUC | 20776 |
| 5497 | AUUUUAUA G CCCAAAUU | 9333 | AAUUUGGG GCCGAAAGGCGAGUGAGGUCU UAUAAAAU | 20777 |
| 5518 | CAUCUAUU G UAUUAUUU | 9339 | AAAUAAUA GCCGAAAGGCGAGUGAGGUCU AAUAGAUG | 20778 |
| 5545 | CAUAUAGA G CUAUUUCU | 9346 | AGAAAUAG GCCGAAAGGCGAGUGAGGUCU UCUAUAUG | 20779 |
| 5564 | UGAUUUUU G CCCUUGUU | 9350 | AACAAGGG GCCGAAAGGCGAGUGAGGUCU AAAAAUCA | 20780 |
| 5570 | UUGCCCUU G UUCUGUCC | 9351 | GGACAGAA GCCGAAAGGCGAGUGAGGUCU AAGGGCAA | 20781 |
| 5575 | CUUGUUCU G UCCUUUUU | 9352 | AAAAAGGA GCCGAAAGGCGAGUGAGGUCU AGAACAAG | 20782 |

TABLE XXIII-continued

Human KDR Ziuzyme and Substrate Sequence

| Pos | Substrate | Seq ID No | Zinzyme | Seq ID No |
|---|---|---|---|---|
| 5599 | AAGAAAAU G UGUUUUUU | 9354 | AAAAAACA GCCGAAAGGCGAGUGAGGUCU AUUUUCUU | 20783 |
| 5601 | GAAAAUGU G UUUUUUGU | 9355 | ACAAAAAA GCCGAAAGGCGAGUGAGGUCU ACAUUUUC | 20784 |
| 5608 | UGUUUUUU G UUUGGUAC | 9356 | GUACCAAA GCCGAAAGGCGAGUGAGGUCU AAAAAACA | 20785 |
| 5613 | UUUGUUUG G UACCAUAG | 9357 | CUAUGGUA GCCGAAAGGCGAGUGAGGUCU CAAACAAA | 20786 |
| 5621 | GUACCAUA G UGUGAAAU | 9360 | AUUUCACA GCCGAAAGGCGAGUGAGGUCU UAUGGUAC | 20787 |
| 5623 | ACCAUAGU G UGAAAUGC | 9361 | GCAUUUCA GCCGAAAGGCGAGUGAGGUCU ACUAUGGU | 20788 |
| 5630 | UGUGAAAU G CUGGGAAC | 9363 | GUUCCCAG GCCGAAAGGCGAGUGAGGUCU AUUUCACA | 20789 |
| 5655 | UAAGACAU G CUAUGGCA | 9370 | UGCCAUAG GCCGAAAGGCGAGUGAGGUCU AUGUCUCA | 20790 |
| 5661 | AUGCUAUG G CACAUAUA | 9372 | UAUAUGUG GCCGAAAGGCGAGUGAGGUCU CAUAGCAU | 20791 |
| 5676 | UAUUUAUA G UCUGUCCA | 9378 | UAAACAGA GCCGAAAGGCGAGUGAGGUCU UAUAAAUA | 20792 |
| 5680 | UAUAGUCU G UUUAUGUA | 9379 | UACAUAAA GCCGAAAGGCGAGUGAGGUCU AGACUAUA | 20793 |
| 5686 | CUGUUUAU G UAGAAACA | 9381 | UGUUUCUA GCCGAAAGGCGAGUGAGGUCU AUAAACAG | 20794 |
| 5698 | AAACAAAU G UAAUAUAU | 9384 | AUAUAUUA GCCGAAAGGCGAGUGAGGUCU AUUUGUUU | 20795 |
| 5711 | AUAUUAAA G CCUUAUAU | 9388 | AUAUAAGG GCCGAAAGGCGAGUGAGGUCU UUUAAUAU | 20796 |
| 5732 | UGAACUUU G UACUAUUC | 9394 | GAAUAGUA GCCGAAAGGCGAGUGAGGUCU AAAGUUCA | 20797 |
| 5748 | CACAUUUU G UAUCAGUA | 9399 | UACUGAUA GCCGAAAGGCGAGUGAGGUCU AAAAUGUG | 20798 |
| 5754 | UUGUAUCA G UAUUAUGU | 9401 | ACAUAAUA GCCGAAAGGCGAGUGAGGUCU UGAUACAA | 20799 |
| 5761 | AGUAUUAU G UAGCAUAA | 9404 | UUAUGCUA GCCGAAAGGCGAGUGAGGUCU AUAAUACU | 20800 |
| 5764 | AUUAUGUA G CAUAACAA | 9405 | UUGUUAUG GCCGAAAGGCGAGUGAGGUCU UACAUAAU | 20801 |
| 5775 | UAACAAAG G UCAUAAUG | 9408 | CAUUAUGA GCCGAAAGGCGAGUGAGGUCU CUUUGUUA | 20802 |
| 5783 | GUCAUAAU G CUUUCAGC | 9411 | GCUGAAAG GCCGAAAGGCGAGUGAGGUCU AUCAUGAC | 20803 |
| 5790 | UGCUUUCA G CAAUUGAU | 9412 | AUCAAUUG GCCGAAAGGCGAGUGAGGUCU UGAAAGCA | 20804 |
| 5799 | CAAUUGAU G UCAUUUUA | 9415 | UAAAAUGA GCCGAAAGGCGAGUGAGGUCU AUCAAUUG | 20805 |

Input Sequence = AF035121.
Cut Site = G/Y
Arm Length = 8.
Core Sequence = GCcgaaagGCGaGuCaaGGuCu (SEQ ID NO. 20829).
AF035121 (*Homo sapiens* KDR/flk-1 protein mRNA, complete cds.; Acc# AF035121; 5830 bp)

SEQUENCE LISTING (20829 sequences)

SEQ ID NO: 1 - RNA, 17 nt, Homo sapiens
cggacacuccucucggc

SEQ ID NO: 2 - RNA, 17 nt, Homo sapiens
acacuccucucggcucc

SEQ ID NO: 3 - RNA, 17 nt, Homo sapiens
acuccucucggcuccuc

SEQ ID NO: 4 - RNA, 17 nt, Homo sapiens
ucucggcuccuccccgg

SEQ ID NO: 5 - RNA, 17 nt, Homo sapiens
cggcuccuccccggcag

SEQ ID NO: 6 - RNA, 17 nt, Homo sapiens
cggcggcucggagcggg

SEQ ID NO: 7 - RNA, 17 nt, Homo sapiens
agcgggcuccggggcuc

SEQ ID NO: 8 - RNA, 17 nt, Homo sapiens
ccggggcucgggugcag

SEQ ID NO: 9 - RNA, 17 nt, Homo sapiens
gcgaggauuacccgggg

SEQ ID NO: 10 - RNA, 17 nt, Homo sapiens
cgaggauuacccgggga

SEQ ID NO: 11 - RNA, 17 nt, Homo sapiens
gaagugguugucuccug

SEQ ID NO: 12 - RNA, 17 nt, Homo sapiens
gugguugucuccuggcu

SEQ ID NO: 13 - RNA, 17 nt, Homo sapiens
gguugucuccuggcugg

SEQ ID NO: 14 - RNA, 17 nt, Homo sapiens
cgggcgcucagggcgcg

SEQ ID NO: 15 - RNA, 17 nt, Homo sapiens
gacggacucuggcggcc

SEQ ID NO: 16 - RNA, 17 nt, Homo sapiens
ggccgggucguuggccg

SEQ ID NO: 17 - RNA, 17 nt, Homo sapiens
cgggucguuggccgggg

SEQ ID NO: 18 - RNA, 17 nt, Homo sapiens
ggccgcgucgcgcucac

SEQ ID NO: 19 - RNA, 17 nt, Homo sapiens
gucgcgcucaccauggu

SEQ ID NO: 20 - RNA, 17 nt, Homo sapiens
accauggucagcuacug

SEQ ID NO: 21 - RNA, 17 nt, Homo sapiens
ggucagcuacugggaca

SEQ ID NO: 22 - RNA, 17 nt, Homo sapiens
accgggguccugcugug

SEQ ID NO: 23 - RNA, 17 nt, Homo sapiens
gcgcugcucagcugucu

SEQ ID NO: 24 - RNA, 17 nt, Homo sapiens
ucagcugucugcuucuc

SEQ ID NO: 25 - RNA, 17 nt, Homo sapiens
ugucugcuucucacagg

SEQ ID NO: 26 - RNA, 17 nt, Homo sapiens
gucugcuucucacagga

SEQ ID NO: 27 - RNA, 17 nt, Homo sapiens
cugcuucucacaggauc

SEQ ID NO: 28 - RNA, 17 nt, Homo sapiens
cacaggaucuaguucag

SEQ ID NO: 29 - RNA, 17 nt, Homo sapiens
caggaucuaguucaggu

SEQ ID NO: 30 - RNA, 17 nt, Homo sapiens
gaucuaguucagguuca

SEQ ID NO: 31 - RNA, 17 nt, Homo sapiens
aucuaguucagguucaa

SEQ ID NO: 32 - RNA, 17 nt, Homo sapiens
guucagguucaaaauua

SEQ ID NO: 33 - RNA, 17 nt, Homo sapiens
uucagguucaaaauuaa

SEQ ID NO: 34 - RNA, 17 nt, Homo sapiens
uucaaaauuaaaagauc

SEQ ID NO: 35 - RNA, 17 nt, Homo sapiens
ucaaaauuaaaagaucc

SEQ ID NO: 36 - RNA, 17 nt, Homo sapiens
uaaaagauccugaacug

SEQ ID NO: 37 - RNA, 17 nt, Homo sapiens
aacugaguuuaaaaggc

SEQ ID NO: 38 - RNA, 17 nt, Homo sapiens
acugaguuuaaaaggca

SEQ ID NO: 39 - RNA, 17 nt, Homo sapiens
cugaguuuaaaaggcac

SEQ ID NO: 40 - RNA, 17 nt, Homo sapiens
cagcacaucaugcaagc

SEQ ID NO: 41 - RNA, 17 nt, Homo sapiens
cacugcaucuccaaugc

SEQ ID NO: 42 - RNA, 17 nt, Homo sapiens
cugcaucuccaaugcag

SEQ ID NO: 43 - RNA, 17 nt, Homo sapiens
cagcccauaaauggucu

SEQ ID NO: 44 - RNA, 17 nt, Homo sapiens
uaaauggucuuugccug

SEQ ID NO: 45 - RNA, 17 nt, Homo sapiens
aauggucuuugccugaa

SEQ ID NO: 46 - RNA, 17 nt, Homo sapiens
auggucuuugccugaaa

SEQ ID NO: 47 - RNA, 17 nt, Homo sapiens
uggugaguaaggaaagc

SEQ ID NO: 48 - RNA, 17 nt, Homo sapiens
cugagcauaacuaaauc

SEQ ID NO: 49 - RNA, 17 nt, Homo sapiens
gcauaacuaaaucugcc

SEQ ID NO: 50 - RNA, 17 nt, Homo sapiens
aacuaaaucugccugug

SEQ ID NO: 51 - RNA, 17 nt, Homo sapiens
caaacaauucugcagua

SEQ ID NO: 52 - RNA, 17 nt, Homo sapiens
aaacaauucugcaguac

SEQ ID NO: 53 - RNA, 17 nt, Homo sapiens
ucugcaguacuuuaacc

SEQ ID NO: 54 - RNA, 17 nt, Homo sapiens
gcaguacuuuaaccuug

SEQ ID NO: 55 - RNA, 17 nt, Homo sapiens
caguacuuuaaccuuga

SEQ ID NO: 56 - RNA, 17 nt, Homo sapiens
aguacuuuaaccuugaa

SEQ ID NO: 57 - RNA, 17 nt, Homo sapiens
uuuaaccuugaacacag

SEQ ID NO: 58 - RNA, 17 nt, Homo sapiens
acacagcucaagcaaac

SEQ ID NO: 59 - RNA, 17 nt, Homo sapiens
cacuggcuucuacagcu

SEQ ID NO: 60 - RNA, 17 nt, Homo sapiens
acuggcuucuacagcug

SEQ ID NO: 61 - RNA, 17 nt, Homo sapiens
uggcuucuacagcugca

SEQ ID NO: 62 - RNA, 17 nt, Homo sapiens
cugcaaauaucuagcug

SEQ ID NO: 63 - RNA, 17 nt, Homo sapiens
gcaaauaucuagcugua

SEQ ID NO: 64 - RNA, 17 nt, Homo sapiens
aaauaucuagcuguacc

SEQ ID NO: 65 - RNA, 17 nt, Homo sapiens
cuagcuguaccuacuuc

SEQ ID NO: 66 - RNA, 17 nt, Homo sapiens
cuguaccuacuucaaag

SEQ ID NO: 67 - RNA, 17 nt, Homo sapiens
uaccuacuucaaagaag

SEQ ID NO: 68 - RNA, 17 nt, Homo sapiens
accuacuucaaagaaga

SEQ ID NO: 69 - RNA, 17 nt, Homo sapiens
aacagaaucugcaaucu

SEQ ID NO: 70 - RNA, 17 nt, Homo sapiens
ucugcaaucuauauauu

SEQ ID NO: 71 - RNA, 17 nt, Homo sapiens
ugcaaucuauauauuua

SEQ ID NO: 72 - RNA, 17 nt, Homo sapiens
caaucuauauauuuauu

SEQ ID NO: 73 - RNA, 17 nt, Homo sapiens
aucuauauauuuauuag

SEQ ID NO: 74 - RNA, 17 nt, Homo sapiens
cuauauauuuauuagug

SEQ ID NO: 75 - RNA, 17 nt, Homo sapiens
uauauauuuauuaguga

SEQ ID NO: 76 - RNA, 17 nt, Homo sapiens
auauauuuauuagugau

SEQ ID NO: 77 - RNA, 17 nt, Homo sapiens
auauuuauuagugauac

SEQ ID NO: 78 - RNA, 17 nt, Homo sapiens
uauuuauuagugauaca

SEQ ID NO: 79 - RNA, 17 nt, Homo sapiens
uuagugauacagguaga

SEQ ID NO: 80 - RNA, 17 nt, Homo sapiens
auacagguagaccuuuc

SEQ ID NO: 81 - RNA, 17 nt, Homo sapiens
guagaccuuucguagag

SEQ ID NO: 82 - RNA, 17 nt, Homo sapiens
uagaccuuucguagaga

SEQ ID NO: 83 - RNA, 17 nt, Homo sapiens
agaccuuucguagagau

SEQ ID NO: 84 - RNA, 17 nt, Homo sapiens
ccuuucguagagaugua

SEQ ID NO: 85 - RNA, 17 nt, Homo sapiens
agagauguacagugaaa

SEQ ID NO: 86 - RNA, 17 nt, Homo sapiens
agugaaauccccgaaau

SEQ ID NO: 87 - RNA, 17 nt, Homo sapiens
cccgaaauuauacacau

SEQ ID NO: 88 - RNA, 17 nt, Homo sapiens
ccgaaauuauacacaug

SEQ ID NO: 89 - RNA, 17 nt, Homo sapiens
gaaauuauacacaugac

SEQ ID NO: 90 - RNA, 17 nt, Homo sapiens
agggagcucgucauucc

SEQ ID NO: 91 - RNA, 17 nt, Homo sapiens
gagcucgucauucccug

SEQ ID NO: 92 - RNA, 17 nt, Homo sapiens
cucgucauucccugccg

SEQ ID NO: 93 - RNA, 17 nt, Homo sapiens
ucgucauucccugccgg

SEQ ID NO: 94 - RNA, 17 nt, Homo sapiens
ugccggguuacgucacc

SEQ ID NO: 95 - RNA, 17 nt, Homo sapiens
gccggguuacgucaccu

SEQ ID NO: 96 - RNA, 17 nt, Homo sapiens
gguuacgucaccuaaca

SEQ ID NO: 97 - RNA, 17 nt, Homo sapiens
cgucaccuaacaucacu

SEQ ID NO: 98 - RNA, 17 nt, Homo sapiens
ccuaacaucacuguuac

SEQ ID NO: 99 - RNA, 17 nt, Homo sapiens
aucacuguuacuuuaaa

SEQ ID NO: 100 - RNA, 17 nt, Homo sapiens
ucacuguuacuuuaaaa

SEQ ID NO: 101 - RNA, 17 nt, Homo sapiens
cuguuacuuuaaaaaag

SEQ ID NO: 102 - RNA, 17 nt, Homo sapiens
uguuacuuuaaaaaagu

SEQ ID NO: 103 - RNA, 17 nt, Homo sapiens
guuacuuuaaaaaaguu

SEQ ID NO: 104 - RNA, 17 nt, Homo sapiens
aaaaaaguuuccacuug

SEQ ID NO: 105 - RNA, 17 nt, Homo sapiens
aaaaaguuuccacuuga

SEQ ID NO: 106 - RNA, 17 nt, Homo sapiens
aaaaguuuccacuugac

SEQ ID NO: 107 - RNA, 17 nt, Homo sapiens
uuuccacuugacacuuu

SEQ ID NO: 108 - RNA, 17 nt, Homo sapiens
uugacacuuugaucccu

SEQ ID NO: 109 - RNA, 17 nt, Homo sapiens
ugacacuuugaucccug

SEQ ID NO: 110 - RNA, 17 nt, Homo sapiens
acuuugaucccugaugg

SEQ ID NO: 111 - RNA, 17 nt, Homo sapiens
aaacgcauaaucuggga

SEQ ID NO: 112 - RNA, 17 nt, Homo sapiens
cgcauaaucugggacag

SEQ ID NO: 113 - RNA, 17 nt, Homo sapiens
gggacaguagaaagggc

SEQ ID NO: 114 - RNA, 17 nt, Homo sapiens
aaagggcuucaucauau

SEQ ID NO: 115 - RNA, 17 nt, Homo sapiens
aagggcuucaucauauc

SEQ ID NO: 116 - RNA, 17 nt, Homo sapiens
ggcuucaucauaucaaa

SEQ ID NO: 117 - RNA, 17 nt, Homo sapiens
uucaucauaucaaaugc

SEQ ID NO: 118 - RNA, 17 nt, Homo sapiens
caucauaucaaaugcaa

SEQ ID NO: 119 - RNA, 17 nt, Homo sapiens
ugcaacguacaaagaaa

SEQ ID NO: 120 - RNA, 17 nt, Homo sapiens
aaagaaauagggcuucu

SEQ ID NO: 121 - RNA, 17 nt, Homo sapiens
auagggcuucugaccug

SEQ ID NO: 122 - RNA, 17 nt, Homo sapiens
uagggcuucugaccugu

SEQ ID NO: 123 - RNA, 17 nt, Homo sapiens
gcaacagucaaugggca

SEQ ID NO: 124 - RNA, 17 nt, Homo sapiens
augggcauuuguauaag

SEQ ID NO: 125 - RNA, 17 nt, Homo sapiens
ugggcauuuguauaaga

SEQ ID NO: 126 - RNA, 17 nt, Homo sapiens
gcauuuguauaagacaa

SEQ ID NO: 127 - RNA, 17 nt, Homo sapiens
auuuguauaagacaaac

SEQ ID NO: 128 - RNA, 17 nt, Homo sapiens
gacaaacuaucucacac

SEQ ID NO: 129 - RNA, 17 nt, Homo sapiens
caaacuaucucacacau

SEQ ID NO: 130 - RNA, 17 nt, Homo sapiens
aacuaucucacacaucg

SEQ ID NO: 131 - RNA, 17 nt, Homo sapiens
ucacacaucgacaaacc

SEQ ID NO: 132 - RNA, 17 nt, Homo sapiens
aaaccaauacaaucaua

SEQ ID NO: 133 - RNA, 17 nt, Homo sapiens
aauacaaucauagaugu

SEQ ID NO: 134 - RNA, 17 nt, Homo sapiens
acaaucauagaugucca

SEQ ID NO: 135 - RNA, 17 nt, Homo sapiens
auagauguccaaauaag

SEQ ID NO: 136 - RNA, 17 nt, Homo sapiens
guccaaauaagcacacc

SEQ ID NO: 137 - RNA, 17 nt, Homo sapiens
cgcccagucaaauuacu

SEQ ID NO: 138 - RNA, 17 nt, Homo sapiens
agucaaauuacuuagag

SEQ ID NO: 139 - RNA, 17 nt, Homo sapiens
gucaaauuacuuagagg

SEQ ID NO: 140 - RNA, 17 nt, Homo sapiens
aaauuacuuagaggcca

SEQ ID NO: 141 - RNA, 17 nt, Homo sapiens
aauuacuuagaggccau

SEQ ID NO: 142 - RNA, 17 nt, Homo sapiens
gaggccauacucuuguc

SEQ ID NO: 143 - RNA, 17 nt, Homo sapiens
gccauacucuuguccuc

SEQ ID NO: 144 - RNA, 17 nt, Homo sapiens
cauacucuuguccucaa

SEQ ID NO: 145 - RNA, 17 nt, Homo sapiens
acucuuguccucaauug

SEQ ID NO: 146 - RNA, 17 nt, Homo sapiens
cuuguccucaauuguac

SEQ ID NO: 147 - RNA, 17 nt, Homo sapiens
uccucaauuguacugcu

SEQ ID NO: 148 - RNA, 17 nt, Homo sapiens
ucaauuguacugcuacc

SEQ ID NO: 149 - RNA, 17 nt, Homo sapiens
guacugcuaccacuccc

SEQ ID NO: 150 - RNA, 17 nt, Homo sapiens
cuaccacucccuugaac

SEQ ID NO: 151 - RNA, 17 nt, Homo sapiens
cacucccuugaacacga

SEQ ID NO: 152 - RNA, 17 nt, Homo sapiens
acgagaguucaaaugac

SEQ ID NO: 153 - RNA, 17 nt, Homo sapiens
cgagaguucaaaugacc

SEQ ID NO: 154 - RNA, 17 nt, Homo sapiens
ccuggaguuacccugau

SEQ ID NO: 155 - RNA, 17 nt, Homo sapiens
cuggaguuacccugaug

SEQ ID NO: 156 - RNA, 17 nt, Homo sapiens
aaaaaaauaagagagcu

SEQ ID NO: 157 - RNA, 17 nt, Homo sapiens
agagagcuuccguaagg

SEQ ID NO: 158 - RNA, 17 nt, Homo sapiens
gagagcuuccguaaggc

SEQ ID NO: 159 - RNA, 17 nt, Homo sapiens
gcuuccguaaggcgacg

SEQ ID NO: 160 - RNA, 17 nt, Homo sapiens
cgacgaauugaccaaag

SEQ ID NO: 161 - RNA, 17 nt, Homo sapiens
aaagcaauucccaugcc

SEQ ID NO: 162 - RNA, 17 nt, Homo sapiens
aagcaauucccaugcca

SEQ ID NO: 163 - RNA, 17 nt, Homo sapiens
gccaacauauucuacag

SEQ ID NO: 164 - RNA, 17 nt, Homo sapiens
caacauauucuacagug

SEQ ID NO: 165 - RNA, 17 nt, Homo sapiens
aacauauucuacagugu

SEQ ID NO: 166 - RNA, 17 nt, Homo sapiens
cauauucuacaguguuc

SEQ ID NO: 167 - RNA, 17 nt, Homo sapiens
uacaguguucuuacuau

SEQ ID NO: 168 - RNA, 17 nt, Homo sapiens
acaguguucuuacuauu

SEQ ID NO: 169 - RNA, 17 nt, Homo sapiens
aguguucuuacuauuga

SEQ ID NO: 170 - RNA, 17 nt, Homo sapiens
guguucuuacuauugac

SEQ ID NO: 171 - RNA, 17 nt, Homo sapiens
uucuuacuauugacaaa

SEQ ID NO: 172 - RNA, 17 nt, Homo sapiens
cuuacuauugacaaaau

SEQ ID NO: 173 - RNA, 17 nt, Homo sapiens
aaaggacuuuauacuug

SEQ ID NO: 174 - RNA, 17 nt, Homo sapiens
aaggacuuuauacuugu

SEQ ID NO: 175 - RNA, 17 nt, Homo sapiens
aggacuuuauacuuguc

SEQ ID NO: 176 - RNA, 17 nt, Homo sapiens
gacuuuauacuugucgu

SEQ ID NO: 177 - RNA, 17 nt, Homo sapiens
uuuauacuugucgugua

SEQ ID NO: 178 - RNA, 17 nt, Homo sapiens
auacuugucguguaagg

SEQ ID NO: 179 - RNA, 17 nt, Homo sapiens
ugucguguaaggagugg

SEQ ID NO: 180 - RNA, 17 nt, Homo sapiens
uggaccaucauucaaau

SEQ ID NO: 181 - RNA, 17 nt, Homo sapiens
accaucauucaaaucug

SEQ ID NO: 182 - RNA, 17 nt, Homo sapiens
ccaucauucaaaucugu

SEQ ID NO: 183 - RNA, 17 nt, Homo sapiens
auucaaaucuguuaaca

SEQ ID NO: 184 - RNA, 17 nt, Homo sapiens
aaaucuguuaacaccuc

SEQ ID NO: 185 - RNA, 17 nt, Homo sapiens
aaucuguuaacaccuca

SEQ ID NO: 186 - RNA, 17 nt, Homo sapiens
uaacaccucagugcaua

SEQ ID NO: 187 - RNA, 17 nt, Homo sapiens
cagugcauauauaugau

SEQ ID NO: 188 - RNA, 17 nt, Homo sapiens
gugcauauauaugauaa

SEQ ID NO: 189 - RNA, 17 nt, Homo sapiens
gcauauauaugauaaag

SEQ ID NO: 190 - RNA, 17 nt, Homo sapiens
uauaugauaaagcauuc

SEQ ID NO: 191 - RNA, 17 nt, Homo sapiens
uaaagcauucaucacug

SEQ ID NO: 192 - RNA, 17 nt, Homo sapiens
aaagcauucaucacugu

SEQ ID NO: 193 - RNA, 17 nt, Homo sapiens
gcauucaucacugugaa

SEQ ID NO: 194 - RNA, 17 nt, Homo sapiens
ugaaacaucgaaaacag

SEQ ID NO: 195 - RNA, 17 nt, Homo sapiens
caggugcuugaaaccgu

SEQ ID NO: 196 - RNA, 17 nt, Homo sapiens
gaaaccguagcuggcaa

SEQ ID NO: 197 - RNA, 17 nt, Homo sapiens
caagcggucuuaccggc

SEQ ID NO: 198 - RNA, 17 nt, Homo sapiens
agcggucuuaccggcuc

SEQ ID NO: 199 - RNA, 17 nt, Homo sapiens
gcggucuuaccggcucu

SEQ ID NO: 200 - RNA, 17 nt, Homo sapiens
uaccggcucucuaugaa

SEQ ID NO: 201 - RNA, 17 nt, Homo sapiens
ccggcucucuaugaaag

SEQ ID NO: 202 - RNA, 17 nt, Homo sapiens
ggcucucuaugaaagug

SEQ ID NO: 203 - RNA, 17 nt, Homo sapiens
gaaggcauuucccucgc

SEQ ID NO: 204 - RNA, 17 nt, Homo sapiens
aaggcauuucccucgcc

SEQ ID NO: 205 - RNA, 17 nt, Homo sapiens
aggcauuucccucgccg

SEQ ID NO: 206 - RNA, 17 nt, Homo sapiens
auuucccucgccggaag

SEQ ID NO: 207 - RNA, 17 nt, Homo sapiens
ccggaaguuguaugguu

SEQ ID NO: 208 - RNA, 17 nt, Homo sapiens
gaaguuguaugguuaaa

SEQ ID NO: 209 - RNA, 17 nt, Homo sapiens
uguaugguuaaaagaug

SEQ ID NO: 210 - RNA, 17 nt, Homo sapiens
guaugguuaaaagaugg

SEQ ID NO: 211 - RNA, 17 nt, Homo sapiens
agauggguuaccugcga

SEQ ID NO: 212 - RNA, 17 nt, Homo sapiens
gauggguuaccugcgac

SEQ ID NO: 213 - RNA, 17 nt, Homo sapiens
ugagaaaucugcucgcu

SEQ ID NO: 214 - RNA, 17 nt, Homo sapiens
aaucugcucgcuauuug

SEQ ID NO: 215 - RNA, 17 nt, Homo sapiens
ugcucgcuauuugacuc

SEQ ID NO: 216 - RNA, 17 nt, Homo sapiens
cucgcuauuugacucgu

SEQ ID NO: 217 - RNA, 17 nt, Homo sapiens
ucgcuauuugacucgug

SEQ ID NO: 218 - RNA, 17 nt, Homo sapiens
auuugacucguggcuac

SEQ ID NO: 219 - RNA, 17 nt, Homo sapiens
ucguggcuacucguuaa

SEQ ID NO: 220 - RNA, 17 nt, Homo sapiens
uggcuacucguuaauua

SEQ ID NO: 221 - RNA, 17 nt, Homo sapiens
cuacucguuaauuauca

SEQ ID NO: 222 - RNA, 17 nt, Homo sapiens
uacucguuaauuaucaa

SEQ ID NO: 223 - RNA, 17 nt, Homo sapiens
ucguuaauuaucaagga

SEQ ID NO: 224 - RNA, 17 nt, Homo sapiens
cguuaauuaucaaggac

SEQ ID NO: 225 - RNA, 17 nt, Homo sapiens
uuaauuaucaaggacgu

SEQ ID NO: 226 - RNA, 17 nt, Homo sapiens
aaggacguaacugaaga

SEQ ID NO: 227 - RNA, 17 nt, Homo sapiens
cagggaauuauacaauc

SEQ ID NO: 228 - RNA, 17 nt, Homo sapiens
agggaauuauacaaucu

SEQ ID NO: 229 - RNA, 17 nt, Homo sapiens
ggaauuauacaaucuug

SEQ ID NO: 230 - RNA, 17 nt, Homo sapiens
uauacaaucuugcugag

SEQ ID NO: 231 - RNA, 17 nt, Homo sapiens
uacaaucuugcugagca

SEQ ID NO: 232 - RNA, 17 nt, Homo sapiens
cugagcauaaaacaguc

SEQ ID NO: 233 - RNA, 17 nt, Homo sapiens
aaaacagucaaaugugu

SEQ ID NO: 234 - RNA, 17 nt, Homo sapiens
aaauguguuuaaaaacc

SEQ ID NO: 235 - RNA, 17 nt, Homo sapiens
aauguguuuaaaaaccu

SEQ ID NO: 236 - RNA, 17 nt, Homo sapiens
auguguuuaaaaaccuc

SEQ ID NO: 237 - RNA, 17 nt, Homo sapiens
aaaaaccucacugccac

SEQ ID NO: 238 - RNA, 17 nt, Homo sapiens
cugccacucuaauuguc

SEQ ID NO: 239 - RNA, 17 nt, Homo sapiens
gccacucuaauugucaa

SEQ ID NO: 240 - RNA, 17 nt, Homo sapiens
acucuaauugucaaugu

SEQ ID NO: 241 - RNA, 17 nt, Homo sapiens
cuaauugucaaugugaa

SEQ ID NO: 242 - RNA, 17 nt, Homo sapiens
ccccagauuuacgaaaa

SEQ ID NO: 243 - RNA, 17 nt, Homo sapiens
cccagauuuacgaaaag

SEQ ID NO: 244 - RNA, 17 nt, Homo sapiens
ccagauuuacgaaaagg

SEQ ID NO: 245 - RNA, 17 nt, Homo sapiens
ggccgugucaucguuuc

SEQ ID NO: 246 - RNA, 17 nt, Homo sapiens
cgugucaucguuuccag

SEQ ID NO: 247 - RNA, 17 nt, Homo sapiens
gucaucguuuccagacc

SEQ ID NO: 248 - RNA, 17 nt, Homo sapiens
ucaucguuuccagaccc

SEQ ID NO: 249 - RNA, 17 nt, Homo sapiens
caucguuuccagacccg

SEQ ID NO: 250 - RNA, 17 nt, Homo sapiens
acccggcucucuaccca

SEQ ID NO: 251 - RNA, 17 nt, Homo sapiens
ccggcucucuacccacu

SEQ ID NO: 252 - RNA, 17 nt, Homo sapiens
ggcucucuacccacugg

SEQ ID NO: 253 - RNA, 17 nt, Homo sapiens
agacaaauccugacuug

SEQ ID NO: 254 - RNA, 17 nt, Homo sapiens
uccugacuuguaccgca

SEQ ID NO: 255 - RNA, 17 nt, Homo sapiens
ugacuuguaccgcauau

SEQ ID NO: 256 - RNA, 17 nt, Homo sapiens
uaccgcauaugguaucc

SEQ ID NO: 257 - RNA, 17 nt, Homo sapiens
cauaugguaucccucaa

SEQ ID NO: 258 - RNA, 17 nt, Homo sapiens
uaugguaucccucaacc

SEQ ID NO: 259 - RNA, 17 nt, Homo sapiens
guaucccucaaccuaca

SEQ ID NO: 260 - RNA, 17 nt, Homo sapiens
cucaaccuacaaucaag

SEQ ID NO: 261 - RNA, 17 nt, Homo sapiens
ccuacaaucaagugguu

SEQ ID NO: 262 - RNA, 17 nt, Homo sapiens
caagugguucuggcacc

SEQ ID NO: 263 - RNA, 17 nt, Homo sapiens
aagugguucuggcaccc

SEQ ID NO: 264 - RNA, 17 nt, Homo sapiens
accccuguaaccauaau

SEQ ID NO: 265 - RNA, 17 nt, Homo sapiens
guaaccauaaucauucc

SEQ ID NO: 266 - RNA, 17 nt, Homo sapiens
accauaaucauuccgaa

SEQ ID NO: 267 - RNA, 17 nt, Homo sapiens
auaaucauuccgaagca

SEQ ID NO: 268 - RNA, 17 nt, Homo sapiens
uaaucauuccgaagcaa

SEQ ID NO: 269 - RNA, 17 nt, Homo sapiens
gugugacuuuuguucca

SEQ ID NO: 270 - RNA, 17 nt, Homo sapiens
ugugacuuuuguuccaa

SEQ ID NO: 271 - RNA, 17 nt, Homo sapiens
gugacuuuuguuccaau

SEQ ID NO: 272 - RNA, 17 nt, Homo sapiens
acuuuuguuccaauaau

SEQ ID NO: 273 - RNA, 17 nt, Homo sapiens
cuuuuguuccaauaaug

SEQ ID NO: 274 - RNA, 17 nt, Homo sapiens
guuccaauaaugaagag

SEQ ID NO: 275 - RNA, 17 nt, Homo sapiens
ugaagaguccuuuaucc

SEQ ID NO: 276 - RNA, 17 nt, Homo sapiens
agaguccuuuauccugg

SEQ ID NO: 277 - RNA, 17 nt, Homo sapiens
gaguccuuuauccugga

SEQ ID NO: 278 - RNA, 17 nt, Homo sapiens
aguccuuuauccuggau

SEQ ID NO: 279 - RNA, 17 nt, Homo sapiens
uccuuuauccuggaugc

SEQ ID NO: 280 - RNA, 17 nt, Homo sapiens
aacagaauugagagcau

SEQ ID NO: 281 - RNA, 17 nt, Homo sapiens
gagagcaucacucagcg

SEQ ID NO: 282 - RNA, 17 nt, Homo sapiens
gcaucacucagcgcaug

SEQ ID NO: 283 - RNA, 17 nt, Homo sapiens
auggcaauaauagaagg

SEQ ID NO: 284 - RNA, 17 nt, Homo sapiens
gcaauaauagaaggaaa

SEQ ID NO: 285 - RNA, 17 nt, Homo sapiens
gaaagaauaagauggcu

SEQ ID NO: 286 - RNA, 17 nt, Homo sapiens
agauggcuagcaccuug

SEQ ID NO: 287 - RNA, 17 nt, Homo sapiens
uagcaccuugguugugg

SEQ ID NO: 288 - RNA, 17 nt, Homo sapiens
accuugguuguggcuga

SEQ ID NO: 289 - RNA, 17 nt, Homo sapiens
ggcugacucuagaauuu

SEQ ID NO: 290 - RNA, 17 nt, Homo sapiens
cugacucuagaauuucu

SEQ ID NO: 291 - RNA, 17 nt, Homo sapiens
ucuagaauuucuggaau

SEQ ID NO: 292 - RNA, 17 nt, Homo sapiens
cuagaauuucuggaauc

SEQ ID NO: 293 - RNA, 17 nt, Homo sapiens
uagaauuucuggaaucu

SEQ ID NO: 294 - RNA, 17 nt, Homo sapiens
ucuggaaucuacauuug

SEQ ID NO: 295 - RNA, 17 nt, Homo sapiens
uggaaucuacauuugca

SEQ ID NO: 296 - RNA, 17 nt, Homo sapiens
aucuacauuugcauagc

SEQ ID NO: 297 - RNA, 17 nt, Homo sapiens
ucuacauuugcauagcu

SEQ ID NO: 298 - RNA, 17 nt, Homo sapiens
auuugcauagcuuccaa

SEQ ID NO: 299 - RNA, 17 nt, Homo sapiens
gcauagcuuccaauaaa

SEQ ID NO: 300 - RNA, 17 nt, Homo sapiens
cauagcuuccaauaaag

SEQ ID NO: 301 - RNA, 17 nt, Homo sapiens
cuuccaauaaaguuggg

SEQ ID NO: 302 - RNA, 17 nt, Homo sapiens
aauaaaguugggacugu

SEQ ID NO: 303 - RNA, 17 nt, Homo sapiens
agaaacauaagcuuuua

SEQ ID NO: 304 - RNA, 17 nt, Homo sapiens
cauaagcuuuuauauca

SEQ ID NO: 305 - RNA, 17 nt, Homo sapiens
auaagcuuuuauaucac

SEQ ID NO: 306 - RNA, 17 nt, Homo sapiens
uaagcuuuuauaucaca

SEQ ID NO: 307 - RNA, 17 nt, Homo sapiens
aagcuuuuauaucacag

SEQ ID NO: 308 - RNA, 17 nt, Homo sapiens
gcuuuuauaucacagau

SEQ ID NO: 309 - RNA, 17 nt, Homo sapiens
uuuuauaucacagaugu

SEQ ID NO: 310 - RNA, 17 nt, Homo sapiens
aaauggguuucauguua

SEQ ID NO: 311 - RNA, 17 nt, Homo sapiens
aauggguuucauguuaa

SEQ ID NO: 312 - RNA, 17 nt, Homo sapiens
auggguuucauguuaac

SEQ ID NO: 313 - RNA, 17 nt, Homo sapiens
uuucauguuaacuugga

SEQ ID NO: 314 - RNA, 17 nt, Homo sapiens
uucauguuaacuuggaa

SEQ ID NO: 315 - RNA, 17 nt, Homo sapiens
uguuaacuuggaaaaaa

SEQ ID NO: 316 - RNA, 17 nt, Homo sapiens
gaaacugucuugcacag

SEQ ID NO: 317 - RNA, 17 nt, Homo sapiens
aacugucuugcacaguu

SEQ ID NO: 318 - RNA, 17 nt, Homo sapiens
ugcacaguuaacaaguu

SEQ ID NO: 319 - RNA, 17 nt, Homo sapiens
gcacaguuaacaaguuc

SEQ ID NO: 320 - RNA, 17 nt, Homo sapiens
uaacaaguucuuauaca

SEQ ID NO: 321 - RNA, 17 nt, Homo sapiens
aacaaguucuuauacag

SEQ ID NO: 322 - RNA, 17 nt, Homo sapiens
caaguucuuauacagag

SEQ ID NO: 323 - RNA, 17 nt, Homo sapiens
aaguucuuauacagaga

SEQ ID NO: 324 - RNA, 17 nt, Homo sapiens
guucuuauacagagacg

SEQ ID NO: 325 - RNA, 17 nt, Homo sapiens
agagacguuacuuggau

SEQ ID NO: 326 - RNA, 17 nt, Homo sapiens
gagacguuacuuggauu

SEQ ID NO: 327 - RNA, 17 nt, Homo sapiens
acguuacuuggauuuua

SEQ ID NO: 328 - RNA, 17 nt, Homo sapiens
acuuggauuuuacugcg

SEQ ID NO: 329 - RNA, 17 nt, Homo sapiens
cuuggauuuuacugcgg

SEQ ID NO: 330 - RNA, 17 nt, Homo sapiens
uuggauuuuacugcgga

SEQ ID NO: 331 - RNA, 17 nt, Homo sapiens
uggauuuuacugcggac

SEQ ID NO: 332 - RNA, 17 nt, Homo sapiens
cggacaguuaauaacag

SEQ ID NO: 333 - RNA, 17 nt, Homo sapiens
ggacaguuaauaacaga

SEQ ID NO: 334 - RNA, 17 nt, Homo sapiens
caguuaauaacagaaca

SEQ ID NO: 335 - RNA, 17 nt, Homo sapiens
aaugcacuacaguauua

SEQ ID NO: 336 - RNA, 17 nt, Homo sapiens
acuacaguauuagcaag

SEQ ID NO: 337 - RNA, 17 nt, Homo sapiens
uacaguauuagcaagca

SEQ ID NO: 338 - RNA, 17 nt, Homo sapiens
acaguauuagcaagcaa

SEQ ID NO: 339 - RNA, 17 nt, Homo sapiens
auggccaucacuaagga

SEQ ID NO: 340 - RNA, 17 nt, Homo sapiens
ccaucacuaaggagcac

SEQ ID NO: 341 - RNA, 17 nt, Homo sapiens
ggagcacuccaucacuc

SEQ ID NO: 342 - RNA, 17 nt, Homo sapiens
cacuccaucacucuuaa

SEQ ID NO: 343 - RNA, 17 nt, Homo sapiens
ccaucacucuuaaucuu

SEQ ID NO: 344 - RNA, 17 nt, Homo sapiens
aucacucuuaaucuuac

SEQ ID NO: 345 - RNA, 17 nt, Homo sapiens
ucacucuuaaucuuacc

SEQ ID NO: 346 - RNA, 17 nt, Homo sapiens
cucuuaaucuuaccauc

SEQ ID NO: 347 - RNA, 17 nt, Homo sapiens
cuuaaucuuaccaucau

SEQ ID NO: 348 - RNA, 17 nt, Homo sapiens
uuaaucuuaccaucaug

SEQ ID NO: 349 - RNA, 17 nt, Homo sapiens
cuuaccaucaugaaugu

SEQ ID NO: 350 - RNA, 17 nt, Homo sapiens
augaauguuucccugca

SEQ ID NO: 351 - RNA, 17 nt, Homo sapiens
ugaauguuucccugcaa

SEQ ID NO: 352 - RNA, 17 nt, Homo sapiens
gaauguuucccugcaag

SEQ ID NO: 353 - RNA, 17 nt, Homo sapiens
ugcaagauucaggcacc

SEQ ID NO: 354 - RNA, 17 nt, Homo sapiens
gcaagauucaggcaccu

SEQ ID NO: 355 - RNA, 17 nt, Homo sapiens
aggcaccuaugccugca

SEQ ID NO: 356 - RNA, 17 nt, Homo sapiens
aggaauguauacacagg

SEQ ID NO: 357 - RNA, 17 nt, Homo sapiens
gaauguauacacagggg

SEQ ID NO: 358 - RNA, 17 nt, Homo sapiens
gaagaaauccuccagaa

SEQ ID NO: 359 - RNA, 17 nt, Homo sapiens
gaaauccuccagaagaa

SEQ ID NO: 360 - RNA, 17 nt, Homo sapiens
aaagaaauuacaaucag

SEQ ID NO: 361 - RNA, 17 nt, Homo sapiens
aagaaauuacaaucaga

SEQ ID NO: 362 - RNA, 17 nt, Homo sapiens
auuacaaucagagauca

SEQ ID NO: 363 - RNA, 17 nt, Homo sapiens
ucagagaucaggaagca

SEQ ID NO: 364 - RNA, 17 nt, Homo sapiens
agcaccauaccuccugc

SEQ ID NO: 365 - RNA, 17 nt, Homo sapiens
ccauaccuccugcgaaa

SEQ ID NO: 366 - RNA, 17 nt, Homo sapiens
cgaaaccucagugauca

SEQ ID NO: 367 - RNA, 17 nt, Homo sapiens
ucagugaucacacagug

SEQ ID NO: 368 - RNA, 17 nt, Homo sapiens
guggccaucagcaguuc

SEQ ID NO: 369 - RNA, 17 nt, Homo sapiens
ucagcaguuccaccacu

SEQ ID NO: 370 - RNA, 17 nt, Homo sapiens
cagcaguuccaccacuu

SEQ ID NO: 371 - RNA, 17 nt, Homo sapiens
ccaccacuuuagacugu

SEQ ID NO: 372 - RNA, 17 nt, Homo sapiens
caccacuuuagacuguc

SEQ ID NO: 373 - RNA, 17 nt, Homo sapiens
accacuuuagacuguca

SEQ ID NO: 374 - RNA, 17 nt, Homo sapiens
uagacugucaugcuaau

SEQ ID NO: 375 - RNA, 17 nt, Homo sapiens
gucaugcuaaugguguc

SEQ ID NO: 376 - RNA, 17 nt, Homo sapiens
aaugguguccccgagcc

SEQ ID NO: 377 - RNA, 17 nt, Homo sapiens
ccgagccucagaucacu

SEQ ID NO: 378 - RNA, 17 nt, Homo sapiens
ccucagaucacuugguu

SEQ ID NO: 379 - RNA, 17 nt, Homo sapiens
agaucacuugguuuaaa

SEQ ID NO: 380 - RNA, 17 nt, Homo sapiens
cacuugguuuaaaaaca

SEQ ID NO: 381 - RNA, 17 nt, Homo sapiens
acuugguuuaaaaacaa

SEQ ID NO: 382 - RNA, 17 nt, Homo sapiens
cuugguuuaaaaacaac

SEQ ID NO: 383 - RNA, 17 nt, Homo sapiens
cacaaaauacaacaaga

SEQ ID NO: 384 - RNA, 17 nt, Homo sapiens
ccuggaauuauuuuagg

SEQ ID NO: 385 - RNA, 17 nt, Homo sapiens
cuggaauuauuuuagga

SEQ ID NO: 386 - RNA, 17 nt, Homo sapiens
ggaauuauuuuaggacc

SEQ ID NO: 387 - RNA, 17 nt, Homo sapiens
gaauuauuuuaggacca

SEQ ID NO: 388 - RNA, 17 nt, Homo sapiens
aauuauuuuaggaccag

SEQ ID NO: 389 - RNA, 17 nt, Homo sapiens
auuauuuuaggaccagg

SEQ ID NO: 390 - RNA, 17 nt, Homo sapiens
cacgcuguuuauugaaa

SEQ ID NO: 391 - RNA, 17 nt, Homo sapiens
acgcuguuuauugaaag

SEQ ID NO: 392 - RNA, 17 nt, Homo sapiens
cgcuguuuauugaaaga

SEQ ID NO: 393 - RNA, 17 nt, Homo sapiens
cuguuuauugaaagagu

SEQ ID NO: 394 - RNA, 17 nt, Homo sapiens
gaaagagucacagaaga

SEQ ID NO: 395 - RNA, 17 nt, Homo sapiens
gaaggugucuaucacug

SEQ ID NO: 396 - RNA, 17 nt, Homo sapiens
aggugucuaucacugca

SEQ ID NO: 397 - RNA, 17 nt, Homo sapiens
gugucuaucacugcaaa

SEQ ID NO: 398 - RNA, 17 nt, Homo sapiens
gaagggcucuguggaaa

SEQ ID NO: 399 - RNA, 17 nt, Homo sapiens
uggaaaguucagcauac

SEQ ID NO: 400 - RNA, 17 nt, Homo sapiens
ggaaaguucagcauacc

SEQ ID NO: 401 - RNA, 17 nt, Homo sapiens
uucagcauaccucacug

SEQ ID NO: 402 - RNA, 17 nt, Homo sapiens
gcauaccucacuguuca

SEQ ID NO: 403 - RNA, 17 nt, Homo sapiens
cucacuguucaaggaac

SEQ ID NO: 404 - RNA, 17 nt, Homo sapiens
ucacuguucaaggaacc

SEQ ID NO: 405 - RNA, 17 nt, Homo sapiens
aggaaccucggacaagu

SEQ ID NO: 406 - RNA, 17 nt, Homo sapiens
ggacaagucuaaucugg

SEQ ID NO: 407 - RNA, 17 nt, Homo sapiens
acaagucuaaucuggag

SEQ ID NO: 408 - RNA, 17 nt, Homo sapiens
agucuaaucuggagcug

SEQ ID NO: 409 - RNA, 17 nt, Homo sapiens
gagcugaucacucuaac

SEQ ID NO: 410 - RNA, 17 nt, Homo sapiens
ugaucacucuaacaugc

SEQ ID NO: 411 - RNA, 17 nt, Homo sapiens
aucacucuaacaugcac

SEQ ID NO: 412 - RNA, 17 nt, Homo sapiens
cugcgacucucuucugg

SEQ ID NO: 413 - RNA, 17 nt, Homo sapiens
gcgacucucuucuggcu

SEQ ID NO: 414 - RNA, 17 nt, Homo sapiens
gacucucuucuggcucc

SEQ ID NO: 415 - RNA, 17 nt, Homo sapiens
acucucuucuggcuccu

SEQ ID NO: 416 - RNA, 17 nt, Homo sapiens
uucuggcuccuauuaac

SEQ ID NO: 417 - RNA, 17 nt, Homo sapiens
uggcuccuauuaacccu

SEQ ID NO: 418 - RNA, 17 nt, Homo sapiens
gcuccuauuaacccucc

SEQ ID NO: 419 - RNA, 17 nt, Homo sapiens
cuccuauuaacccuccu

SEQ ID NO: 420 - RNA, 17 nt, Homo sapiens
uuaacccuccuuauccg

SEQ ID NO: 421 - RNA, 17 nt, Homo sapiens
acccuccuuauccgaaa

SEQ ID NO: 422 - RNA, 17 nt, Homo sapiens
cccuccuuauccgaaaa

SEQ ID NO: 423 - RNA, 17 nt, Homo sapiens
cuccuuauccgaaaaau

SEQ ID NO: 424 - RNA, 17 nt, Homo sapiens
gaaaaggucuucuucug

SEQ ID NO: 425 - RNA, 17 nt, Homo sapiens
aaaggucuucuucugaa

SEQ ID NO: 426 - RNA, 17 nt, Homo sapiens
aaggucuucuucugaaa

SEQ ID NO: 427 - RNA, 17 nt, Homo sapiens
ggucuucuucugaaaua

SEQ ID NO: 428 - RNA, 17 nt, Homo sapiens
gucuucuucugaaauaa

SEQ ID NO: 429 - RNA, 17 nt, Homo sapiens
ucugaaauaaagacuga

SEQ ID NO: 430 - RNA, 17 nt, Homo sapiens
gacugacuaccuaucaa

SEQ ID NO: 431 - RNA, 17 nt, Homo sapiens
gacuaccuaucaauuau

SEQ ID NO: 432 - RNA, 17 nt, Homo sapiens
cuaccuaucaauuauaa

SEQ ID NO: 433 - RNA, 17 nt, Homo sapiens
cuaucaauuauaaugga

SEQ ID NO: 434 - RNA, 17 nt, Homo sapiens
uaucaauuauaauggac

SEQ ID NO: 435 - RNA, 17 nt, Homo sapiens
ucaauuauaauggaccc

SEQ ID NO: 436 - RNA, 17 nt, Homo sapiens
gaugaaguuccuuugga

SEQ ID NO: 437 - RNA, 17 nt, Homo sapiens
augaaguuccuuuggau

SEQ ID NO: 438 - RNA, 17 nt, Homo sapiens
aaguuccuuuggaugag

SEQ ID NO: 439 - RNA, 17 nt, Homo sapiens
aguuccuuuggaugagc

SEQ ID NO: 440 - RNA, 17 nt, Homo sapiens
gagcggcucccuuauga

SEQ ID NO: 441 - RNA, 17 nt, Homo sapiens
ggcucccuuaugaugcc

SEQ ID NO: 442 - RNA, 17 nt, Homo sapiens
gcucccuuaugaugcca

SEQ ID NO: 443 - RNA, 17 nt, Homo sapiens
gugggaguuugcccggg

SEQ ID NO: 444 - RNA, 17 nt, Homo sapiens
ugggaguuugcccggga

SEQ ID NO: 445 - RNA, 17 nt, Homo sapiens
gagagacuuaaacuggg

SEQ ID NO: 446 - RNA, 17 nt, Homo sapiens
agagacuuaaacugggc

SEQ ID NO: 447 - RNA, 17 nt, Homo sapiens
gggcaaaucacuuggaa

SEQ ID NO: 448 - RNA, 17 nt, Homo sapiens
aaaucacuuggaagagg

SEQ ID NO: 449 - RNA, 17 nt, Homo sapiens
gaggggcuuuuggaaaa

SEQ ID NO: 450 - RNA, 17 nt, Homo sapiens
aggggcuuuuggaaaag

SEQ ID NO: 451 - RNA, 17 nt, Homo sapiens
ggggcuuuuggaaaagu

SEQ ID NO: 452 - RNA, 17 nt, Homo sapiens
aaagugguucaagcauc

SEQ ID NO: 453 - RNA, 17 nt, Homo sapiens
aagugguucaagcauca

SEQ ID NO: 454 - RNA, 17 nt, Homo sapiens
ucaagcaucagcauuug

SEQ ID NO: 455 - RNA, 17 nt, Homo sapiens
aucagcauuuggcauua

SEQ ID NO: 456 - RNA, 17 nt, Homo sapiens
ucagcauuuggcauuaa

SEQ ID NO: 457 - RNA, 17 nt, Homo sapiens
uuuggcauuaagaaauc

SEQ ID NO: 458 - RNA, 17 nt, Homo sapiens
uuggcauuaagaaauca

SEQ ID NO: 459 - RNA, 17 nt, Homo sapiens
uaagaaaucaccuacgu

SEQ ID NO: 460 - RNA, 17 nt, Homo sapiens
aaucaccuacgugccgg

SEQ ID NO: 461 - RNA, 17 nt, Homo sapiens
cagcgaguacaaagcuc

SEQ ID NO: 462 - RNA, 17 nt, Homo sapiens
acaaagcucugaugacu

SEQ ID NO: 463 - RNA, 17 nt, Homo sapiens
acugagcuaaaaaucuu

SEQ ID NO: 464 - RNA, 17 nt, Homo sapiens
cuaaaaaucuugaccca

SEQ ID NO: 465 - RNA, 17 nt, Homo sapiens
aaaaaucuugacccaca

SEQ ID NO: 466 - RNA, 17 nt, Homo sapiens
acccacauuggccacca

SEQ ID NO: 467 - RNA, 17 nt, Homo sapiens
gccaccaucugaacgug

SEQ ID NO: 468 - RNA, 17 nt, Homo sapiens
aacgugguuaaccugcu

SEQ ID NO: 469 - RNA, 17 nt, Homo sapiens
acgugguuaaccugcug

SEQ ID NO: 470 - RNA, 17 nt, Homo sapiens
gagggccucugauggug

SEQ ID NO: 471 - RNA, 17 nt, Homo sapiens
auggugauuguugaaua

SEQ ID NO: 472 - RNA, 17 nt, Homo sapiens
gugauuguugaauacug

SEQ ID NO: 473 - RNA, 17 nt, Homo sapiens
uguugaauacugcaaau

SEQ ID NO: 474 - RNA, 17 nt, Homo sapiens
cugcaaauauggaaauc

SEQ ID NO: 475 - RNA, 17 nt, Homo sapiens
auggaaaucucuccaac

SEQ ID NO: 476 - RNA, 17 nt, Homo sapiens
ggaaaucucuccaacua

SEQ ID NO: 477 - RNA, 17 nt, Homo sapiens
aaaucucuccaacuacc

SEQ ID NO: 478 - RNA, 17 nt, Homo sapiens
cuccaacuaccucaaga

SEQ ID NO: 479 - RNA, 17 nt, Homo sapiens
aacuaccucaagagcaa

SEQ ID NO: 480 - RNA, 17 nt, Homo sapiens
acgugacuuauuuuuuc

SEQ ID NO: 481 - RNA, 17 nt, Homo sapiens
cgugacuuauuuuuucu

SEQ ID NO: 482 - RNA, 17 nt, Homo sapiens
ugacuuauuuuuucuca

SEQ ID NO: 483 - RNA, 17 nt, Homo sapiens
gacuuauuuuuucucaa

SEQ ID NO: 484 - RNA, 17 nt, Homo sapiens
acuuauuuuuucucaac

SEQ ID NO: 485 - RNA, 17 nt, Homo sapiens
cuuauuuuuucucaaca

SEQ ID NO: 486 - RNA, 17 nt, Homo sapiens
uuauuuuuucucaacaa

SEQ ID NO: 487 - RNA, 17 nt, Homo sapiens
uauuuuuucucaacaag

SEQ ID NO: 488 - RNA, 17 nt, Homo sapiens
uuuuuucucaacaagga

SEQ ID NO: 489 - RNA, 17 nt, Homo sapiens
gcagcacuacacaugga

SEQ ID NO: 490 - RNA, 17 nt, Homo sapiens
uggagccuaagaaagaa

SEQ ID NO: 491 - RNA, 17 nt, Homo sapiens
ccaagacuagauagcgu

SEQ ID NO: 492 - RNA, 17 nt, Homo sapiens
gacuagauagcgucacc

SEQ ID NO: 493 - RNA, 17 nt, Homo sapiens
gauagcgucaccagcag

SEQ ID NO: 494 - RNA, 17 nt, Homo sapiens
cgaaagcuuugcgagcu

SEQ ID NO: 495 - RNA, 17 nt, Homo sapiens
gaaagcuuugcgagcuc

SEQ ID NO: 496 - RNA, 17 nt, Homo sapiens
ugcgagcuccggcuuuc

SEQ ID NO: 497 - RNA, 17 nt, Homo sapiens
cuccggcuuucaggaag

SEQ ID NO: 498 - RNA, 17 nt, Homo sapiens
uccggcuuucaggaaga

SEQ ID NO: 499 - RNA, 17 nt, Homo sapiens
ccggcuuucaggaagau

SEQ ID NO: 500 - RNA, 17 nt, Homo sapiens
aggaagauaaaagucug

SEQ ID NO: 501 - RNA, 17 nt, Homo sapiens
auaaaagucugagugau

SEQ ID NO: 502 - RNA, 17 nt, Homo sapiens
agugauguugaggaaga

SEQ ID NO: 503 - RNA, 17 nt, Homo sapiens
aggaggauucugacggu

SEQ ID NO: 504 - RNA, 17 nt, Homo sapiens
ggaggauucugacgguu

SEQ ID NO: 505 - RNA, 17 nt, Homo sapiens
cugacgguuucuacaag

SEQ ID NO: 506 - RNA, 17 nt, Homo sapiens
ugacgguuucuacaagg

SEQ ID NO: 507 - RNA, 17 nt, Homo sapiens
gacgguuucuacaagga

SEQ ID NO: 508 - RNA, 17 nt, Homo sapiens
cgguuucuacaaggagc

SEQ ID NO: 509 - RNA, 17 nt, Homo sapiens
gagcccaucacuaugga

SEQ ID NO: 510 - RNA, 17 nt, Homo sapiens
ccaucacuauggaagau

SEQ ID NO: 511 - RNA, 17 nt, Homo sapiens
uggaagaucugauuucu

SEQ ID NO: 512 - RNA, 17 nt, Homo sapiens
gaucugauuucuuacag

SEQ ID NO: 513 - RNA, 17 nt, Homo sapiens
aucugauuucuuacagu

SEQ ID NO: 514 - RNA, 17 nt, Homo sapiens
ucugauuucuuacaguu

SEQ ID NO: 515 - RNA, 17 nt, Homo sapiens
ugauuucuuacaguuuu

SEQ ID NO: 516 - RNA, 17 nt, Homo sapiens
gauuucuuacaguuuuc

SEQ ID NO: 517 - RNA, 17 nt, Homo sapiens
cuuacaguuuucaagug

SEQ ID NO: 518 - RNA, 17 nt, Homo sapiens
uuacaguuuucaagugg

SEQ ID NO: 519 - RNA, 17 nt, Homo sapiens
uacaguuuucaaguggc

SEQ ID NO: 520 - RNA, 17 nt, Homo sapiens
acaguuuucaaguggcc

SEQ ID NO: 521 - RNA, 17 nt, Homo sapiens
cauggaguuccugucuu

SEQ ID NO: 522 - RNA, 17 nt, Homo sapiens
auggaguuccugucuuc

SEQ ID NO: 523 - RNA, 17 nt, Homo sapiens
guuccugucuuccagaa

SEQ ID NO: 524 - RNA, 17 nt, Homo sapiens
uccugucuuccagaaag

SEQ ID NO: 525 - RNA, 17 nt, Homo sapiens
ccugucuuccagaaagu

SEQ ID NO: 526 - RNA, 17 nt, Homo sapiens
aagugcauucaucggga

SEQ ID NO: 527 - RNA, 17 nt, Homo sapiens
agugcauucaucgggac

SEQ ID NO: 528 - RNA, 17 nt, Homo sapiens
gcauucaucgggaccug

SEQ ID NO: 529 - RNA, 17 nt, Homo sapiens
agaaacauucuuuuauc

SEQ ID NO: 530 - RNA, 17 nt, Homo sapiens
gaaacauucuuuuaucu

SEQ ID NO: 531 - RNA, 17 nt, Homo sapiens
aacauucuuuuaucuga

SEQ ID NO: 532 - RNA, 17 nt, Homo sapiens
acauucuuuuaucugag

SEQ ID NO: 533 - RNA, 17 nt, Homo sapiens
cauucuuuuaucugaga

SEQ ID NO: 534 - RNA, 17 nt, Homo sapiens
auucuuuuaucugagaa

SEQ ID NO: 535 - RNA, 17 nt, Homo sapiens
ucuuuuaucugagaaca

SEQ ID NO: 536 - RNA, 17 nt, Homo sapiens
gugaagauuugugauuu

SEQ ID NO: 537 - RNA, 17 nt, Homo sapiens
ugaagauuugugauuuu

SEQ ID NO: 538 - RNA, 17 nt, Homo sapiens
uuugugauuuuggccuu

SEQ ID NO: 539 - RNA, 17 nt, Homo sapiens
uugugauuuuggccuug

SEQ ID NO: 540 - RNA, 17 nt, Homo sapiens
ugugauuuuggccuugc

SEQ ID NO: 541 - RNA, 17 nt, Homo sapiens
uuuggccuugcccggga

SEQ ID NO: 542 - RNA, 17 nt, Homo sapiens
cccgggauauuuauaag

SEQ ID NO: 543 - RNA, 17 nt, Homo sapiens
cgggauauuuauaagaa

SEQ ID NO: 544 - RNA, 17 nt, Homo sapiens
gggauauuuauaagaac

SEQ ID NO: 545 - RNA, 17 nt, Homo sapiens
ggauauuuauaagaacc

SEQ ID NO: 546 - RNA, 17 nt, Homo sapiens
auauuuauaagaacccc

SEQ ID NO: 547 - RNA, 17 nt, Homo sapiens
accccgauuaugugaga

SEQ ID NO: 548 - RNA, 17 nt, Homo sapiens
ccccgauuaugugagaa

SEQ ID NO: 549 - RNA, 17 nt, Homo sapiens
aaggagauacucgacuu

SEQ ID NO: 550 - RNA, 17 nt, Homo sapiens
gagauacucgacuuccu

SEQ ID NO: 551 - RNA, 17 nt, Homo sapiens
acucgacuuccucugaa

SEQ ID NO: 552 - RNA, 17 nt, Homo sapiens
cucgacuuccucugaaa

SEQ ID NO: 553 - RNA, 17 nt, Homo sapiens
gacuuccucugaaaugg

SEQ ID NO: 554 - RNA, 17 nt, Homo sapiens
ggauggcucccgaaucu

SEQ ID NO: 555 - RNA, 17 nt, Homo sapiens
ucccgaaucuaucuuug

SEQ ID NO: 556 - RNA, 17 nt, Homo sapiens
ccgaaucuaucuuugac

SEQ ID NO: 557 - RNA, 17 nt, Homo sapiens
gaaucuaucuuugacaa

SEQ ID NO: 558 - RNA, 17 nt, Homo sapiens
aucuaucuuugacaaaa

SEQ ID NO: 559 - RNA, 17 nt, Homo sapiens
ucuaucuuugacaaaau

SEQ ID NO: 560 - RNA, 17 nt, Homo sapiens
gacaaaaucuacagcac

SEQ ID NO: 561 - RNA, 17 nt, Homo sapiens
caaaaucuacagcacca

SEQ ID NO: 562 - RNA, 17 nt, Homo sapiens
cguguggucuuacggag

SEQ ID NO: 563 - RNA, 17 nt, Homo sapiens
uguggucuuacggagua

SEQ ID NO: 564 - RNA, 17 nt, Homo sapiens
guggucuuacggaguau

SEQ ID NO: 565 - RNA, 17 nt, Homo sapiens
uacggaguauugcugug

SEQ ID NO: 566 - RNA, 17 nt, Homo sapiens
cggaguauugcuguggg

SEQ ID NO: 567 - RNA, 17 nt, Homo sapiens
ugggaaaucuucuccuu

SEQ ID NO: 568 - RNA, 17 nt, Homo sapiens
ggaaaucuucuccuuag

SEQ ID NO: 569 - RNA, 17 nt, Homo sapiens
gaaaucuucuccuuagg

SEQ ID NO: 570 - RNA, 17 nt, Homo sapiens
aaucuucuccuuaggug

SEQ ID NO: 571 - RNA, 17 nt, Homo sapiens
cuucuccuuaggugggu

SEQ ID NO: 572 - RNA, 17 nt, Homo sapiens
uucuccuuagguggguc

SEQ ID NO: 573 - RNA, 17 nt, Homo sapiens
aggugggucuccauacc

SEQ ID NO: 574 - RNA, 17 nt, Homo sapiens
gugggucuccauaccca

SEQ ID NO: 575 - RNA, 17 nt, Homo sapiens
gucuccauacccaggag

SEQ ID NO: 576 - RNA, 17 nt, Homo sapiens
ccaggaguacaaaugga

SEQ ID NO: 577 - RNA, 17 nt, Homo sapiens
ugaggacuuuugcaguc

SEQ ID NO: 578 - RNA, 17 nt, Homo sapiens
gaggacuuuugcagucg

SEQ ID NO: 579 - RNA, 17 nt, Homo sapiens
aggacuuuugcagucgc

SEQ ID NO: 580 - RNA, 17 nt, Homo sapiens
uuugcagucgccugagg

SEQ ID NO: 581 - RNA, 17 nt, Homo sapiens
ugagagcuccugaguac

SEQ ID NO: 582 - RNA, 17 nt, Homo sapiens
uccugaguacucuacuc

SEQ ID NO: 583 - RNA, 17 nt, Homo sapiens
ugaguacucuacuccug

SEQ ID NO: 584 - RNA, 17 nt, Homo sapiens
aguacucuacuccugaa

SEQ ID NO: 585 - RNA, 17 nt, Homo sapiens
acucuacuccugaaauc

SEQ ID NO: 586 - RNA, 17 nt, Homo sapiens
ccugaaaucuaucagau

SEQ ID NO: 587 - RNA, 17 nt, Homo sapiens
ugaaaucuaucagauca

SEQ ID NO: 588 - RNA, 17 nt, Homo sapiens
aaaucuaucagaucaug

SEQ ID NO: 589 - RNA, 17 nt, Homo sapiens
uaucagaucaugcugga

SEQ ID NO: 590 - RNA, 17 nt, Homo sapiens
gccaagauuugcagaac

SEQ ID NO: 591 - RNA, 17 nt, Homo sapiens
ccaagauuugcagaacu

SEQ ID NO: 592 - RNA, 17 nt, Homo sapiens
gcagaacuuguggaaaa

SEQ ID NO: 593 - RNA, 17 nt, Homo sapiens
gaaaaacuaggugauuu

SEQ ID NO: 594 - RNA, 17 nt, Homo sapiens
uaggugauuugcuucaa

SEQ ID NO: 595 - RNA, 17 nt, Homo sapiens
aggugauuugcuucaag

SEQ ID NO: 596 - RNA, 17 nt, Homo sapiens
gauuugcuucaagcaaa

SEQ ID NO: 597 - RNA, 17 nt, Homo sapiens
auuugcuucaagcaaau

SEQ ID NO: 598 - RNA, 17 nt, Homo sapiens
gcaaauguacaacagga

SEQ ID NO: 599 - RNA, 17 nt, Homo sapiens
aggaugguaaagacuac

SEQ ID NO: 600 - RNA, 17 nt, Homo sapiens
uaaagacuacaucccaa

SEQ ID NO: 601 - RNA, 17 nt, Homo sapiens
gacuacaucccaaucaa

SEQ ID NO: 602 - RNA, 17 nt, Homo sapiens
aucccaaucaaugccau

SEQ ID NO: 603 - RNA, 17 nt, Homo sapiens
aaugccauacugacagg

SEQ ID NO: 604 - RNA, 17 nt, Homo sapiens
caggaaauaguggguuu

SEQ ID NO: 605 - RNA, 17 nt, Homo sapiens
uaguggguuuacauacu

SEQ ID NO: 606 - RNA, 17 nt, Homo sapiens
aguggguuuacauacuc

SEQ ID NO: 607 - RNA, 17 nt, Homo sapiens
guggguuuacauacuca

SEQ ID NO: 608 - RNA, 17 nt, Homo sapiens
guuuacauacucaacuc

SEQ ID NO: 609 - RNA, 17 nt, Homo sapiens
uacauacucaacuccug

SEQ ID NO: 610 - RNA, 17 nt, Homo sapiens
acucaacuccugccuuc

SEQ ID NO: 611 - RNA, 17 nt, Homo sapiens
uccugccuucucugagg

SEQ ID NO: 612 - RNA, 17 nt, Homo sapiens
ccugccuucucugagga

SEQ ID NO: 613 - RNA, 17 nt, Homo sapiens
ugccuucucugaggacu

SEQ ID NO: 614 - RNA, 17 nt, Homo sapiens
ugaggacuucuucaagg

SEQ ID NO: 615 - RNA, 17 nt, Homo sapiens
gaggacuucuucaagga

SEQ ID NO: 616 - RNA, 17 nt, Homo sapiens
ggacuucuucaaggaaa

SEQ ID NO: 617 - RNA, 17 nt, Homo sapiens
gacuucuucaaggaaag

SEQ ID NO: 618 - RNA, 17 nt, Homo sapiens
aggaaaguauuucagcu

SEQ ID NO: 619 - RNA, 17 nt, Homo sapiens
gaaaguauuucagcucc

SEQ ID NO: 620 - RNA, 17 nt, Homo sapiens
aaaguauuucagcuccg

SEQ ID NO: 621 - RNA, 17 nt, Homo sapiens
aaguauuucagcuccga

SEQ ID NO: 622 - RNA, 17 nt, Homo sapiens
uuucagcuccgaaguuu

SEQ ID NO: 623 - RNA, 17 nt, Homo sapiens
uccgaaguuuaauucag

SEQ ID NO: 624 - RNA, 17 nt, Homo sapiens
ccgaaguuuaauucagg

SEQ ID NO: 625 - RNA, 17 nt, Homo sapiens
cgaaguuuaauucagga

SEQ ID NO: 626 - RNA, 17 nt, Homo sapiens
aguuuaauucaggaagc

SEQ ID NO: 627 - RNA, 17 nt, Homo sapiens
guuuaauucaggaagcu

SEQ ID NO: 628 - RNA, 17 nt, Homo sapiens
aggaagcucugaugaug

SEQ ID NO: 629 - RNA, 17 nt, Homo sapiens
gaugaugucagauaugu

SEQ ID NO: 630 - RNA, 17 nt, Homo sapiens
ugucagauauguaaaug

SEQ ID NO: 631 - RNA, 17 nt, Homo sapiens
agauauguaaaugcuuu

SEQ ID NO: 632 - RNA, 17 nt, Homo sapiens
uaaaugcuuucaaguuc

SEQ ID NO: 633 - RNA, 17 nt, Homo sapiens
aaaugcuuucaaguuca

SEQ ID NO: 634 - RNA, 17 nt, Homo sapiens
aaugcuuucaaguucau

SEQ ID NO: 635 - RNA, 17 nt, Homo sapiens
uuucaaguucaugagcc

SEQ ID NO: 636 - RNA, 17 nt, Homo sapiens
uucaaguucaugagccu

SEQ ID NO: 637 - RNA, 17 nt, Homo sapiens
gaaagaaucaaaaccuu

SEQ ID NO: 638 - RNA, 17 nt, Homo sapiens
caaaaccuuugaagaac

SEQ ID NO: 639 - RNA, 17 nt, Homo sapiens
aaaaccuuugaagaacu

SEQ ID NO: 640 - RNA, 17 nt, Homo sapiens
gaagaacuuuuaccgaa

SEQ ID NO: 641 - RNA, 17 nt, Homo sapiens
aagaacuuuuaccgaau

SEQ ID NO: 642 - RNA, 17 nt, Homo sapiens
agaacuuuuaccgaaug

SEQ ID NO: 643 - RNA, 17 nt, Homo sapiens
gaacuuuuaccgaaugc

SEQ ID NO: 644 - RNA, 17 nt, Homo sapiens
ugccaccuccauguuug

SEQ ID NO: 645 - RNA, 17 nt, Homo sapiens
cuccauguuugaugacu

SEQ ID NO: 646 - RNA, 17 nt, Homo sapiens
uccauguuugaugacua

SEQ ID NO: 647 - RNA, 17 nt, Homo sapiens
ugaugacuaccagggcg

SEQ ID NO: 648 - RNA, 17 nt, Homo sapiens
gcagcacucuguuggcc

SEQ ID NO: 649 - RNA, 17 nt, Homo sapiens
cacucuguuggccucuc

SEQ ID NO: 650 - RNA, 17 nt, Homo sapiens
guuggccucucccaugc

SEQ ID NO: 651 - RNA, 17 nt, Homo sapiens
uggccucucccaugcug

SEQ ID NO: 652 - RNA, 17 nt, Homo sapiens
gaagcgcuucaccugga

SEQ ID NO: 653 - RNA, 17 nt, Homo sapiens
aagcgcuucaccuggac

SEQ ID NO: 654 - RNA, 17 nt, Homo sapiens
caaggccucgcucaaga

SEQ ID NO: 655 - RNA, 17 nt, Homo sapiens
gccucgcucaagauuga

SEQ ID NO: 656 - RNA, 17 nt, Homo sapiens
cucaagauugacuugag

SEQ ID NO: 657 - RNA, 17 nt, Homo sapiens
gauugacuugagaguaa

SEQ ID NO: 658 - RNA, 17 nt, Homo sapiens
uugagaguaaccaguaa

SEQ ID NO: 659 - RNA, 17 nt, Homo sapiens
uaaccaguaaaaguaag

SEQ ID NO: 660 - RNA, 17 nt, Homo sapiens
guaaaaguaaggagucg

SEQ ID NO: 661 - RNA, 17 nt, Homo sapiens
uaaggagucggggcugu

SEQ ID NO: 662 - RNA, 17 nt, Homo sapiens
ggggcugucugauguca

SEQ ID NO: 663 - RNA, 17 nt, Homo sapiens
ucugaugucagcaggcc

SEQ ID NO: 664 - RNA, 17 nt, Homo sapiens
ggcccaguuucugccau

SEQ ID NO: 665 - RNA, 17 nt, Homo sapiens
gcccaguuucugccauu

SEQ ID NO: 666 - RNA, 17 nt, Homo sapiens
cccaguuucugccauuc

SEQ ID NO: 667 - RNA, 17 nt, Homo sapiens
ucugccauuccagcugu

SEQ ID NO: 668 - RNA, 17 nt, Homo sapiens
cugccauuccagcugug

SEQ ID NO: 669 - RNA, 17 nt, Homo sapiens
gggcacgucagcgaagg

SEQ ID NO: 670 - RNA, 17 nt, Homo sapiens
gcgcagguucaccuacg

SEQ ID NO: 671 - RNA, 17 nt, Homo sapiens
cgcagguucaccuacga

SEQ ID NO: 672 - RNA, 17 nt, Homo sapiens
guucaccuacgaccacg

SEQ ID NO: 673 - RNA, 17 nt, Homo sapiens
aggaaaaucgcgugcug

SEQ ID NO: 674 - RNA, 17 nt, Homo sapiens
gugcugcuccccgcccc

SEQ ID NO: 675 - RNA, 17 nt, Homo sapiens
cccagacuacaacucgg

SEQ ID NO: 676 - RNA, 17 nt, Homo sapiens
cuacaacucgguggucc

SEQ ID NO: 677 - RNA, 17 nt, Homo sapiens
ucggugguccuguacuc

SEQ ID NO: 678 - RNA, 17 nt, Homo sapiens
gguccuguacuccaccc

SEQ ID NO: 679 - RNA, 17 nt, Homo sapiens
ccuguacuccaccccac

SEQ ID NO: 680 - RNA, 17 nt, Homo sapiens
ccacccaucuagaguuu

SEQ ID NO: 681 - RNA, 17 nt, Homo sapiens
acccaucuagaguuuga

SEQ ID NO: 682 - RNA, 17 nt, Homo sapiens
ucuagaguuugacacga

SEQ ID NO: 683 - RNA, 17 nt, Homo sapiens
cuagaguuugacacgaa

SEQ ID NO: 684 - RNA, 17 nt, Homo sapiens
cgaagccuuauuucuag

SEQ ID NO: 685 - RNA, 17 nt, Homo sapiens
gaagccuuauuucuaga

SEQ ID NO: 686 - RNA, 17 nt, Homo sapiens
agccuuauuucuagaag

SEQ ID NO: 687 - RNA, 17 nt, Homo sapiens
gccuuauuucuagaagc

SEQ ID NO: 688 - RNA, 17 nt, Homo sapiens
ccuuauuucuagaagca

SEQ ID NO: 689 - RNA, 17 nt, Homo sapiens
uuauuucuagaagcaca

SEQ ID NO: 690 - RNA, 17 nt, Homo sapiens
acauguguauuuauacc

SEQ ID NO: 691 - RNA, 17 nt, Homo sapiens
auguguauuuauacccc

SEQ ID NO: 692 - RNA, 17 nt, Homo sapiens
uguguauuuauaccccc

SEQ ID NO: 693 - RNA, 17 nt, Homo sapiens
guguauuuauaccccca

SEQ ID NO: 694 - RNA, 17 nt, Homo sapiens
guauuuauacccccagg

SEQ ID NO: 695 - RNA, 17 nt, Homo sapiens
aggaaacuagcuuuugc

SEQ ID NO: 696 - RNA, 17 nt, Homo sapiens
aacuagcuuuugccagu

SEQ ID NO: 697 - RNA, 17 nt, Homo sapiens
acuagcuuuugccagua

SEQ ID NO: 698 - RNA, 17 nt, Homo sapiens
cuagcuuuugccaguau

SEQ ID NO: 699 - RNA, 17 nt, Homo sapiens
uugccaguauuaugcau

SEQ ID NO: 700 - RNA, 17 nt, Homo sapiens
gccaguauuaugcauau

SEQ ID NO: 701 - RNA, 17 nt, Homo sapiens
ccaguauuaugcauaua

SEQ ID NO: 702 - RNA, 17 nt, Homo sapiens
uuaugcauauauaaguu

SEQ ID NO: 703 - RNA, 17 nt, Homo sapiens
augcauauauaaguuua

SEQ ID NO: 704 - RNA, 17 nt, Homo sapiens
gcauauauaaguuuaca

SEQ ID NO: 705 - RNA, 17 nt, Homo sapiens
auauaaguuuacaccuu

SEQ ID NO: 706 - RNA, 17 nt, Homo sapiens
uauaaguuuacaccuuu

SEQ ID NO: 707 - RNA, 17 nt, Homo sapiens
auaaguuuacaccuuua

SEQ ID NO: 708 - RNA, 17 nt, Homo sapiens
uuacaccuuuaucuuuc

SEQ ID NO: 709 - RNA, 17 nt, Homo sapiens
uacaccuuuaucuuucc

SEQ ID NO: 710 - RNA, 17 nt, Homo sapiens
acaccuuuaucuuucca

SEQ ID NO: 711 - RNA, 17 nt, Homo sapiens
accuuuaucuuuccaug

SEQ ID NO: 712 - RNA, 17 nt, Homo sapiens
cuuuaucuuuccauggg

SEQ ID NO: 713 - RNA, 17 nt, Homo sapiens
uuuaucuuuccauggga

SEQ ID NO: 714 - RNA, 17 nt, Homo sapiens
uuaucuuuccaugggag

SEQ ID NO: 715 - RNA, 17 nt, Homo sapiens
cagcugcuuuuugugau

SEQ ID NO: 716 - RNA, 17 nt, Homo sapiens
agcugcuuuuugugauu

SEQ ID NO: 717 - RNA, 17 nt, Homo sapiens
gcugcuuuuugugauuu

SEQ ID NO: 718 - RNA, 17 nt, Homo sapiens
cugcuuuuugugauuuu

SEQ ID NO: 719 - RNA, 17 nt, Homo sapiens
uuugugauuuuuuuaau

SEQ ID NO: 720 - RNA, 17 nt, Homo sapiens
uugugauuuuuuuaaua

SEQ ID NO: 721 - RNA, 17 nt, Homo sapiens
ugugauuuuuuuaauag

SEQ ID NO: 722 - RNA, 17 nt, Homo sapiens
gugauuuuuuuaauagu

SEQ ID NO: 723 - RNA, 17 nt, Homo sapiens
ugauuuuuuuaauagug

SEQ ID NO: 724 - RNA, 17 nt, Homo sapiens
gauuuuuuuaauagugc

SEQ ID NO: 725 - RNA, 17 nt, Homo sapiens
auuuuuuuaauagugcu

SEQ ID NO: 726 - RNA, 17 nt, Homo sapiens
uuuuuaauagugcuuuu

SEQ ID NO: 727 - RNA, 17 nt, Homo sapiens
auagugcuuuuuuuuuu

SEQ ID NO: 728 - RNA, 17 nt, Homo sapiens
uagugcuuuuuuuuuuu

SEQ ID NO: 729 - RNA, 17 nt, Homo sapiens
agugcuuuuuuuuuuug

SEQ ID NO: 730 - RNA, 17 nt, Homo sapiens
gugcuuuuuuuuuuuga

SEQ ID NO: 731 - RNA, 17 nt, Homo sapiens
ugcuuuuuuuuuuugac

SEQ ID NO: 732 - RNA, 17 nt, Homo sapiens
gcuuuuuuuuuuugacu

SEQ ID NO: 733 - RNA, 17 nt, Homo sapiens
cuuuuuuuuuuugacua

SEQ ID NO: 734 - RNA, 17 nt, Homo sapiens
uuuuuuuuuuugacuaa

SEQ ID NO: 735 - RNA, 17 nt, Homo sapiens
uuuuuuuuuugacuaac

SEQ ID NO: 736 - RNA, 17 nt, Homo sapiens
uuuuuuuuugacuaaca

SEQ ID NO: 737 - RNA, 17 nt, Homo sapiens
uuuugacuaacaagaau

SEQ ID NO: 738 - RNA, 17 nt, Homo sapiens
aagaauguaacuccaga

SEQ ID NO: 739 - RNA, 17 nt, Homo sapiens
auguaacuccagauaga

SEQ ID NO: 740 - RNA, 17 nt, Homo sapiens
cuccagauagagaaaua

SEQ ID NO: 741 - RNA, 17 nt, Homo sapiens
agagaaauagugacaag

SEQ ID NO: 742 - RNA, 17 nt, Homo sapiens
agaacacuacugcuaaa

SEQ ID NO: 743 - RNA, 17 nt, Homo sapiens
cuacugcuaaauccuca

SEQ ID NO: 744 - RNA, 17 nt, Homo sapiens
ugcuaaauccucauguu

SEQ ID NO: 745 - RNA, 17 nt, Homo sapiens
uaaauccucauguuacu

SEQ ID NO: 746 - RNA, 17 nt, Homo sapiens
ccucauguuacucagug

SEQ ID NO: 747 - RNA, 17 nt, Homo sapiens
cucauguuacucagugu

SEQ ID NO: 748 - RNA, 17 nt, Homo sapiens
auguuacucaguguuag

SEQ ID NO: 749 - RNA, 17 nt, Homo sapiens
cucaguguuagagaaau

SEQ ID NO: 750 - RNA, 17 nt, Homo sapiens
ucaguguuagagaaauc

SEQ ID NO: 751 - RNA, 17 nt, Homo sapiens
agagaaauccuuccuaa

SEQ ID NO: 752 - RNA, 17 nt, Homo sapiens
gaaauccuuccuaaacc

SEQ ID NO: 753 - RNA, 17 nt, Homo sapiens
aaauccuuccuaaaccc

SEQ ID NO: 754 - RNA, 17 nt, Homo sapiens
uccuuccuaaacccaau

SEQ ID NO: 755 - RNA, 17 nt, Homo sapiens
caaugacuucccugcuc

SEQ ID NO: 756 - RNA, 17 nt, Homo sapiens
aaugacuucccugcucc

SEQ ID NO: 757 - RNA, 17 nt, Homo sapiens
ucccugcuccaaccccc

SEQ ID NO: 758 - RNA, 17 nt, Homo sapiens
cgccaccucagggcacg

SEQ ID NO: 759 - RNA, 17 nt, Homo sapiens
ggaccaguuugauugag

SEQ ID NO: 760 - RNA, 17 nt, Homo sapiens
gaccaguuugauugagg

SEQ ID NO: 761 - RNA, 17 nt, Homo sapiens
aguuugauugaggagcu

SEQ ID NO: 762 - RNA, 17 nt, Homo sapiens
gcacugaucacccaaug

SEQ ID NO: 763 - RNA, 17 nt, Homo sapiens
caaugcaucacguaccc

SEQ ID NO: 764 - RNA, 17 nt, Homo sapiens
caucacguaccccacug

SEQ ID NO: 765 - RNA, 17 nt, Homo sapiens
aagcccguuagccccag

SEQ ID NO: 766 - RNA, 17 nt, Homo sapiens
agcccguuagccccagg

SEQ ID NO: 767 - RNA, 17 nt, Homo sapiens
caggggaucacuggcug

SEQ ID NO: 768 - RNA, 17 nt, Homo sapiens
agcaacaucucgggagu

SEQ ID NO: 769 - RNA, 17 nt, Homo sapiens
caacaucucgggagucc

SEQ ID NO: 770 - RNA, 17 nt, Homo sapiens
ucgggaguccucuagca

SEQ ID NO: 771 - RNA, 17 nt, Homo sapiens
ggaguccucuagcaggc

SEQ ID NO: 772 - RNA, 17 nt, Homo sapiens
aguccucuagcaggccu

SEQ ID NO: 773 - RNA, 17 nt, Homo sapiens
gcaggccuaagacaugu

SEQ ID NO: 774 - RNA, 17 nt, Homo sapiens
gaaagaauuugagacgc

SEQ ID NO: 775 - RNA, 17 nt, Homo sapiens
aaagaauuugagacgca

SEQ ID NO: 776 - RNA, 17 nt, Homo sapiens
acggggcucagcaaugc

SEQ ID NO: 777 - RNA, 17 nt, Homo sapiens
aaugccauuucaguggc

SEQ ID NO: 778 - RNA, 17 nt, Homo sapiens
augccauuucaguggcu

SEQ ID NO: 779 - RNA, 17 nt, Homo sapiens
ugccauuucaguggcuu

SEQ ID NO: 780 - RNA, 17 nt, Homo sapiens
caguggcuucccagcuc

SEQ ID NO: 781 - RNA, 17 nt, Homo sapiens
aguggcuucccagcucu

SEQ ID NO: 782 - RNA, 17 nt, Homo sapiens
ucccagcucugacccuu

SEQ ID NO: 783 - RNA, 17 nt, Homo sapiens
cugacccuucuacauuu

SEQ ID NO: 784 - RNA, 17 nt, Homo sapiens
ugacccuucuacauuug

SEQ ID NO: 785 - RNA, 17 nt, Homo sapiens
acccuucuacauuugag

SEQ ID NO: 786 - RNA, 17 nt, Homo sapiens
uucuacauuugagggcc

SEQ ID NO: 787 - RNA, 17 nt, Homo sapiens
ucuacauuugagggccc

SEQ ID NO: 788 - RNA, 17 nt, Homo sapiens
ggggacauuuucuggau

SEQ ID NO: 789 - RNA, 17 nt, Homo sapiens
gggacauuuucuggauu

SEQ ID NO: 790 - RNA, 17 nt, Homo sapiens
ggacauuuucuggauuc

SEQ ID NO: 791 - RNA, 17 nt, Homo sapiens
gacauuuucuggauucu

SEQ ID NO: 792 - RNA, 17 nt, Homo sapiens
uucuggauucugggagg

SEQ ID NO: 793 - RNA, 17 nt, Homo sapiens
ucuggauucugggaggc

SEQ ID NO: 794 - RNA, 17 nt, Homo sapiens
ggacaaauaucuuuuuu

SEQ ID NO: 795 - RNA, 17 nt, Homo sapiens
acaaauaucuuuuuugg

SEQ ID NO: 796 - RNA, 17 nt, Homo sapiens
aaauaucuuuuuuggaa

SEQ ID NO: 797 - RNA, 17 nt, Homo sapiens
aauaucuuuuuuggaac

SEQ ID NO: 798 - RNA, 17 nt, Homo sapiens
auaucuuuuuuggaacu

SEQ ID NO: 799 - RNA, 17 nt, Homo sapiens
uaucuuuuuuggaacua

SEQ ID NO: 800 - RNA, 17 nt, Homo sapiens
aucuuuuuuggaacuaa

SEQ ID NO: 801 - RNA, 17 nt, Homo sapiens
uuggaacuaaagcaaau

SEQ ID NO: 802 - RNA, 17 nt, Homo sapiens
aagcaaauuuuagaccu

SEQ ID NO: 803 - RNA, 17 nt, Homo sapiens
agcaaauuuuagaccuu

SEQ ID NO: 804 - RNA, 17 nt, Homo sapiens
gcaaauuuuagaccuuu

SEQ ID NO: 805 - RNA, 17 nt, Homo sapiens
caaauuuuagaccuuua

SEQ ID NO: 806 - RNA, 17 nt, Homo sapiens
uuagaccuuuaccuaug

SEQ ID NO: 807 - RNA, 17 nt, Homo sapiens
uagaccuuuaccuaugg

SEQ ID NO: 808 - RNA, 17 nt, Homo sapiens
agaccuuuaccuaugga

SEQ ID NO: 809 - RNA, 17 nt, Homo sapiens
cuuuaccuauggaagug

SEQ ID NO: 810 - RNA, 17 nt, Homo sapiens
gaagugguucuaugucc

SEQ ID NO: 811 - RNA, 17 nt, Homo sapiens
aagugguucuaugucca

SEQ ID NO: 812 - RNA, 17 nt, Homo sapiens
gugguucuauguccauu

SEQ ID NO: 813 - RNA, 17 nt, Homo sapiens
uucuauguccauucuca

SEQ ID NO: 814 - RNA, 17 nt, Homo sapiens
auguccauucucauucg

SEQ ID NO: 815 - RNA, 17 nt, Homo sapiens
uguccauucucauucgu

SEQ ID NO: 816 - RNA, 17 nt, Homo sapiens
uccauucucauucgugg

SEQ ID NO: 817 - RNA, 17 nt, Homo sapiens
auucucauucguggcau

SEQ ID NO: 818 - RNA, 17 nt, Homo sapiens
uucucauucguggcaug

SEQ ID NO: 819 - RNA, 17 nt, Homo sapiens
uggcauguuuugauuug

SEQ ID NO: 820 - RNA, 17 nt, Homo sapiens
ggcauguuuugauuugu

SEQ ID NO: 821 - RNA, 17 nt, Homo sapiens
gcauguuuugauuugua

SEQ ID NO: 822 - RNA, 17 nt, Homo sapiens
guuuugauuuguagcac

SEQ ID NO: 823 - RNA, 17 nt, Homo sapiens
uuuugauuuguagcacu

SEQ ID NO: 824 - RNA, 17 nt, Homo sapiens
ugauuuguagcacugag

SEQ ID NO: 825 - RNA, 17 nt, Homo sapiens
guggcacucaacucuga

SEQ ID NO: 826 - RNA, 17 nt, Homo sapiens
acucaacucugagccca

SEQ ID NO: 827 - RNA, 17 nt, Homo sapiens
gagcccauacuuuuggc

SEQ ID NO: 828 - RNA, 17 nt, Homo sapiens
cccauacuuuuggcucc

SEQ ID NO: 829 - RNA, 17 nt, Homo sapiens
ccauacuuuuggcuccu

SEQ ID NO: 830 - RNA, 17 nt, Homo sapiens
cauacuuuuggcuccuc

SEQ ID NO: 831 - RNA, 17 nt, Homo sapiens
uuuuggcuccucuagua

SEQ ID NO: 832 - RNA, 17 nt, Homo sapiens
uggcuccucuaguaaga

SEQ ID NO: 833 - RNA, 17 nt, Homo sapiens
gcuccucuaguaagaug

SEQ ID NO: 834 - RNA, 17 nt, Homo sapiens
ccucuaguaagaugcac

SEQ ID NO: 835 - RNA, 17 nt, Homo sapiens
ugaaaacuuagccagag

SEQ ID NO: 836 - RNA, 17 nt, Homo sapiens
gaaaacuuagccagagu

SEQ ID NO: 837 - RNA, 17 nt, Homo sapiens
gccagaguuagguuguc

SEQ ID NO: 838 - RNA, 17 nt, Homo sapiens
ccagaguuagguugucu

SEQ ID NO: 839 - RNA, 17 nt, Homo sapiens
aguuagguugucuccag

SEQ ID NO: 840 - RNA, 17 nt, Homo sapiens
uagguugucuccaggcc

SEQ ID NO: 841 - RNA, 17 nt, Homo sapiens
gguugucuccaggccau

SEQ ID NO: 842 - RNA, 17 nt, Homo sapiens
gauggccuuacacugaa

SEQ ID NO: 843 - RNA, 17 nt, Homo sapiens
auggccuuacacugaaa

SEQ ID NO: 844 - RNA, 17 nt, Homo sapiens
gaaaaugucacauucua

SEQ ID NO: 845 - RNA, 17 nt, Homo sapiens
ugucacauucuauuuug

SEQ ID NO: 846 - RNA, 17 nt, Homo sapiens
gucacauucuauuuugg

SEQ ID NO: 847 - RNA, 17 nt, Homo sapiens
cacauucuauuuugggu

SEQ ID NO: 848 - RNA, 17 nt, Homo sapiens
cauucuauuuuggguau

SEQ ID NO: 849 - RNA, 17 nt, Homo sapiens
auucuauuuuggguauu

SEQ ID NO: 850 - RNA, 17 nt, Homo sapiens
uucuauuuuggguauua

SEQ ID NO: 851 - RNA, 17 nt, Homo sapiens
uuuuggguauuaauaua

SEQ ID NO: 852 - RNA, 17 nt, Homo sapiens
uuggguauuaauauaua

SEQ ID NO: 853 - RNA, 17 nt, Homo sapiens
uggguauuaauauauag

SEQ ID NO: 854 - RNA, 17 nt, Homo sapiens
guauuaauauauagucc

SEQ ID NO: 855 - RNA, 17 nt, Homo sapiens
auuaauauauaguccag

SEQ ID NO: 856 - RNA, 17 nt, Homo sapiens
uaauauauaguccagac

SEQ ID NO: 857 - RNA, 17 nt, Homo sapiens
uauauaguccagacacu

SEQ ID NO: 858 - RNA, 17 nt, Homo sapiens
cagacacuuaacucaau

SEQ ID NO: 859 - RNA, 17 nt, Homo sapiens
agacacuuaacucaauu

SEQ ID NO: 860 - RNA, 17 nt, Homo sapiens
acuuaacucaauuucuu

SEQ ID NO: 861 - RNA, 17 nt, Homo sapiens
aacucaauuucuuggua

SEQ ID NO: 862 - RNA, 17 nt, Homo sapiens
acucaauuucuugguau

SEQ ID NO: 863 - RNA, 17 nt, Homo sapiens
cucaauuucuugguauu

SEQ ID NO: 864 - RNA, 17 nt, Homo sapiens
caauuucuugguauuau

SEQ ID NO: 865 - RNA, 17 nt, Homo sapiens
uucuugguauuauucug

SEQ ID NO: 866 - RNA, 17 nt, Homo sapiens
cuugguauuauucuguu

SEQ ID NO: 867 - RNA, 17 nt, Homo sapiens
uugguauuauucuguuu

SEQ ID NO: 868 - RNA, 17 nt, Homo sapiens
gguauuauucuguuuug

SEQ ID NO: 869 - RNA, 17 nt, Homo sapiens
guauuauucuguuuugc

SEQ ID NO: 870 - RNA, 17 nt, Homo sapiens
uauucuguuuugcacag

SEQ ID NO: 871 - RNA, 17 nt, Homo sapiens
auucuguuuugcacagu

SEQ ID NO: 872 - RNA, 17 nt, Homo sapiens
uucuguuuugcacaguu

SEQ ID NO: 873 - RNA, 17 nt, Homo sapiens
ugcacaguuaguuguga

SEQ ID NO: 874 - RNA, 17 nt, Homo sapiens
gcacaguuaguugugaa

SEQ ID NO: 875 - RNA, 17 nt, Homo sapiens
caguuaguugugaaaga

SEQ ID NO: 876 - RNA, 17 nt, Homo sapiens
aaugcaguccugaggag

SEQ ID NO: 877 - RNA, 17 nt, Homo sapiens
aggagaguuuucuccau

SEQ ID NO: 878 - RNA, 17 nt, Homo sapiens
ggagaguuuucuccaua

SEQ ID NO: 879 - RNA, 17 nt, Homo sapiens
gagaguuuucuccauau

SEQ ID NO: 880 - RNA, 17 nt, Homo sapiens
agaguuuucuccauauc

SEQ ID NO: 881 - RNA, 17 nt, Homo sapiens
aguuuucuccauaucaa

SEQ ID NO: 882 - RNA, 17 nt, Homo sapiens
uucuccauaucaaaacg

SEQ ID NO: 883 - RNA, 17 nt, Homo sapiens
cuccauaucaaaacgag

SEQ ID NO: 884 - RNA, 17 nt, Homo sapiens
aaaaaggucaauaaggu

SEQ ID NO: 885 - RNA, 17 nt, Homo sapiens
aggucaauaaggucaag

SEQ ID NO: 886 - RNA, 17 nt, Homo sapiens
aauaaggucaagggaag

SEQ ID NO: 887 - RNA, 17 nt, Homo sapiens
gaccccgucucuauacc

SEQ ID NO: 888 - RNA, 17 nt, Homo sapiens
ccccgucucuauaccaa

SEQ ID NO: 889 - RNA, 17 nt, Homo sapiens
ccgucucuauaccaacc

SEQ ID NO: 890 - RNA, 17 nt, Homo sapiens
gucucuauaccaaccaa

SEQ ID NO: 891 - RNA, 17 nt, Homo sapiens
aaaccaauucaccaaca

SEQ ID NO: 892 - RNA, 17 nt, Homo sapiens
aaccaauucaccaacac

SEQ ID NO: 893 - RNA, 17 nt, Homo sapiens
aacacaguugggaccca

SEQ ID NO: 894 - RNA, 17 nt, Homo sapiens
caggaagucagucacgu

SEQ ID NO: 895 - RNA, 17 nt, Homo sapiens
aagucagucacguuucc

SEQ ID NO: 896 - RNA, 17 nt, Homo sapiens
agucacguuuccuuuuc

SEQ ID NO: 897 - RNA, 17 nt, Homo sapiens
gucacguuuccuuuuca

SEQ ID NO: 898 - RNA, 17 nt, Homo sapiens
ucacguuuccuuuucau

SEQ ID NO: 899 - RNA, 17 nt, Homo sapiens
cguuuccuuuucauuua

SEQ ID NO: 900 - RNA, 17 nt, Homo sapiens
guuuccuuuucauuuaa

SEQ ID NO: 901 - RNA, 17 nt, Homo sapiens
uuuccuuuucauuuaau

SEQ ID NO: 902 - RNA, 17 nt, Homo sapiens
uuccuuuucauuuaaug

SEQ ID NO: 903 - RNA, 17 nt, Homo sapiens
cuuuucauuuaaugggg

SEQ ID NO: 904 - RNA, 17 nt, Homo sapiens
uuuucauuuaaugggga

SEQ ID NO: 905 - RNA, 17 nt, Homo sapiens
uuucauuuaauggggau

SEQ ID NO: 906 - RNA, 17 nt, Homo sapiens
auggggauuccacuauc

SEQ ID NO: 907 - RNA, 17 nt, Homo sapiens
uggggauuccacuaucu

SEQ ID NO: 908 - RNA, 17 nt, Homo sapiens
auuccacuaucucacac

SEQ ID NO: 909 - RNA, 17 nt, Homo sapiens
uccacuaucucacacua

SEQ ID NO: 910 - RNA, 17 nt, Homo sapiens
cacuaucucacacuaau

SEQ ID NO: 911 - RNA, 17 nt, Homo sapiens
cucacacuaaucugaaa

SEQ ID NO: 912 - RNA, 17 nt, Homo sapiens
acacuaaucugaaagga

SEQ ID NO: 913 - RNA, 17 nt, Homo sapiens
aagagcauuagcuggcg

SEQ ID NO: 914 - RNA, 17 nt, Homo sapiens
agagcauuagcuggcgc

SEQ ID NO: 915 - RNA, 17 nt, Homo sapiens
uggcgcauauuaagcac

SEQ ID NO: 916 - RNA, 17 nt, Homo sapiens
gcgcauauuaagcacuu

SEQ ID NO: 917 - RNA, 17 nt, Homo sapiens
cgcauauuaagcacuuu

SEQ ID NO: 918 - RNA, 17 nt, Homo sapiens
uaagcacuuuaagcucc

SEQ ID NO: 919 - RNA, 17 nt, Homo sapiens
aagcacuuuaagcuccu

SEQ ID NO: 920 - RNA, 17 nt, Homo sapiens
agcacuuuaagcuccuu

SEQ ID NO: 921 - RNA, 17 nt, Homo sapiens
uuuaagcuccuugagua

SEQ ID NO: 922 - RNA, 17 nt, Homo sapiens
aagcuccuugaguaaaa

SEQ ID NO: 923 - RNA, 17 nt, Homo sapiens
ccuugaguaaaaaggug

SEQ ID NO: 924 - RNA, 17 nt, Homo sapiens
aaggugguauguaauuu

SEQ ID NO: 925 - RNA, 17 nt, Homo sapiens
ugguauguaauuuaugc

SEQ ID NO: 926 - RNA, 17 nt, Homo sapiens
uauguaauuuaugcaag

SEQ ID NO: 927 - RNA, 17 nt, Homo sapiens
auguaauuuaugcaagg

SEQ ID NO: 928 - RNA, 17 nt, Homo sapiens
uguaauuuaugcaaggu

SEQ ID NO: 929 - RNA, 17 nt, Homo sapiens
ugcaagguauuucucca

SEQ ID NO: 930 - RNA, 17 nt, Homo sapiens
caagguauuucuccagu

SEQ ID NO: 931 - RNA, 17 nt, Homo sapiens
aagguauuucuccaguu

SEQ ID NO: 932 - RNA, 17 nt, Homo sapiens
agguauuucuccaguug

SEQ ID NO: 933 - RNA, 17 nt, Homo sapiens
guauuucuccaguuggg

SEQ ID NO: 934 - RNA, 17 nt, Homo sapiens
ucuccaguugggacuca

SEQ ID NO: 935 - RNA, 17 nt, Homo sapiens
uugggacucaggauauu

SEQ ID NO: 936 - RNA, 17 nt, Homo sapiens
cucaggauauuaguuaa

SEQ ID NO: 937 - RNA, 17 nt, Homo sapiens
caggauauuaguuaaug

SEQ ID NO: 938 - RNA, 17 nt, Homo sapiens
aggauauuaguuaauga

SEQ ID NO: 939 - RNA, 17 nt, Homo sapiens
auauuaguuaaugagcc

SEQ ID NO: 940 - RNA, 17 nt, Homo sapiens
uauuaguuaaugagcca

SEQ ID NO: 941 - RNA, 17 nt, Homo sapiens
ugagccaucacuagaag

SEQ ID NO: 942 - RNA, 17 nt, Homo sapiens
ccaucacuagaagaaaa

SEQ ID NO: 943 - RNA, 17 nt, Homo sapiens
aagcccauuuucaacug

SEQ ID NO: 944 - RNA, 17 nt, Homo sapiens
agcccauuuucaacugc

SEQ ID NO: 945 - RNA, 17 nt, Homo sapiens
gcccauuuucaacugcu

SEQ ID NO: 946 - RNA, 17 nt, Homo sapiens
cccauuuucaacugcuu

SEQ ID NO: 947 - RNA, 17 nt, Homo sapiens
caacugcuuugaaacuu

SEQ ID NO: 948 - RNA, 17 nt, Homo sapiens
aacugcuuugaaacuug

SEQ ID NO: 949 - RNA, 17 nt, Homo sapiens
uugaaacuugccugggg

SEQ ID NO: 950 - RNA, 17 nt, Homo sapiens
ccuggggucugagcaug

SEQ ID NO: 951 - RNA, 17 nt, Homo sapiens
augggaauagggagaca

SEQ ID NO: 952 - RNA, 17 nt, Homo sapiens
gacaggguaggaaaggg

SEQ ID NO: 953 - RNA, 17 nt, Homo sapiens
gggcgccuacucuucag

SEQ ID NO: 954 - RNA, 17 nt, Homo sapiens
cgccuacucuucagggu

SEQ ID NO: 955 - RNA, 17 nt, Homo sapiens
ccuacucuucagggucu

SEQ ID NO: 956 - RNA, 17 nt, Homo sapiens
cuacucuucagggucua

SEQ ID NO: 957 - RNA, 17 nt, Homo sapiens
uucagggucuaaagauc

SEQ ID NO: 958 - RNA, 17 nt, Homo sapiens
cagggucuaaagaucaa

SEQ ID NO: 959 - RNA, 17 nt, Homo sapiens
cuaaagaucaagugggc

SEQ ID NO: 960 - RNA, 17 nt, Homo sapiens
gugggccuuggaucgcu

SEQ ID NO: 961 - RNA, 17 nt, Homo sapiens
ccuuggaucgcuaagcu

SEQ ID NO: 962 - RNA, 17 nt, Homo sapiens
ggaucgcuaagcuggcu

SEQ ID NO: 963 - RNA, 17 nt, Homo sapiens
agcuggcucuguuugau

SEQ ID NO: 964 - RNA, 17 nt, Homo sapiens
ggcucuguuugaugcua

SEQ ID NO: 965 - RNA, 17 nt, Homo sapiens
gcucuguuugaugcuau

SEQ ID NO: 966 - RNA, 17 nt, Homo sapiens
uugaugcuauuuaugca

SEQ ID NO: 967 - RNA, 17 nt, Homo sapiens
gaugcuauuuaugcaag

SEQ ID NO: 968 - RNA, 17 nt, Homo sapiens
augcuauuuaugcaagu

SEQ ID NO: 969 - RNA, 17 nt, Homo sapiens
ugcuauuuaugcaaguu

SEQ ID NO: 970 - RNA, 17 nt, Homo sapiens
augcaaguuagggucua

SEQ ID NO: 971 - RNA, 17 nt, Homo sapiens
ugcaaguuagggucuau

SEQ ID NO: 972 - RNA, 17 nt, Homo sapiens
guuagggucuauguauu

SEQ ID NO: 973 - RNA, 17 nt, Homo sapiens
uagggucuauguauuua

SEQ ID NO: 974 - RNA, 17 nt, Homo sapiens
gucuauguauuuaggau

SEQ ID NO: 975 - RNA, 17 nt, Homo sapiens
cuauguauuuaggaugc

SEQ ID NO: 976 - RNA, 17 nt, Homo sapiens
uauguauuuaggaugcg

SEQ ID NO: 977 - RNA, 17 nt, Homo sapiens
auguauuuaggaugcgc

SEQ ID NO: 978 - RNA, 17 nt, Homo sapiens
augcgccuacucuucag

SEQ ID NO: 979 - RNA, 17 nt, Homo sapiens
cuauguauuuaggaugu

SEQ ID NO: 980 - RNA, 17 nt, Homo sapiens
uauguauuuaggauguc

SEQ ID NO: 981 - RNA, 17 nt, Homo sapiens
auguauuuaggaugucu

SEQ ID NO: 982 - RNA, 17 nt, Homo sapiens
uaggaugucugcaccuu

SEQ ID NO: 983 - RNA, 17 nt, Homo sapiens
cugcaccuucugcagcc

SEQ ID NO: 984 - RNA, 17 nt, Homo sapiens
ugcaccuucugcagcca

SEQ ID NO: 985 - RNA, 17 nt, Homo sapiens
cagccagucagaagcug

SEQ ID NO: 986 - RNA, 17 nt, Homo sapiens
caguggauugcugcuuc

SEQ ID NO: 987 - RNA, 17 nt, Homo sapiens
uugcugcuucuugggga

SEQ ID NO: 988 - RNA, 17 nt, Homo sapiens
ugcugcuucuuggggag

SEQ ID NO: 989 - RNA, 17 nt, Homo sapiens
cugcuucuuggggagaa

SEQ ID NO: 990 - RNA, 17 nt, Homo sapiens
agaagaguaugcuuccu

SEQ ID NO: 991 - RNA, 17 nt, Homo sapiens
aguaugcuuccuuuuau

SEQ ID NO: 992 - RNA, 17 nt, Homo sapiens
guaugcuuccuuuuauc

SEQ ID NO: 993 - RNA, 17 nt, Homo sapiens
ugcuuccuuuuauccau

SEQ ID NO: 994 - RNA, 17 nt, Homo sapiens
gcuuccuuuuauccaug

SEQ ID NO: 995 - RNA, 17 nt, Homo sapiens
cuuccuuuuauccaugu

SEQ ID NO: 996 - RNA, 17 nt, Homo sapiens
uuccuuuuauccaugua

SEQ ID NO: 997 - RNA, 17 nt, Homo sapiens
ccuuuuauccauguaau

SEQ ID NO: 998 - RNA, 17 nt, Homo sapiens
auccauguaauuuaacu

SEQ ID NO: 999 - RNA, 17 nt, Homo sapiens
cauguaauuuaacugua

SEQ ID NO: 1000 - RNA, 17 nt, Homo sapiens
auguaauuuaacuguag

SEQ ID NO: 1001 - RNA, 17 nt, Homo sapiens
uguaauuuaacuguaga

SEQ ID NO: 1002 - RNA, 17 nt, Homo sapiens
uuaacuguagaaccuga

SEQ ID NO: 1003 - RNA, 17 nt, Homo sapiens
ccugagcucuaaguaac

SEQ ID NO: 1004 - RNA, 17 nt, Homo sapiens
ugagcucuaaguaaccg

SEQ ID NO: 1005 - RNA, 17 nt, Homo sapiens
cucuaaguaaccgaaga

SEQ ID NO: 1006 - RNA, 17 nt, Homo sapiens
aagaauguaugccucug

SEQ ID NO: 1007 - RNA, 17 nt, Homo sapiens
guaugccucuguucuua

SEQ ID NO: 1008 - RNA, 17 nt, Homo sapiens
gccucuguucuuaugug

SEQ ID NO: 1009 - RNA, 17 nt, Homo sapiens
ccucuguucuuaugugc

SEQ ID NO: 1010 - RNA, 17 nt, Homo sapiens
ucuguucuuaugugcca

SEQ ID NO: 1011 - RNA, 17 nt, Homo sapiens
cuguucuuaugugccac

SEQ ID NO: 1012 - RNA, 17 nt, Homo sapiens
ugccacauccuuguuua

SEQ ID NO: 1013 - RNA, 17 nt, Homo sapiens
cacauccuuguuuaaag

SEQ ID NO: 1014 - RNA, 17 nt, Homo sapiens
auccuuguuuaaaggcu

SEQ ID NO: 1015 - RNA, 17 nt, Homo sapiens
uccuuguuuaaaggcuc

SEQ ID NO: 1016 - RNA, 17 nt, Homo sapiens
ccuuguuuaaaggcucu

SEQ ID NO: 1017 - RNA, 17 nt, Homo sapiens
uaaaggcucucuguaug

SEQ ID NO: 1018 - RNA, 17 nt, Homo sapiens
aaggcucucuguaugaa

SEQ ID NO: 1019 - RNA, 17 nt, Homo sapiens
cucucuguaugaagaga

SEQ ID NO: 1020 - RNA, 17 nt, Homo sapiens
gggaccgucaucagcac

SEQ ID NO: 1021 - RNA, 17 nt, Homo sapiens
accgucaucagcacauu

SEQ ID NO: 1022 - RNA, 17 nt, Homo sapiens
cagcacauucccuagug

SEQ ID NO: 1023 - RNA, 17 nt, Homo sapiens
agcacauucccuaguga

SEQ ID NO: 1024 - RNA, 17 nt, Homo sapiens
cauucccuagugagccu

SEQ ID NO: 1025 - RNA, 17 nt, Homo sapiens
gugagccuacuggcucc

SEQ ID NO: 1026 - RNA, 17 nt, Homo sapiens
uacuggcuccuggcagc

SEQ ID NO: 1027 - RNA, 17 nt, Homo sapiens
cagcggcuuuuguggaa

SEQ ID NO: 1028 - RNA, 17 nt, Homo sapiens
agcggcuuuuguggaag

SEQ ID NO: 1029 - RNA, 17 nt, Homo sapiens
gcggcuuuuguggaaga

SEQ ID NO: 1030 - RNA, 17 nt, Homo sapiens
ggaagacucacuagcca

SEQ ID NO: 1031 - RNA, 17 nt, Homo sapiens
gacucacuagccagaag

SEQ ID NO: 1032 - RNA, 17 nt, Homo sapiens
gggacaguccucuccac

SEQ ID NO: 1033 - RNA, 17 nt, Homo sapiens
acaguccucuccaccaa

SEQ ID NO: 1034 - RNA, 17 nt, Homo sapiens
aguccucuccaccaaga

SEQ ID NO: 1035 - RNA, 17 nt, Homo sapiens
accaagaucuaaaucca

SEQ ID NO: 1036 - RNA, 17 nt, Homo sapiens
caagaucuaaauccaaa

SEQ ID NO: 1037 - RNA, 17 nt, Homo sapiens
aucuaaauccaaacaaa

SEQ ID NO: 1038 - RNA, 17 nt, Homo sapiens
agcaggcuagagccaga

SEQ ID NO: 1039 - RNA, 17 nt, Homo sapiens
ggacaaaucuuuguugu

SEQ ID NO: 1040 - RNA, 17 nt, Homo sapiens
acaaaucuuuguuguuc

SEQ ID NO: 1041 - RNA, 17 nt, Homo sapiens
caaaucuuuguuguucc

SEQ ID NO: 1042 - RNA, 17 nt, Homo sapiens
aucuuuguuguuccucu

SEQ ID NO: 1043 - RNA, 17 nt, Homo sapiens
uuuguuguuccucuucu

SEQ ID NO: 1044 - RNA, 17 nt, Homo sapiens
uuguuguuccucuucuu

SEQ ID NO: 1045 - RNA, 17 nt, Homo sapiens
uuguuccucuucuuuac

SEQ ID NO: 1046 - RNA, 17 nt, Homo sapiens
guuccucuucuuuacac

SEQ ID NO: 1047 - RNA, 17 nt, Homo sapiens
uuccucuucuuuacaca

SEQ ID NO: 1048 - RNA, 17 nt, Homo sapiens
ccucuucuuuacacaua

SEQ ID NO: 1049 - RNA, 17 nt, Homo sapiens
cucuucuuuacacauac

SEQ ID NO: 1050 - RNA, 17 nt, Homo sapiens
ucuucuuuacacauacg

SEQ ID NO: 1051 - RNA, 17 nt, Homo sapiens
uuacacauacgcaaacc

SEQ ID NO: 1052 - RNA, 17 nt, Homo sapiens
cuggcaauuuuauaaau

SEQ ID NO: 1053 - RNA, 17 nt, Homo sapiens
uggcaauuuuauaaauc

SEQ ID NO: 1054 - RNA, 17 nt, Homo sapiens
ggcaauuuuauaaauca

SEQ ID NO: 1055 - RNA, 17 nt, Homo sapiens
gcaauuuuauaaaucag

SEQ ID NO: 1056 - RNA, 17 nt, Homo sapiens
aauuuuauaaaucaggu

SEQ ID NO: 1057 - RNA, 17 nt, Homo sapiens
uuauaaaucagguaacu

SEQ ID NO: 1058 - RNA, 17 nt, Homo sapiens
aaucagguaacuggaag

SEQ ID NO: 1059 - RNA, 17 nt, Homo sapiens
aaggagguuaaacucag

SEQ ID NO: 1060 - RNA, 17 nt, Homo sapiens
aggagguuaaacucaga

SEQ ID NO: 1061 - RNA, 17 nt, Homo sapiens
guuaaacucagaaaaaa

SEQ ID NO: 1062 - RNA, 17 nt, Homo sapiens
gaagaccucagucaauu

SEQ ID NO: 1063 - RNA, 17 nt, Homo sapiens
accucagucaauucucu

SEQ ID NO: 1064 - RNA, 17 nt, Homo sapiens
cagucaauucucuacuu

SEQ ID NO: 1065 - RNA, 17 nt, Homo sapiens
agucaauucucuacuuu

SEQ ID NO: 1066 - RNA, 17 nt, Homo sapiens
ucaauucucuacuuuuu

SEQ ID NO: 1067 - RNA, 17 nt, Homo sapiens
aauucucuacuuuuuuu

SEQ ID NO: 1068 - RNA, 17 nt, Homo sapiens
ucucuacuuuuuuuuuu

SEQ ID NO: 1069 - RNA, 17 nt, Homo sapiens
cucuacuuuuuuuuuuu

SEQ ID NO: 1070 - RNA, 17 nt, Homo sapiens
ucuacuuuuuuuuuuuu

SEQ ID NO: 1071 - RNA, 17 nt, Homo sapiens
cuacuuuuuuuuuuuuu

SEQ ID NO: 1072 - RNA, 17 nt, Homo sapiens
uacuuuuuuuuuuuuuu

SEQ ID NO: 1073 - RNA, 17 nt, Homo sapiens
acuuuuuuuuuuuuuuu

SEQ ID NO: 1074 - RNA, 17 nt, Homo sapiens
cuuuuuuuuuuuuuuuu

SEQ ID NO: 1075 - RNA, 17 nt, Homo sapiens
uuuuuuuuuuuuuuuuc

SEQ ID NO: 1076 - RNA, 17 nt, Homo sapiens
uuuuuuuuuuuuuuucc

SEQ ID NO: 1077 - RNA, 17 nt, Homo sapiens
uuuuuuuuuuuuuucca

SEQ ID NO: 1078 - RNA, 17 nt, Homo sapiens
uuuuuuuuuuuuuccaa

SEQ ID NO: 1079 - RNA, 17 nt, Homo sapiens
uuuuuuuuuuuuccaaa

SEQ ID NO: 1080 - RNA, 17 nt, Homo sapiens
uuuuuuuuuuuccaaau

SEQ ID NO: 1081 - RNA, 17 nt, Homo sapiens
uuuuuuuuuuccaaauc

SEQ ID NO: 1082 - RNA, 17 nt, Homo sapiens
uuuuuuuuuccaaauca

SEQ ID NO: 1083 - RNA, 17 nt, Homo sapiens
uuuuuuuuccaaaucag

SEQ ID NO: 1084 - RNA, 17 nt, Homo sapiens
uuccaaaucagauaaua

SEQ ID NO: 1085 - RNA, 17 nt, Homo sapiens
aaucagauaauagccca

SEQ ID NO: 1086 - RNA, 17 nt, Homo sapiens
cagauaauagcccagca

SEQ ID NO: 1087 - RNA, 17 nt, Homo sapiens
cagcaaauagugauaac

SEQ ID NO: 1088 - RNA, 17 nt, Homo sapiens
auagugauaacaaauaa

SEQ ID NO: 1089 - RNA, 17 nt, Homo sapiens
uaacaaauaaaaccuua

SEQ ID NO: 1090 - RNA, 17 nt, Homo sapiens
uaaaaccuuagcuguuc

SEQ ID NO: 1091 - RNA, 17 nt, Homo sapiens
aaaaccuuagcuguuca

SEQ ID NO: 1092 - RNA, 17 nt, Homo sapiens
uuagcuguucaugucuu

SEQ ID NO: 1093 - RNA, 17 nt, Homo sapiens
uagcuguucaugucuug

SEQ ID NO: 1094 - RNA, 17 nt, Homo sapiens
guucaugucuugauuuc

SEQ ID NO: 1095 - RNA, 17 nt, Homo sapiens
ucaugucuugauuucaa

SEQ ID NO: 1096 - RNA, 17 nt, Homo sapiens
gucuugauuucaauaau

SEQ ID NO: 1097 - RNA, 17 nt, Homo sapiens
ucuugauuucaauaauu

SEQ ID NO: 1098 - RNA, 17 nt, Homo sapiens
cuugauuucaauaauua

SEQ ID NO: 1099 - RNA, 17 nt, Homo sapiens
auuucaauaauuaauuc

SEQ ID NO: 1100 - RNA, 17 nt, Homo sapiens
ucaauaauuaauucuua

SEQ ID NO: 1101 - RNA, 17 nt, Homo sapiens
caauaauuaauucuuaa

SEQ ID NO: 1102 - RNA, 17 nt, Homo sapiens
uaauuaauucuuaauca

SEQ ID NO: 1103 - RNA, 17 nt, Homo sapiens
aauuaauucuuaaucau

SEQ ID NO: 1104 - RNA, 17 nt, Homo sapiens
uuaauucuuaaucauua

SEQ ID NO: 1105 - RNA, 17 nt, Homo sapiens
uaauucuuaaucauuaa

SEQ ID NO: 1106 - RNA, 17 nt, Homo sapiens
uucuuaaucauuaagag

SEQ ID NO: 1107 - RNA, 17 nt, Homo sapiens
uuaaucauuaagagacc

SEQ ID NO: 1108 - RNA, 17 nt, Homo sapiens
uaaucauuaagagacca

SEQ ID NO: 1109 - RNA, 17 nt, Homo sapiens
gagaccauaauaaauac

SEQ ID NO: 1110 - RNA, 17 nt, Homo sapiens
accauaauaaauacucc

SEQ ID NO: 1111 - RNA, 17 nt, Homo sapiens
uaauaaauacuccuuuu

SEQ ID NO: 1112 - RNA, 17 nt, Homo sapiens
uaaauacuccuuuucaa

SEQ ID NO: 1113 - RNA, 17 nt, Homo sapiens
auacuccuuuucaagag

SEQ ID NO: 1114 - RNA, 17 nt, Homo sapiens
uacuccuuuucaagaga

SEQ ID NO: 1115 - RNA, 17 nt, Homo sapiens
acuccuuuucaagagaa

SEQ ID NO: 1116 - RNA, 17 nt, Homo sapiens
cuccuuuucaagagaaa

SEQ ID NO: 1117 - RNA, 17 nt, Homo sapiens
aaaaccauuagaauugu

SEQ ID NO: 1118 - RNA, 17 nt, Homo sapiens
aaaccauuagaauuguu

SEQ ID NO: 1119 - RNA, 17 nt, Homo sapiens
auuagaauuguuacuca

SEQ ID NO: 1120 - RNA, 17 nt, Homo sapiens
agaauuguuacucagcu

SEQ ID NO: 1121 - RNA, 17 nt, Homo sapiens
gaauuguuacucagcuc

SEQ ID NO: 1122 - RNA, 17 nt, Homo sapiens
uuguuacucagcuccuu

SEQ ID NO: 1123 - RNA, 17 nt, Homo sapiens
acucagcuccuucaaac

SEQ ID NO: 1124 - RNA, 17 nt, Homo sapiens
cagcuccuucaaacuca

SEQ ID NO: 1125 - RNA, 17 nt, Homo sapiens
agcuccuucaaacucag

SEQ ID NO: 1126 - RNA, 17 nt, Homo sapiens
uucaaacucagguuugu

SEQ ID NO: 1127 - RNA, 17 nt, Homo sapiens
acucagguuuguagcau

SEQ ID NO: 1128 - RNA, 17 nt, Homo sapiens
cucagguuuguagcaua

SEQ ID NO: 1129 - RNA, 17 nt, Homo sapiens
agguuuguagcauacau

SEQ ID NO: 1130 - RNA, 17 nt, Homo sapiens
uguagcauacaugaguc

SEQ ID NO: 1131 - RNA, 17 nt, Homo sapiens
acaugaguccauccauc

SEQ ID NO: 1132 - RNA, 17 nt, Homo sapiens
gaguccauccaucaguc

SEQ ID NO: 1133 - RNA, 17 nt, Homo sapiens
ccauccaucagucaaag

SEQ ID NO: 1134 - RNA, 17 nt, Homo sapiens
ccaucagucaaagaaug

SEQ ID NO: 1135 - RNA, 17 nt, Homo sapiens
agaaugguuccaucugg

SEQ ID NO: 1136 - RNA, 17 nt, Homo sapiens
gaaugguuccaucugga

SEQ ID NO: 1137 - RNA, 17 nt, Homo sapiens
gguuccaucuggagucu

SEQ ID NO: 1138 - RNA, 17 nt, Homo sapiens
ucuggagucuuaaugua

SEQ ID NO: 1139 - RNA, 17 nt, Homo sapiens
uggagucuuaauguaga

SEQ ID NO: 1140 - RNA, 17 nt, Homo sapiens
ggagucuuaauguagaa

SEQ ID NO: 1141 - RNA, 17 nt, Homo sapiens
cuuaauguagaaagaaa

SEQ ID NO: 1142 - RNA, 17 nt, Homo sapiens
uggagacuuguaauaau

SEQ ID NO: 1143 - RNA, 17 nt, Homo sapiens
agacuuguaauaaugag

SEQ ID NO: 1144 - RNA, 17 nt, Homo sapiens
cuuguaauaaugagcua

SEQ ID NO: 1145 - RNA, 17 nt, Homo sapiens
aaugagcuaguuacaaa

SEQ ID NO: 1146 - RNA, 17 nt, Homo sapiens
gagcuaguuacaaagug

SEQ ID NO: 1147 - RNA, 17 nt, Homo sapiens
agcuaguuacaaagugc

SEQ ID NO: 1148 - RNA, 17 nt, Homo sapiens
aaagugcuuguucauua

SEQ ID NO: 1149 - RNA, 17 nt, Homo sapiens
gugcuuguucauuaaaa

SEQ ID NO: 1150 - RNA, 17 nt, Homo sapiens
ugcuuguucauuaaaau

SEQ ID NO: 1151 - RNA, 17 nt, Homo sapiens
uuguucauuaaaauagc

SEQ ID NO: 1152 - RNA, 17 nt, Homo sapiens
uguucauuaaaauagca

SEQ ID NO: 1153 - RNA, 17 nt, Homo sapiens
auuaaaauagcacugaa

SEQ ID NO: 1154 - RNA, 17 nt, Homo sapiens
cugaaaauugaaacaug

SEQ ID NO: 1155 - RNA, 17 nt, Homo sapiens
acaugaauuaacugaua

SEQ ID NO: 1156 - RNA, 17 nt, Homo sapiens
caugaauuaacugauaa

SEQ ID NO: 1157 - RNA, 17 nt, Homo sapiens
uaacugauaauauucca

SEQ ID NO: 1158 - RNA, 17 nt, Homo sapiens
cugauaauauuccaauc

SEQ ID NO: 1159 - RNA, 17 nt, Homo sapiens
gauaauauuccaaucau

SEQ ID NO: 1160 - RNA, 17 nt, Homo sapiens
auaauauuccaaucauu

SEQ ID NO: 1161 - RNA, 17 nt, Homo sapiens
auuccaaucauuugcca

SEQ ID NO: 1162 - RNA, 17 nt, Homo sapiens
ccaaucauuugccauuu

SEQ ID NO: 1163 - RNA, 17 nt, Homo sapiens
caaucauuugccauuua

SEQ ID NO: 1164 - RNA, 17 nt, Homo sapiens
uuugccauuuaugacaa

SEQ ID NO: 1165 - RNA, 17 nt, Homo sapiens
uugccauuuaugacaaa

SEQ ID NO: 1166 - RNA, 17 nt, Homo sapiens
ugccauuuaugacaaaa

SEQ ID NO: 1167 - RNA, 17 nt, Homo sapiens
aaaaugguuggcacuaa

SEQ ID NO: 1168 - RNA, 17 nt, Homo sapiens
uuggcacuaacaaagaa

SEQ ID NO: 1169 - RNA, 17 nt, Homo sapiens
cgagcacuuccuuucag

SEQ ID NO: 1170 - RNA, 17 nt, Homo sapiens
gagcacuuccuuucaga

SEQ ID NO: 1171 - RNA, 17 nt, Homo sapiens
cacuuccuuucagaguu

SEQ ID NO: 1172 - RNA, 17 nt, Homo sapiens
acuuccuuucagaguuu

SEQ ID NO: 1173 - RNA, 17 nt, Homo sapiens
cuuccuuucagaguuuc

SEQ ID NO: 1174 - RNA, 17 nt, Homo sapiens
uucagaguuucugagau

SEQ ID NO: 1175 - RNA, 17 nt, Homo sapiens
ucagaguuucugagaua

SEQ ID NO: 1176 - RNA, 17 nt, Homo sapiens
cagaguuucugagauaa

SEQ ID NO: 1177 - RNA, 17 nt, Homo sapiens
ucugagauaauguacgu

SEQ ID NO: 1178 - RNA, 17 nt, Homo sapiens
gauaauguacguggaac

SEQ ID NO: 1179 - RNA, 17 nt, Homo sapiens
ggaacagucugggugga

SEQ ID NO: 1180 - RNA, 17 nt, Homo sapiens
gugcaagucugugucuu

SEQ ID NO: 1181 - RNA, 17 nt, Homo sapiens
gucugugucuugucagu

SEQ ID NO: 1182 - RNA, 17 nt, Homo sapiens
cugugucuugucagucc

SEQ ID NO: 1183 - RNA, 17 nt, Homo sapiens
ugucuugucaguccaag

SEQ ID NO: 1184 - RNA, 17 nt, Homo sapiens
uugucaguccaagaagu

SEQ ID NO: 1185 - RNA, 17 nt, Homo sapiens
cgagauguuaauuuuag

SEQ ID NO: 1186 - RNA, 17 nt, Homo sapiens
gagauguuaauuuuagg

SEQ ID NO: 1187 - RNA, 17 nt, Homo sapiens
auguuaauuuuagggac

SEQ ID NO: 1188 - RNA, 17 nt, Homo sapiens
uguuaauuuuagggacc

SEQ ID NO: 1189 - RNA, 17 nt, Homo sapiens
guuaauuuuagggaccc

SEQ ID NO: 1190 - RNA, 17 nt, Homo sapiens
uuaauuuuagggacccg

SEQ ID NO: 1191 - RNA, 17 nt, Homo sapiens
ccgugccuuguuuccua

SEQ ID NO: 1192 - RNA, 17 nt, Homo sapiens
ugccuuguuuccuagcc

SEQ ID NO: 1193 - RNA, 17 nt, Homo sapiens
gccuuguuuccuagccc

SEQ ID NO: 1194 - RNA, 17 nt, Homo sapiens
ccuuguuuccuagccca

SEQ ID NO: 1195 - RNA, 17 nt, Homo sapiens
uguuuccuagcccacaa

SEQ ID NO: 1196 - RNA, 17 nt, Homo sapiens
gcaaacaucaaacagau

SEQ ID NO: 1197 - RNA, 17 nt, Homo sapiens
aaacagauacucgcuag

SEQ ID NO: 1198 - RNA, 17 nt, Homo sapiens
cagauacucgcuagccu

SEQ ID NO: 1199 - RNA, 17 nt, Homo sapiens
uacucgcuagccucauu

SEQ ID NO: 1200 - RNA, 17 nt, Homo sapiens
gcuagccucauuuaaau

SEQ ID NO: 1201 - RNA, 17 nt, Homo sapiens
agccucauuuaaauuga

SEQ ID NO: 1202 - RNA, 17 nt, Homo sapiens
gccucauuuaaauugau

SEQ ID NO: 1203 - RNA, 17 nt, Homo sapiens
ccucauuuaaauugauu

SEQ ID NO: 1204 - RNA, 17 nt, Homo sapiens
auuuaaauugauuaaag

SEQ ID NO: 1205 - RNA, 17 nt, Homo sapiens
aaauugauuaaaggagg

SEQ ID NO: 1206 - RNA, 17 nt, Homo sapiens
aauugauuaaaggagga

SEQ ID NO: 1207 - RNA, 17 nt, Homo sapiens
gagugcaucuuuggccg

SEQ ID NO: 1208 - RNA, 17 nt, Homo sapiens
gugcaucuuuggccgac

SEQ ID NO: 1209 - RNA, 17 nt, Homo sapiens
ugcaucuuuggccgaca

SEQ ID NO: 1210 - RNA, 17 nt, Homo sapiens
agugguguaacugugug

SEQ ID NO: 1211 - RNA, 17 nt, Homo sapiens
guggguguauguguguu

SEQ ID NO: 1212 - RNA, 17 nt, Homo sapiens
auguguguuuugugcau

SEQ ID NO: 1213 - RNA, 17 nt, Homo sapiens
uguguguuuugugcaua

SEQ ID NO: 1214 - RNA, 17 nt, Homo sapiens
guguguuuugugcauaa

SEQ ID NO: 1215 - RNA, 17 nt, Homo sapiens
uugugcauaacuauuua

SEQ ID NO: 1216 - RNA, 17 nt, Homo sapiens
gcauaacuauuuaagga

SEQ ID NO: 1217 - RNA, 17 nt, Homo sapiens
auaacuauuuaaggaaa

SEQ ID NO: 1218 - RNA, 17 nt, Homo sapiens
uaacuauuuaaggaaac

SEQ ID NO: 1219 - RNA, 17 nt, Homo sapiens
aacuauuuaaggaaacu

SEQ ID NO: 1220 - RNA, 17 nt, Homo sapiens
acuggaauuuuaaaguu

SEQ ID NO: 1221 - RNA, 17 nt, Homo sapiens
cuggaauuuuaaaguua

SEQ ID NO: 1222 - RNA, 17 nt, Homo sapiens
uggaauuuuaaaguuac

SEQ ID NO: 1223 - RNA, 17 nt, Homo sapiens
ggaauuuuaaaguuacu

SEQ ID NO: 1224 - RNA, 17 nt, Homo sapiens
uuuaaaguuacuuuuau

SEQ ID NO: 1225 - RNA, 17 nt, Homo sapiens
uuaaaguuacuuuuaua

SEQ ID NO: 1226 - RNA, 17 nt, Homo sapiens
aaguuacuuuuauacaa

SEQ ID NO: 1227 - RNA, 17 nt, Homo sapiens
aguuacuuuuauacaaa

SEQ ID NO: 1228 - RNA, 17 nt, Homo sapiens
guuacuuuuauacaaac

SEQ ID NO: 1229 - RNA, 17 nt, Homo sapiens
uuacuuuuauacaaacc

SEQ ID NO: 1230 - RNA, 17 nt, Homo sapiens
acuuuuauacaaaccaa

SEQ ID NO: 1231 - RNA, 17 nt, Homo sapiens
ccaagaauauaugcuac

SEQ ID NO: 1232 - RNA, 17 nt, Homo sapiens
aagaauauaugcuacag

SEQ ID NO: 1233 - RNA, 17 nt, Homo sapiens
uauaugcuacagauaua

SEQ ID NO: 1234 - RNA, 17 nt, Homo sapiens
cuacagauauaagacag

SEQ ID NO: 1235 - RNA, 17 nt, Homo sapiens
acagauauaagacagac

SEQ ID NO: 1236 - RNA, 17 nt, Homo sapiens
gacaugguuugguccua

SEQ ID NO: 1237 - RNA, 17 nt, Homo sapiens
acaugguuugguccuau

SEQ ID NO: 1238 - RNA, 17 nt, Homo sapiens
gguuugguccuauauuu

SEQ ID NO: 1239 - RNA, 17 nt, Homo sapiens
uugguccuauauuucua

SEQ ID NO: 1240 - RNA, 17 nt, Homo sapiens
gguccuauauuucuagu

SEQ ID NO: 1241 - RNA, 17 nt, Homo sapiens
uccuauauuucuaguca

SEQ ID NO: 1242 - RNA, 17 nt, Homo sapiens
ccuauauuucuagucau

SEQ ID NO: 1243 - RNA, 17 nt, Homo sapiens
cuauauuucuagucaug

SEQ ID NO: 1244 - RNA, 17 nt, Homo sapiens
auauuucuagucaugau

SEQ ID NO: 1245 - RNA, 17 nt, Homo sapiens
uuucuagucaugaugaa

SEQ ID NO: 1246 - RNA, 17 nt, Homo sapiens
augaauguauuuuguau

SEQ ID NO: 1247 - RNA, 17 nt, Homo sapiens
gaauguauuuuguauac

SEQ ID NO: 1248 - RNA, 17 nt, Homo sapiens
aauguauuuuguauacc

SEQ ID NO: 1249 - RNA, 17 nt, Homo sapiens
auguauuuuguauacca

SEQ ID NO: 1250 - RNA, 17 nt, Homo sapiens
uauuuuguauaccaucu

SEQ ID NO: 1251 - RNA, 17 nt, Homo sapiens
uuuuguauaccaucuuc

SEQ ID NO: 1252 - RNA, 17 nt, Homo sapiens
uauaccaucuucauaua

SEQ ID NO: 1253 - RNA, 17 nt, Homo sapiens
uaccaucuucauauaau

SEQ ID NO: 1254 - RNA, 17 nt, Homo sapiens
accaucuucauauaaua

SEQ ID NO: 1255 - RNA, 17 nt, Homo sapiens
aucuucauauaauauac

SEQ ID NO: 1256 - RNA, 17 nt, Homo sapiens
cuucauauaauauacuu

SEQ ID NO: 1257 - RNA, 17 nt, Homo sapiens
cauauaauauacuuaaa

SEQ ID NO: 1258 - RNA, 17 nt, Homo sapiens
uauaauauacuuaaaaa

SEQ ID NO: 1259 - RNA, 17 nt, Homo sapiens
aauauacuuaaaaauau

SEQ ID NO: 1260 - RNA, 17 nt, Homo sapiens
auauacuuaaaaauauu

SEQ ID NO: 1261 - RNA, 17 nt, Homo sapiens
uuaaaaauauuucuuaa

SEQ ID NO: 1262 - RNA, 17 nt, Homo sapiens
aaaaauauuucuuaauu

SEQ ID NO: 1263 - RNA, 17 nt, Homo sapiens
aaaauauuucuuaauug

SEQ ID NO: 1264 - RNA, 17 nt, Homo sapiens
aaauauuucuuaauugg

SEQ ID NO: 1265 - RNA, 17 nt, Homo sapiens
auauuucuuaauuggga

SEQ ID NO: 1266 - RNA, 17 nt, Homo sapiens
uauuucuuaauugggau

SEQ ID NO: 1267 - RNA, 17 nt, Homo sapiens
uucuuaauugggauuug

SEQ ID NO: 1268 - RNA, 17 nt, Homo sapiens
auugggauuuguaaucg

SEQ ID NO: 1269 - RNA, 17 nt, Homo sapiens
uugggauuuguaaucgu

SEQ ID NO: 1270 - RNA, 17 nt, Homo sapiens
ggauuuguaaucguacc

SEQ ID NO: 1271 - RNA, 17 nt, Homo sapiens
uuuguaaucguaccaac

SEQ ID NO: 1272 - RNA, 17 nt, Homo sapiens
guaaucguaccaacuua

SEQ ID NO: 1273 - RNA, 17 nt, Homo sapiens
uaccaacuuaauugaua

SEQ ID NO: 1274 - RNA, 17 nt, Homo sapiens
accaacuuaauugauaa

SEQ ID NO: 1275 - RNA, 17 nt, Homo sapiens
aacuuaauugauaaacu

SEQ ID NO: 1276 - RNA, 17 nt, Homo sapiens
uaauugauaaacuuggc

SEQ ID NO: 1277 - RNA, 17 nt, Homo sapiens
gauaaacuuggcaacug

SEQ ID NO: 1278 - RNA, 17 nt, Homo sapiens
caacugcuuuuauguuc

SEQ ID NO: 1279 - RNA, 17 nt, Homo sapiens
aacugcuuuuauguucu

SEQ ID NO: 1280 - RNA, 17 nt, Homo sapiens
acugcuuuuauguucug

SEQ ID NO: 1281 - RNA, 17 nt, Homo sapiens
cugcuuuuauguucugu

SEQ ID NO: 1282 - RNA, 17 nt, Homo sapiens
uuuuauguucugucucc

SEQ ID NO: 1283 - RNA, 17 nt, Homo sapiens
uuuauguucugucuccu

SEQ ID NO: 1284 - RNA, 17 nt, Homo sapiens
uguucugucuccuucca

SEQ ID NO: 1285 - RNA, 17 nt, Homo sapiens
uucugucuccuuccaua

SEQ ID NO: 1286 - RNA, 17 nt, Homo sapiens
ugucuccuuccauaaau

SEQ ID NO: 1287 - RNA, 17 nt, Homo sapiens
gucuccuuccauaaauu

SEQ ID NO: 1288 - RNA, 17 nt, Homo sapiens
ccuuccauaaauuuuuc

SEQ ID NO: 1289 - RNA, 17 nt, Homo sapiens
ccauaaauuuuucaaaa

SEQ ID NO: 1290 - RNA, 17 nt, Homo sapiens
cauaaauuuuucaaaau

SEQ ID NO: 1291 - RNA, 17 nt, Homo sapiens
auaaauuuuucaaaaua

SEQ ID NO: 1292 - RNA, 17 nt, Homo sapiens
uaaauuuuucaaaauac

SEQ ID NO: 1293 - RNA, 17 nt, Homo sapiens
aaauuuuucaaaauacu

SEQ ID NO: 1294 - RNA, 17 nt, Homo sapiens
uucaaaauacuaauuca

SEQ ID NO: 1295 - RNA, 17 nt, Homo sapiens
aaaauacuaauucaaca

SEQ ID NO: 1296 - RNA, 17 nt, Homo sapiens
auacuaauucaacaaag

SEQ ID NO: 1297 - RNA, 17 nt, Homo sapiens
uacuaauucaacaaaga

SEQ ID NO: 1298 - RNA, 17 nt, Homo sapiens
aaaaagcucuuuuuuuu

SEQ ID NO: 1299 - RNA, 17 nt, Homo sapiens
aaagcucuuuuuuuucc

SEQ ID NO: 1300 - RNA, 17 nt, Homo sapiens
aagcucuuuuuuuuccu

SEQ ID NO: 1301 - RNA, 17 nt, Homo sapiens
agcucuuuuuuuuccua

SEQ ID NO: 1302 - RNA, 17 nt, Homo sapiens
gcucuuuuuuuuccuaa

SEQ ID NO: 1303 - RNA, 17 nt, Homo sapiens
cucuuuuuuuuccuaaa

SEQ ID NO: 1304 - RNA, 17 nt, Homo sapiens
ucuuuuuuuuccuaaaa

SEQ ID NO: 1305 - RNA, 17 nt, Homo sapiens
cuuuuuuuuccuaaaau

SEQ ID NO: 1306 - RNA, 17 nt, Homo sapiens
uuuuuuuuccuaaaaua

SEQ ID NO: 1307 - RNA, 17 nt, Homo sapiens
uuuuuccuaaaauaaac

SEQ ID NO: 1308 - RNA, 17 nt, Homo sapiens
ccuaaaauaaacucaaa

SEQ ID NO: 1309 - RNA, 17 nt, Homo sapiens
aauaaacucaaauuuau

SEQ ID NO: 1310 - RNA, 17 nt, Homo sapiens
acucaaauuuauccuug

SEQ ID NO: 1311 - RNA, 17 nt, Homo sapiens
cucaaauuuauccuugu

SEQ ID NO: 1312 - RNA, 17 nt, Homo sapiens
ucaaauuuauccuuguu

SEQ ID NO: 1313 - RNA, 17 nt, Homo sapiens
aaauuuauccuuguuua

SEQ ID NO: 1314 - RNA, 17 nt, Homo sapiens
uuuauccuuguuuagag

SEQ ID NO: 1315 - RNA, 17 nt, Homo sapiens
auccuuguuuagagcag

SEQ ID NO: 1316 - RNA, 17 nt, Homo sapiens
uccuuguuuagagcaga

SEQ ID NO: 1317 - RNA, 17 nt, Homo sapiens
ccuuguuuagagcagag

SEQ ID NO: 1318 - RNA, 17 nt, Homo sapiens
agaaaaauuaagaaaaa

SEQ ID NO: 1319 - RNA, 17 nt, Homo sapiens
gaaaaauuaagaaaaac

SEQ ID NO: 1320 - RNA, 17 nt, Homo sapiens
gaaaaacuuugaaaugg

SEQ ID NO: 1321 - RNA, 17 nt, Homo sapiens
aaaaacuuugaaauggu

SEQ ID NO: 1322 - RNA, 17 nt, Homo sapiens
gaaauggucucaaaaaa

SEQ ID NO: 1323 - RNA, 17 nt, Homo sapiens
aauggucucaaaaaauu

SEQ ID NO: 1324 - RNA, 17 nt, Homo sapiens
caaaaaauugcuaaaua

SEQ ID NO: 1325 - RNA, 17 nt, Homo sapiens
aaauugcuaaauauuuu

SEQ ID NO: 1326 - RNA, 17 nt, Homo sapiens
ugcuaaauauuuucaau

SEQ ID NO: 1327 - RNA, 17 nt, Homo sapiens
cuaaauauuuucaaugg

SEQ ID NO: 1328 - RNA, 17 nt, Homo sapiens
uaaauauuuucaaugga

SEQ ID NO: 1329 - RNA, 17 nt, Homo sapiens
aaauauuuucaauggaa

SEQ ID NO: 1330 - RNA, 17 nt, Homo sapiens
aauauuuucaauggaaa

SEQ ID NO: 1331 - RNA, 17 nt, Homo sapiens
ggaaaacuaaauguuag

SEQ ID NO: 1332 - RNA, 17 nt, Homo sapiens
cuaaauguuaguuuagc

SEQ ID NO: 1333 - RNA, 17 nt, Homo sapiens
uaaauguuaguuuagcu

SEQ ID NO: 1334 - RNA, 17 nt, Homo sapiens
auguuaguuuagcugau

SEQ ID NO: 1335 - RNA, 17 nt, Homo sapiens
uguuaguuuagcugauu

SEQ ID NO: 1336 - RNA, 17 nt, Homo sapiens
guuaguuuagcugauug

SEQ ID NO: 1337 - RNA, 17 nt, Homo sapiens
uagcugauuguaugggg

SEQ ID NO: 1338 - RNA, 17 nt, Homo sapiens
cugauuguaugggguuu

SEQ ID NO: 1339 - RNA, 17 nt, Homo sapiens
uaugggguuuucgaacc

SEQ ID NO: 1340 - RNA, 17 nt, Homo sapiens
augggguuuucgaaccu

SEQ ID NO: 1341 - RNA, 17 nt, Homo sapiens
ugggguuuucgaaccuu

SEQ ID NO: 1342 - RNA, 17 nt, Homo sapiens
gggguuuucgaaccuuu

SEQ ID NO: 1343 - RNA, 17 nt, Homo sapiens
ucgaaccuuucacuuuu

SEQ ID NO: 1344 - RNA, 17 nt, Homo sapiens
cgaaccuuucacuuuuu

SEQ ID NO: 1345 - RNA, 17 nt, Homo sapiens
gaaccuuucacuuuuug

SEQ ID NO: 1346 - RNA, 17 nt, Homo sapiens
cuuucacuuuuuguuug

SEQ ID NO: 1347 - RNA, 17 nt, Homo sapiens
uuucacuuuuuguuugu

SEQ ID NO: 1348 - RNA, 17 nt, Homo sapiens
uucacuuuuuguuuguu

SEQ ID NO: 1349 - RNA, 17 nt, Homo sapiens
ucacuuuuuguuuguuu

SEQ ID NO: 1350 - RNA, 17 nt, Homo sapiens
cuuuuuguuuguuuuac

SEQ ID NO: 1351 - RNA, 17 nt, Homo sapiens
uuuuuguuuguuuuacc

SEQ ID NO: 1352 - RNA, 17 nt, Homo sapiens
uuguuuguuuuaccuau

SEQ ID NO: 1353 - RNA, 17 nt, Homo sapiens
uguuuguuuuaccuauu

SEQ ID NO: 1354 - RNA, 17 nt, Homo sapiens
guuuguuuuaccuauuu

SEQ ID NO: 1355 - RNA, 17 nt, Homo sapiens
uuuguuuuaccuauuuc

SEQ ID NO: 1356 - RNA, 17 nt, Homo sapiens
uuuuaccuauuucacaa

SEQ ID NO: 1357 - RNA, 17 nt, Homo sapiens
uuaccuauuucacaacu

SEQ ID NO: 1358 - RNA, 17 nt, Homo sapiens
uaccuauuucacaacug

SEQ ID NO: 1359 - RNA, 17 nt, Homo sapiens
accuauuucacaacugu

SEQ ID NO: 1360 - RNA, 17 nt, Homo sapiens
aacuguguaaauugcca

SEQ ID NO: 1361 - RNA, 17 nt, Homo sapiens
guguaaauugccaauaa

SEQ ID NO: 1362 - RNA, 17 nt, Homo sapiens
uugccaauaauuccugu

SEQ ID NO: 1363 - RNA, 17 nt, Homo sapiens
ccaauaauuccugucca

SEQ ID NO: 1364 - RNA, 17 nt, Homo sapiens
caauaauuccuguccau

SEQ ID NO: 1365 - RNA, 17 nt, Homo sapiens
auuccuguccaugaaaa

SEQ ID NO: 1366 - RNA, 17 nt, Homo sapiens
augcaaauuauccagug

SEQ ID NO: 1367 - RNA, 17 nt, Homo sapiens
ugcaaauuauccagugu

SEQ ID NO: 1368 - RNA, 17 nt, Homo sapiens
caaauuauccaguguag

SEQ ID NO: 1369 - RNA, 17 nt, Homo sapiens
uccaguguagauauauu

SEQ ID NO: 1370 - RNA, 17 nt, Homo sapiens
guguagauauauuugac

SEQ ID NO: 1371 - RNA, 17 nt, Homo sapiens
guagauauauuugacca

SEQ ID NO: 1372 - RNA, 17 nt, Homo sapiens
agauauauuugaccauc

SEQ ID NO: 1373 - RNA, 17 nt, Homo sapiens
gauauauuugaccauca

SEQ ID NO: 1374 - RNA, 17 nt, Homo sapiens
uugaccaucacccuaug

SEQ ID NO: 1375 - RNA, 17 nt, Homo sapiens
aucacccuauggauauu

SEQ ID NO: 1376 - RNA, 17 nt, Homo sapiens
cuauggauauuggcuag

SEQ ID NO: 1377 - RNA, 17 nt, Homo sapiens
auggauauuggcuaguu

SEQ ID NO: 1378 - RNA, 17 nt, Homo sapiens
uauuggcuaguuuugcc

SEQ ID NO: 1379 - RNA, 17 nt, Homo sapiens
uggcuaguuuugccuuu

SEQ ID NO: 1380 - RNA, 17 nt, Homo sapiens
ggcuaguuuugccuuua

SEQ ID NO: 1381 - RNA, 17 nt, Homo sapiens
gcuaguuuugccuuuau

SEQ ID NO: 1382 - RNA, 17 nt, Homo sapiens
uuuugccuuuauuaagc

SEQ ID NO: 1383 - RNA, 17 nt, Homo sapiens
uuugccuuuauuaagca

SEQ ID NO: 1384 - RNA, 17 nt, Homo sapiens
uugccuuuauuaagcaa

SEQ ID NO: 1385 - RNA, 17 nt, Homo sapiens
gccuuuauuaagcaaau

SEQ ID NO: 1386 - RNA, 17 nt, Homo sapiens
ccuuuauuaagcaaauu

SEQ ID NO: 1387 - RNA, 17 nt, Homo sapiens
aagcaaauucauuucag

SEQ ID NO: 1388 - RNA, 17 nt, Homo sapiens
agcaaauucauuucagc

SEQ ID NO: 1389 - RNA, 17 nt, Homo sapiens
aaauucauuucagccug

SEQ ID NO: 1390 - RNA, 17 nt, Homo sapiens
aauucauuucagccuga

SEQ ID NO: 1391 - RNA, 17 nt, Homo sapiens
auucauuucagccugaa

SEQ ID NO: 1392 - RNA, 17 nt, Homo sapiens
cugaaugucugccuaua

SEQ ID NO: 1393 - RNA, 17 nt, Homo sapiens
gucugccuauauauucu

SEQ ID NO: 1394 - RNA, 17 nt, Homo sapiens
cugccuauauauucucu

SEQ ID NO: 1395 - RNA, 17 nt, Homo sapiens
gccuauauauucucugc

SEQ ID NO: 1396 - RNA, 17 nt, Homo sapiens
cuauauauucucugcuc

SEQ ID NO: 1397 - RNA, 17 nt, Homo sapiens
uauauauucucugcucu

SEQ ID NO: 1398 - RNA, 17 nt, Homo sapiens
uauauucucugcucuuu

SEQ ID NO: 1399 - RNA, 17 nt, Homo sapiens
ucucugcucuuuguauu

SEQ ID NO: 1400 - RNA, 17 nt, Homo sapiens
ucugcucuuuguauucu

SEQ ID NO: 1401 - RNA, 17 nt, Homo sapiens
cugcucuuuguauucuc

SEQ ID NO: 1402 - RNA, 17 nt, Homo sapiens
cucuuuguauucuccuu

SEQ ID NO: 1403 - RNA, 17 nt, Homo sapiens
cuuuguauucuccuuug

SEQ ID NO: 1404 - RNA, 17 nt, Homo sapiens
uuuguauucuccuuuga

SEQ ID NO: 1405 - RNA, 17 nt, Homo sapiens
uguauucuccuuugaac

SEQ ID NO: 1406 - RNA, 17 nt, Homo sapiens
auucuccuuugaacccg

SEQ ID NO: 1407 - RNA, 17 nt, Homo sapiens
uucuccuuugaacccgu

SEQ ID NO: 1408 - RNA, 17 nt, Homo sapiens
gaacccguuaaaacauc

SEQ ID NO: 1409 - RNA, 17 nt, Homo sapiens
aacccguuaaaacaucc

SEQ ID NO: 1410 - RNA, 17 nt, Homo sapiens
uaaaacauccuguggca

SEQ ID NO: 1411 - RNA, 18 nt, Homo sapiens
ccucucggcuccuccccg

SEQ ID NO: 1412 - RNA, 18 nt, Homo sapiens
ggcggcggcucggagcgg

SEQ ID NO: 1413 - RNA, 18 nt, Homo sapiens
gaggacggacucuggcgg

SEQ ID NO: 1414 - RNA, 18 nt, Homo sapiens
ucuggcggccgggucguu

SEQ ID NO: 1415 - RNA, 18 nt, Homo sapiens
ggguccugcugugcgcgc

SEQ ID NO: 1416 - RNA, 18 nt, Homo sapiens
gcgcgcugcucagcuguc

SEQ ID NO: 1417 - RNA, 18 nt, Homo sapiens
cugcucagcugucugcuu

SEQ ID NO: 1418 - RNA, 18 nt, Homo sapiens
cucagcugucugcuucuc

SEQ ID NO: 1419 - RNA, 18 nt, Homo sapiens
gcugucugcuucucacag

SEQ ID NO: 1420 - RNA, 18 nt, Homo sapiens
ggaagcagcccauaaaug

SEQ ID NO: 1421 - RNA, 18 nt, Homo sapiens
uaaaucugccuguggaag

SEQ ID NO: 1422 - RNA, 18 nt, Homo sapiens
gaacacagcucaagcaaa

SEQ ID NO: 1423 - RNA, 18 nt, Homo sapiens
uucuacagcugcaaauau

SEQ ID NO: 1424 - RNA, 18 nt, Homo sapiens
auucccugccggguuacg

SEQ ID NO: 1425 - RNA, 18 nt, Homo sapiens
gaucccugauggaaaacg

SEQ ID NO: 1426 - RNA, 18 nt, Homo sapiens
ggcuucugaccugugaag

SEQ ID NO: 1427 - RNA, 18 nt, Homo sapiens
uuacccugaugaaaaaaa

SEQ ID NO: 1428 - RNA, 18 nt, Homo sapiens
gcaagcggucuuaccggc

SEQ ID NO: 1429 - RNA, 18 nt, Homo sapiens
cuuaccggcucucuauga

SEQ ID NO: 1430 - RNA, 18 nt, Homo sapiens
gaaaucugcucgcuauuu

SEQ ID NO: 1431 - RNA, 18 nt, Homo sapiens
aaccccagauuuacgaaa

SEQ ID NO: 1432 - RNA, 18 nt, Homo sapiens
guuuccagacccggcucu

SEQ ID NO: 1433 - RNA, 18 nt, Homo sapiens
agacccggcucucuaccc

SEQ ID NO: 1434 - RNA, 18 nt, Homo sapiens
aaauccugacuuguaccg

SEQ ID NO: 1435 - RNA, 18 nt, Homo sapiens
uguggcugacucuagaau

SEQ ID NO: 1436 - RNA, 18 nt, Homo sapiens
uaucacagaugugccaaa

SEQ ID NO: 1437 - RNA, 18 nt, Homo sapiens
aaaugccgacggaaggag

SEQ ID NO: 1438 - RNA, 18 nt, Homo sapiens
ugaaacugucuugcacag

SEQ ID NO: 1439 - RNA, 18 nt, Homo sapiens
aucagcaguuccaccacu

SEQ ID NO: 1440 - RNA, 18 nt, Homo sapiens
agccucagaucacuuggu

SEQ ID NO: 1441 - RNA, 18 nt, Homo sapiens
gcacgcuguuuauugaaa

SEQ ID NO: 1442 - RNA, 18 nt, Homo sapiens
ccucacuguucaaggaac

SEQ ID NO: 1443 - RNA, 18 nt, Homo sapiens
uggagcugaucacucuaa

SEQ ID NO: 1444 - RNA, 18 nt, Homo sapiens
aaagacugacuaccuauc

SEQ ID NO: 1445 - RNA, 18 nt, Homo sapiens
ggacccagaugaaguucc

SEQ ID NO: 1446 - RNA, 18 nt, Homo sapiens
gugagcggcucccuuaug

SEQ ID NO: 1447 - RNA, 18 nt, Homo sapiens
cgugccggacuguggcug

SEQ ID NO: 1448 - RNA, 18 nt, Homo sapiens
aagcucugaugacugagc

SEQ ID NO: 1449 - RNA, 18 nt, Homo sapiens
uuaaccugcugggagccu

SEQ ID NO: 1450 - RNA, 18 nt, Homo sapiens
ggccucugauggugauug

SEQ ID NO: 1451 - RNA, 18 nt, Homo sapiens
agcuccggcuuucaggaa

SEQ ID NO: 1452 - RNA, 18 nt, Homo sapiens
ggauucugacgguuucua

SEQ ID NO: 1453 - RNA, 18 nt, Homo sapiens
ucugacgguuucuacaag

SEQ ID NO: 1454 - RNA, 18 nt, Homo sapiens
aagaucugauuucuuaca

SEQ ID NO: 1455 - RNA, 18 nt, Homo sapiens
ucuuacaguuuucaagug

SEQ ID NO: 1456 - RNA, 18 nt, Homo sapiens
aguuccugucuuccagaa

SEQ ID NO: 1457 - RNA, 18 nt, Homo sapiens
gaaccccgauuaugugag

SEQ ID NO: 1458 - RNA, 18 nt, Homo sapiens
uuuugcagucgccugagg

SEQ ID NO: 1459 - RNA, 18 nt, Homo sapiens
ucuaucagaucaugcugg

SEQ ID NO: 1460 - RNA, 18 nt, Homo sapiens
cuggacugcuggcacaga

SEQ ID NO: 1461 - RNA, 18 nt, Homo sapiens
aacuccugccuucucuga

SEQ ID NO: 1462 - RNA, 18 nt, Homo sapiens
uauuucagcuccgaaguu

SEQ ID NO: 1463 - RNA, 18 nt, Homo sapiens
aagcucugaugaugucag

SEQ ID NO: 1464 - RNA, 18 nt, Homo sapiens
gcacucuguuggccucuc

SEQ ID NO: 1465 - RNA, 18 nt, Homo sapiens
cggggcugucugauguca

SEQ ID NO: 1466 - RNA, 18 nt, Homo sapiens
gcugucugaugucagcag

SEQ ID NO: 1467 - RNA, 18 nt, Homo sapiens
aggcccaguuucugccau

SEQ ID NO: 1468 - RNA, 18 nt, Homo sapiens
cauuccagcugugggcac

SEQ ID NO: 1469 - RNA, 18 nt, Homo sapiens
gcgugcugcuccccgccc

SEQ ID NO: 1470 - RNA, 18 nt, Homo sapiens
gcuccccgcccccagacu

SEQ ID NO: 1471 - RNA, 18 nt, Homo sapiens
gcccccagacuacaacuc

SEQ ID NO: 1472 - RNA, 18 nt, Homo sapiens
ggagccagcugcuuuuug

SEQ ID NO: 1473 - RNA, 18 nt, Homo sapiens
gccagcugcuuuuuguga

SEQ ID NO: 1474 - RNA, 18 nt, Homo sapiens
cuucccugcuccaacccc

SEQ ID NO: 1475 - RNA, 18 nt, Homo sapiens
aggaccaguuugauugag

SEQ ID NO: 1476 - RNA, 18 nt, Homo sapiens
cugcacugaucacccaau

SEQ ID NO: 1477 - RNA, 18 nt, Homo sapiens
ugggccagcccugcagcc

SEQ ID NO: 1478 - RNA, 18 nt, Homo sapiens
cccugcagcccaaaaccc

SEQ ID NO: 1479 - RNA, 18 nt, Homo sapiens
cuucccagcucugacccu

SEQ ID NO: 1480 - RNA, 18 nt, Homo sapiens
cagcucugacccuucuac

SEQ ID NO: 1481 - RNA, 18 nt, Homo sapiens
aggagcagauggacagcg

SEQ ID NO: 1482 - RNA, 18 nt, Homo sapiens
uuauucuguuuugcacag

SEQ ID NO: 1483 - RNA, 18 nt, Homo sapiens
aaaugcaguccugaggag

SEQ ID NO: 1484 - RNA, 18 nt, Homo sapiens
gagggcugauggaggaaa

SEQ ID NO: 1485 - RNA, 18 nt, Homo sapiens
agaccccgucucuauacc

SEQ ID NO: 1486 - RNA, 18 nt, Homo sapiens
caacacaguugggaccca

SEQ ID NO: 1487 - RNA, 18 nt, Homo sapiens
uucuccaguugggacuca

SEQ ID NO: 1488 - RNA, 18 nt, Homo sapiens
uucaacugcuuugaaacu

SEQ ID NO: 1489 - RNA, 18 nt, Homo sapiens
uggcucuguuugaugcua

SEQ ID NO: 1490 - RNA, 18 nt, Homo sapiens
gauugcugcuucuugggg

SEQ ID NO: 1491 - RNA, 18 nt, Homo sapiens
ugccucuguucuuaugug

SEQ ID NO: 1492 - RNA, 18 nt, Homo sapiens
ggcagcggcuuuugugga

SEQ ID NO: 1493 - RNA, 18 nt, Homo sapiens
ugggacaguccucuccac

SEQ ID NO: 1494 - RNA, 18 nt, Homo sapiens
ugugacagcuggcaauuu

SEQ ID NO: 1495 - RNA, 18 nt, Homo sapiens
cuuagcuguucaugucuu

SEQ ID NO: 1496 - RNA, 18 nt, Homo sapiens
uuacucagcuccuucaaa

SEQ ID NO: 1497 - RNA, 18 nt, Homo sapiens
uggaacagucugggugga

SEQ ID NO: 1498 - RNA, 18 nt, Homo sapiens
cuugucaguccaagaagu

SEQ ID NO: 1499 - RNA, 18 nt, Homo sapiens
ggcaacugcuuuuauguu

SEQ ID NO: 1500 - RNA, 18 nt, Homo sapiens
auguucugucuccuucca

SEQ ID NO: 1501 - RNA, 18 nt, Homo sapiens
uuuagcugauuguauggg

SEQ ID NO: 1502 - RNA, 18 nt, Homo sapiens
aauuccuguccaugaaaa

SEQ ID NO: 1503 - RNA, 18 nt, Homo sapiens
cauuucagccugaauguc

SEQ ID NO: 1504 - RNA, 18 nt, Homo sapiens
aaugucugccuauauauu

SEQ ID NO: 1505 - RNA, 18 nt, Homo sapiens
auucucugcucuuuguau

SEQ ID NO: 1506 - RNA, 17 nt, Homo sapiens
cuggccgucgcccugug

SEQ ID NO: 1507 - RNA, 17 nt, Homo sapiens
cuguggcucugcgugga

SEQ ID NO: 1508 - RNA, 17 nt, Homo sapiens
ggccgccucuguggguu

SEQ ID NO: 1509 - RNA, 17 nt, Homo sapiens
cuguggguuugccuagu

SEQ ID NO: 1510 - RNA, 17 nt, Homo sapiens
uguggguuugccuagug

SEQ ID NO: 1511 - RNA, 17 nt, Homo sapiens
guuugccuaguguuucu

SEQ ID NO: 1512 - RNA, 17 nt, Homo sapiens
ccuaguguuucucuuga

SEQ ID NO: 1513 - RNA, 17 nt, Homo sapiens
cuaguguuucucuugau

SEQ ID NO: 1514 - RNA, 17 nt, Homo sapiens
uaguguuucucuugauc

SEQ ID NO: 1515 - RNA, 17 nt, Homo sapiens
guguuucucuugaucug

SEQ ID NO: 1516 - RNA, 17 nt, Homo sapiens
guuucucuugaucugcc

SEQ ID NO: 1517 - RNA, 17 nt, Homo sapiens
cucuugaucugcccagg

SEQ ID NO: 1518 - RNA, 17 nt, Homo sapiens
cccaggcucagcauaca

SEQ ID NO: 1519 - RNA, 17 nt, Homo sapiens
cucagcauacaaaaaga

SEQ ID NO: 1520 - RNA, 17 nt, Homo sapiens
aaagacauacuuacaau

SEQ ID NO: 1521 - RNA, 17 nt, Homo sapiens
gacauacuuacaauuaa

SEQ ID NO: 1522 - RNA, 17 nt, Homo sapiens
acauacuuacaauuaag

SEQ ID NO: 1523 - RNA, 17 nt, Homo sapiens
cuuacaauuaaggcuaa

SEQ ID NO: 1524 - RNA, 17 nt, Homo sapiens
uuacaauuaaggcuaau

SEQ ID NO: 1525 - RNA, 17 nt, Homo sapiens
uuaaggcuaauacaacu

SEQ ID NO: 1526 - RNA, 17 nt, Homo sapiens
aggcuaauacaacucuu

SEQ ID NO: 1527 - RNA, 17 nt, Homo sapiens
auacaacucuucaaauu

SEQ ID NO: 1528 - RNA, 17 nt, Homo sapiens
acaacucuucaaauuac

SEQ ID NO: 1529 - RNA, 17 nt, Homo sapiens
caacucuucaaauuacu

SEQ ID NO: 1530 - RNA, 17 nt, Homo sapiens
cuucaaauuacuugcag

SEQ ID NO: 1531 - RNA, 17 nt, Homo sapiens
uucaaauuacuugcagg

SEQ ID NO: 1532 - RNA, 17 nt, Homo sapiens
aaauuacuugcagggga

SEQ ID NO: 1533 - RNA, 17 nt, Homo sapiens
gagggacuuggacuggc

SEQ ID NO: 1534 - RNA, 17 nt, Homo sapiens
gacuggcuuuggcccaa

SEQ ID NO: 1535 - RNA, 17 nt, Homo sapiens
acuggcuuuggcccaau

SEQ ID NO: 1536 - RNA, 17 nt, Homo sapiens
ggcccaauaaucagagu

SEQ ID NO: 1537 - RNA, 17 nt, Homo sapiens
ccaauaaucagaguggc

SEQ ID NO: 1538 - RNA, 17 nt, Homo sapiens
gauggccucuucuguaa

SEQ ID NO: 1539 - RNA, 17 nt, Homo sapiens
uggccucuucuguaaga

SEQ ID NO: 1540 - RNA, 17 nt, Homo sapiens
ggccucuucuguaagac

SEQ ID NO: 1541 - RNA, 17 nt, Homo sapiens
ucuucuguaagacacuc

SEQ ID NO: 1542 - RNA, 17 nt, Homo sapiens
aagacacucacaauucc

SEQ ID NO: 1543 - RNA, 17 nt, Homo sapiens
cucacaauuccaaaagu

SEQ ID NO: 1544 - RNA, 17 nt, Homo sapiens
ucacaauuccaaaagug

SEQ ID NO: 1545 - RNA, 17 nt, Homo sapiens
aaagugaucggaaauga

SEQ ID NO: 1546 - RNA, 17 nt, Homo sapiens
uggagccuacaagugcu

SEQ ID NO: 1547 - RNA, 17 nt, Homo sapiens
caagugcuucuaccggg

SEQ ID NO: 1548 - RNA, 17 nt, Homo sapiens
aagugcuucuaccggga

SEQ ID NO: 1549 - RNA, 17 nt, Homo sapiens
gugcuucuaccgggaaa

SEQ ID NO: 1550 - RNA, 17 nt, Homo sapiens
aacugacuuggccucgg

SEQ ID NO: 1551 - RNA, 17 nt, Homo sapiens
cuuggccucggucauuu

SEQ ID NO: 1552 - RNA, 17 nt, Homo sapiens
gccucggucauuuaugu

SEQ ID NO: 1553 - RNA, 17 nt, Homo sapiens
ucggucauuuaugucua

SEQ ID NO: 1554 - RNA, 17 nt, Homo sapiens
cggucauuuaugucuau

SEQ ID NO: 1555 - RNA, 17 nt, Homo sapiens
ggucauuuaugucuaug

SEQ ID NO: 1556 - RNA, 17 nt, Homo sapiens
auuuaugucuauguuca

SEQ ID NO: 1557 - RNA, 17 nt, Homo sapiens
uuaugucuauguucaag

SEQ ID NO: 1558 - RNA, 17 nt, Homo sapiens
gucuauguucaagauua

SEQ ID NO: 1559 - RNA, 17 nt, Homo sapiens
ucuauguucaagauuac

SEQ ID NO: 1560 - RNA, 17 nt, Homo sapiens
uucaagauuacagaucu

SEQ ID NO: 1561 - RNA, 17 nt, Homo sapiens
ucaagauuacagaucuc

SEQ ID NO: 1562 - RNA, 17 nt, Homo sapiens
uuacagaucuccauuua

SEQ ID NO: 1563 - RNA, 17 nt, Homo sapiens
acagaucuccauuuauu

SEQ ID NO: 1564 - RNA, 17 nt, Homo sapiens
aucuccauuuauugcuu

SEQ ID NO: 1565 - RNA, 17 nt, Homo sapiens
ucuccauuuauugcuuc

SEQ ID NO: 1566 - RNA, 17 nt, Homo sapiens
cuccauuuauugcuucu

SEQ ID NO: 1567 - RNA, 17 nt, Homo sapiens
ccauuuauugcuucugu

SEQ ID NO: 1568 - RNA, 17 nt, Homo sapiens
uuauugcuucuguuagu

SEQ ID NO: 1569 - RNA, 17 nt, Homo sapiens
uauugcuucuguuagug

SEQ ID NO: 1570 - RNA, 17 nt, Homo sapiens
gcuucuguuagugacca

SEQ ID NO: 1571 - RNA, 17 nt, Homo sapiens
cuucuguuagugaccaa

SEQ ID NO: 1572 - RNA, 17 nt, Homo sapiens
cauggagucguguacau

SEQ ID NO: 1573 - RNA, 17 nt, Homo sapiens
agucguguacauuacug

SEQ ID NO: 1574 - RNA, 17 nt, Homo sapiens
guguacauuacugagaa

SEQ ID NO: 1575 - RNA, 17 nt, Homo sapiens
uguacauuacugagaac

SEQ ID NO: 1576 - RNA, 17 nt, Homo sapiens
guggugauuccaugucu

SEQ ID NO: 1577 - RNA, 17 nt, Homo sapiens
uggugauuccaugucuc

SEQ ID NO: 1578 - RNA, 17 nt, Homo sapiens
uuccaugucucgggucc

SEQ ID NO: 1579 - RNA, 17 nt, Homo sapiens
ccaugucucggguccau

SEQ ID NO: 1580 - RNA, 17 nt, Homo sapiens
ucucggguccauuucaa

SEQ ID NO: 1581 - RNA, 17 nt, Homo sapiens
ggguccauuucaaaucu

SEQ ID NO: 1582 - RNA, 17 nt, Homo sapiens
gguccauuucaaaucuc

SEQ ID NO: 1583 - RNA, 17 nt, Homo sapiens
guccauuucaaaucuca

SEQ ID NO: 1584 - RNA, 17 nt, Homo sapiens
uuucaaaucucaacgug

SEQ ID NO: 1585 - RNA, 17 nt, Homo sapiens
ucaaaucucaacguguc

SEQ ID NO: 1586 - RNA, 17 nt, Homo sapiens
caacgugucacuuugug

SEQ ID NO: 1587 - RNA, 17 nt, Homo sapiens
gugucacuuugugcaag

SEQ ID NO: 1588 - RNA, 17 nt, Homo sapiens
ugucacuuugugcaaga

SEQ ID NO: 1589 - RNA, 17 nt, Homo sapiens
ugcaagauacccagaaa

SEQ ID NO: 1590 - RNA, 17 nt, Homo sapiens
aaagagauuuguuccug

SEQ ID NO: 1591 - RNA, 17 nt, Homo sapiens
aagagauuuguuccuga

SEQ ID NO: 1592 - RNA, 17 nt, Homo sapiens
agauuuguuccugaugg

SEQ ID NO: 1593 - RNA, 17 nt, Homo sapiens
gauuuguuccugauggu

SEQ ID NO: 1594 - RNA, 17 nt, Homo sapiens
cugaugguaacagaauu

SEQ ID NO: 1595 - RNA, 17 nt, Homo sapiens
aacagaauuuccuggga

SEQ ID NO: 1596 - RNA, 17 nt, Homo sapiens
acagaauuuccugggac

SEQ ID NO: 1597 - RNA, 17 nt, Homo sapiens
cagaauuuccugggaca

SEQ ID NO: 1598 - RNA, 17 nt, Homo sapiens
gaagggcuuuacuauuc

SEQ ID NO: 1599 - RNA, 17 nt, Homo sapiens
aagggcuuuacuauucc

SEQ ID NO: 1600 - RNA, 17 nt, Homo sapiens
agggcuuuacuauuccc

SEQ ID NO: 1601 - RNA, 17 nt, Homo sapiens
gcuuuacuauucccagc

SEQ ID NO: 1602 - RNA, 17 nt, Homo sapiens
uuuacuauucccagcua

SEQ ID NO: 1603 - RNA, 17 nt, Homo sapiens
uuacuauucccagcuac

SEQ ID NO: 1604 - RNA, 17 nt, Homo sapiens
ucccagcuacaugauca

SEQ ID NO: 1605 - RNA, 17 nt, Homo sapiens
uacaugaucagcuaugc

SEQ ID NO: 1606 - RNA, 17 nt, Homo sapiens
gaucagcuaugcuggca

SEQ ID NO: 1607 - RNA, 17 nt, Homo sapiens
ggcauggucuucuguga

SEQ ID NO: 1608 - RNA, 17 nt, Homo sapiens
cauggucuucugugaag

SEQ ID NO: 1609 - RNA, 17 nt, Homo sapiens
auggucuucugugaagc

SEQ ID NO: 1610 - RNA, 17 nt, Homo sapiens
gcaaaaauuaaugauga

SEQ ID NO: 1611 - RNA, 17 nt, Homo sapiens
caaaaauuaaugaugaa

SEQ ID NO: 1612 - RNA, 17 nt, Homo sapiens
augaaaguuaccagucu

SEQ ID NO: 1613 - RNA, 17 nt, Homo sapiens
ugaaaguuaccagucua

SEQ ID NO: 1614 - RNA, 17 nt, Homo sapiens
uuaccagucuauuaugu

SEQ ID NO: 1615 - RNA, 17 nt, Homo sapiens
accagucuauuauguac

SEQ ID NO: 1616 - RNA, 17 nt, Homo sapiens
cagucuauuauguacau

SEQ ID NO: 1617 - RNA, 17 nt, Homo sapiens
agucuauuauguacaua

SEQ ID NO: 1618 - RNA, 17 nt, Homo sapiens
uauuauguacauaguug

SEQ ID NO: 1619 - RNA, 17 nt, Homo sapiens
auguacauaguugucgu

SEQ ID NO: 1620 - RNA, 17 nt, Homo sapiens
uacauaguugucguugu

SEQ ID NO: 1621 - RNA, 17 nt, Homo sapiens
auaguugucguuguagg

SEQ ID NO: 1622 - RNA, 17 nt, Homo sapiens
guugucguuguagggua

SEQ ID NO: 1623 - RNA, 17 nt, Homo sapiens
gucguuguaggguauag

SEQ ID NO: 1624 - RNA, 17 nt, Homo sapiens
uguaggguauaggauuu

SEQ ID NO: 1625 - RNA, 17 nt, Homo sapiens
uaggguauaggauuuau

SEQ ID NO: 1626 - RNA, 17 nt, Homo sapiens
uauaggauuuaugaugu

SEQ ID NO: 1627 - RNA, 17 nt, Homo sapiens
auaggauuuaugaugug

SEQ ID NO: 1628 - RNA, 17 nt, Homo sapiens
uaggauuuaugaugugg

SEQ ID NO: 1629 - RNA, 17 nt, Homo sapiens
gaugugguucugagucc

SEQ ID NO: 1630 - RNA, 17 nt, Homo sapiens
augugguucugaguccg

SEQ ID NO: 1631 - RNA, 17 nt, Homo sapiens
uucugaguccgucucau

SEQ ID NO: 1632 - RNA, 17 nt, Homo sapiens
gaguccgucucauggaa

SEQ ID NO: 1633 - RNA, 17 nt, Homo sapiens
guccgucucauggaauu

SEQ ID NO: 1634 - RNA, 17 nt, Homo sapiens
cauggaauugaacuauc

SEQ ID NO: 1635 - RNA, 17 nt, Homo sapiens
auugaacuaucuguugg

SEQ ID NO: 1636 - RNA, 17 nt, Homo sapiens
ugaacuaucuguuggag

SEQ ID NO: 1637 - RNA, 17 nt, Homo sapiens
cuaucuguuggagaaaa

SEQ ID NO: 1638 - RNA, 17 nt, Homo sapiens
gaaaagcuugucuuaaa

SEQ ID NO: 1639 - RNA, 17 nt, Homo sapiens
aagcuugucuuaaauug

SEQ ID NO: 1640 - RNA, 17 nt, Homo sapiens
gcuugucuuaaauugua

SEQ ID NO: 1641 - RNA, 17 nt, Homo sapiens
cuugucuuaaauuguac

SEQ ID NO: 1642 - RNA, 17 nt, Homo sapiens
ucuuaaauuguacagca

SEQ ID NO: 1643 - RNA, 17 nt, Homo sapiens
uaaauuguacagcaaga

SEQ ID NO: 1644 - RNA, 17 nt, Homo sapiens
acugaacuaaauguggg

SEQ ID NO: 1645 - RNA, 17 nt, Homo sapiens
guggggauugacuucaa

SEQ ID NO: 1646 - RNA, 17 nt, Homo sapiens
gauugacuucaacuggg

SEQ ID NO: 1647 - RNA, 17 nt, Homo sapiens
auugacuucaacuggga

SEQ ID NO: 1648 - RNA, 17 nt, Homo sapiens
cugggaauacccuucuu

SEQ ID NO: 1649 - RNA, 17 nt, Homo sapiens
aauacccuucuucgaag

SEQ ID NO: 1650 - RNA, 17 nt, Homo sapiens
auacccuucuucgaagc

SEQ ID NO: 1651 - RNA, 17 nt, Homo sapiens
acccuucuucgaagcau

SEQ ID NO: 1652 - RNA, 17 nt, Homo sapiens
cccuucuucgaagcauc

SEQ ID NO: 1653 - RNA, 17 nt, Homo sapiens
cgaagcaucagcauaag

SEQ ID NO: 1654 - RNA, 17 nt, Homo sapiens
aucagcauaagaaacuu

SEQ ID NO: 1655 - RNA, 17 nt, Homo sapiens
aagaaacuuguaaaccg

SEQ ID NO: 1656 - RNA, 17 nt, Homo sapiens
aaacuuguaaaccgaga

SEQ ID NO: 1657 - RNA, 17 nt, Homo sapiens
cgagaccuaaaaaccca

SEQ ID NO: 1658 - RNA, 17 nt, Homo sapiens
aacccagucugggagug

SEQ ID NO: 1659 - RNA, 17 nt, Homo sapiens
gaagaaauuuuugagca

SEQ ID NO: 1660 - RNA, 17 nt, Homo sapiens
aagaaauuuuugagcac

SEQ ID NO: 1661 - RNA, 17 nt, Homo sapiens
agaaauuuuugagcacc

SEQ ID NO: 1662 - RNA, 17 nt, Homo sapiens
gaaauuuuugagcaccu

SEQ ID NO: 1663 - RNA, 17 nt, Homo sapiens
gagcaccuuaacuauag

SEQ ID NO: 1664 - RNA, 17 nt, Homo sapiens
agcaccuuaacuauaga

SEQ ID NO: 1665 - RNA, 17 nt, Homo sapiens
ccuuaacuauagauggu

SEQ ID NO: 1666 - RNA, 17 nt, Homo sapiens
uuaacuauagauggugu

SEQ ID NO: 1667 - RNA, 17 nt, Homo sapiens
gaugguguaacccggag

SEQ ID NO: 1668 - RNA, 17 nt, Homo sapiens
ccaaggauuguacaccu

SEQ ID NO: 1669 - RNA, 17 nt, Homo sapiens
aggauuguacaccugug

SEQ ID NO: 1670 - RNA, 17 nt, Homo sapiens
ugcagcauccagugggc

SEQ ID NO: 1671 - RNA, 17 nt, Homo sapiens
cagcacauuugucaggg

SEQ ID NO: 1672 - RNA, 17 nt, Homo sapiens
agcacauuugucagggu

SEQ ID NO: 1673 - RNA, 17 nt, Homo sapiens
acauuugucagggucca

SEQ ID NO: 1674 - RNA, 17 nt, Homo sapiens
gucaggguccaugaaaa

SEQ ID NO: 1675 - RNA, 17 nt, Homo sapiens
aaaaaccuuuuguugcu

SEQ ID NO: 1676 - RNA, 17 nt, Homo sapiens
aaaaccuuuuguugcuu

SEQ ID NO: 1677 - RNA, 17 nt, Homo sapiens
aaaccuuuuguugcuuu

SEQ ID NO: 1678 - RNA, 17 nt, Homo sapiens
ccuuuuguugcuuuugg

SEQ ID NO: 1679 - RNA, 17 nt, Homo sapiens
uuguugcuuuuggaagu

SEQ ID NO: 1680 - RNA, 17 nt, Homo sapiens
uguugcuuuuggaagug

SEQ ID NO: 1681 - RNA, 17 nt, Homo sapiens
guugcuuuuggaagugg

SEQ ID NO: 1682 - RNA, 17 nt, Homo sapiens
cauggaaucucuggugg

SEQ ID NO: 1683 - RNA, 17 nt, Homo sapiens
uggaaucucugguggaa

SEQ ID NO: 1684 - RNA, 17 nt, Homo sapiens
gagcgugucagaauccc

SEQ ID NO: 1685 - RNA, 17 nt, Homo sapiens
gucagaaucccugcgaa

SEQ ID NO: 1686 - RNA, 17 nt, Homo sapiens
ugcgaaguaccuugguu

SEQ ID NO: 1687 - RNA, 17 nt, Homo sapiens
aaguaccuugguuaccc

SEQ ID NO: 1688 - RNA, 17 nt, Homo sapiens
accuugguuacccaccc

SEQ ID NO: 1689 - RNA, 17 nt, Homo sapiens
ccuugguuacccacccc

SEQ ID NO: 1690 - RNA, 17 nt, Homo sapiens
ccagaaauaaaauggua

SEQ ID NO: 1691 - RNA, 17 nt, Homo sapiens
aaaaugguauaaaaaug

SEQ ID NO: 1692 - RNA, 17 nt, Homo sapiens
aaugguauaaaaaugga

SEQ ID NO: 1693 - RNA, 17 nt, Homo sapiens
aauggaauaccccuuga

SEQ ID NO: 1694 - RNA, 17 nt, Homo sapiens
auaccccuugaguccaa

SEQ ID NO: 1695 - RNA, 17 nt, Homo sapiens
ccuugaguccaaucaca

SEQ ID NO: 1696 - RNA, 17 nt, Homo sapiens
aguccaaucacacaauu

SEQ ID NO: 1697 - RNA, 17 nt, Homo sapiens
cacacaauuaaagcggg

SEQ ID NO: 1698 - RNA, 17 nt, Homo sapiens
acacaauuaaagcgggg

SEQ ID NO: 1699 - RNA, 17 nt, Homo sapiens
gggcauguacugacgau

SEQ ID NO: 1700 - RNA, 17 nt, Homo sapiens
cugacgauuauggaagu

SEQ ID NO: 1701 - RNA, 17 nt, Homo sapiens
ugacgauuauggaagug

SEQ ID NO: 1702 - RNA, 17 nt, Homo sapiens
caggaaauuacacuguc

SEQ ID NO: 1703 - RNA, 17 nt, Homo sapiens
aggaaauuacacuguca

SEQ ID NO: 1704 - RNA, 17 nt, Homo sapiens
uacacugucauccuuac

SEQ ID NO: 1705 - RNA, 17 nt, Homo sapiens
acugucauccuuaccaa

SEQ ID NO: 1706 - RNA, 17 nt, Homo sapiens
gucauccuuaccaaucc

SEQ ID NO: 1707 - RNA, 17 nt, Homo sapiens
ucauccuuaccaauccc

SEQ ID NO: 1708 - RNA, 17 nt, Homo sapiens
uuaccaaucccauuuca

SEQ ID NO: 1709 - RNA, 17 nt, Homo sapiens
aaucccauuucaaagga

SEQ ID NO: 1710 - RNA, 17 nt, Homo sapiens
aucccauuucaaaggag

SEQ ID NO: 1711 - RNA, 17 nt, Homo sapiens
ucccauuucaaaggaga

SEQ ID NO: 1712 - RNA, 17 nt, Homo sapiens
cauguggucucucuggu

SEQ ID NO: 1713 - RNA, 17 nt, Homo sapiens
uguggucucucugguug

SEQ ID NO: 1714 - RNA, 17 nt, Homo sapiens
uggucucucugguugug

SEQ ID NO: 1715 - RNA, 17 nt, Homo sapiens
ucucugguuguguaugu

SEQ ID NO: 1716 - RNA, 17 nt, Homo sapiens
gguuguguaugucccac

SEQ ID NO: 1717 - RNA, 17 nt, Homo sapiens
guguaugucccacccca

SEQ ID NO: 1718 - RNA, 17 nt, Homo sapiens
ccccagauuggugagaa

SEQ ID NO: 1719 - RNA, 17 nt, Homo sapiens
ugagaaaucucuaaucu

SEQ ID NO: 1720 - RNA, 17 nt, Homo sapiens
agaaaucucuaaucucu

SEQ ID NO: 1721 - RNA, 17 nt, Homo sapiens
aaaucucuaaucucucc

SEQ ID NO: 1722 - RNA, 17 nt, Homo sapiens
ucucuaaucucuccugu

SEQ ID NO: 1723 - RNA, 17 nt, Homo sapiens
ucuaaucucuccugugg

SEQ ID NO: 1724 - RNA, 17 nt, Homo sapiens
uaaucucuccuguggau

SEQ ID NO: 1725 - RNA, 17 nt, Homo sapiens
cuguggauuccuaccag

SEQ ID NO: 1726 - RNA, 17 nt, Homo sapiens
uguggauuccuaccagu

SEQ ID NO: 1727 - RNA, 17 nt, Homo sapiens
ggauuccuaccaguacg

SEQ ID NO: 1728 - RNA, 17 nt, Homo sapiens
cuaccaguacggcacca

SEQ ID NO: 1729 - RNA, 17 nt, Homo sapiens
gcaccacucaaacgcug

SEQ ID NO: 1730 - RNA, 17 nt, Homo sapiens
ugacauguacggucuau

SEQ ID NO: 1731 - RNA, 17 nt, Homo sapiens
uguacggucuaugccau

SEQ ID NO: 1732 - RNA, 17 nt, Homo sapiens
uacggucuaugccauuc

SEQ ID NO: 1733 - RNA, 17 nt, Homo sapiens
uaugccauuccuccccc

SEQ ID NO: 1734 - RNA, 17 nt, Homo sapiens
augccauuccucccccg

SEQ ID NO: 1735 - RNA, 17 nt, Homo sapiens
ccauuccucccccgcau

SEQ ID NO: 1736 - RNA, 17 nt, Homo sapiens
ccccgcaucacauccac

SEQ ID NO: 1737 - RNA, 17 nt, Homo sapiens
caucacauccacuggua

SEQ ID NO: 1738 - RNA, 17 nt, Homo sapiens
ccacugguauuggcagu

SEQ ID NO: 1739 - RNA, 17 nt, Homo sapiens
acugguauuggcaguug

SEQ ID NO: 1740 - RNA, 17 nt, Homo sapiens
uuggcaguuggaggaag

SEQ ID NO: 1741 - RNA, 17 nt, Homo sapiens
caagcugucucagugac

SEQ ID NO: 1742 - RNA, 17 nt, Homo sapiens
agcugucucagugacaa

SEQ ID NO: 1743 - RNA, 17 nt, Homo sapiens
aaacccauacccuugug

SEQ ID NO: 1744 - RNA, 17 nt, Homo sapiens
cauacccuugugaagaa

SEQ ID NO: 1745 - RNA, 17 nt, Homo sapiens
ggaggacuuccagggag

SEQ ID NO: 1746 - RNA, 17 nt, Homo sapiens
gaggacuuccagggagg

SEQ ID NO: 1747 - RNA, 17 nt, Homo sapiens
gaggaaauaaaauugaa

SEQ ID NO: 1748 - RNA, 17 nt, Homo sapiens
aauaaaauugaaguuaa

SEQ ID NO: 1749 - RNA, 17 nt, Homo sapiens
auugaaguuaauaaaaa

SEQ ID NO: 1750 - RNA, 17 nt, Homo sapiens
uugaaguuaauaaaaau

SEQ ID NO: 1751 - RNA, 17 nt, Homo sapiens
aaguuaauaaaaaucaa

SEQ ID NO: 1752 - RNA, 17 nt, Homo sapiens
auaaaaaucaauuugcu

SEQ ID NO: 1753 - RNA, 17 nt, Homo sapiens
aaaucaauuugcucuaa

SEQ ID NO: 1754 - RNA, 17 nt, Homo sapiens
aaucaauuugcucuaau

SEQ ID NO: 1755 - RNA, 17 nt, Homo sapiens
aauuugcucuaauugaa

SEQ ID NO: 1756 - RNA, 17 nt, Homo sapiens
uuugcucuaauugaagg

SEQ ID NO: 1757 - RNA, 17 nt, Homo sapiens
gcucuaauugaaggaaa

SEQ ID NO: 1758 - RNA, 17 nt, Homo sapiens
aaaacuguaaguacccu

SEQ ID NO: 1759 - RNA, 17 nt, Homo sapiens
cuguaaguacccuuguu

SEQ ID NO: 1760 - RNA, 17 nt, Homo sapiens
aguacccuuguuaucca

SEQ ID NO: 1761 - RNA, 17 nt, Homo sapiens
acccuuguuauccaagc

SEQ ID NO: 1762 - RNA, 17 nt, Homo sapiens
cccuuguuauccaagcg

SEQ ID NO: 1763 - RNA, 17 nt, Homo sapiens
cuuguuauccaagcggc

SEQ ID NO: 1764 - RNA, 17 nt, Homo sapiens
aaaugugucagcuuugu

SEQ ID NO: 1765 - RNA, 17 nt, Homo sapiens
ugucagcuuuguacaaa

SEQ ID NO: 1766 - RNA, 17 nt, Homo sapiens
gucagcuuuguacaaau

SEQ ID NO: 1767 - RNA, 17 nt, Homo sapiens
agcuuuguacaaaugug

SEQ ID NO: 1768 - RNA, 17 nt, Homo sapiens
gaagcggucaacaaagu

SEQ ID NO: 1769 - RNA, 17 nt, Homo sapiens
aacaaagucgggagagg

SEQ ID NO: 1770 - RNA, 17 nt, Homo sapiens
agggugaucuccuucca

SEQ ID NO: 1771 - RNA, 17 nt, Homo sapiens
ggugaucuccuuccacg

SEQ ID NO: 1772 - RNA, 17 nt, Homo sapiens
gaucuccuuccacguga

SEQ ID NO: 1773 - RNA, 17 nt, Homo sapiens
aucuccuuccacgugac

SEQ ID NO: 1774 - RNA, 17 nt, Homo sapiens
ccagggguccugaaauu

SEQ ID NO: 1775 - RNA, 17 nt, Homo sapiens
ccugaaauuacuuugca

SEQ ID NO: 1776 - RNA, 17 nt, Homo sapiens
cugaaauuacuuugcaa

SEQ ID NO: 1777 - RNA, 17 nt, Homo sapiens
aaauuacuuugcaaccu

SEQ ID NO: 1778 - RNA, 17 nt, Homo sapiens
aauuacuuugcaaccug

SEQ ID NO: 1779 - RNA, 17 nt, Homo sapiens
gagcgugucuuuguggu

SEQ ID NO: 1780 - RNA, 17 nt, Homo sapiens
gcgugucuuuguggugc

SEQ ID NO: 1781 - RNA, 17 nt, Homo sapiens
cgugucuuuguggugca

SEQ ID NO: 1782 - RNA, 17 nt, Homo sapiens
agacagaucuacguuug

SEQ ID NO: 1783 - RNA, 17 nt, Homo sapiens
acagaucuacguuugag

SEQ ID NO: 1784 - RNA, 17 nt, Homo sapiens
aucuacguuugagaacc

SEQ ID NO: 1785 - RNA, 17 nt, Homo sapiens
ucuacguuugagaaccu

SEQ ID NO: 1786 - RNA, 17 nt, Homo sapiens
gagaaccucacauggua

SEQ ID NO: 1787 - RNA, 17 nt, Homo sapiens
cacaugguacaagcuug

SEQ ID NO: 1788 - RNA, 17 nt, Homo sapiens
uacaagcuuggcccaca

SEQ ID NO: 1789 - RNA, 17 nt, Homo sapiens
cacagccucugccaauc

SEQ ID NO: 1790 - RNA, 17 nt, Homo sapiens
cugccaauccauguggg

SEQ ID NO: 1791 - RNA, 17 nt, Homo sapiens
gggagaguugcccacac

SEQ ID NO: 1792 - RNA, 17 nt, Homo sapiens
acaccuguuugcaagaa

SEQ ID NO: 1793 - RNA, 17 nt, Homo sapiens
caccuguuugcaagaac

SEQ ID NO: 1794 - RNA, 17 nt, Homo sapiens
caagaacuuggauacuc

SEQ ID NO: 1795 - RNA, 17 nt, Homo sapiens
acuuggauacucuuugg

SEQ ID NO: 1796 - RNA, 17 nt, Homo sapiens
uggauacucuuuggaaa

SEQ ID NO: 1797 - RNA, 17 nt, Homo sapiens
gauacucuuuggaaauu

SEQ ID NO: 1798 - RNA, 17 nt, Homo sapiens
auacucuuuggaaauug

SEQ ID NO: 1799 - RNA, 17 nt, Homo sapiens
uuggaaauugaaugcca

SEQ ID NO: 1800 - RNA, 17 nt, Homo sapiens
caccauguucucuaaua

SEQ ID NO: 1801 - RNA, 17 nt, Homo sapiens
accauguucucuaauag

SEQ ID NO: 1802 - RNA, 17 nt, Homo sapiens
cauguucucuaauagca

SEQ ID NO: 1803 - RNA, 17 nt, Homo sapiens
uguucucuaauagcaca

SEQ ID NO: 1804 - RNA, 17 nt, Homo sapiens
ucucuaauagcacaaau

SEQ ID NO: 1805 - RNA, 17 nt, Homo sapiens
aaugacauuuugaucau

SEQ ID NO: 1806 - RNA, 17 nt, Homo sapiens
augacauuuugaucaug

SEQ ID NO: 1807 - RNA, 17 nt, Homo sapiens
ugacauuuugaucaugg

SEQ ID NO: 1808 - RNA, 17 nt, Homo sapiens
auuuugaucauggagcu

SEQ ID NO: 1809 - RNA, 17 nt, Homo sapiens
auggagcuuaagaaugc

SEQ ID NO: 1810 - RNA, 17 nt, Homo sapiens
uggagcuuaagaaugca

SEQ ID NO: 1811 - RNA, 17 nt, Homo sapiens
gaaugcauccuugcagg

SEQ ID NO: 1812 - RNA, 17 nt, Homo sapiens
ugcauccuugcaggacc

SEQ ID NO: 1813 - RNA, 17 nt, Homo sapiens
aggagacuaugucugcc

SEQ ID NO: 1814 - RNA, 17 nt, Homo sapiens
gacuaugucugccuugc

SEQ ID NO: 1815 - RNA, 17 nt, Homo sapiens
gucugccuugcucaaga

SEQ ID NO: 1816 - RNA, 17 nt, Homo sapiens
gccuugcucaagacagg

SEQ ID NO: 1817 - RNA, 17 nt, Homo sapiens
aaagacauugcgugguc

SEQ ID NO: 1818 - RNA, 17 nt, Homo sapiens
ugcguggucaggcagcu

SEQ ID NO: 1819 - RNA, 17 nt, Homo sapiens
aggcagcucacaguccu

SEQ ID NO: 1820 - RNA, 17 nt, Homo sapiens
cucacaguccuagagcg

SEQ ID NO: 1821 - RNA, 17 nt, Homo sapiens
acaguccuagagcgugu

SEQ ID NO: 1822 - RNA, 17 nt, Homo sapiens
cccacgaucacaggaaa

SEQ ID NO: 1823 - RNA, 17 nt, Homo sapiens
uggagaaucagacgaca

SEQ ID NO: 1824 - RNA, 17 nt, Homo sapiens
cgacaaguauuggggaa

SEQ ID NO: 1825 - RNA, 17 nt, Homo sapiens
acaaguauuggggaaag

SEQ ID NO: 1826 - RNA, 17 nt, Homo sapiens
gaaagcaucgaagucuc

SEQ ID NO: 1827 - RNA, 17 nt, Homo sapiens
aucgaagucucaugcac

SEQ ID NO: 1828 - RNA, 17 nt, Homo sapiens
cgaagucucaugcacgg

SEQ ID NO: 1829 - RNA, 17 nt, Homo sapiens
cacggcaucugggaauc

SEQ ID NO: 1830 - RNA, 17 nt, Homo sapiens
cugggaaucccccucca

SEQ ID NO: 1831 - RNA, 17 nt, Homo sapiens
aucccccuccacagauc

SEQ ID NO: 1832 - RNA, 17 nt, Homo sapiens
ccacagaucaugugguu

SEQ ID NO: 1833 - RNA, 17 nt, Homo sapiens
caugugguuuaaagaua

SEQ ID NO: 1834 - RNA, 17 nt, Homo sapiens
augugguuuaaagauaa

SEQ ID NO: 1835 - RNA, 17 nt, Homo sapiens
ugugguuuaaagauaau

SEQ ID NO: 1836 - RNA, 17 nt, Homo sapiens
uuaaagauaaugagacc

SEQ ID NO: 1837 - RNA, 17 nt, Homo sapiens
gagacccuuguagaaga

SEQ ID NO: 1838 - RNA, 17 nt, Homo sapiens
acccuuguagaagacuc

SEQ ID NO: 1839 - RNA, 17 nt, Homo sapiens
agaagacucaggcauug

SEQ ID NO: 1840 - RNA, 17 nt, Homo sapiens
ucaggcauuguauugaa

SEQ ID NO: 1841 - RNA, 17 nt, Homo sapiens
ggcauuguauugaagga

SEQ ID NO: 1842 - RNA, 17 nt, Homo sapiens
cauuguauugaaggaug

SEQ ID NO: 1843 - RNA, 17 nt, Homo sapiens
cggaaccucacuauccg

SEQ ID NO: 1844 - RNA, 17 nt, Homo sapiens
accucacuauccgcaga

SEQ ID NO: 1845 - RNA, 17 nt, Homo sapiens
cucacuauccgcagagu

SEQ ID NO: 1846 - RNA, 17 nt, Homo sapiens
gaaggccucuacaccug

SEQ ID NO: 1847 - RNA, 17 nt, Homo sapiens
aggccucuacaccugcc

SEQ ID NO: 1848 - RNA, 17 nt, Homo sapiens
ugcaguguucuuggcug

SEQ ID NO: 1849 - RNA, 17 nt, Homo sapiens
gcaguguucuuggcugu

SEQ ID NO: 1850 - RNA, 17 nt, Homo sapiens
aguguucuuggcugugc

SEQ ID NO: 1851 - RNA, 17 nt, Homo sapiens
ggaggcauuuuucauaa

SEQ ID NO: 1852 - RNA, 17 nt, Homo sapiens
gaggcauuuuucauaau

SEQ ID NO: 1853 - RNA, 17 nt, Homo sapiens
aggcauuuuucauaaua

SEQ ID NO: 1854 - RNA, 17 nt, Homo sapiens
ggcauuuuucauaauag

SEQ ID NO: 1855 - RNA, 17 nt, Homo sapiens
gcauuuuucauaauaga

SEQ ID NO: 1856 - RNA, 17 nt, Homo sapiens
uuuuucauaauagaagg

SEQ ID NO: 1857 - RNA, 17 nt, Homo sapiens
uucauaauagaaggugc

SEQ ID NO: 1858 - RNA, 17 nt, Homo sapiens
gacgaacuuggaaauca

SEQ ID NO: 1859 - RNA, 17 nt, Homo sapiens
uuggaaaucauuauucu

SEQ ID NO: 1860 - RNA, 17 nt, Homo sapiens
gaaaucauuauucuagu

SEQ ID NO: 1861 - RNA, 17 nt, Homo sapiens
aaaucauuauucuagua

SEQ ID NO: 1862 - RNA, 17 nt, Homo sapiens
aucauuauucuaguagg

SEQ ID NO: 1863 - RNA, 17 nt, Homo sapiens
ucauuauucuaguaggc

SEQ ID NO: 1864 - RNA, 17 nt, Homo sapiens
auuauucuaguaggcac

SEQ ID NO: 1865 - RNA, 17 nt, Homo sapiens
auucuaguaggcacgac

SEQ ID NO: 1866 - RNA, 17 nt, Homo sapiens
acggugauugccauguu

SEQ ID NO: 1867 - RNA, 17 nt, Homo sapiens
ugccauguucuucuggc

SEQ ID NO: 1868 - RNA, 17 nt, Homo sapiens
gccauguucuucuggcu

SEQ ID NO: 1869 - RNA, 17 nt, Homo sapiens
cauguucuucuggcuac

SEQ ID NO: 1870 - RNA, 17 nt, Homo sapiens
auguucuucuggcuacu

SEQ ID NO: 1871 - RNA, 17 nt, Homo sapiens
uucuggcuacuucuugu

SEQ ID NO: 1872 - RNA, 17 nt, Homo sapiens
uggcuacuucuugucau

SEQ ID NO: 1873 - RNA, 17 nt, Homo sapiens
ggcuacuucuugucauc

SEQ ID NO: 1874 - RNA, 17 nt, Homo sapiens
cuacuucuugucaucau

SEQ ID NO: 1875 - RNA, 17 nt, Homo sapiens
cuucuugucaucauccu

SEQ ID NO: 1876 - RNA, 17 nt, Homo sapiens
cuugucaucauccuagg

SEQ ID NO: 1877 - RNA, 17 nt, Homo sapiens
gucaucauccuagggac

SEQ ID NO: 1878 - RNA, 17 nt, Homo sapiens
aucauccuagggaccgu

SEQ ID NO: 1879 - RNA, 17 nt, Homo sapiens
gggaccguuaagcgggc

SEQ ID NO: 1880 - RNA, 17 nt, Homo sapiens
ggaccguuaagcgggcc

SEQ ID NO: 1881 - RNA, 17 nt, Homo sapiens
gacaggcuacuugucca

SEQ ID NO: 1882 - RNA, 17 nt, Homo sapiens
aggcuacuuguccaucg

SEQ ID NO: 1883 - RNA, 17 nt, Homo sapiens
cuacuuguccaucguca

SEQ ID NO: 1884 - RNA, 17 nt, Homo sapiens
uuguccaucgucaugga

SEQ ID NO: 1885 - RNA, 17 nt, Homo sapiens
uccaucgucauggaucc

SEQ ID NO: 1886 - RNA, 17 nt, Homo sapiens
ucauggauccagaugaa

SEQ ID NO: 1887 - RNA, 17 nt, Homo sapiens
gaugaacucccauugga

SEQ ID NO: 1888 - RNA, 17 nt, Homo sapiens
acucccauuggaugaac

SEQ ID NO: 1889 - RNA, 17 nt, Homo sapiens
augaacauugugaacga

SEQ ID NO: 1890 - RNA, 17 nt, Homo sapiens
gacugccuuaugaugcc

SEQ ID NO: 1891 - RNA, 17 nt, Homo sapiens
acugccuuaugaugcca

SEQ ID NO: 1892 - RNA, 17 nt, Homo sapiens
augggaauuccccagag

SEQ ID NO: 1893 - RNA, 17 nt, Homo sapiens
ugggaauuccccagaga

SEQ ID NO: 1894 - RNA, 17 nt, Homo sapiens
cugaaccuagguaagcc

SEQ ID NO: 1895 - RNA, 17 nt, Homo sapiens
accuagguaagccucuu

SEQ ID NO: 1896 - RNA, 17 nt, Homo sapiens
guaagccucuuggccgu

SEQ ID NO: 1897 - RNA, 17 nt, Homo sapiens
aagccucuuggccgugg

SEQ ID NO: 1898 - RNA, 17 nt, Homo sapiens
uggugccuuuggccaag

SEQ ID NO: 1899 - RNA, 17 nt, Homo sapiens
ggugccuuuggccaaga

SEQ ID NO: 1900 - RNA, 17 nt, Homo sapiens
caagagauugaagcaga

SEQ ID NO: 1901 - RNA, 17 nt, Homo sapiens
agaugccuuuggaauug

SEQ ID NO: 1902 - RNA, 17 nt, Homo sapiens
gaugccuuuggaauuga

SEQ ID NO: 1903 - RNA, 17 nt, Homo sapiens
uuuggaauugacaagac

SEQ ID NO: 1904 - RNA, 17 nt, Homo sapiens
cagcaacuugcaggaca

SEQ ID NO: 1905 - RNA, 17 nt, Homo sapiens
aggacaguagcagucaa

SEQ ID NO: 1906 - RNA, 17 nt, Homo sapiens
guagcagucaaaauguu

SEQ ID NO: 1907 - RNA, 17 nt, Homo sapiens
caaaauguugaaagaag

SEQ ID NO: 1908 - RNA, 17 nt, Homo sapiens
gugagcaucgagcucuc

SEQ ID NO: 1909 - RNA, 17 nt, Homo sapiens
aucgagcucucaugucu

SEQ ID NO: 1910 - RNA, 17 nt, Homo sapiens
cgagcucucaugucuga

SEQ ID NO: 1911 - RNA, 17 nt, Homo sapiens
ucucaugucugaacuca

SEQ ID NO: 1912 - RNA, 17 nt, Homo sapiens
ucugaacucaagauccu

SEQ ID NO: 1913 - RNA, 17 nt, Homo sapiens
cucaagauccucauuca

SEQ ID NO: 1914 - RNA, 17 nt, Homo sapiens
aagauccucauucauau

SEQ ID NO: 1915 - RNA, 17 nt, Homo sapiens
auccucauucauauugg

SEQ ID NO: 1916 - RNA, 17 nt, Homo sapiens
uccucauucauauuggu

SEQ ID NO: 1917 - RNA, 17 nt, Homo sapiens
ucauucauauuggucac

SEQ ID NO: 1918 - RNA, 17 nt, Homo sapiens
auucauauuggucacca

SEQ ID NO: 1919 - RNA, 17 nt, Homo sapiens
auauuggucaccaucuc

SEQ ID NO: 1920 - RNA, 17 nt, Homo sapiens
gucaccaucucaaugug

SEQ ID NO: 1921 - RNA, 17 nt, Homo sapiens
caccaucucaauguggu

SEQ ID NO: 1922 - RNA, 17 nt, Homo sapiens
aauguggucaaccuucu

SEQ ID NO: 1923 - RNA, 17 nt, Homo sapiens
gucaaccuucuaggugc

SEQ ID NO: 1924 - RNA, 17 nt, Homo sapiens
ucaaccuucuaggugcc

SEQ ID NO: 1925 - RNA, 17 nt, Homo sapiens
aaccuucuaggugccug

SEQ ID NO: 1926 - RNA, 17 nt, Homo sapiens
gugccuguaccaagcca

SEQ ID NO: 1927 - RNA, 17 nt, Homo sapiens
gggccacucauggugau

SEQ ID NO: 1928 - RNA, 17 nt, Homo sapiens
auggugauuguggaauu

SEQ ID NO: 1929 - RNA, 17 nt, Homo sapiens
uguggaauucugcaaau

SEQ ID NO: 1930 - RNA, 17 nt, Homo sapiens
guggaauucugcaaauu

SEQ ID NO: 1931 - RNA, 17 nt, Homo sapiens
cugcaaauuuggaaacc

SEQ ID NO: 1932 - RNA, 17 nt, Homo sapiens
ugcaaauuuggaaaccu

SEQ ID NO: 1933 - RNA, 17 nt, Homo sapiens
aaaccuguccacuuacc

SEQ ID NO: 1934 - RNA, 17 nt, Homo sapiens
uguccacuuaccugagg

SEQ ID NO: 1935 - RNA, 17 nt, Homo sapiens
guccacuuaccugagga

SEQ ID NO: 1936 - RNA, 17 nt, Homo sapiens
aaaugaauuuguccccu

SEQ ID NO: 1937 - RNA, 17 nt, Homo sapiens
aaugaauuuguccccua

SEQ ID NO: 1938 - RNA, 17 nt, Homo sapiens
gaauuuguccccuacaa

SEQ ID NO: 1939 - RNA, 17 nt, Homo sapiens
uguccccuacaagacca

SEQ ID NO: 1940 - RNA, 17 nt, Homo sapiens
ggcacgauuccgucaag

SEQ ID NO: 1941 - RNA, 17 nt, Homo sapiens
gcacgauuccgucaagg

SEQ ID NO: 1942 - RNA, 17 nt, Homo sapiens
gauuccgucaagggaaa

SEQ ID NO: 1943 - RNA, 17 nt, Homo sapiens
gaaagacuacguuggag

SEQ ID NO: 1944 - RNA, 17 nt, Homo sapiens
gacuacguuggagcaau

SEQ ID NO: 1945 - RNA, 17 nt, Homo sapiens
ggagcaaucccugugga

SEQ ID NO: 1946 - RNA, 17 nt, Homo sapiens
cuguggaucugaaacgg

SEQ ID NO: 1947 - RNA, 17 nt, Homo sapiens
acggcgcuuggacagca

SEQ ID NO: 1948 - RNA, 17 nt, Homo sapiens
gacagcaucaccaguag

SEQ ID NO: 1949 - RNA, 17 nt, Homo sapiens
ucaccaguagccagagc

SEQ ID NO: 1950 - RNA, 17 nt, Homo sapiens
ccagagcucagccagcu

SEQ ID NO: 1951 - RNA, 17 nt, Homo sapiens
agccagcucuggauuug

SEQ ID NO: 1952 - RNA, 17 nt, Homo sapiens
cucuggauuuguggagg

SEQ ID NO: 1953 - RNA, 17 nt, Homo sapiens
ucuggauuuguggagga

SEQ ID NO: 1954 - RNA, 17 nt, Homo sapiens
ggagaagucccucagug

SEQ ID NO: 1955 - RNA, 17 nt, Homo sapiens
aagucccucagugaugu

SEQ ID NO: 1956 - RNA, 17 nt, Homo sapiens
agugauguagaagaaga

SEQ ID NO: 1957 - RNA, 17 nt, Homo sapiens
aggaagcuccugaagau

SEQ ID NO: 1958 - RNA, 17 nt, Homo sapiens
cugaagaucuguauaag

SEQ ID NO: 1959 - RNA, 17 nt, Homo sapiens
agaucuguauaaggacu

SEQ ID NO: 1960 - RNA, 17 nt, Homo sapiens
aucuguauaaggacuuc

SEQ ID NO: 1961 - RNA, 17 nt, Homo sapiens
uaaggacuuccugaccu

SEQ ID NO: 1962 - RNA, 17 nt, Homo sapiens
aaggacuuccugaccuu

SEQ ID NO: 1963 - RNA, 17 nt, Homo sapiens
ccugaccuuggagcauc

SEQ ID NO: 1964 - RNA, 17 nt, Homo sapiens
uggagcaucucaucugu

SEQ ID NO: 1965 - RNA, 17 nt, Homo sapiens
gagcaucucaucuguua

SEQ ID NO: 1966 - RNA, 17 nt, Homo sapiens
caucucaucuguuacag

SEQ ID NO: 1967 - RNA, 17 nt, Homo sapiens
ucaucuguuacagcuuc

SEQ ID NO: 1968 - RNA, 17 nt, Homo sapiens
caucuguuacagcuucc

SEQ ID NO: 1969 - RNA, 17 nt, Homo sapiens
uuacagcuuccaagugg

SEQ ID NO: 1970 - RNA, 17 nt, Homo sapiens
uacagcuuccaaguggc

SEQ ID NO: 1971 - RNA, 17 nt, Homo sapiens
aaguggcuaagggcaug

SEQ ID NO: 1972 - RNA, 17 nt, Homo sapiens
cauggaguucuuggcau

SEQ ID NO: 1973 - RNA, 17 nt, Homo sapiens
auggaguucuuggcauc

SEQ ID NO: 1974 - RNA, 17 nt, Homo sapiens
ggaguucuuggcaucgc

SEQ ID NO: 1975 - RNA, 17 nt, Homo sapiens
cuuggcaucgcgaaagu

SEQ ID NO: 1976 - RNA, 17 nt, Homo sapiens
gaaaguguauccacagg

SEQ ID NO: 1977 - RNA, 17 nt, Homo sapiens
aaguguauccacaggga

SEQ ID NO: 1978 - RNA, 17 nt, Homo sapiens
cacgaaauauccucuua

SEQ ID NO: 1979 - RNA, 17 nt, Homo sapiens
cgaaauauccucuuauc

SEQ ID NO: 1980 - RNA, 17 nt, Homo sapiens
aauauccucuuaucgga

SEQ ID NO: 1981 - RNA, 17 nt, Homo sapiens
uauccucuuaucggaga

SEQ ID NO: 1982 - RNA, 17 nt, Homo sapiens
auccucuuaucggagaa

SEQ ID NO: 1983 - RNA, 17 nt, Homo sapiens
ccucuuaucggagaaga

SEQ ID NO: 1984 - RNA, 17 nt, Homo sapiens
aacgugguuaaaaucug

SEQ ID NO: 1985 - RNA, 17 nt, Homo sapiens
acgugguuaaaaucugu

SEQ ID NO: 1986 - RNA, 17 nt, Homo sapiens
guuaaaaucugugacuu

SEQ ID NO: 1987 - RNA, 17 nt, Homo sapiens
cugugacuuuggcuugg

SEQ ID NO: 1988 - RNA, 17 nt, Homo sapiens
ugugacuuuggcuuggc

SEQ ID NO: 1989 - RNA, 17 nt, Homo sapiens
cuuuggcuuggcccggg

SEQ ID NO: 1990 - RNA, 17 nt, Homo sapiens
cccgggauauuuauaaa

SEQ ID NO: 1991 - RNA, 17 nt, Homo sapiens
cgggauauuuauaaaga

SEQ ID NO: 1992 - RNA, 17 nt, Homo sapiens
gggauauuuauaaagau

SEQ ID NO: 1993 - RNA, 17 nt, Homo sapiens
ggauauuuauaaagauc

SEQ ID NO: 1994 - RNA, 17 nt, Homo sapiens
auauuuauaaagaucca

SEQ ID NO: 1995 - RNA, 17 nt, Homo sapiens
auaaagauccagauuau

SEQ ID NO: 1996 - RNA, 17 nt, Homo sapiens
auccagauuaugucaga

SEQ ID NO: 1997 - RNA, 17 nt, Homo sapiens
uccagauuaugucagaa

SEQ ID NO: 1998 - RNA, 17 nt, Homo sapiens
gauuaugucagaaaagg

SEQ ID NO: 1999 - RNA, 17 nt, Homo sapiens
gagaugcucgccucccu

SEQ ID NO: 2000 - RNA, 17 nt, Homo sapiens
gcucgccucccuuugaa

SEQ ID NO: 2001 - RNA, 17 nt, Homo sapiens
gccucccuuugaaaugg

SEQ ID NO: 2002 - RNA, 17 nt, Homo sapiens
ccucccuuugaaaugga

SEQ ID NO: 2003 - RNA, 17 nt, Homo sapiens
gaaacaauuuuugacag

SEQ ID NO: 2004 - RNA, 17 nt, Homo sapiens
aaacaauuuuugacaga

SEQ ID NO: 2005 - RNA, 17 nt, Homo sapiens
aacaauuuuugacagag

SEQ ID NO: 2006 - RNA, 17 nt, Homo sapiens
acaauuuuugacagagu

SEQ ID NO: 2007 - RNA, 17 nt, Homo sapiens
cagaguguacacaaucc

SEQ ID NO: 2008 - RNA, 17 nt, Homo sapiens
uacacaauccagaguga

SEQ ID NO: 2009 - RNA, 17 nt, Homo sapiens
agugacgucuggucuuu

SEQ ID NO: 2010 - RNA, 17 nt, Homo sapiens
cgucuggucuuuuggug

SEQ ID NO: 2011 - RNA, 17 nt, Homo sapiens
ucuggucuuuugguguu

SEQ ID NO: 2012 - RNA, 17 nt, Homo sapiens
cuggucuuuugguguuu

SEQ ID NO: 2013 - RNA, 17 nt, Homo sapiens
uggucuuuugguguuuu

SEQ ID NO: 2014 - RNA, 17 nt, Homo sapiens
uuugguguuuugcugug

SEQ ID NO: 2015 - RNA, 17 nt, Homo sapiens
uugguguuuugcugugg

SEQ ID NO: 2016 - RNA, 17 nt, Homo sapiens
ugguguuuugcuguggg

SEQ ID NO: 2017 - RNA, 17 nt, Homo sapiens
ugggaaauauuuuccuu

SEQ ID NO: 2018 - RNA, 17 nt, Homo sapiens
ggaaauauuuuccuuag

SEQ ID NO: 2019 - RNA, 17 nt, Homo sapiens
gaaauauuuuccuuagg

SEQ ID NO: 2020 - RNA, 17 nt, Homo sapiens
aaauauuuuccuuaggu

SEQ ID NO: 2021 - RNA, 17 nt, Homo sapiens
aauauuuuccuuaggug

SEQ ID NO: 2022 - RNA, 17 nt, Homo sapiens
auuuuccuuaggugcuu

SEQ ID NO: 2023 - RNA, 17 nt, Homo sapiens
uuuuccuuaggugcuuc

SEQ ID NO: 2024 - RNA, 17 nt, Homo sapiens
uaggugcuucuccauau

SEQ ID NO: 2025 - RNA, 17 nt, Homo sapiens
aggugcuucuccauauc

SEQ ID NO: 2026 - RNA, 17 nt, Homo sapiens
gugcuucuccauauccu

SEQ ID NO: 2027 - RNA, 17 nt, Homo sapiens
uucuccauauccugggg

SEQ ID NO: 2028 - RNA, 17 nt, Homo sapiens
cuccauauccuggggua

SEQ ID NO: 2029 - RNA, 17 nt, Homo sapiens
ccugggguaaagauuga

SEQ ID NO: 2030 - RNA, 17 nt, Homo sapiens
guaaagauugaugaaga

SEQ ID NO: 2031 - RNA, 17 nt, Homo sapiens
ugaagaauuuuguaggc

SEQ ID NO: 2032 - RNA, 17 nt, Homo sapiens
gaagaauuuuguaggcg

SEQ ID NO: 2033 - RNA, 17 nt, Homo sapiens
aagaauuuuguaggcga

SEQ ID NO: 2034 - RNA, 17 nt, Homo sapiens
aauuuuguaggcgauug

SEQ ID NO: 2035 - RNA, 17 nt, Homo sapiens
uaggcgauugaaagaag

SEQ ID NO: 2036 - RNA, 17 nt, Homo sapiens
aaggaacuagaaugagg

SEQ ID NO: 2037 - RNA, 17 nt, Homo sapiens
ccccugauuauacuaca

SEQ ID NO: 2038 - RNA, 17 nt, Homo sapiens
cccugauuauacuacac

SEQ ID NO: 2039 - RNA, 17 nt, Homo sapiens
cugauuauacuacacca

SEQ ID NO: 2040 - RNA, 17 nt, Homo sapiens
auuauacuacaccagaa

SEQ ID NO: 2041 - RNA, 17 nt, Homo sapiens
agaaauguaccagacca

SEQ ID NO: 2042 - RNA, 17 nt, Homo sapiens
agcccagucagagaccc

SEQ ID NO: 2043 - RNA, 17 nt, Homo sapiens
acccacguuuucagagu

SEQ ID NO: 2044 - RNA, 17 nt, Homo sapiens
cccacguuuucagaguu

SEQ ID NO: 2045 - RNA, 17 nt, Homo sapiens
ccacguuuucagaguug

SEQ ID NO: 2046 - RNA, 17 nt, Homo sapiens
cacguuuucagaguugg

SEQ ID NO: 2047 - RNA, 17 nt, Homo sapiens
uucagaguugguggaac

SEQ ID NO: 2048 - RNA, 17 nt, Homo sapiens
uggaacauuugggaaau

SEQ ID NO: 2049 - RNA, 17 nt, Homo sapiens
ggaacauuugggaaauc

SEQ ID NO: 2050 - RNA, 17 nt, Homo sapiens
ugggaaaucucuugcaa

SEQ ID NO: 2051 - RNA, 17 nt, Homo sapiens
ggaaaucucuugcaagc

SEQ ID NO: 2052 - RNA, 17 nt, Homo sapiens
aaaucucuugcaagcua

SEQ ID NO: 2053 - RNA, 17 nt, Homo sapiens
ugcaagcuaaugcucag

SEQ ID NO: 2054 - RNA, 17 nt, Homo sapiens
cuaaugcucagcaggau

SEQ ID NO: 2055 - RNA, 17 nt, Homo sapiens
caaagacuacauuguuc

SEQ ID NO: 2056 - RNA, 17 nt, Homo sapiens
gacuacauuguucuucc

SEQ ID NO: 2057 - RNA, 17 nt, Homo sapiens
uacauuguucuuccgau

SEQ ID NO: 2058 - RNA, 17 nt, Homo sapiens
acauuguucuuccgaua

SEQ ID NO: 2059 - RNA, 17 nt, Homo sapiens
auuguucuuccgauauc

SEQ ID NO: 2060 - RNA, 17 nt, Homo sapiens
uuguucuuccgauauca

SEQ ID NO: 2061 - RNA, 17 nt, Homo sapiens
cuuccgauaucagagac

SEQ ID NO: 2062 - RNA, 17 nt, Homo sapiens
uccgauaucagagacuu

SEQ ID NO: 2063 - RNA, 17 nt, Homo sapiens
cagagacuuugagcaug

SEQ ID NO: 2064 - RNA, 17 nt, Homo sapiens
agagacuuugagcaugg

SEQ ID NO: 2065 - RNA, 17 nt, Homo sapiens
aagaggauucuggacuc

SEQ ID NO: 2066 - RNA, 17 nt, Homo sapiens
agaggauucuggacucu

SEQ ID NO: 2067 - RNA, 17 nt, Homo sapiens
ucuggacucucucugcc

SEQ ID NO: 2068 - RNA, 17 nt, Homo sapiens
uggacucucucugccua

SEQ ID NO: 2069 - RNA, 17 nt, Homo sapiens
gacucucucugccuacc

SEQ ID NO: 2070 - RNA, 17 nt, Homo sapiens
cucugccuaccucaccu

SEQ ID NO: 2071 - RNA, 17 nt, Homo sapiens
gccuaccucaccuguuu

SEQ ID NO: 2072 - RNA, 17 nt, Homo sapiens
ucaccuguuuccuguau

SEQ ID NO: 2073 - RNA, 17 nt, Homo sapiens
caccuguuuccuguaug

SEQ ID NO: 2074 - RNA, 17 nt, Homo sapiens
accuguuuccuguaugg

SEQ ID NO: 2075 - RNA, 17 nt, Homo sapiens
uuuccuguauggaggag

SEQ ID NO: 2076 - RNA, 17 nt, Homo sapiens
gaggaaguaugugaccc

SEQ ID NO: 2077 - RNA, 17 nt, Homo sapiens
ccccaaauuccauuaug

SEQ ID NO: 2078 - RNA, 17 nt, Homo sapiens
cccaaauuccauuauga

SEQ ID NO: 2079 - RNA, 17 nt, Homo sapiens
aauuccauuaugacaac

SEQ ID NO: 2080 - RNA, 17 nt, Homo sapiens
auuccauuaugacaaca

SEQ ID NO: 2081 - RNA, 17 nt, Homo sapiens
gcaggaaucagucagua

SEQ ID NO: 2082 - RNA, 17 nt, Homo sapiens
gaaucagucaguaucug

SEQ ID NO: 2083 - RNA, 17 nt, Homo sapiens
cagucaguaucugcaga

SEQ ID NO: 2084 - RNA, 17 nt, Homo sapiens
gucaguaucugcagaac

SEQ ID NO: 2085 - RNA, 17 nt, Homo sapiens
agaacaguaagcgaaag

SEQ ID NO: 2086 - RNA, 17 nt, Homo sapiens
gugaguguaaaaacauu

SEQ ID NO: 2087 - RNA, 17 nt, Homo sapiens
aaaaacauuugaagaua

SEQ ID NO: 2088 - RNA, 17 nt, Homo sapiens
aaaacauuugaagauau

SEQ ID NO: 2089 - RNA, 17 nt, Homo sapiens
uugaagauaucccguua

SEQ ID NO: 2090 - RNA, 17 nt, Homo sapiens
gaagauaucccguuaga

SEQ ID NO: 2091 - RNA, 17 nt, Homo sapiens
uaucccguuagaagaac

SEQ ID NO: 2092 - RNA, 17 nt, Homo sapiens
aucccguuagaagaacc

SEQ ID NO: 2093 - RNA, 17 nt, Homo sapiens
ccagaaguaaaaguaau

SEQ ID NO: 2094 - RNA, 17 nt, Homo sapiens
guaaaaguaaucccaga

SEQ ID NO: 2095 - RNA, 17 nt, Homo sapiens
aaaguaaucccagauga

SEQ ID NO: 2096 - RNA, 17 nt, Homo sapiens
acagugguaugguucuu

SEQ ID NO: 2097 - RNA, 17 nt, Homo sapiens
gguaugguucuugccuc

SEQ ID NO: 2098 - RNA, 17 nt, Homo sapiens
guaugguucuugccuca

SEQ ID NO: 2099 - RNA, 17 nt, Homo sapiens
augguucuugccucaga

SEQ ID NO: 2100 - RNA, 17 nt, Homo sapiens
ucuugccucagaagagc

SEQ ID NO: 2101 - RNA, 17 nt, Homo sapiens
ugaaaacuuuggaagac

SEQ ID NO: 2102 - RNA, 17 nt, Homo sapiens
gaaaacuuuggaagaca

SEQ ID NO: 2103 - RNA, 17 nt, Homo sapiens
aaccaaauuaucuccau

SEQ ID NO: 2104 - RNA, 17 nt, Homo sapiens
accaaauuaucuccauc

SEQ ID NO: 2105 - RNA, 17 nt, Homo sapiens
caaauuaucuccaucuu

SEQ ID NO: 2106 - RNA, 17 nt, Homo sapiens
aauuaucuccaucuuuu

SEQ ID NO: 2107 - RNA, 17 nt, Homo sapiens
aucuccaucuuuuggug

SEQ ID NO: 2108 - RNA, 17 nt, Homo sapiens
cuccaucuuuuggugga

SEQ ID NO: 2109 - RNA, 17 nt, Homo sapiens
uccaucuuuugguggaa

SEQ ID NO: 2110 - RNA, 17 nt, Homo sapiens
ccaucuuuugguggaau

SEQ ID NO: 2111 - RNA, 17 nt, Homo sapiens
cagggagucuguggcau

SEQ ID NO: 2112 - RNA, 17 nt, Homo sapiens
uguggcaucugaaggcu

SEQ ID NO: 2113 - RNA, 17 nt, Homo sapiens
ugaaggcucaaaccaga

SEQ ID NO: 2114 - RNA, 17 nt, Homo sapiens
aagcggcuaccaguccg

SEQ ID NO: 2115 - RNA, 17 nt, Homo sapiens
cuaccaguccggauauc

SEQ ID NO: 2116 - RNA, 17 nt, Homo sapiens
guccggauaucacuccg

SEQ ID NO: 2117 - RNA, 17 nt, Homo sapiens
ccggauaucacuccgau

SEQ ID NO: 2118 - RNA, 17 nt, Homo sapiens
auaucacuccgaugaca

SEQ ID NO: 2119 - RNA, 17 nt, Homo sapiens
caccguguacuccagug

SEQ ID NO: 2120 - RNA, 17 nt, Homo sapiens
cguguacuccagugagg

SEQ ID NO: 2121 - RNA, 17 nt, Homo sapiens
gcagaacuuuuaaagcu

SEQ ID NO: 2122 - RNA, 17 nt, Homo sapiens
cagaacuuuuaaagcug

SEQ ID NO: 2123 - RNA, 17 nt, Homo sapiens
agaacuuuuaaagcuga

SEQ ID NO: 2124 - RNA, 17 nt, Homo sapiens
gaacuuuuaaagcugau

SEQ ID NO: 2125 - RNA, 17 nt, Homo sapiens
aagcugauagagauugg

SEQ ID NO: 2126 - RNA, 17 nt, Homo sapiens
auagagauuggagugca

SEQ ID NO: 2127 - RNA, 17 nt, Homo sapiens
aaaccgguagcacagcc

SEQ ID NO: 2128 - RNA, 17 nt, Homo sapiens
gcccagauucuccagcc

SEQ ID NO: 2129 - RNA, 17 nt, Homo sapiens
cccagauucuccagccu

SEQ ID NO: 2130 - RNA, 17 nt, Homo sapiens
cagauucuccagccuga

SEQ ID NO: 2131 - RNA, 17 nt, Homo sapiens
acugagcucuccuccug

SEQ ID NO: 2132 - RNA, 17 nt, Homo sapiens
ugagcucuccuccuguu

SEQ ID NO: 2133 - RNA, 17 nt, Homo sapiens
gcucuccuccuguuuaa

SEQ ID NO: 2134 - RNA, 17 nt, Homo sapiens
ccuccuguuuaaaagga

SEQ ID NO: 2135 - RNA, 17 nt, Homo sapiens
cuccuguuuaaaaggaa

SEQ ID NO: 2136 - RNA, 17 nt, Homo sapiens
uccuguuuaaaaggaag

SEQ ID NO: 2137 - RNA, 17 nt, Homo sapiens
ggaagcauccacacccc

SEQ ID NO: 2138 - RNA, 17 nt, Homo sapiens
ccccaacucccggacau

SEQ ID NO: 2139 - RNA, 17 nt, Homo sapiens
ccggacaucacaugaga

SEQ ID NO: 2140 - RNA, 17 nt, Homo sapiens
ugagaggucugcucaga

SEQ ID NO: 2141 - RNA, 17 nt, Homo sapiens
ggucugcucagauuuug

SEQ ID NO: 2142 - RNA, 17 nt, Homo sapiens
gcucagauuuugaagug

SEQ ID NO: 2143 - RNA, 17 nt, Homo sapiens
cucagauuuugaagugu

SEQ ID NO: 2144 - RNA, 17 nt, Homo sapiens
ucagauuuugaaguguu

SEQ ID NO: 2145 - RNA, 17 nt, Homo sapiens
ugaaguguuguucuuuc

SEQ ID NO: 2146 - RNA, 17 nt, Homo sapiens
aguguuguucuuuccac

SEQ ID NO: 2147 - RNA, 17 nt, Homo sapiens
guguuguucuuuccacc

SEQ ID NO: 2148 - RNA, 17 nt, Homo sapiens
guuguucuuuccaccag

SEQ ID NO: 2149 - RNA, 17 nt, Homo sapiens
uuguucuuuccaccagc

SEQ ID NO: 2150 - RNA, 17 nt, Homo sapiens
uguucuuuccaccagca

SEQ ID NO: 2151 - RNA, 17 nt, Homo sapiens
caggaaguagccgcauu

SEQ ID NO: 2152 - RNA, 17 nt, Homo sapiens
agccgcauuugauuuuc

SEQ ID NO: 2153 - RNA, 17 nt, Homo sapiens
gccgcauuugauuuuca

SEQ ID NO: 2154 - RNA, 17 nt, Homo sapiens
cauuugauuuucauuuc

SEQ ID NO: 2155 - RNA, 17 nt, Homo sapiens
auuugauuuucauuucg

SEQ ID NO: 2156 - RNA, 17 nt, Homo sapiens
uuugauuuucauuucga

SEQ ID NO: 2157 - RNA, 17 nt, Homo sapiens
uugauuuucauuucgac

SEQ ID NO: 2158 - RNA, 17 nt, Homo sapiens
auuuucauuucgacaac

SEQ ID NO: 2159 - RNA, 17 nt, Homo sapiens
uuuucauuucgacaaca

SEQ ID NO: 2160 - RNA, 17 nt, Homo sapiens
uuucauuucgacaacag

SEQ ID NO: 2161 - RNA, 17 nt, Homo sapiens
aaggaccucggacugca

SEQ ID NO: 2162 - RNA, 17 nt, Homo sapiens
agccagcucuucuaggc

SEQ ID NO: 2163 - RNA, 17 nt, Homo sapiens
ccagcucuucuaggcuu

SEQ ID NO: 2164 - RNA, 17 nt, Homo sapiens
cagcucuucuaggcuug

SEQ ID NO: 2165 - RNA, 17 nt, Homo sapiens
gcucuucuaggcuugug

SEQ ID NO: 2166 - RNA, 18 nt, Homo sapiens
aggugcugcuggccgucg

SEQ ID NO: 2167 - RNA, 18 nt, Homo sapiens
gcuggccgucgcccugug

SEQ ID NO: 2168 - RNA, 18 nt, Homo sapiens
ccgggccgccucuguggg

SEQ ID NO: 2169 - RNA, 18 nt, Homo sapiens
uugaucugcccaggcuca

SEQ ID NO: 2170 - RNA, 18 nt, Homo sapiens
ggaaacugacuuggccuc

SEQ ID NO: 2171 - RNA, 18 nt, Homo sapiens
gauuacagaucuccauuu

SEQ ID NO: 2172 - RNA, 18 nt, Homo sapiens
uguuccugaugguaacag

SEQ ID NO: 2173 - RNA, 18 nt, Homo sapiens
guuaccagucuauuaugu

SEQ ID NO: 2174 - RNA, 18 nt, Homo sapiens
ugaguccgucucauggaa

SEQ ID NO: 2175 - RNA, 18 nt, Homo sapiens
acuaucuguuggagaaaa

SEQ ID NO: 2176 - RNA, 18 nt, Homo sapiens
aaacccagucugggagug

SEQ ID NO: 2177 - RNA, 18 nt, Homo sapiens
gugggcugaugaccaaga

SEQ ID NO: 2178 - RNA, 18 nt, Homo sapiens
auguacugacgauuaugg

SEQ ID NO: 2179 - RNA, 18 nt, Homo sapiens
caccccagauuggugaga

SEQ ID NO: 2180 - RNA, 18 nt, Homo sapiens
auguacggucuaugccau

SEQ ID NO: 2181 - RNA, 18 nt, Homo sapiens
auuggcaguuggaggaag

SEQ ID NO: 2182 - RNA, 18 nt, Homo sapiens
ccaagcugucucagugac

SEQ ID NO: 2183 - RNA, 18 nt, Homo sapiens
ugugucagcuuuguacaa

SEQ ID NO: 2184 - RNA, 18 nt, Homo sapiens
acaugcagcccacugagc

SEQ ID NO: 2185 - RNA, 18 nt, Homo sapiens
gcagacagaucuacguuu

SEQ ID NO: 2186 - RNA, 18 nt, Homo sapiens
gcccacagccucugccaa

SEQ ID NO: 2187 - RNA, 18 nt, Homo sapiens
cacaccuguuugcaagaa

SEQ ID NO: 2188 - RNA, 18 nt, Homo sapiens
uaugucugccuugcucaa

SEQ ID NO: 2189 - RNA, 18 nt, Homo sapiens
ucaggcagcucacagucc

SEQ ID NO: 2190 - RNA, 18 nt, Homo sapiens
gcucacaguccuagagcg

SEQ ID NO: 2191 - RNA, 18 nt, Homo sapiens
agaaucagacgacaagua

SEQ ID NO: 2192 - RNA, 18 nt, Homo sapiens
cuccacagaucauguggu

SEQ ID NO: 2193 - RNA, 18 nt, Homo sapiens
ggauccagaugaacuccc

SEQ ID NO: 2194 - RNA, 18 nt, Homo sapiens
aacgacugccuuaugaug

SEQ ID NO: 2195 - RNA, 18 nt, Homo sapiens
gagaccggcugaaccuag

SEQ ID NO: 2196 - RNA, 18 nt, Homo sapiens
ugaagcagaugccuuugg

SEQ ID NO: 2197 - RNA, 18 nt, Homo sapiens
gaaaccuguccacuuacc

SEQ ID NO: 2198 - RNA, 18 nt, Homo sapiens
ucagccagcucuggauuu

SEQ ID NO: 2199 - RNA, 18 nt, Homo sapiens
acuuccugaccuuggagc

SEQ ID NO: 2200 - RNA, 18 nt, Homo sapiens
uguuacagcuuccaagug

SEQ ID NO: 2201 - RNA, 18 nt, Homo sapiens
agauccagauuaugucag

SEQ ID NO: 2202 - RNA, 18 nt, Homo sapiens
ggccccugauuauacuac

SEQ ID NO: 2203 - RNA, 18 nt, Homo sapiens
uguaccagaccaugcugg

SEQ ID NO: 2204 - RNA, 18 nt, Homo sapiens
cuggacugcuggcacggg

SEQ ID NO: 2205 - RNA, 18 nt, Homo sapiens
ucucucugccuaccucac

SEQ ID NO: 2206 - RNA, 18 nt, Homo sapiens
cucaccuguuuccuguau

SEQ ID NO: 2207 - RNA, 18 nt, Homo sapiens
agagccggccugugagug

SEQ ID NO: 2208 - RNA, 18 nt, Homo sapiens
aaucccagaugacaacca

SEQ ID NO: 2209 - RNA, 18 nt, Homo sapiens
acaaccagacggacagug

SEQ ID NO: 2210 - RNA, 18 nt, Homo sapiens
gcuaccaguccggauauc

SEQ ID NO: 2211 - RNA, 18 nt, Homo sapiens
ucacuccgaugacacaga

SEQ ID NO: 2212 - RNA, 18 nt, Homo sapiens
uagcacagcccagauucu

SEQ ID NO: 2213 - RNA, 18 nt, Homo sapiens
cagcccagauucuccagc

SEQ ID NO: 2214 - RNA, 18 nt, Homo sapiens
uucuccagccugacacgg

SEQ ID NO: 2215 - RNA, 18 nt, Homo sapiens
uccuccuguuuaaaagga

SEQ ID NO: 2216 - RNA, 18 nt, Homo sapiens
gaggucugcucagauuuu

SEQ ID NO: 2217 - RNA, 18 nt, Homo sapiens
cugcucagauuuugaagu

SEQ ID NO: 2218 - RNA, 18 nt, Homo sapiens
gaccucggacugcaggga

SEQ ID NO: 2219 - RNA, 18 nt, Homo sapiens
ggagccagcucuucuagg

SEQ ID NO: 2220 - RNA, 17 nt, Mus musculus
gggcgaauuggguacgg

SEQ ID NO: 2221 - RNA, 17 nt, Mus musculus
aauuggguacgggaccc

SEQ ID NO: 2222 - RNA, 17 nt, Mus musculus
accccccucgaggucga

SEQ ID NO: 2223 - RNA, 17 nt, Mus musculus
cucgaggucgacgguau

SEQ ID NO: 2224 - RNA, 17 nt, Mus musculus
ucgacgguaucgauaag

SEQ ID NO: 2225 - RNA, 17 nt, Mus musculus
gacgguaucgauaagcu

SEQ ID NO: 2226 - RNA, 17 nt, Mus musculus
guaucgauaagcuugau

SEQ ID NO: 2227 - RNA, 17 nt, Mus musculus
gauaagcuugauaucga

SEQ ID NO: 2228 - RNA, 17 nt, Mus musculus
agcuugauaucgaauuc

SEQ ID NO: 2229 - RNA, 17 nt, Mus musculus
cuugauaucgaauucgg

SEQ ID NO: 2230 - RNA, 17 nt, Mus musculus
uaucgaauucgggccca

SEQ ID NO: 2231 - RNA, 17 nt, Mus musculus
aucgaauucgggcccag

SEQ ID NO: 2232 - RNA, 17 nt, Mus musculus
gacugugucccgcagcc

SEQ ID NO: 2233 - RNA, 17 nt, Mus musculus
gccgggauaaccuggcu

SEQ ID NO: 2234 - RNA, 17 nt, Mus musculus
gacccgauuccgcggac

SEQ ID NO: 2235 - RNA, 17 nt, Mus musculus
acccgauuccgcggaca

SEQ ID NO: 2236 - RNA, 17 nt, Mus musculus
cccgcgcucuccccggu

SEQ ID NO: 2237 - RNA, 17 nt, Mus musculus
cgcgcucuccccggucu

SEQ ID NO: 2238 - RNA, 17 nt, Mus musculus
uccccggucuugcgcug

SEQ ID NO: 2239 - RNA, 17 nt, Mus musculus
cccggucuugcgcugcg

SEQ ID NO: 2240 - RNA, 17 nt, Mus musculus
ggggccauaccgccucu

SEQ ID NO: 2241 - RNA, 17 nt, Mus musculus
uaccgccucugugacuu

SEQ ID NO: 2242 - RNA, 17 nt, Mus musculus
cugugacuucuuugcgg

SEQ ID NO: 2243 - RNA, 17 nt, Mus musculus
ugugacuucuuugcggg

SEQ ID NO: 2244 - RNA, 17 nt, Mus musculus
ugacuucuuugcgggcc

SEQ ID NO: 2245 - RNA, 17 nt, Mus musculus
gacuucuuugcgggcca

SEQ ID NO: 2246 - RNA, 17 nt, Mus musculus
gaaggagucugugccug

SEQ ID NO: 2247 - RNA, 17 nt, Mus musculus
acugggcucugugccca

SEQ ID NO: 2248 - RNA, 17 nt, Mus musculus
gcgcugcuagcugucgc

SEQ ID NO: 2249 - RNA, 17 nt, Mus musculus
cuagcugucgcucugug

SEQ ID NO: 2250 - RNA, 17 nt, Mus musculus
cugucgcucugugguuc

SEQ ID NO: 2251 - RNA, 17 nt, Mus musculus
ucugugguucugcgugg

SEQ ID NO: 2252 - RNA, 17 nt, Mus musculus
cugugguucugcgugga

SEQ ID NO: 2253 - RNA, 17 nt, Mus musculus
agccgccucuguggguu

SEQ ID NO: 2254 - RNA, 17 nt, Mus musculus
cuguggguuugacuggc

SEQ ID NO: 2255 - RNA, 17 nt, Mus musculus
uguggguuugacuggcg

SEQ ID NO: 2256 - RNA, 17 nt, Mus musculus
cuggcgauuuucuccau

SEQ ID NO: 2257 - RNA, 17 nt, Mus musculus
uggcgauuuucuccauc

SEQ ID NO: 2258 - RNA, 17 nt, Mus musculus
ggcgauuuucuccaucc

SEQ ID NO: 2259 - RNA, 17 nt, Mus musculus
gcgauuuucuccauccc

SEQ ID NO: 2260 - RNA, 17 nt, Mus musculus
gauuuucuccauccccc

SEQ ID NO: 2261 - RNA, 17 nt, Mus musculus
uucuccauccccccaag

SEQ ID NO: 2262 - RNA, 17 nt, Mus musculus
cccaagcucagcacaca

SEQ ID NO: 2263 - RNA, 17 nt, Mus musculus
aaagacauacugacaau

SEQ ID NO: 2264 - RNA, 17 nt, Mus musculus
cugacaauuuuggcaaa

SEQ ID NO: 2265 - RNA, 17 nt, Mus musculus
ugacaauuuuggcaaau

SEQ ID NO: 2266 - RNA, 17 nt, Mus musculus
gacaauuuuggcaaaua

SEQ ID NO: 2267 - RNA, 17 nt, Mus musculus
uggcaaauacaacccuu

SEQ ID NO: 2268 - RNA, 17 nt, Mus musculus
acaacccuucagauuac

SEQ ID NO: 2269 - RNA, 17 nt, Mus musculus
caacccuucagauuacu

SEQ ID NO: 2270 - RNA, 17 nt, Mus musculus
cuucagauuacuugcag

SEQ ID NO: 2271 - RNA, 17 nt, Mus musculus
uucagauuacuugcagg

SEQ ID NO: 2272 - RNA, 17 nt, Mus musculus
agauuacuugcagggga

SEQ ID NO: 2273 - RNA, 17 nt, Mus musculus
ccaaugcucagcgugau

SEQ ID NO: 2274 - RNA, 17 nt, Mus musculus
agcgugauucugaggaa

SEQ ID NO: 2275 - RNA, 17 nt, Mus musculus
gcgugauucugaggaaa

SEQ ID NO: 2276 - RNA, 17 nt, Mus musculus
gaaaggguauuggugac

SEQ ID NO: 2277 - RNA, 17 nt, Mus musculus
aaggguauuggugacug

SEQ ID NO: 2278 - RNA, 17 nt, Mus musculus
gugacaguaucuucugc

SEQ ID NO: 2279 - RNA, 17 nt, Mus musculus
gacaguaucuucugcaa

SEQ ID NO: 2280 - RNA, 17 nt, Mus musculus
caguaucuucugcaaaa

SEQ ID NO: 2281 - RNA, 17 nt, Mus musculus
aguaucuucugcaaaac

SEQ ID NO: 2282 - RNA, 17 nt, Mus musculus
aaaacacucaccauucc

SEQ ID NO: 2283 - RNA, 17 nt, Mus musculus
cucaccauucccagggu

SEQ ID NO: 2284 - RNA, 17 nt, Mus musculus
ucaccauucccagggug

SEQ ID NO: 2285 - RNA, 17 nt, Mus musculus
agggugguuggaaauga

SEQ ID NO: 2286 - RNA, 17 nt, Mus musculus
gaaaugauacuggagcc

SEQ ID NO: 2287 - RNA, 17 nt, Mus musculus
caagugcucguaccggg

SEQ ID NO: 2288 - RNA, 17 nt, Mus musculus
gugcucguaccgggacg

SEQ ID NO: 2289 - RNA, 17 nt, Mus musculus
cgggacgucgacauagc

SEQ ID NO: 2290 - RNA, 17 nt, Mus musculus
gucgacauagccuccac

SEQ ID NO: 2291 - RNA, 17 nt, Mus musculus
cauagccuccacuguuu

SEQ ID NO: 2292 - RNA, 17 nt, Mus musculus
uccacuguuuaugucua

SEQ ID NO: 2293 - RNA, 17 nt, Mus musculus
ccacuguuuaugucuau

SEQ ID NO: 2294 - RNA, 17 nt, Mus musculus
cacuguuuaugucuaug

SEQ ID NO: 2295 - RNA, 17 nt, Mus musculus
guuuaugucuauguucg

SEQ ID NO: 2296 - RNA, 17 nt, Mus musculus
uuaugucuauguucgag

SEQ ID NO: 2297 - RNA, 17 nt, Mus musculus
gucuauguucgagauua

SEQ ID NO: 2298 - RNA, 17 nt, Mus musculus
ucuauguucgagauuac

SEQ ID NO: 2299 - RNA, 17 nt, Mus musculus
uucgagauuacagauca

SEQ ID NO: 2300 - RNA, 17 nt, Mus musculus
ucgagauuacagaucac

SEQ ID NO: 2301 - RNA, 17 nt, Mus musculus
uuacagaucaccauuca

SEQ ID NO: 2302 - RNA, 17 nt, Mus musculus
aucaccauucaucgccu

SEQ ID NO: 2303 - RNA, 17 nt, Mus musculus
ucaccauucaucgccuc

SEQ ID NO: 2304 - RNA, 17 nt, Mus musculus
ccauucaucgccucugu

SEQ ID NO: 2305 - RNA, 17 nt, Mus musculus
caucgccucugucagug

SEQ ID NO: 2306 - RNA, 17 nt, Mus musculus
gccucugucagugacca

SEQ ID NO: 2307 - RNA, 17 nt, Mus musculus
cauggcaucguguacau

SEQ ID NO: 2308 - RNA, 17 nt, Mus musculus
caucguguacaucaccg

SEQ ID NO: 2309 - RNA, 17 nt, Mus musculus
guguacaucaccgagaa

SEQ ID NO: 2310 - RNA, 17 nt, Mus musculus
guggugauccccugccg

SEQ ID NO: 2311 - RNA, 17 nt, Mus musculus
ccgagggucgauuucaa

SEQ ID NO: 2312 - RNA, 17 nt, Mus musculus
gggucgauuucaaaccu

SEQ ID NO: 2313 - RNA, 17 nt, Mus musculus
ggucgauuucaaaccuc

SEQ ID NO: 2314 - RNA, 17 nt, Mus musculus
gucgauuucaaaccuca

SEQ ID NO: 2315 - RNA, 17 nt, Mus musculus
ucaaaccucaauguguc

SEQ ID NO: 2316 - RNA, 17 nt, Mus musculus
caaugugucucuuugcg

SEQ ID NO: 2317 - RNA, 17 nt, Mus musculus
augugucucuuugcgcu

SEQ ID NO: 2318 - RNA, 17 nt, Mus musculus
gugucucuuugcgcuag

SEQ ID NO: 2319 - RNA, 17 nt, Mus musculus
ugucucuuugcgcuagg

SEQ ID NO: 2320 - RNA, 17 nt, Mus musculus
uuugcgcuagguaucca

SEQ ID NO: 2321 - RNA, 17 nt, Mus musculus
cgcuagguauccagaaa

SEQ ID NO: 2322 - RNA, 17 nt, Mus musculus
cuagguauccagaaaag

SEQ ID NO: 2323 - RNA, 17 nt, Mus musculus
aaagagauuuguuccgg

SEQ ID NO: 2324 - RNA, 17 nt, Mus musculus
aagagauuuguuccgga

SEQ ID NO: 2325 - RNA, 17 nt, Mus musculus
agauuuguuccggaugg

SEQ ID NO: 2326 - RNA, 17 nt, Mus musculus
gauuuguuccggaugga

SEQ ID NO: 2327 - RNA, 17 nt, Mus musculus
agcgagauaggcuuuac

SEQ ID NO: 2328 - RNA, 17 nt, Mus musculus
gauaggcuuuacucucc

SEQ ID NO: 2329 - RNA, 17 nt, Mus musculus
auaggcuuuacucuccc

SEQ ID NO: 2330 - RNA, 17 nt, Mus musculus
uaggcuuuacucucccc

SEQ ID NO: 2331 - RNA, 17 nt, Mus musculus
gcuuuacucuccccagu

SEQ ID NO: 2332 - RNA, 17 nt, Mus musculus
uuuacucuccccaguua

SEQ ID NO: 2333 - RNA, 17 nt, Mus musculus
uccccaguuacaugauc

SEQ ID NO: 2334 - RNA, 17 nt, Mus musculus
ccccaguuacaugauca

SEQ ID NO: 2335 - RNA, 17 nt, Mus musculus
gaucagcuaugccggca

SEQ ID NO: 2336 - RNA, 17 nt, Mus musculus
cauggucuucugugagg

SEQ ID NO: 2337 - RNA, 17 nt, Mus musculus
auggucuucugugaggc

SEQ ID NO: 2338 - RNA, 17 nt, Mus musculus
gcaaagaucaaugauga

SEQ ID NO: 2339 - RNA, 17 nt, Mus musculus
ugaaaccuaucagucua

SEQ ID NO: 2340 - RNA, 17 nt, Mus musculus
aaaccuaucagucuauc

SEQ ID NO: 2341 - RNA, 17 nt, Mus musculus
cuaucagucuaucaugu

SEQ ID NO: 2342 - RNA, 17 nt, Mus musculus
aucagucuaucauguac

SEQ ID NO: 2343 - RNA, 17 nt, Mus musculus
cagucuaucauguacau

SEQ ID NO: 2344 - RNA, 17 nt, Mus musculus
uaucauguacauaguug

SEQ ID NO: 2345 - RNA, 17 nt, Mus musculus
auguacauaguuguggu

SEQ ID NO: 2346 - RNA, 17 nt, Mus musculus
uacauaguugugguugu

SEQ ID NO: 2347 - RNA, 17 nt, Mus musculus
guugugguuguaggaua

SEQ ID NO: 2348 - RNA, 17 nt, Mus musculus
gugguuguaggauauag

SEQ ID NO: 2349 - RNA, 17 nt, Mus musculus
uguaggauauaggauuu

SEQ ID NO: 2350 - RNA, 17 nt, Mus musculus
uaggauauaggauuuau

SEQ ID NO: 2351 - RNA, 17 nt, Mus musculus
uaggauuuaugauguga

SEQ ID NO: 2352 - RNA, 17 nt, Mus musculus
gaugugauucugagccc

SEQ ID NO: 2353 - RNA, 17 nt, Mus musculus
augugauucugagcccc

SEQ ID NO: 2354 - RNA, 17 nt, Mus musculus
caugaaauugagcuauc

SEQ ID NO: 2355 - RNA, 17 nt, Mus musculus
auugagcuaucugccgg

SEQ ID NO: 2356 - RNA, 17 nt, Mus musculus
ugagcuaucugccggag

SEQ ID NO: 2357 - RNA, 17 nt, Mus musculus
gaaaaacuugucuuaaa

SEQ ID NO: 2358 - RNA, 17 nt, Mus musculus
aaacuugucuuaaauug

SEQ ID NO: 2359 - RNA, 17 nt, Mus musculus
acuugucuuaaauugua

SEQ ID NO: 2360 - RNA, 17 nt, Mus musculus
ucuuaaauuguacagcg

SEQ ID NO: 2361 - RNA, 17 nt, Mus musculus
uaaauuguacagcgaga

SEQ ID NO: 2362 - RNA, 17 nt, Mus musculus
acagagcucaauguggg

SEQ ID NO: 2363 - RNA, 17 nt, Mus musculus
guggggcuugauuucac

SEQ ID NO: 2364 - RNA, 17 nt, Mus musculus
ggcuugauuucaccugg

SEQ ID NO: 2365 - RNA, 17 nt, Mus musculus
gcuugauuucaccuggc

SEQ ID NO: 2366 - RNA, 17 nt, Mus musculus
cuugauuucaccuggca

SEQ ID NO: 2367 - RNA, 17 nt, Mus musculus
cuggcacucuccaccuu

SEQ ID NO: 2368 - RNA, 17 nt, Mus musculus
ggcacucuccaccuuca

SEQ ID NO: 2369 - RNA, 17 nt, Mus musculus
cuccaccuucaaagucu

SEQ ID NO: 2370 - RNA, 17 nt, Mus musculus
uccaccuucaaagucuc

SEQ ID NO: 2371 - RNA, 17 nt, Mus musculus
uucaaagucucaucaua

SEQ ID NO: 2372 - RNA, 17 nt, Mus musculus
caaagucucaucauaag

SEQ ID NO: 2373 - RNA, 17 nt, Mus musculus
agucucaucauaagaag

SEQ ID NO: 2374 - RNA, 17 nt, Mus musculus
cucaucauaagaagauu

SEQ ID NO: 2375 - RNA, 17 nt, Mus musculus
aagaagauuguaaaccg

SEQ ID NO: 2376 - RNA, 17 nt, Mus musculus
aagauuguaaaccggga

SEQ ID NO: 2377 - RNA, 17 nt, Mus musculus
gaaacccuuuccuggga

SEQ ID NO: 2378 - RNA, 17 nt, Mus musculus
aaacccuuuccugggac

SEQ ID NO: 2379 - RNA, 17 nt, Mus musculus
aacccuuuccugggacu

SEQ ID NO: 2380 - RNA, 17 nt, Mus musculus
gaagauguuuuugagca

SEQ ID NO: 2381 - RNA, 17 nt, Mus musculus
aagauguuuuugagcac

SEQ ID NO: 2382 - RNA, 17 nt, Mus musculus
agauguuuuugagcacc

SEQ ID NO: 2383 - RNA, 17 nt, Mus musculus
gauguuuuugagcaccu

SEQ ID NO: 2384 - RNA, 17 nt, Mus musculus
gagcaccuugacaauag

SEQ ID NO: 2385 - RNA, 17 nt, Mus musculus
uugacaauagaaagugu

SEQ ID NO: 2386 - RNA, 17 nt, Mus musculus
aggggaauacaccugug

SEQ ID NO: 2387 - RNA, 17 nt, Mus musculus
accuguguagcguccag

SEQ ID NO: 2388 - RNA, 17 nt, Mus musculus
uguagcguccaguggac

SEQ ID NO: 2389 - RNA, 17 nt, Mus musculus
cggaugaucaagagaaa

SEQ ID NO: 2390 - RNA, 17 nt, Mus musculus
agagaaauagaacauuu

SEQ ID NO: 2391 - RNA, 17 nt, Mus musculus
uagaacauuuguccgag

SEQ ID NO: 2392 - RNA, 17 nt, Mus musculus
agaacauuuguccgagu

SEQ ID NO: 2393 - RNA, 17 nt, Mus musculus
acauuuguccgaguuca

SEQ ID NO: 2394 - RNA, 17 nt, Mus musculus
guccgaguucacacaaa

SEQ ID NO: 2395 - RNA, 17 nt, Mus musculus
uccgaguucacacaaag

SEQ ID NO: 2396 - RNA, 17 nt, Mus musculus
caaagccuuuuauugcu

SEQ ID NO: 2397 - RNA, 17 nt, Mus musculus
aaagccuuuuauugcuu

SEQ ID NO: 2398 - RNA, 17 nt, Mus musculus
aagccuuuuauugcuuu

SEQ ID NO: 2399 - RNA, 17 nt, Mus musculus
agccuuuuauugcuuuc

SEQ ID NO: 2400 - RNA, 17 nt, Mus musculus
ccuuuuauugcuuucgg

SEQ ID NO: 2401 - RNA, 17 nt, Mus musculus
uuauugcuuucgguagu

SEQ ID NO: 2402 - RNA, 17 nt, Mus musculus
uauugcuuucgguagug

SEQ ID NO: 2403 - RNA, 17 nt, Mus musculus
auugcuuucgguagugg

SEQ ID NO: 2404 - RNA, 17 nt, Mus musculus
cuuucgguagugggaug

SEQ ID NO: 2405 - RNA, 17 nt, Mus musculus
gaugaaaucuuuggugg

SEQ ID NO: 2406 - RNA, 17 nt, Mus musculus
ugaaaucuuugguggaa

SEQ ID NO: 2407 - RNA, 17 nt, Mus musculus
gaaaucuuugguggaag

SEQ ID NO: 2408 - RNA, 17 nt, Mus musculus
ugggcagucaaguccga

SEQ ID NO: 2409 - RNA, 17 nt, Mus musculus
agucaaguccgaauccc

SEQ ID NO: 2410 - RNA, 17 nt, Mus musculus
guccgaaucccugugaa

SEQ ID NO: 2411 - RNA, 17 nt, Mus musculus
ugugaaguaucucaguu

SEQ ID NO: 2412 - RNA, 17 nt, Mus musculus
ugaaguaucucaguuac

SEQ ID NO: 2413 - RNA, 17 nt, Mus musculus
aaguaucucaguuaccc

SEQ ID NO: 2414 - RNA, 17 nt, Mus musculus
aucucaguuacccagcu

SEQ ID NO: 2415 - RNA, 17 nt, Mus musculus
ucucaguuacccagcuc

SEQ ID NO: 2416 - RNA, 17 nt, Mus musculus
acccagcuccugauauc

SEQ ID NO: 2417 - RNA, 17 nt, Mus musculus
cuccugauaucaaaugg

SEQ ID NO: 2418 - RNA, 17 nt, Mus musculus
ccugauaucaaauggua

SEQ ID NO: 2419 - RNA, 17 nt, Mus musculus
caaaugguacagaaaug

SEQ ID NO: 2420 - RNA, 17 nt, Mus musculus
aggcccauugaguccaa

SEQ ID NO: 2421 - RNA, 17 nt, Mus musculus
cauugaguccaacuaca

SEQ ID NO: 2422 - RNA, 17 nt, Mus musculus
guccaacuacacaauga

SEQ ID NO: 2423 - RNA, 17 nt, Mus musculus
acaaugauuguuggcga

SEQ ID NO: 2424 - RNA, 17 nt, Mus musculus
augauuguuggcgauga

SEQ ID NO: 2425 - RNA, 17 nt, Mus musculus
gaugaacucaccaucau

SEQ ID NO: 2426 - RNA, 17 nt, Mus musculus
cucaccaucauggaagu

SEQ ID NO: 2427 - RNA, 17 nt, Mus musculus
aggaaacuacacgguca

SEQ ID NO: 2428 - RNA, 17 nt, Mus musculus
uacacggucauccucac

SEQ ID NO: 2429 - RNA, 17 nt, Mus musculus
acggucauccucaccaa

SEQ ID NO: 2430 - RNA, 17 nt, Mus musculus
gucauccucaccaaccc

SEQ ID NO: 2431 - RNA, 17 nt, Mus musculus
aaccccauuucaaugga

SEQ ID NO: 2432 - RNA, 17 nt, Mus musculus
accccauuucaauggag

SEQ ID NO: 2433 - RNA, 17 nt, Mus musculus
ccccauuucaauggaga

SEQ ID NO: 2434 - RNA, 17 nt, Mus musculus
cacauggucucucuggu

SEQ ID NO: 2435 - RNA, 17 nt, Mus musculus
cauggucucucugguug

SEQ ID NO: 2436 - RNA, 17 nt, Mus musculus
ucucugguugugaaugu

SEQ ID NO: 2437 - RNA, 17 nt, Mus musculus
gugaaugucccacccca

SEQ ID NO: 2438 - RNA, 17 nt, Mus musculus
ccccagaucggugagaa

SEQ ID NO: 2439 - RNA, 17 nt, Mus musculus
gaaagccuugaucucgc

SEQ ID NO: 2440 - RNA, 17 nt, Mus musculus
gccuugaucucgccuau

SEQ ID NO: 2441 - RNA, 17 nt, Mus musculus
cuugaucucgccuaugg

SEQ ID NO: 2442 - RNA, 17 nt, Mus musculus
ucucgccuauggauucc

SEQ ID NO: 2443 - RNA, 17 nt, Mus musculus
cuauggauuccuaccag

SEQ ID NO: 2444 - RNA, 17 nt, Mus musculus
uauggauuccuaccagu

SEQ ID NO: 2445 - RNA, 17 nt, Mus musculus
ggauuccuaccaguaug

SEQ ID NO: 2446 - RNA, 17 nt, Mus musculus
cuaccaguaugggacca

SEQ ID NO: 2447 - RNA, 17 nt, Mus musculus
gcagacauugacaugca

SEQ ID NO: 2448 - RNA, 17 nt, Mus musculus
ugcacagucuacgccaa

SEQ ID NO: 2449 - RNA, 17 nt, Mus musculus
cacagucuacgccaacc

SEQ ID NO: 2450 - RNA, 17 nt, Mus musculus
ccaacccuccccugcac

SEQ ID NO: 2451 - RNA, 17 nt, Mus musculus
caccacauccaguggua

SEQ ID NO: 2452 - RNA, 17 nt, Mus musculus
ccagugguacuggcagc

SEQ ID NO: 2453 - RNA, 17 nt, Mus musculus
uggcagcuagaagaagc

SEQ ID NO: 2454 - RNA, 17 nt, Mus musculus
agccugcuccuacagac

SEQ ID NO: 2455 - RNA, 17 nt, Mus musculus
cugcuccuacagacccg

SEQ ID NO: 2456 - RNA, 17 nt, Mus musculus
aagcccguaugcuugua

SEQ ID NO: 2457 - RNA, 17 nt, Mus musculus
cguaugcuuguaaagaa

SEQ ID NO: 2458 - RNA, 17 nt, Mus musculus
augcuuguaaagaaugg

SEQ ID NO: 2459 - RNA, 17 nt, Mus musculus
uggaggauuuccagggg

SEQ ID NO: 2460 - RNA, 17 nt, Mus musculus
ggaggauuuccaggggg

SEQ ID NO: 2461 - RNA, 17 nt, Mus musculus
gaggauuuccagggggg

SEQ ID NO: 2462 - RNA, 17 nt, Mus musculus
aacaagaucgaagucac

SEQ ID NO: 2463 - RNA, 17 nt, Mus musculus
aucgaagucaccaaaaa

SEQ ID NO: 2464 - RNA, 17 nt, Mus musculus
aaaccaauaugcccuga

SEQ ID NO: 2465 - RNA, 17 nt, Mus musculus
gcccugauugaaggaaa

SEQ ID NO: 2466 - RNA, 17 nt, Mus musculus
aaaacuguaaguacgcu

SEQ ID NO: 2467 - RNA, 17 nt, Mus musculus
cuguaaguacgcugguc

SEQ ID NO: 2468 - RNA, 17 nt, Mus musculus
acgcuggucauccaagc

SEQ ID NO: 2469 - RNA, 17 nt, Mus musculus
cuggucauccaagcugc

SEQ ID NO: 2470 - RNA, 17 nt, Mus musculus
caacgugucagcguugu

SEQ ID NO: 2471 - RNA, 17 nt, Mus musculus
gucagcguuguacaaau

SEQ ID NO: 2472 - RNA, 17 nt, Mus musculus
agcguuguacaaaugug

SEQ ID NO: 2473 - RNA, 17 nt, Mus musculus
gaagccaucaacaaagc

SEQ ID NO: 2474 - RNA, 17 nt, Mus musculus
gagagggucaucuccuu

SEQ ID NO: 2475 - RNA, 17 nt, Mus musculus
agggucaucuccuucca

SEQ ID NO: 2476 - RNA, 17 nt, Mus musculus
ggucaucuccuuccaug

SEQ ID NO: 2477 - RNA, 17 nt, Mus musculus
caucuccuuccauguga

SEQ ID NO: 2478 - RNA, 17 nt, Mus musculus
aucuccuuccaugugau

SEQ ID NO: 2479 - RNA, 17 nt, Mus musculus
caugugaucaggggucc

SEQ ID NO: 2480 - RNA, 17 nt, Mus musculus
ucagggguccugaaauu

SEQ ID NO: 2481 - RNA, 17 nt, Mus musculus
ccugaaauuacugugca

SEQ ID NO: 2482 - RNA, 17 nt, Mus musculus
cugaaauuacugugcaa

SEQ ID NO: 2483 - RNA, 17 nt, Mus musculus
gagugugucccuguugu

SEQ ID NO: 2484 - RNA, 17 nt, Mus musculus
gucccuguugugcacug

SEQ ID NO: 2485 - RNA, 17 nt, Mus musculus
acagaaauacguuugag

SEQ ID NO: 2486 - RNA, 17 nt, Mus musculus
aaauacguuugagaacc

SEQ ID NO: 2487 - RNA, 17 nt, Mus musculus
aauacguuugagaaccu

SEQ ID NO: 2488 - RNA, 17 nt, Mus musculus
gagaaccucacguggua

SEQ ID NO: 2489 - RNA, 17 nt, Mus musculus
cacgugguacaagcuug

SEQ ID NO: 2490 - RNA, 17 nt, Mus musculus
uacaagcuuggcucaca

SEQ ID NO: 2491 - RNA, 17 nt, Mus musculus
gcuuggcucacaggcaa

SEQ ID NO: 2492 - RNA, 17 nt, Mus musculus
ggcaacaucgguccaca

SEQ ID NO: 2493 - RNA, 17 nt, Mus musculus
acaucgguccacauggg

SEQ ID NO: 2494 - RNA, 17 nt, Mus musculus
gggcgaaucacucacac

SEQ ID NO: 2495 - RNA, 17 nt, Mus musculus
gaaucacucacaccagu

SEQ ID NO: 2496 - RNA, 17 nt, Mus musculus
acaccaguuugcaagaa

SEQ ID NO: 2497 - RNA, 17 nt, Mus musculus
caccaguuugcaagaac

SEQ ID NO: 2498 - RNA, 17 nt, Mus musculus
caagaacuuggaugcuc

SEQ ID NO: 2499 - RNA, 17 nt, Mus musculus
uggaugcucuuuggaaa

SEQ ID NO: 2500 - RNA, 17 nt, Mus musculus
gaugcucuuuggaaacu

SEQ ID NO: 2501 - RNA, 17 nt, Mus musculus
augcucuuuggaaacug

SEQ ID NO: 2502 - RNA, 17 nt, Mus musculus
caccauguuuucuaaca

SEQ ID NO: 2503 - RNA, 17 nt, Mus musculus
accauguuuucuaacag

SEQ ID NO: 2504 - RNA, 17 nt, Mus musculus
ccauguuuucuaacagc

SEQ ID NO: 2505 - RNA, 17 nt, Mus musculus
cauguuuucuaacagca

SEQ ID NO: 2506 - RNA, 17 nt, Mus musculus
uguuuucuaacagcaca

SEQ ID NO: 2507 - RNA, 17 nt, Mus musculus
aaugacaucuugauugu

SEQ ID NO: 2508 - RNA, 17 nt, Mus musculus
ugacaucuugauugugg

SEQ ID NO: 2509 - RNA, 17 nt, Mus musculus
aucuugauuguggcauu

SEQ ID NO: 2510 - RNA, 17 nt, Mus musculus
uguggcauuucagaaug

SEQ ID NO: 2511 - RNA, 17 nt, Mus musculus
guggcauuucagaaugc

SEQ ID NO: 2512 - RNA, 17 nt, Mus musculus
uggcauuucagaaugcc

SEQ ID NO: 2513 - RNA, 17 nt, Mus musculus
gaaugccucucugcagg

SEQ ID NO: 2514 - RNA, 17 nt, Mus musculus
augccucucugcaggac

SEQ ID NO: 2515 - RNA, 17 nt, Mus musculus
aggcgacuauguuugcu

SEQ ID NO: 2516 - RNA, 17 nt, Mus musculus
gacuauguuugcucugc

SEQ ID NO: 2517 - RNA, 17 nt, Mus musculus
acuauguuugcucugcu

SEQ ID NO: 2518 - RNA, 17 nt, Mus musculus
uguuugcucugcucaag

SEQ ID NO: 2519 - RNA, 17 nt, Mus musculus
gcucugcucaagauaag

SEQ ID NO: 2520 - RNA, 17 nt, Mus musculus
cucaagauaagaagacc

SEQ ID NO: 2521 - RNA, 17 nt, Mus musculus
aaagacauugccugguc

SEQ ID NO: 2522 - RNA, 17 nt, Mus musculus
ugccuggucaaacagcu

SEQ ID NO: 2523 - RNA, 17 nt, Mus musculus
aaacagcucaucauccu

SEQ ID NO: 2524 - RNA, 17 nt, Mus musculus
cagcucaucauccuaga

SEQ ID NO: 2525 - RNA, 17 nt, Mus musculus
cucaucauccuagagcg

SEQ ID NO: 2526 - RNA, 17 nt, Mus musculus
aucauccuagagcgcau

SEQ ID NO: 2527 - RNA, 17 nt, Mus musculus
cccaugaucaccggaaa

SEQ ID NO: 2528 - RNA, 17 nt, Mus musculus
ccggaaaucuggagaau

SEQ ID NO: 2529 - RNA, 17 nt, Mus musculus
uggagaaucagacaaca

SEQ ID NO: 2530 - RNA, 17 nt, Mus musculus
acaaccauuggcgagac

SEQ ID NO: 2531 - RNA, 17 nt, Mus musculus
gagaccauugaagugac

SEQ ID NO: 2532 - RNA, 17 nt, Mus musculus
aagugacuugcccagca

SEQ ID NO: 2533 - RNA, 17 nt, Mus musculus
cccagcaucuggaaauc

SEQ ID NO: 2534 - RNA, 17 nt, Mus musculus
cuggaaauccuacccca

SEQ ID NO: 2535 - RNA, 17 nt, Mus musculus
gaaauccuaccccacac

SEQ ID NO: 2536 - RNA, 17 nt, Mus musculus
ccacacauuacaugguu

SEQ ID NO: 2537 - RNA, 17 nt, Mus musculus
cacacauuacaugguuc

SEQ ID NO: 2538 - RNA, 17 nt, Mus musculus
uacaugguucaaagaca

SEQ ID NO: 2539 - RNA, 17 nt, Mus musculus
acaugguucaaagacaa

SEQ ID NO: 2540 - RNA, 17 nt, Mus musculus
acccugguagaagauuc

SEQ ID NO: 2541 - RNA, 17 nt, Mus musculus
uagaagauucaggcauu

SEQ ID NO: 2542 - RNA, 17 nt, Mus musculus
agaagauucaggcauug

SEQ ID NO: 2543 - RNA, 17 nt, Mus musculus
ucaggcauuguacugag

SEQ ID NO: 2544 - RNA, 17 nt, Mus musculus
ggcauuguacugagaga

SEQ ID NO: 2545 - RNA, 17 nt, Mus musculus
accugacuauccgcagg

SEQ ID NO: 2546 - RNA, 17 nt, Mus musculus
cugacuauccgcagggu

SEQ ID NO: 2547 - RNA, 17 nt, Mus musculus
ggaggccucuacaccug

SEQ ID NO: 2548 - RNA, 17 nt, Mus musculus
ugcaauguccuuggcug

SEQ ID NO: 2549 - RNA, 17 nt, Mus musculus
aauguccuuggcugugc

SEQ ID NO: 2550 - RNA, 17 nt, Mus musculus
gagacgcucuucauaau

SEQ ID NO: 2551 - RNA, 17 nt, Mus musculus
gacgcucuucauaauag

SEQ ID NO: 2552 - RNA, 17 nt, Mus musculus
acgcucuucauaauaga

SEQ ID NO: 2553 - RNA, 17 nt, Mus musculus
cucuucauaauagaagg

SEQ ID NO: 2554 - RNA, 17 nt, Mus musculus
gaccaacuuggaaguca

SEQ ID NO: 2555 - RNA, 17 nt, Mus musculus
uuggaagucauuauccu

SEQ ID NO: 2556 - RNA, 17 nt, Mus musculus
gaagucauuauccucgu

SEQ ID NO: 2557 - RNA, 17 nt, Mus musculus
aagucauuauccucguc

SEQ ID NO: 2558 - RNA, 17 nt, Mus musculus
gucauuauccucgucgg

SEQ ID NO: 2559 - RNA, 17 nt, Mus musculus
auuauccucgucggcac

SEQ ID NO: 2560 - RNA, 17 nt, Mus musculus
auccucgucggcacugc

SEQ ID NO: 2561 - RNA, 17 nt, Mus musculus
gcagugauugccauguu

SEQ ID NO: 2562 - RNA, 17 nt, Mus musculus
cauguucuucuggcucc

SEQ ID NO: 2563 - RNA, 17 nt, Mus musculus
auguucuucuggcuccu

SEQ ID NO: 2564 - RNA, 17 nt, Mus musculus
uucuggcuccuucuugu

SEQ ID NO: 2565 - RNA, 17 nt, Mus musculus
uggcuccuucuugucau

SEQ ID NO: 2566 - RNA, 17 nt, Mus musculus
ggcuccuucuugucauu

SEQ ID NO: 2567 - RNA, 17 nt, Mus musculus
cuccuucuugucauugu

SEQ ID NO: 2568 - RNA, 17 nt, Mus musculus
cuucuugucauuguccu

SEQ ID NO: 2569 - RNA, 17 nt, Mus musculus
cuugucauuguccuacg

SEQ ID NO: 2570 - RNA, 17 nt, Mus musculus
gucauuguccuacggac

SEQ ID NO: 2571 - RNA, 17 nt, Mus musculus
auuguccuacggaccgu

SEQ ID NO: 2572 - RNA, 17 nt, Mus musculus
cggaccguuaagcgggc

SEQ ID NO: 2573 - RNA, 17 nt, Mus musculus
gacaggcuacuugucua

SEQ ID NO: 2574 - RNA, 17 nt, Mus musculus
aggcuacuugucuauug

SEQ ID NO: 2575 - RNA, 17 nt, Mus musculus
cuacuugucuauuguca

SEQ ID NO: 2576 - RNA, 17 nt, Mus musculus
acuugucuauugucaug

SEQ ID NO: 2577 - RNA, 17 nt, Mus musculus
uugucuauugucaugga

SEQ ID NO: 2578 - RNA, 17 nt, Mus musculus
ucuauugucauggaucc

SEQ ID NO: 2579 - RNA, 17 nt, Mus musculus
agaugaauugcccuugg

SEQ ID NO: 2580 - RNA, 17 nt, Mus musculus
auugcccuuggaugagc

SEQ ID NO: 2581 - RNA, 17 nt, Mus musculus
ugaacgcuugccuuaug

SEQ ID NO: 2582 - RNA, 17 nt, Mus musculus
gcuugccuuaugaugcc

SEQ ID NO: 2583 - RNA, 17 nt, Mus musculus
cuugccuuaugaugcca

SEQ ID NO: 2584 - RNA, 17 nt, Mus musculus
gugggaauuccccaggg

SEQ ID NO: 2585 - RNA, 17 nt, Mus musculus
ugggaauuccccaggga

SEQ ID NO: 2586 - RNA, 17 nt, Mus musculus
cugaaacuaggaaaacc

SEQ ID NO: 2587 - RNA, 17 nt, Mus musculus
gaaaaccucuuggccgc

SEQ ID NO: 2588 - RNA, 17 nt, Mus musculus
aaaccucuuggccgcgg

SEQ ID NO: 2589 - RNA, 17 nt, Mus musculus
cggugccuucggccaag

SEQ ID NO: 2590 - RNA, 17 nt, Mus musculus
ggugccuucggccaagu

SEQ ID NO: 2591 - RNA, 17 nt, Mus musculus
caagugauugaggcaga

SEQ ID NO: 2592 - RNA, 17 nt, Mus musculus
cagacgcuuuuggaauu

SEQ ID NO: 2593 - RNA, 17 nt, Mus musculus
agacgcuuuuggaauug

SEQ ID NO: 2594 - RNA, 17 nt, Mus musculus
gacgcuuuuggaauuga

SEQ ID NO: 2595 - RNA, 17 nt, Mus musculus
cagcgacuugcaaaaca

SEQ ID NO: 2596 - RNA, 17 nt, Mus musculus
aaaacaguagccgucaa

SEQ ID NO: 2597 - RNA, 17 nt, Mus musculus
guagccgucaagauguu

SEQ ID NO: 2598 - RNA, 17 nt, Mus musculus
caagauguugaaagaag

SEQ ID NO: 2599 - RNA, 17 nt, Mus musculus
gcgagcaucgagcccuc

SEQ ID NO: 2600 - RNA, 17 nt, Mus musculus
cgagcccucaugucuga

SEQ ID NO: 2601 - RNA, 17 nt, Mus musculus
ccucaugucugaacuca

SEQ ID NO: 2602 - RNA, 17 nt, Mus musculus
cucaagauccucaucca

SEQ ID NO: 2603 - RNA, 17 nt, Mus musculus
aagauccucauccacau

SEQ ID NO: 2604 - RNA, 17 nt, Mus musculus
auccucauccacauugg

SEQ ID NO: 2605 - RNA, 17 nt, Mus musculus
auccacauuggucacca

SEQ ID NO: 2606 - RNA, 17 nt, Mus musculus
acauuggucaccaucuc

SEQ ID NO: 2607 - RNA, 17 nt, Mus musculus
gugaaccuccuaggcgc

SEQ ID NO: 2608 - RNA, 17 nt, Mus musculus
aaccuccuaggcgccug

SEQ ID NO: 2609 - RNA, 17 nt, Mus musculus
gagggccucucauggug

SEQ ID NO: 2610 - RNA, 17 nt, Mus musculus
gggccucucauggugau

SEQ ID NO: 2611 - RNA, 17 nt, Mus musculus
uguggaauucugcaagu

SEQ ID NO: 2612 - RNA, 17 nt, Mus musculus
guggaauucugcaaguu

SEQ ID NO: 2613 - RNA, 17 nt, Mus musculus
cugcaaguuuggaaacc

SEQ ID NO: 2614 - RNA, 17 nt, Mus musculus
ugcaaguuuggaaaccu

SEQ ID NO: 2615 - RNA, 17 nt, Mus musculus
ggaaaccuaucaacuua

SEQ ID NO: 2616 - RNA, 17 nt, Mus musculus
aaaccuaucaacuuacu

SEQ ID NO: 2617 - RNA, 17 nt, Mus musculus
uaucaacuuacuuacgg

SEQ ID NO: 2618 - RNA, 17 nt, Mus musculus
aucaacuuacuuacggg

SEQ ID NO: 2619 - RNA, 17 nt, Mus musculus
aacuuacuuacggggca

SEQ ID NO: 2620 - RNA, 17 nt, Mus musculus
acuuacuuacggggcaa

SEQ ID NO: 2621 - RNA, 17 nt, Mus musculus
aaaugaauuuguucccu

SEQ ID NO: 2622 - RNA, 17 nt, Mus musculus
aaugaauuuguucccua

SEQ ID NO: 2623 - RNA, 17 nt, Mus musculus
gaauuuguucccuauaa

SEQ ID NO: 2624 - RNA, 17 nt, Mus musculus
aauuuguucccuauaag

SEQ ID NO: 2625 - RNA, 17 nt, Mus musculus
uguucccuauaagagca

SEQ ID NO: 2626 - RNA, 17 nt, Mus musculus
uucccuauaagagcaaa

SEQ ID NO: 2627 - RNA, 17 nt, Mus musculus
ggcacgcuuccgccagg

SEQ ID NO: 2628 - RNA, 17 nt, Mus musculus
gcacgcuuccgccaggg

SEQ ID NO: 2629 - RNA, 17 nt, Mus musculus
caaggacuacguugggg

SEQ ID NO: 2630 - RNA, 17 nt, Mus musculus
gacuacguuggggagcu

SEQ ID NO: 2631 - RNA, 17 nt, Mus musculus
ggggagcucuccgugga

SEQ ID NO: 2632 - RNA, 17 nt, Mus musculus
ggagcucuccguggauc

SEQ ID NO: 2633 - RNA, 17 nt, Mus musculus
ccguggaucugaaaaga

SEQ ID NO: 2634 - RNA, 17 nt, Mus musculus
aagacgcuuggacagca

SEQ ID NO: 2635 - RNA, 17 nt, Mus musculus
gacagcaucaccagcag

SEQ ID NO: 2636 - RNA, 17 nt, Mus musculus
ccagagcucugccagcu

SEQ ID NO: 2637 - RNA, 17 nt, Mus musculus
ugccagcucaggcuuug

SEQ ID NO: 2638 - RNA, 17 nt, Mus musculus
cucaggcuuuguugagg

SEQ ID NO: 2639 - RNA, 17 nt, Mus musculus
ucaggcuuuguugagga

SEQ ID NO: 2640 - RNA, 17 nt, Mus musculus
ggcuuuguugaggagaa

SEQ ID NO: 2641 - RNA, 17 nt, Mus musculus
ggagaaaucgcucagug

SEQ ID NO: 2642 - RNA, 17 nt, Mus musculus
aaaucgcucagugaugu

SEQ ID NO: 2643 - RNA, 17 nt, Mus musculus
agugauguagaggaaga

SEQ ID NO: 2644 - RNA, 17 nt, Mus musculus
aagaagcuucugaagaa

SEQ ID NO: 2645 - RNA, 17 nt, Mus musculus
agaagcuucugaagaac

SEQ ID NO: 2646 - RNA, 17 nt, Mus musculus
agaacuguacaaggacu

SEQ ID NO: 2647 - RNA, 17 nt, Mus musculus
caaggacuuccugaccu

SEQ ID NO: 2648 - RNA, 17 nt, Mus musculus
ggaguucuuggcaucaa

SEQ ID NO: 2649 - RNA, 17 nt, Mus musculus
cuuggcaucaaggaagu

SEQ ID NO: 2650 - RNA, 17 nt, Mus musculus
ggaaguguauccacagg

SEQ ID NO: 2651 - RNA, 17 nt, Mus musculus
cgaaacauucuccuauc

SEQ ID NO: 2652 - RNA, 17 nt, Mus musculus
gaaacauucuccuaucg

SEQ ID NO: 2653 - RNA, 17 nt, Mus musculus
aacauucuccuaucgga

SEQ ID NO: 2654 - RNA, 17 nt, Mus musculus
auucuccuaucggagaa

SEQ ID NO: 2655 - RNA, 17 nt, Mus musculus
ucuccuaucggagaaga

SEQ ID NO: 2656 - RNA, 17 nt, Mus musculus
aaugugguuaagaucug

SEQ ID NO: 2657 - RNA, 17 nt, Mus musculus
augugguuaagaucugu

SEQ ID NO: 2658 - RNA, 17 nt, Mus musculus
guuaagaucugugacuu

SEQ ID NO: 2659 - RNA, 17 nt, Mus musculus
cugugacuucggcuugg

SEQ ID NO: 2660 - RNA, 17 nt, Mus musculus
ugugacuucggcuuggc

SEQ ID NO: 2661 - RNA, 17 nt, Mus musculus
cuucggcuuggcccggg

SEQ ID NO: 2662 - RNA, 17 nt, Mus musculus
cgggacauuuauaaaga

SEQ ID NO: 2663 - RNA, 17 nt, Mus musculus
gggacauuuauaaagac

SEQ ID NO: 2664 - RNA, 17 nt, Mus musculus
ggacauuuauaaagacc

SEQ ID NO: 2665 - RNA, 17 nt, Mus musculus
acauuuauaaagacccg

SEQ ID NO: 2666 - RNA, 17 nt, Mus musculus
acccggauuaugucaga

SEQ ID NO: 2667 - RNA, 17 nt, Mus musculus
cccggauuaugucagaa

SEQ ID NO: 2668 - RNA, 17 nt, Mus musculus
gcccgacucccuuugaa

SEQ ID NO: 2669 - RNA, 17 nt, Mus musculus
gacucccuuugaagugg

SEQ ID NO: 2670 - RNA, 17 nt, Mus musculus
acucccuuugaagugga

SEQ ID NO: 2671 - RNA, 17 nt, Mus musculus
gaaaccauuuuugacag

SEQ ID NO: 2672 - RNA, 17 nt, Mus musculus
aaaccauuuuugacaga

SEQ ID NO: 2673 - RNA, 17 nt, Mus musculus
aaccauuuuugacagag

SEQ ID NO: 2674 - RNA, 17 nt, Mus musculus
accauuuuugacagagu

SEQ ID NO: 2675 - RNA, 17 nt, Mus musculus
gacagaguauacacaau

SEQ ID NO: 2676 - RNA, 17 nt, Mus musculus
cagaguauacacaauuc

SEQ ID NO: 2677 - RNA, 17 nt, Mus musculus
uacacaauucagagcga

SEQ ID NO: 2678 - RNA, 17 nt, Mus musculus
acacaauucagagcgau

SEQ ID NO: 2679 - RNA, 17 nt, Mus musculus
uguguggucuuucggug

SEQ ID NO: 2680 - RNA, 17 nt, Mus musculus
uguggucuuucggugug

SEQ ID NO: 2681 - RNA, 17 nt, Mus musculus
guggucuuucggugugu

SEQ ID NO: 2682 - RNA, 17 nt, Mus musculus
uggucuuucgguguguu

SEQ ID NO: 2683 - RNA, 17 nt, Mus musculus
cgguguguugcucuggg

SEQ ID NO: 2684 - RNA, 17 nt, Mus musculus
guguugcucugggaaau

SEQ ID NO: 2685 - RNA, 17 nt, Mus musculus
auuuuccuuaggugccu

SEQ ID NO: 2686 - RNA, 17 nt, Mus musculus
uuuuccuuaggugccuc

SEQ ID NO: 2687 - RNA, 17 nt, Mus musculus
aggugccuccccauacc

SEQ ID NO: 2688 - RNA, 17 nt, Mus musculus
cuccccauacccugggg

SEQ ID NO: 2689 - RNA, 17 nt, Mus musculus
ccuggggucaagauuga

SEQ ID NO: 2690 - RNA, 17 nt, Mus musculus
gucaagauugaugaaga

SEQ ID NO: 2691 - RNA, 17 nt, Mus musculus
ugaagaauuuuguagga

SEQ ID NO: 2692 - RNA, 17 nt, Mus musculus
gaagaauuuuguaggag

SEQ ID NO: 2693 - RNA, 17 nt, Mus musculus
aagaauuuuguaggaga

SEQ ID NO: 2694 - RNA, 17 nt, Mus musculus
aauuuuguaggagauug

SEQ ID NO: 2695 - RNA, 17 nt, Mus musculus
uaggagauugaaagaag

SEQ ID NO: 2696 - RNA, 17 nt, Mus musculus
aaggaacuagaaugcgg

SEQ ID NO: 2697 - RNA, 17 nt, Mus musculus
ugcgggcuccugacuac

SEQ ID NO: 2698 - RNA, 17 nt, Mus musculus
uccugacuacacuaccc

SEQ ID NO: 2699 - RNA, 17 nt, Mus musculus
acuacacuaccccagaa

SEQ ID NO: 2700 - RNA, 17 nt, Mus musculus
gagacccucguuuucag

SEQ ID NO: 2701 - RNA, 17 nt, Mus musculus
acccucguuuucagagu

SEQ ID NO: 2702 - RNA, 17 nt, Mus musculus
cccucguuuucagaguu

SEQ ID NO: 2703 - RNA, 17 nt, Mus musculus
ccucguuuucagaguug

SEQ ID NO: 2704 - RNA, 17 nt, Mus musculus
cucguuuucagaguugg

SEQ ID NO: 2705 - RNA, 17 nt, Mus musculus
uucagaguugguggagc

SEQ ID NO: 2706 - RNA, 17 nt, Mus musculus
uggagcauuugggaaac

SEQ ID NO: 2707 - RNA, 17 nt, Mus musculus
ggagcauuugggaaacc

SEQ ID NO: 2708 - RNA, 17 nt, Mus musculus
ggaaaccuccugcaagc

SEQ ID NO: 2709 - RNA, 17 nt, Mus musculus
caaagacuauauuguuc

SEQ ID NO: 2710 - RNA, 17 nt, Mus musculus
aagacuauauuguucuu

SEQ ID NO: 2711 - RNA, 17 nt, Mus musculus
gacuauauuguucuucc

SEQ ID NO: 2712 - RNA, 17 nt, Mus musculus
uauauuguucuuccaau

SEQ ID NO: 2713 - RNA, 17 nt, Mus musculus
auauuguucuuccaaug

SEQ ID NO: 2714 - RNA, 17 nt, Mus musculus
auuguucuuccaauguc

SEQ ID NO: 2715 - RNA, 17 nt, Mus musculus
uuguucuuccaauguca

SEQ ID NO: 2716 - RNA, 17 nt, Mus musculus
uccaaugucagagacac

SEQ ID NO: 2717 - RNA, 17 nt, Mus musculus
ucuggacucucccugcc

SEQ ID NO: 2718 - RNA, 17 nt, Mus musculus
uggacucucccugccua

SEQ ID NO: 2719 - RNA, 17 nt, Mus musculus
cccugccuaccucaccu

SEQ ID NO: 2720 - RNA, 17 nt, Mus musculus
uuuccuguauggaggaa

SEQ ID NO: 2721 - RNA, 17 nt, Mus musculus
gcaggaaucagucauua

SEQ ID NO: 2722 - RNA, 17 nt, Mus musculus
gaaucagucauuaucuc

SEQ ID NO: 2723 - RNA, 17 nt, Mus musculus
ucagucauuaucuccag

SEQ ID NO: 2724 - RNA, 17 nt, Mus musculus
cagucauuaucuccaga

SEQ ID NO: 2725 - RNA, 17 nt, Mus musculus
gucauuaucuccagaac

SEQ ID NO: 2726 - RNA, 17 nt, Mus musculus
cauuaucuccagaacag

SEQ ID NO: 2727 - RNA, 17 nt, Mus musculus
uugaagauaucccauug

SEQ ID NO: 2728 - RNA, 17 nt, Mus musculus
gaagauaucccauugga

SEQ ID NO: 2729 - RNA, 17 nt, Mus musculus
uaucccauuggaggaac

SEQ ID NO: 2730 - RNA, 17 nt, Mus musculus
ccagaaguaaaagugau

SEQ ID NO: 2731 - RNA, 17 nt, Mus musculus
aaagugaucccagauga

SEQ ID NO: 2732 - RNA, 17 nt, Mus musculus
gggaugguccuugcauc

SEQ ID NO: 2733 - RNA, 17 nt, Mus musculus
augguccuugcaucaga

SEQ ID NO: 2734 - RNA, 17 nt, Mus musculus
ccuugcaucagaagagc

SEQ ID NO: 2735 - RNA, 17 nt, Mus musculus
ugaaaacucuggaagac

SEQ ID NO: 2736 - RNA, 17 nt, Mus musculus
gaacaaauuaucuccau

SEQ ID NO: 2737 - RNA, 17 nt, Mus musculus
aacaaauuaucuccauc

SEQ ID NO: 2738 - RNA, 17 nt, Mus musculus
ugcccaguaaaagcagg

SEQ ID NO: 2739 - RNA, 17 nt, Mus musculus
cagggagucuguggccu

SEQ ID NO: 2740 - RNA, 17 nt, Mus musculus
uguggccucggaaggcu

SEQ ID NO: 2741 - RNA, 17 nt, Mus musculus
ggaaggcuccaaccaga

SEQ ID NO: 2742 - RNA, 17 nt, Mus musculus
caguggcuaccagucug

SEQ ID NO: 2743 - RNA, 17 nt, Mus musculus
cuaccagucuggguauc

SEQ ID NO: 2744 - RNA, 17 nt, Mus musculus
gucuggguaucacucag

SEQ ID NO: 2745 - RNA, 17 nt, Mus musculus
cuggguaucacucagau

SEQ ID NO: 2746 - RNA, 17 nt, Mus musculus
guaucacucagaugaca

SEQ ID NO: 2747 - RNA, 17 nt, Mus musculus
caccguguacuccagcg

SEQ ID NO: 2748 - RNA, 17 nt, Mus musculus
cguguacuccagcgacg

SEQ ID NO: 2749 - RNA, 17 nt, Mus musculus
gcaggacuuuuaaagau

SEQ ID NO: 2750 - RNA, 17 nt, Mus musculus
caggacuuuuaaagaug

SEQ ID NO: 2751 - RNA, 17 nt, Mus musculus
aggacuuuuaaagaugg

SEQ ID NO: 2752 - RNA, 17 nt, Mus musculus
ggacuuuuaaagauggu

SEQ ID NO: 2753 - RNA, 17 nt, Mus musculus
gcugcaguucacgcuga

SEQ ID NO: 2754 - RNA, 17 nt, Mus musculus
cugcaguucacgcugac

SEQ ID NO: 2755 - RNA, 17 nt, Mus musculus
cgcugacucagggacca

SEQ ID NO: 2756 - RNA, 17 nt, Mus musculus
cugcagcucaccuccug

SEQ ID NO: 2757 - RNA, 17 nt, Mus musculus
gcucaccuccuguuuaa

SEQ ID NO: 2758 - RNA, 17 nt, Mus musculus
ccuccuguuuaaaugga

SEQ ID NO: 2759 - RNA, 17 nt, Mus musculus
cuccuguuuaaauggaa

SEQ ID NO: 2760 - RNA, 17 nt, Mus musculus
uccuguuuaaauggaag

SEQ ID NO: 2761 - RNA, 17 nt, Mus musculus
gaagugguccugucccg

SEQ ID NO: 2762 - RNA, 17 nt, Mus musculus
gguccugucccggcucc

SEQ ID NO: 2763 - RNA, 17 nt, Mus musculus
ucccggcuccgccccca

SEQ ID NO: 2764 - RNA, 17 nt, Mus musculus
ccccaacuccuggaaau

SEQ ID NO: 2765 - RNA, 17 nt, Mus musculus
cuggaaaucacgagaga

SEQ ID NO: 2766 - RNA, 17 nt, Mus musculus
gugcugcuuagauuuuc

SEQ ID NO: 2767 - RNA, 17 nt, Mus musculus
ugcugcuuagauuuuca

SEQ ID NO: 2768 - RNA, 17 nt, Mus musculus
gcuuagauuuucaagug

SEQ ID NO: 2769 - RNA, 17 nt, Mus musculus
cuuagauuuucaagugu

SEQ ID NO: 2770 - RNA, 17 nt, Mus musculus
uuagauuuucaaguguu

SEQ ID NO: 2771 - RNA, 17 nt, Mus musculus
uagauuuucaaguguug

SEQ ID NO: 2772 - RNA, 17 nt, Mus musculus
ucaaguguuguucuuuc

SEQ ID NO: 2773 - RNA, 17 nt, Mus musculus
guuguucuuuccaccac

SEQ ID NO: 2774 - RNA, 17 nt, Mus musculus
uuguucuuuccaccacc

SEQ ID NO: 2775 - RNA, 17 nt, Mus musculus
uguucuuuccaccaccc

SEQ ID NO: 2776 - RNA, 17 nt, Mus musculus
ccggaaguagccacauu

SEQ ID NO: 2777 - RNA, 17 nt, Mus musculus
agccacauuugauuuuc

SEQ ID NO: 2778 - RNA, 17 nt, Mus musculus
gccacauuugauuuuca

SEQ ID NO: 2779 - RNA, 17 nt, Mus musculus
cauuugauuuucauuuu

SEQ ID NO: 2780 - RNA, 17 nt, Mus musculus
auuugauuuucauuuuu

SEQ ID NO: 2781 - RNA, 17 nt, Mus musculus
uuugauuuucauuuuug

SEQ ID NO: 2782 - RNA, 17 nt, Mus musculus
uugauuuucauuuuugg

SEQ ID NO: 2783 - RNA, 17 nt, Mus musculus
auuuucauuuuuggagg

SEQ ID NO: 2784 - RNA, 17 nt, Mus musculus
uuuucauuuuuggagga

SEQ ID NO: 2785 - RNA, 17 nt, Mus musculus
uuucauuuuuggaggag

SEQ ID NO: 2786 - RNA, 17 nt, Mus musculus
uucauuuuuggaggagg

SEQ ID NO: 2787 - RNA, 17 nt, Mus musculus
agggaccucagacugca

SEQ ID NO: 2788 - RNA, 17 nt, Mus musculus
aaggagcuuguccucag

SEQ ID NO: 2789 - RNA, 17 nt, Mus musculus
gagcuuguccucagggc

SEQ ID NO: 2790 - RNA, 17 nt, Mus musculus
cuuguccucagggcauu

SEQ ID NO: 2791 - RNA, 17 nt, Mus musculus
cagggcauuuccagaga

SEQ ID NO: 2792 - RNA, 17 nt, Mus musculus
agggcauuuccagagaa

SEQ ID NO: 2793 - RNA, 17 nt, Mus musculus
gggcauuuccagagaag

SEQ ID NO: 2794 - RNA, 17 nt, Mus musculus
gaauguguugacucuac

SEQ ID NO: 2795 - RNA, 17 nt, Mus musculus
uguugacucuacucucu

SEQ ID NO: 2796 - RNA, 17 nt, Mus musculus
uugacucuacucucuuu

SEQ ID NO: 2797 - RNA, 17 nt, Mus musculus
acucuacucucuuuucc

SEQ ID NO: 2798 - RNA, 17 nt, Mus musculus
ucuacucucuuuuccau

SEQ ID NO: 2799 - RNA, 17 nt, Mus musculus
uacucucuuuuccauuc

SEQ ID NO: 2800 - RNA, 17 nt, Mus musculus
acucucuuuuccauuca

SEQ ID NO: 2801 - RNA, 17 nt, Mus musculus
cucucuuuuccauucau

SEQ ID NO: 2802 - RNA, 17 nt, Mus musculus
ucucuuuuccauucauu

SEQ ID NO: 2803 - RNA, 17 nt, Mus musculus
uuuuccauucauuuaaa

SEQ ID NO: 2804 - RNA, 17 nt, Mus musculus
uuuccauucauuuaaaa

SEQ ID NO: 2805 - RNA, 17 nt, Mus musculus
ccauucauuuaaaaguc

SEQ ID NO: 2806 - RNA, 17 nt, Mus musculus
cauucauuuaaaagucc

SEQ ID NO: 2807 - RNA, 17 nt, Mus musculus
auucauuuaaaaguccu

SEQ ID NO: 2808 - RNA, 17 nt, Mus musculus
uuaaaaguccuauauaa

SEQ ID NO: 2809 - RNA, 17 nt, Mus musculus
aaaguccuauauaaugu

SEQ ID NO: 2810 - RNA, 17 nt, Mus musculus
aguccuauauaaugugc

SEQ ID NO: 2811 - RNA, 17 nt, Mus musculus
uccuauauaaugugccc

SEQ ID NO: 2812 - RNA, 17 nt, Mus musculus
gcuguggucucacuacc

SEQ ID NO: 2813 - RNA, 17 nt, Mus musculus
uguggucucacuaccag

SEQ ID NO: 2814 - RNA, 17 nt, Mus musculus
gucucacuaccaguuaa

SEQ ID NO: 2815 - RNA, 17 nt, Mus musculus
cuaccaguuaaagcaaa

SEQ ID NO: 2816 - RNA, 17 nt, Mus musculus
uaccaguuaaagcaaaa

SEQ ID NO: 2817 - RNA, 17 nt, Mus musculus
aaaagacuuucaaacac

SEQ ID NO: 2818 - RNA, 17 nt, Mus musculus
aaagacuuucaaacacg

SEQ ID NO: 2819 - RNA, 17 nt, Mus musculus
aagacuuucaaacacgu

SEQ ID NO: 2820 - RNA, 17 nt, Mus musculus
cguggacucuguccucc

SEQ ID NO: 2821 - RNA, 17 nt, Mus musculus
gacucuguccuccaaga

SEQ ID NO: 2822 - RNA, 17 nt, Mus musculus
ucuguccuccaagaagu

SEQ ID NO: 2823 - RNA, 17 nt, Mus musculus
cggcaccucugugaaac

SEQ ID NO: 2824 - RNA, 17 nt, Mus musculus
aacuggaucgaaugggc

SEQ ID NO: 2825 - RNA, 17 nt, Mus musculus
gcaaugcuuuguguguu

SEQ ID NO: 2826 - RNA, 17 nt, Mus musculus
caaugcuuuguguguug

SEQ ID NO: 2827 - RNA, 17 nt, Mus musculus
uuguguguugaggaugg

SEQ ID NO: 2828 - RNA, 17 nt, Mus musculus
ugagaugucccagggcc

SEQ ID NO: 2829 - RNA, 17 nt, Mus musculus
ggccgagucugucuacc

SEQ ID NO: 2830 - RNA, 17 nt, Mus musculus
gagucugucuaccuugg

SEQ ID NO: 2831 - RNA, 17 nt, Mus musculus
gucugucuaccuuggag

SEQ ID NO: 2832 - RNA, 17 nt, Mus musculus
gucuaccuuggaggcuu

SEQ ID NO: 2833 - RNA, 17 nt, Mus musculus
uggaggcuuuguggagg

SEQ ID NO: 2834 - RNA, 17 nt, Mus musculus
ggaggcuuuguggagga

SEQ ID NO: 2835 - RNA, 17 nt, Mus musculus
ugcgggcuaugagccaa

SEQ ID NO: 2836 - RNA, 17 nt, Mus musculus
ccaaguguuaagugugg

SEQ ID NO: 2837 - RNA, 17 nt, Mus musculus
caaguguuaaguguggg

SEQ ID NO: 2838 - RNA, 17 nt, Mus musculus
gcgcaagucgcucggag

SEQ ID NO: 2839 - RNA, 17 nt, Mus musculus
aagucgcucggagagcg

SEQ ID NO: 2840 - RNA, 17 nt, Mus musculus
agagcgguuggagccug

SEQ ID NO: 2841 - RNA, 17 nt, Mus musculus
agaugcauugugcuggc

SEQ ID NO: 2842 - RNA, 17 nt, Mus musculus
ugcuggcucugguggag

SEQ ID NO: 2843 - RNA, 17 nt, Mus musculus
ggugggcuuguggccug

SEQ ID NO: 2844 - RNA, 17 nt, Mus musculus
uggccugucaggaaacg

SEQ ID NO: 2845 - RNA, 17 nt, Mus musculus
ggcaggguuugguuuug

SEQ ID NO: 2846 - RNA, 17 nt, Mus musculus
gcaggguuugguuuugg

SEQ ID NO: 2847 - RNA, 17 nt, Mus musculus
gguuugguuuuggaagg

SEQ ID NO: 2848 - RNA, 17 nt, Mus musculus
guuugguuuuggaaggu

SEQ ID NO: 2849 - RNA, 17 nt, Mus musculus
uuugguuuuggaagguu

SEQ ID NO: 2850 - RNA, 17 nt, Mus musculus
uggaagguuugcgugcu

SEQ ID NO: 2851 - RNA, 17 nt, Mus musculus
ggaagguuugcgugcuc

SEQ ID NO: 2852 - RNA, 17 nt, Mus musculus
ugcgugcucuucacagu

SEQ ID NO: 2853 - RNA, 17 nt, Mus musculus
cgugcucuucacagucg

SEQ ID NO: 2854 - RNA, 17 nt, Mus musculus
gugcucuucacagucgg

SEQ ID NO: 2855 - RNA, 17 nt, Mus musculus
uucacagucggguuaca

SEQ ID NO: 2856 - RNA, 17 nt, Mus musculus
agucggguuacaggcga

SEQ ID NO: 2857 - RNA, 17 nt, Mus musculus
gucggguuacaggcgag

SEQ ID NO: 2858 - RNA, 17 nt, Mus musculus
aggcgaguucccugugg

SEQ ID NO: 2859 - RNA, 17 nt, Mus musculus
ggcgaguucccuguggc

SEQ ID NO: 2860 - RNA, 17 nt, Mus musculus
uguggcguuuccuacuc

SEQ ID NO: 2861 - RNA, 17 nt, Mus musculus
guggcguuuccuacucc

SEQ ID NO: 2862 - RNA, 17 nt, Mus musculus
uggcguuuccuacuccu

SEQ ID NO: 2863 - RNA, 17 nt, Mus musculus
cguuuccuacuccuaau

SEQ ID NO: 2864 - RNA, 17 nt, Mus musculus
uuccuacuccuaaugag

SEQ ID NO: 2865 - RNA, 17 nt, Mus musculus
cuacuccuaaugagagu

SEQ ID NO: 2866 - RNA, 17 nt, Mus musculus
augagaguuccuuccgg

SEQ ID NO: 2867 - RNA, 17 nt, Mus musculus
ugagaguuccuuccgga

SEQ ID NO: 2868 - RNA, 17 nt, Mus musculus
gaguuccuuccggacuc

SEQ ID NO: 2869 - RNA, 17 nt, Mus musculus
aguuccuuccggacucu

SEQ ID NO: 2870 - RNA, 17 nt, Mus musculus
uccggacucuuacgugu

SEQ ID NO: 2871 - RNA, 17 nt, Mus musculus
cggacucuuacgugucu

SEQ ID NO: 2872 - RNA, 17 nt, Mus musculus
ggacucuuacgugucuc

SEQ ID NO: 2873 - RNA, 17 nt, Mus musculus
uuacgugucuccuggcc

SEQ ID NO: 2874 - RNA, 17 nt, Mus musculus
acgugucuccuggccug

SEQ ID NO: 2875 - RNA, 17 nt, Mus musculus
augcagcuugcuccuuc

SEQ ID NO: 2876 - RNA, 17 nt, Mus musculus
agcuugcuccuuccuca

SEQ ID NO: 2877 - RNA, 17 nt, Mus musculus
uugcuccuuccucaucu

SEQ ID NO: 2878 - RNA, 17 nt, Mus musculus
ugcuccuuccucaucuc

SEQ ID NO: 2879 - RNA, 17 nt, Mus musculus
uccuuccucaucucuca

SEQ ID NO: 2880 - RNA, 17 nt, Mus musculus
uuccucaucucucaggc

SEQ ID NO: 2881 - RNA, 17 nt, Mus musculus
ccucaucucucaggcug

SEQ ID NO: 2882 - RNA, 17 nt, Mus musculus
ucaucucucaggcugug

SEQ ID NO: 2883 - RNA, 17 nt, Mus musculus
cugugccuuaauucaga

SEQ ID NO: 2884 - RNA, 17 nt, Mus musculus
ugugccuuaauucagaa

SEQ ID NO: 2885 - RNA, 17 nt, Mus musculus
gccuuaauucagaacac

SEQ ID NO: 2886 - RNA, 17 nt, Mus musculus
ccuuaauucagaacacc

SEQ ID NO: 2887 - RNA, 17 nt, Mus musculus
aggaacgucggcagagg

SEQ ID NO: 2888 - RNA, 17 nt, Mus musculus
cagaggcuccugacggg

SEQ ID NO: 2889 - RNA, 17 nt, Mus musculus
cgaagaauugugagaac

SEQ ID NO: 2890 - RNA, 17 nt, Mus musculus
cagaaacucaggguuuc

SEQ ID NO: 2891 - RNA, 17 nt, Mus musculus
cucaggguuucugcugg

SEQ ID NO: 2892 - RNA, 17 nt, Mus musculus
ucaggguuucugcuggg

SEQ ID NO: 2893 - RNA, 17 nt, Mus musculus
caggguuucugcugggu

SEQ ID NO: 2894 - RNA, 17 nt, Mus musculus
uggcaggucugaggguu

SEQ ID NO: 2895 - RNA, 17 nt, Mus musculus
cugaggguucucuguca

SEQ ID NO: 2896 - RNA, 17 nt, Mus musculus
ugaggguucucugucaa

SEQ ID NO: 2897 - RNA, 17 nt, Mus musculus
aggguucucugucaagu

SEQ ID NO: 2898 - RNA, 17 nt, Mus musculus
uucucugucaaguggcg

SEQ ID NO: 2899 - RNA, 17 nt, Mus musculus
guggcgguaaaggcuca

SEQ ID NO: 2900 - RNA, 17 nt, Mus musculus
uaaaggcucaggcuggu

SEQ ID NO: 2901 - RNA, 17 nt, Mus musculus
gcugguguucuuccucu

SEQ ID NO: 2902 - RNA, 17 nt, Mus musculus
cugguguucuuccucua

SEQ ID NO: 2903 - RNA, 17 nt, Mus musculus
gguguucuuccucuauc

SEQ ID NO: 2904 - RNA, 17 nt, Mus musculus
guguucuuccucuaucu

SEQ ID NO: 2905 - RNA, 17 nt, Mus musculus
uucuuccucuaucucca

SEQ ID NO: 2906 - RNA, 17 nt, Mus musculus
cuuccucuaucuccacu

SEQ ID NO: 2907 - RNA, 17 nt, Mus musculus
uccucuaucuccacucc

SEQ ID NO: 2908 - RNA, 17 nt, Mus musculus
cucuaucuccacuccug

SEQ ID NO: 2909 - RNA, 17 nt, Mus musculus
ucuccacuccugucagg

SEQ ID NO: 2910 - RNA, 17 nt, Mus musculus
acuccugucaggccccc

SEQ ID NO: 2911 - RNA, 17 nt, Mus musculus
ccccaaguccucaguau

SEQ ID NO: 2912 - RNA, 17 nt, Mus musculus
caaguccucaguauuuu

SEQ ID NO: 2913 - RNA, 17 nt, Mus musculus
uccucaguauuuuagcu

SEQ ID NO: 2914 - RNA, 17 nt, Mus musculus
cucaguauuuuagcuuu

SEQ ID NO: 2915 - RNA, 17 nt, Mus musculus
ucaguauuuuagcuuug

SEQ ID NO: 2916 - RNA, 17 nt, Mus musculus
caguauuuuagcuuugu

SEQ ID NO: 2917 - RNA, 17 nt, Mus musculus
aguauuuuagcuuugug

SEQ ID NO: 2918 - RNA, 17 nt, Mus musculus
uuuuagcuuuguggcuu

SEQ ID NO: 2919 - RNA, 17 nt, Mus musculus
uuuagcuuuguggcuuc

SEQ ID NO: 2920 - RNA, 17 nt, Mus musculus
uuguggcuuccugaugg

SEQ ID NO: 2921 - RNA, 17 nt, Mus musculus
uguggcuuccugauggc

SEQ ID NO: 2922 - RNA, 17 nt, Mus musculus
agaaaaaucuuaauugg

SEQ ID NO: 2923 - RNA, 17 nt, Mus musculus
aaaaaucuuaauugguu

SEQ ID NO: 2924 - RNA, 17 nt, Mus musculus
aaaaucuuaauugguug

SEQ ID NO: 2925 - RNA, 17 nt, Mus musculus
aucuuaauugguugguu

SEQ ID NO: 2926 - RNA, 17 nt, Mus musculus
uaauugguugguuugcu

SEQ ID NO: 2927 - RNA, 17 nt, Mus musculus
ugguugguuugcucucc

SEQ ID NO: 2928 - RNA, 17 nt, Mus musculus
gguugguuugcucucca

SEQ ID NO: 2929 - RNA, 17 nt, Mus musculus
gguuugcucuccagaua

SEQ ID NO: 2930 - RNA, 17 nt, Mus musculus
uuugcucuccagauaau

SEQ ID NO: 2931 - RNA, 17 nt, Mus musculus
cuccagauaaucacuag

SEQ ID NO: 2932 - RNA, 17 nt, Mus musculus
cagauaaucacuagcca

SEQ ID NO: 2933 - RNA, 17 nt, Mus musculus
uaaucacuagccagauu

SEQ ID NO: 2934 - RNA, 17 nt, Mus musculus
agccagauuucgaaauu

SEQ ID NO: 2935 - RNA, 17 nt, Mus musculus
gccagauuucgaaauua

SEQ ID NO: 2936 - RNA, 17 nt, Mus musculus
ccagauuucgaaauuac

SEQ ID NO: 2937 - RNA, 17 nt, Mus musculus
uucgaaauuacuuuuua

SEQ ID NO: 2938 - RNA, 17 nt, Mus musculus
ucgaaauuacuuuuuag

SEQ ID NO: 2939 - RNA, 17 nt, Mus musculus
aaauuacuuuuuagccg

SEQ ID NO: 2940 - RNA, 17 nt, Mus musculus
aauuacuuuuuagccga

SEQ ID NO: 2941 - RNA, 17 nt, Mus musculus
auuacuuuuuagccgag

SEQ ID NO: 2942 - RNA, 17 nt, Mus musculus
uuacuuuuuagccgagg

SEQ ID NO: 2943 - RNA, 17 nt, Mus musculus
uacuuuuuagccgaggu

SEQ ID NO: 2944 - RNA, 17 nt, Mus musculus
gccgagguuaugauaac

SEQ ID NO: 2945 - RNA, 17 nt, Mus musculus
ccgagguuaugauaaca

SEQ ID NO: 2946 - RNA, 17 nt, Mus musculus
guuaugauaacaucuac

SEQ ID NO: 2947 - RNA, 17 nt, Mus musculus
gauaacaucuacuguau

SEQ ID NO: 2948 - RNA, 17 nt, Mus musculus
uaacaucuacuguaucc

SEQ ID NO: 2949 - RNA, 17 nt, Mus musculus
ucuacuguauccuuuag

SEQ ID NO: 2950 - RNA, 17 nt, Mus musculus
uacuguauccuuuagaa

SEQ ID NO: 2951 - RNA, 17 nt, Mus musculus
uguauccuuuagaauuu

SEQ ID NO: 2952 - RNA, 17 nt, Mus musculus
guauccuuuagaauuuu

SEQ ID NO: 2953 - RNA, 17 nt, Mus musculus
uauccuuuagaauuuua

SEQ ID NO: 2954 - RNA, 17 nt, Mus musculus
uuuagaauuuuaaccua

SEQ ID NO: 2955 - RNA, 17 nt, Mus musculus
uuagaauuuuaaccuau

SEQ ID NO: 2956 - RNA, 17 nt, Mus musculus
uagaauuuuaaccuaua

SEQ ID NO: 2957 - RNA, 17 nt, Mus musculus
agaauuuuaaccuauaa

SEQ ID NO: 2958 - RNA, 17 nt, Mus musculus
uuuaaccuauaaaacua

SEQ ID NO: 2959 - RNA, 17 nt, Mus musculus
uaaccuauaaaacuaug

SEQ ID NO: 2960 - RNA, 17 nt, Mus musculus
auaaaacuaugucuacu

SEQ ID NO: 2961 - RNA, 17 nt, Mus musculus
aacuaugucuacugguu

SEQ ID NO: 2962 - RNA, 17 nt, Mus musculus
cuaugucuacugguuuc

SEQ ID NO: 2963 - RNA, 17 nt, Mus musculus
cuacugguuucugccug

SEQ ID NO: 2964 - RNA, 17 nt, Mus musculus
uacugguuucugccugu

SEQ ID NO: 2965 - RNA, 17 nt, Mus musculus
acugguuucugccugug

SEQ ID NO: 2966 - RNA, 18 nt, Mus musculus
gggcccagacuguguccc

SEQ ID NO: 2967 - RNA, 18 nt, Mus musculus
ucccgcagccgggauaac

SEQ ID NO: 2968 - RNA, 18 nt, Mus musculus
ccuggcugacccgauucc

SEQ ID NO: 2969 - RNA, 18 nt, Mus musculus
cugacccgauuccgcgga

SEQ ID NO: 2970 - RNA, 18 nt, Mus musculus
ggacaccgcugacagccg

SEQ ID NO: 2971 - RNA, 18 nt, Mus musculus
gcugacagccgcggcugg

SEQ ID NO: 2972 - RNA, 18 nt, Mus musculus
agccgcggcuggagccag

SEQ ID NO: 2973 - RNA, 18 nt, Mus musculus
cuccccggucuugcgcug

SEQ ID NO: 2974 - RNA, 18 nt, Mus musculus
ccauaccgccucugugac

SEQ ID NO: 2975 - RNA, 18 nt, Mus musculus
gcuagcugucgcucugug

SEQ ID NO: 2976 - RNA, 18 nt, Mus musculus
ccgagccgccucuguggg

SEQ ID NO: 2977 - RNA, 18 nt, Mus musculus
cccuucagauuacuugca

SEQ ID NO: 2978 - RNA, 18 nt, Mus musculus
cuccacuguuuaugucua

SEQ ID NO: 2979 - RNA, 18 nt, Mus musculus
gauuacagaucaccauuc

SEQ ID NO: 2980 - RNA, 18 nt, Mus musculus
auccccugccgagggucg

SEQ ID NO: 2981 - RNA, 18 nt, Mus musculus
uguuccggauggaaacag

SEQ ID NO: 2982 - RNA, 18 nt, Mus musculus
ccuaucagucuaucaugu

SEQ ID NO: 2983 - RNA, 18 nt, Mus musculus
gcuaucugccggagaaaa

SEQ ID NO: 2984 - RNA, 18 nt, Mus musculus
guggacggaugaucaaga

SEQ ID NO: 2985 - RNA, 18 nt, Mus musculus
uuacccagcuccugauau

SEQ ID NO: 2986 - RNA, 18 nt, Mus musculus
caccccagaucggugaga

SEQ ID NO: 2987 - RNA, 18 nt, Mus musculus
augcacagucuacgccaa

SEQ ID NO: 2988 - RNA, 18 nt, Mus musculus
gaagccugcuccuacaga

SEQ ID NO: 2989 - RNA, 18 nt, Mus musculus
uccuacagacccggccaa

SEQ ID NO: 2990 - RNA, 18 nt, Mus musculus
augcccugauugaaggaa

SEQ ID NO: 2991 - RNA, 18 nt, Mus musculus
gcaaccugcugcccagcc

SEQ ID NO: 2992 - RNA, 18 nt, Mus musculus
accugcugcccagccaac

SEQ ID NO: 2993 - RNA, 18 nt, Mus musculus
ugucccuguugugcacug

SEQ ID NO: 2994 - RNA, 18 nt, Mus musculus
aacaucgguccacauggg

SEQ ID NO: 2995 - RNA, 18 nt, Mus musculus
cacaccaguuugcaagaa

SEQ ID NO: 2996 - RNA, 18 nt, Mus musculus
uugcucugcucaagauaa

SEQ ID NO: 2997 - RNA, 18 nt, Mus musculus
ucaaacagcucaucaucc

SEQ ID NO: 2998 - RNA, 18 nt, Mus musculus
ggaaccugacuauccgca

SEQ ID NO: 2999 - RNA, 18 nt, Mus musculus
uccuacggaccguuaagc

SEQ ID NO: 3000 - RNA, 18 nt, Mus musculus
ggauccagaugaauugcc

SEQ ID NO: 3001 - RNA, 18 nt, Mus musculus
gggaccggcugaaacuag

SEQ ID NO: 3002 - RNA, 18 nt, Mus musculus
ugaggcagacgcuuuugg

SEQ ID NO: 3003 - RNA, 18 nt, Mus musculus
ucugccagcucaggcuuu

SEQ ID NO: 3004 - RNA, 18 nt, Mus musculus
gacuucggcuuggcccgg

SEQ ID NO: 3005 - RNA, 18 nt, Mus musculus
agacccggauuaugucag

SEQ ID NO: 3006 - RNA, 18 nt, Mus musculus
gaugcccgacucccuuug

SEQ ID NO: 3007 - RNA, 18 nt, Mus musculus
ggcuccugacuacacuac

SEQ ID NO: 3008 - RNA, 18 nt, Mus musculus
cuggacugcuggcaugag

SEQ ID NO: 3009 - RNA, 18 nt, Mus musculus
ucucccugccuaccucac

SEQ ID NO: 3010 - RNA, 18 nt, Mus musculus
gaucccagaugacagcca

SEQ ID NO: 3011 - RNA, 18 nt, Mus musculus
ccaaccagaccaguggcu

SEQ ID NO: 3012 - RNA, 18 nt, Mus musculus
gcuaccagucuggguauc

SEQ ID NO: 3013 - RNA, 18 nt, Mus musculus
ucacucagaugacacaga

SEQ ID NO: 3014 - RNA, 18 nt, Mus musculus
ugcugcaguucacgcuga

SEQ ID NO: 3015 - RNA, 18 nt, Mus musculus
ucacgcugacucagggac

SEQ ID NO: 3016 - RNA, 18 nt, Mus musculus
cacugcagcucaccuccu

SEQ ID NO: 3017 - RNA, 18 nt, Mus musculus
accuccuguuuaaaugga

SEQ ID NO: 3018 - RNA, 18 nt, Mus musculus
ugguccugucccggcucc

SEQ ID NO: 3019 - RNA, 18 nt, Mus musculus
ugucccggcuccgccccc

SEQ ID NO: 3020 - RNA, 18 nt, Mus musculus
cggcuccgcccccaacuc

SEQ ID NO: 3021 - RNA, 18 nt, Mus musculus
aggugcugcuuagauuuu

SEQ ID NO: 3022 - RNA, 18 nt, Mus musculus
gaccucagacugcaagga

SEQ ID NO: 3023 - RNA, 18 nt, Mus musculus
gugcccugcuguggucuc

SEQ ID NO: 3024 - RNA, 18 nt, Mus musculus
ggacucuguccuccaaga

SEQ ID NO: 3025 - RNA, 18 nt, Mus musculus
cgagucugucuaccuugg

SEQ ID NO: 3026 - RNA, 18 nt, Mus musculus
gagagcgguuggagccug

SEQ ID NO: 3027 - RNA, 18 nt, Mus musculus
gccugcagaugcauugug

SEQ ID NO: 3028 - RNA, 18 nt, Mus musculus
aaaggcggccggcagggu

SEQ ID NO: 3029 - RNA, 18 nt, Mus musculus
cuucacagucggguuaca

SEQ ID NO: 3030 - RNA, 18 nt, Mus musculus
ccuuccggacucuuacgu

SEQ ID NO: 3031 - RNA, 18 nt, Mus musculus
ugaugcagcuugcuccuu

SEQ ID NO: 3032 - RNA, 18 nt, Mus musculus
ggcuccugacggggccga

SEQ ID NO: 3033 - RNA, 18 nt, Mus musculus
gguuucugcuggguggag

SEQ ID NO: 3034 - RNA, 18 nt, Mus musculus
gcuuccugauggcagaaa

SEQ ID NO: 3035 - RNA, 18 nt, Mus musculus
cuagccagauuucgaaau

SEQ ID NO: 3036 - RNA, 18 nt, Mus musculus
gguuucugccugugugcu

SEQ ID NO: 3037 - RNA, 17 nt, Mus musculus
ggccgcgucuugcucac

SEQ ID NO: 3038 - RNA, 17 nt, Mus musculus
ccgcgucuugcucacca

SEQ ID NO: 3039 - RNA, 17 nt, Mus musculus
gucuugcucaccauggu

SEQ ID NO: 3040 - RNA, 17 nt, Mus musculus
accauggucagcugcug

SEQ ID NO: 3041 - RNA, 17 nt, Mus musculus
accgcggucuugccuua

SEQ ID NO: 3042 - RNA, 17 nt, Mus musculus
cgcggucuugccuuacg

SEQ ID NO: 3043 - RNA, 17 nt, Mus musculus
ucuugccuuacgcgcug

SEQ ID NO: 3044 - RNA, 17 nt, Mus musculus
cuugccuuacgcgcugc

SEQ ID NO: 3045 - RNA, 17 nt, Mus musculus
gcgcugcucgggugucu

SEQ ID NO: 3046 - RNA, 17 nt, Mus musculus
ucgggugucugcuucuc

SEQ ID NO: 3047 - RNA, 17 nt, Mus musculus
cugcuucucacaggaua

SEQ ID NO: 3048 - RNA, 17 nt, Mus musculus
cacaggauauggcucag

SEQ ID NO: 3049 - RNA, 17 nt, Mus musculus
auauggcucagggucga

SEQ ID NO: 3050 - RNA, 17 nt, Mus musculus
cucagggucgaaguuaa

SEQ ID NO: 3051 - RNA, 17 nt, Mus musculus
gucgaaguuaaaagugc

SEQ ID NO: 3052 - RNA, 17 nt, Mus musculus
ucgaaguuaaaagugcc

SEQ ID NO: 3053 - RNA, 17 nt, Mus musculus
cagcaugucaugcaagc

SEQ ID NO: 3054 - RNA, 17 nt, Mus musculus
gccagacucucuuucuc

SEQ ID NO: 3055 - RNA, 17 nt, Mus musculus
cagacucucuuucucaa

SEQ ID NO: 3056 - RNA, 17 nt, Mus musculus
gacucucuuucucaagu

SEQ ID NO: 3057 - RNA, 17 nt, Mus musculus
acucucuuucucaagug

SEQ ID NO: 3058 - RNA, 17 nt, Mus musculus
cucucuuucucaagugc

SEQ ID NO: 3059 - RNA, 17 nt, Mus musculus
cucuuucucaagugcag

SEQ ID NO: 3060 - RNA, 17 nt, Mus musculus
agcccacucauggucuc

SEQ ID NO: 3061 - RNA, 17 nt, Mus musculus
cucauggucucugccca

SEQ ID NO: 3062 - RNA, 17 nt, Mus musculus
cauggucucugcccacg

SEQ ID NO: 3063 - RNA, 17 nt, Mus musculus
cugagcaucacuccccc

SEQ ID NO: 3064 - RNA, 17 nt, Mus musculus
gcaucacucccccaucg

SEQ ID NO: 3065 - RNA, 17 nt, Mus musculus
ucccccaucggccugug

SEQ ID NO: 3066 - RNA, 17 nt, Mus musculus
ggagggauaacaggcaa

SEQ ID NO: 3067 - RNA, 17 nt, Mus musculus
caggcaauucugcagca

SEQ ID NO: 3068 - RNA, 17 nt, Mus musculus
aggcaauucugcagcac

SEQ ID NO: 3069 - RNA, 17 nt, Mus musculus
cagcaccuugaccuugg

SEQ ID NO: 3070 - RNA, 17 nt, Mus musculus
cuugaccuuggacacgg

SEQ ID NO: 3071 - RNA, 17 nt, Mus musculus
acgggccucuacaccug

SEQ ID NO: 3072 - RNA, 17 nt, Mus musculus
gggccucuacaccugua

SEQ ID NO: 3073 - RNA, 17 nt, Mus musculus
acaccuguagauaccuc

SEQ ID NO: 3074 - RNA, 17 nt, Mus musculus
cuguagauaccucccua

SEQ ID NO: 3075 - RNA, 17 nt, Mus musculus
agauaccucccuacauc

SEQ ID NO: 3076 - RNA, 17 nt, Mus musculus
accucccuacaucuacu

SEQ ID NO: 3077 - RNA, 17 nt, Mus musculus
cccuacaucuacuucga

SEQ ID NO: 3078 - RNA, 17 nt, Mus musculus
cuacaucuacuucgaag

SEQ ID NO: 3079 - RNA, 17 nt, Mus musculus
caucuacuucgaagaaa

SEQ ID NO: 3080 - RNA, 17 nt, Mus musculus
aucuacuucgaagaaaa

SEQ ID NO: 3081 - RNA, 17 nt, Mus musculus
agcggaaucuucaaucu

SEQ ID NO: 3082 - RNA, 17 nt, Mus musculus
cggaaucuucaaucuac

SEQ ID NO: 3083 - RNA, 17 nt, Mus musculus
ggaaucuucaaucuaca

SEQ ID NO: 3084 - RNA, 17 nt, Mus musculus
ucuucaaucuacauauu

SEQ ID NO: 3085 - RNA, 17 nt, Mus musculus
uucaaucuacauauuug

SEQ ID NO: 3086 - RNA, 17 nt, Mus musculus
aucuacauauuuguuag

SEQ ID NO: 3087 - RNA, 17 nt, Mus musculus
cuacauauuuguuagug

SEQ ID NO: 3088 - RNA, 17 nt, Mus musculus
uacauauuuguuaguga

SEQ ID NO: 3089 - RNA, 17 nt, Mus musculus
auauuuguuagugaugc

SEQ ID NO: 3090 - RNA, 17 nt, Mus musculus
uauuuguuagugaugca

SEQ ID NO: 3091 - RNA, 17 nt, Mus musculus
cagggaguccuuucaua

SEQ ID NO: 3092 - RNA, 17 nt, Mus musculus
ggaguccuuucauagag

SEQ ID NO: 3093 - RNA, 17 nt, Mus musculus
gaguccuuucauagaga

SEQ ID NO: 3094 - RNA, 17 nt, Mus musculus
aguccuuucauagagau

SEQ ID NO: 3095 - RNA, 17 nt, Mus musculus
ccuuucauagagaugca

SEQ ID NO: 3096 - RNA, 17 nt, Mus musculus
acugacauacccaaacu

SEQ ID NO: 3097 - RNA, 17 nt, Mus musculus
cccaaacuugugcacau

SEQ ID NO: 3098 - RNA, 17 nt, Mus musculus
agacagcucaucauccc

SEQ ID NO: 3099 - RNA, 17 nt, Mus musculus
cagcucaucauccccug

SEQ ID NO: 3100 - RNA, 17 nt, Mus musculus
cucaucauccccugccg

SEQ ID NO: 3101 - RNA, 17 nt, Mus musculus
ggugacgucacccaacg

SEQ ID NO: 3102 - RNA, 17 nt, Mus musculus
cccaacgucacagucac

SEQ ID NO: 3103 - RNA, 17 nt, Mus musculus
gucacagucacccuaaa

SEQ ID NO: 3104 - RNA, 17 nt, Mus musculus
gucacccuaaaaaaguu

SEQ ID NO: 3105 - RNA, 17 nt, Mus musculus
aaaaaaguuuccauuug

SEQ ID NO: 3106 - RNA, 17 nt, Mus musculus
aaaaaguuuccauuuga

SEQ ID NO: 3107 - RNA, 17 nt, Mus musculus
aaaaguuuccauuugau

SEQ ID NO: 3108 - RNA, 17 nt, Mus musculus
guuuccauuugauacuc

SEQ ID NO: 3109 - RNA, 17 nt, Mus musculus
uuuccauuugauacucu

SEQ ID NO: 3110 - RNA, 17 nt, Mus musculus
cauuugauacucuuacc

SEQ ID NO: 3111 - RNA, 17 nt, Mus musculus
uugauacucuuaccccu

SEQ ID NO: 3112 - RNA, 17 nt, Mus musculus
gauacucuuaccccuga

SEQ ID NO: 3113 - RNA, 17 nt, Mus musculus
auacucuuaccccugau

SEQ ID NO: 3114 - RNA, 17 nt, Mus musculus
caaagaauaacauggga

SEQ ID NO: 3115 - RNA, 17 nt, Mus musculus
gggacaguaggagaggc

SEQ ID NO: 3116 - RNA, 17 nt, Mus musculus
gagaggcuuuauaauag

SEQ ID NO: 3117 - RNA, 17 nt, Mus musculus
agaggcuuuauaauagc

SEQ ID NO: 3118 - RNA, 17 nt, Mus musculus
gaggcuuuauaauagca

SEQ ID NO: 3119 - RNA, 17 nt, Mus musculus
ggcuuuauaauagcaaa

SEQ ID NO: 3120 - RNA, 17 nt, Mus musculus
uuuauaauagcaaaugc

SEQ ID NO: 3121 - RNA, 17 nt, Mus musculus
ugcaacguacaaagaga

SEQ ID NO: 3122 - RNA, 17 nt, Mus musculus
aaagagauaggacugcu

SEQ ID NO: 3123 - RNA, 17 nt, Mus musculus
gccaccgucaacgggca

SEQ ID NO: 3124 - RNA, 17 nt, Mus musculus
gcaccuguaccagacaa

SEQ ID NO: 3125 - RNA, 17 nt, Mus musculus
gacaaacuaucugaccc

SEQ ID NO: 3126 - RNA, 17 nt, Mus musculus
caaacuaucugacccau

SEQ ID NO: 3127 - RNA, 17 nt, Mus musculus
ugacccaucggcagacc

SEQ ID NO: 3128 - RNA, 17 nt, Mus musculus
agaccaauacaauccua

SEQ ID NO: 3129 - RNA, 17 nt, Mus musculus
aauacaauccuagaugu

SEQ ID NO: 3130 - RNA, 17 nt, Mus musculus
acaauccuagaugucca

SEQ ID NO: 3131 - RNA, 17 nt, Mus musculus
cuagauguccaaauacg

SEQ ID NO: 3132 - RNA, 17 nt, Mus musculus
guccaaauacgcccgcc

SEQ ID NO: 3133 - RNA, 17 nt, Mus musculus
agacugcuccacgggca

SEQ ID NO: 3134 - RNA, 17 nt, Mus musculus
ggcagacucuuguccuc

SEQ ID NO: 3135 - RNA, 17 nt, Mus musculus
cagacucuuguccucaa

SEQ ID NO: 3136 - RNA, 17 nt, Mus musculus
acucuuguccucaacug

SEQ ID NO: 3137 - RNA, 17 nt, Mus musculus
cuuguccucaacugcac

SEQ ID NO: 3138 - RNA, 17 nt, Mus musculus
acggagcucaauacgag

SEQ ID NO: 3139 - RNA, 17 nt, Mus musculus
agcucaauacgagggug

SEQ ID NO: 3140 - RNA, 17 nt, Mus musculus
gcuggaauuacccuggu

SEQ ID NO: 3141 - RNA, 17 nt, Mus musculus
cuggaauuacccuggua

SEQ ID NO: 3142 - RNA, 17 nt, Mus musculus
acccugguaaagcaacu

SEQ ID NO: 3143 - RNA, 17 nt, Mus musculus
aagcaacuaagagagca

SEQ ID NO: 3144 - RNA, 17 nt, Mus musculus
gagagcaucuauaaggc

SEQ ID NO: 3145 - RNA, 17 nt, Mus musculus
gagcaucuauaaggcag

SEQ ID NO: 3146 - RNA, 17 nt, Mus musculus
gcaucuauaaggcagcg

SEQ ID NO: 3147 - RNA, 17 nt, Mus musculus
cagcggauugaccggag

SEQ ID NO: 3148 - RNA, 17 nt, Mus musculus
ggagccauucccacaac

SEQ ID NO: 3149 - RNA, 17 nt, Mus musculus
gagccauucccacaaca

SEQ ID NO: 3150 - RNA, 17 nt, Mus musculus
caauguguuccacagug

SEQ ID NO: 3151 - RNA, 17 nt, Mus musculus
aauguguuccacagugu

SEQ ID NO: 3152 - RNA, 17 nt, Mus musculus
cacaguguucuuaagau

SEQ ID NO: 3153 - RNA, 17 nt, Mus musculus
acaguguucuuaagauc

SEQ ID NO: 3154 - RNA, 17 nt, Mus musculus
aguguucuuaagaucaa

SEQ ID NO: 3155 - RNA, 17 nt, Mus musculus
guguucuuaagaucaac

SEQ ID NO: 3156 - RNA, 17 nt, Mus musculus
cuuaagaucaacaaugu

SEQ ID NO: 3157 - RNA, 17 nt, Mus musculus
aaggggcucuacaccug

SEQ ID NO: 3158 - RNA, 17 nt, Mus musculus
ggggcucuacaccuguc

SEQ ID NO: 3159 - RNA, 17 nt, Mus musculus
acaccugucgcgugaag

SEQ ID NO: 3160 - RNA, 17 nt, Mus musculus
gaguggguccucguucc

SEQ ID NO: 3161 - RNA, 17 nt, Mus musculus
uggguccucguuccagu

SEQ ID NO: 3162 - RNA, 17 nt, Mus musculus
guccucguuccagucuu

SEQ ID NO: 3163 - RNA, 17 nt, Mus musculus
uccucguuccagucuuu

SEQ ID NO: 3164 - RNA, 17 nt, Mus musculus
guuccagucuuucaaca

SEQ ID NO: 3165 - RNA, 17 nt, Mus musculus
uccagucuuucaacacc

SEQ ID NO: 3166 - RNA, 17 nt, Mus musculus
ccagucuuucaacaccu

SEQ ID NO: 3167 - RNA, 17 nt, Mus musculus
cagucuuucaacaccuc

SEQ ID NO: 3168 - RNA, 17 nt, Mus musculus
caacaccuccgugcaug

SEQ ID NO: 3169 - RNA, 17 nt, Mus musculus
gcauguguaugaaaaag

SEQ ID NO: 3170 - RNA, 17 nt, Mus musculus
aaaaggauucaucagug

SEQ ID NO: 3171 - RNA, 17 nt, Mus musculus
aaaggauucaucagugu

SEQ ID NO: 3172 - RNA, 17 nt, Mus musculus
ggauucaucagugugaa

SEQ ID NO: 3173 - RNA, 17 nt, Mus musculus
ugaaacaucggaagcag

SEQ ID NO: 3174 - RNA, 17 nt, Mus musculus
aagacgguccuaucggc

SEQ ID NO: 3175 - RNA, 17 nt, Mus musculus
acgguccuaucggcugu

SEQ ID NO: 3176 - RNA, 17 nt, Mus musculus
gguccuaucggcugucc

SEQ ID NO: 3177 - RNA, 17 nt, Mus musculus
ucggcuguccaugaaag

SEQ ID NO: 3178 - RNA, 17 nt, Mus musculus
gaaggccuuccccuccc

SEQ ID NO: 3179 - RNA, 17 nt, Mus musculus
aaggccuuccccucccc

SEQ ID NO: 3180 - RNA, 17 nt, Mus musculus
cuuccccuccccagaaa

SEQ ID NO: 3181 - RNA, 17 nt, Mus musculus
ccagaaaucguaugguu

SEQ ID NO: 3182 - RNA, 17 nt, Mus musculus
gaaaucguaugguuaaa

SEQ ID NO: 3183 - RNA, 17 nt, Mus musculus
cguaugguuaaaagaug

SEQ ID NO: 3184 - RNA, 17 nt, Mus musculus
agauggcucgccugcaa

SEQ ID NO: 3185 - RNA, 17 nt, Mus musculus
ugcaacauugaagucug

SEQ ID NO: 3186 - RNA, 17 nt, Mus musculus
auugaagucugcucgcu

SEQ ID NO: 3187 - RNA, 17 nt, Mus musculus
agucugcucgcuauuug

SEQ ID NO: 3188 - RNA, 17 nt, Mus musculus
ugcucgcuauuugguac

SEQ ID NO: 3189 - RNA, 17 nt, Mus musculus
cucgcuauuugguacau

SEQ ID NO: 3190 - RNA, 17 nt, Mus musculus
ucgcuauuugguacaug

SEQ ID NO: 3191 - RNA, 17 nt, Mus musculus
uauuugguacauggcua

SEQ ID NO: 3192 - RNA, 17 nt, Mus musculus
acauggcuacucauuaa

SEQ ID NO: 3193 - RNA, 17 nt, Mus musculus
uggcuacucauuaauua

SEQ ID NO: 3194 - RNA, 17 nt, Mus musculus
cuacucauuaauuauca

SEQ ID NO: 3195 - RNA, 17 nt, Mus musculus
uacucauuaauuaucaa

SEQ ID NO: 3196 - RNA, 17 nt, Mus musculus
ucauuaauuaucaaaga

SEQ ID NO: 3197 - RNA, 17 nt, Mus musculus
cauuaauuaucaaagau

SEQ ID NO: 3198 - RNA, 17 nt, Mus musculus
uuaauuaucaaagaugu

SEQ ID NO: 3199 - RNA, 17 nt, Mus musculus
aggggacuauacgaucu

SEQ ID NO: 3200 - RNA, 17 nt, Mus musculus
gggacuauacgaucuug

SEQ ID NO: 3201 - RNA, 17 nt, Mus musculus
uauacgaucuugcuggg

SEQ ID NO: 3202 - RNA, 17 nt, Mus musculus
uacgaucuugcugggca

SEQ ID NO: 3203 - RNA, 17 nt, Mus musculus
cugggcauaaagcaguc

SEQ ID NO: 3204 - RNA, 17 nt, Mus musculus
aaagcagucaaggcuau

SEQ ID NO: 3205 - RNA, 17 nt, Mus musculus
ucaaggcuauuuaaaaa

SEQ ID NO: 3206 - RNA, 17 nt, Mus musculus
aaggcuauuuaaaaacc

SEQ ID NO: 3207 - RNA, 17 nt, Mus musculus
aggcuauuuaaaaaccu

SEQ ID NO: 3208 - RNA, 17 nt, Mus musculus
ggcuauuuaaaaaccuc

SEQ ID NO: 3209 - RNA, 17 nt, Mus musculus
cugccacucucauugua

SEQ ID NO: 3210 - RNA, 17 nt, Mus musculus
gccacucucauuguaaa

SEQ ID NO: 3211 - RNA, 17 nt, Mus musculus
acucucauuguaaacgu

SEQ ID NO: 3212 - RNA, 17 nt, Mus musculus
cucauuguaaacgugaa

SEQ ID NO: 3213 - RNA, 17 nt, Mus musculus
ugaaaccucagaucuac

SEQ ID NO: 3214 - RNA, 17 nt, Mus musculus
ccucagaucuacgaaaa

SEQ ID NO: 3215 - RNA, 17 nt, Mus musculus
ucagaucuacgaaaagu

SEQ ID NO: 3216 - RNA, 17 nt, Mus musculus
cgaaaaguccguguccu

SEQ ID NO: 3217 - RNA, 17 nt, Mus musculus
guccguguccucgcuuc

SEQ ID NO: 3218 - RNA, 17 nt, Mus musculus
cguguccucgcuuccaa

SEQ ID NO: 3219 - RNA, 17 nt, Mus musculus
uccucgcuuccaagccc

SEQ ID NO: 3220 - RNA, 17 nt, Mus musculus
ccucgcuuccaagccca

SEQ ID NO: 3221 - RNA, 17 nt, Mus musculus
gcccaccucucuauccg

SEQ ID NO: 3222 - RNA, 17 nt, Mus musculus
ccaccucucuauccgcu

SEQ ID NO: 3223 - RNA, 17 nt, Mus musculus
accucucuauccgcugg

SEQ ID NO: 3224 - RNA, 17 nt, Mus musculus
cucucuauccgcugggc

SEQ ID NO: 3225 - RNA, 17 nt, Mus musculus
agacaaguccucacuug

SEQ ID NO: 3226 - RNA, 17 nt, Mus musculus
caaguccucacuugcac

SEQ ID NO: 3227 - RNA, 17 nt, Mus musculus
uccucacuugcaccgug

SEQ ID NO: 3228 - RNA, 17 nt, Mus musculus
caccguguauggcaucc

SEQ ID NO: 3229 - RNA, 17 nt, Mus musculus
uauggcaucccucggcc

SEQ ID NO: 3230 - RNA, 17 nt, Mus musculus
gcaucccucggccaaca

SEQ ID NO: 3231 - RNA, 17 nt, Mus musculus
ccaacaaucacguggcu

SEQ ID NO: 3232 - RNA, 17 nt, Mus musculus
acguggcucuggcaccc

SEQ ID NO: 3233 - RNA, 17 nt, Mus musculus
accccugucaccacaau

SEQ ID NO: 3234 - RNA, 17 nt, Mus musculus
accacaaucacuccaaa

SEQ ID NO: 3235 - RNA, 17 nt, Mus musculus
caaucacuccaaagaaa

SEQ ID NO: 3236 - RNA, 17 nt, Mus musculus
agaaagguaugacuucu

SEQ ID NO: 3237 - RNA, 17 nt, Mus musculus
guaugacuucugcacug

SEQ ID NO: 3238 - RNA, 17 nt, Mus musculus
uaugacuucugcacuga

SEQ ID NO: 3239 - RNA, 17 nt, Mus musculus
ugaagaauccuuuaucc

SEQ ID NO: 3240 - RNA, 17 nt, Mus musculus
agaauccuuuauccugg

SEQ ID NO: 3241 - RNA, 17 nt, Mus musculus
gaauccuuuauccugga

SEQ ID NO: 3242 - RNA, 17 nt, Mus musculus
aauccuuuauccuggau

SEQ ID NO: 3243 - RNA, 17 nt, Mus musculus
uccuuuauccuggaucc

SEQ ID NO: 3244 - RNA, 17 nt, Mus musculus
uccuggaucccagcagc

SEQ ID NO: 3245 - RNA, 17 nt, Mus musculus
cagcaacuuaggaaaca

SEQ ID NO: 3246 - RNA, 17 nt, Mus musculus
agcaacuuaggaaacag

SEQ ID NO: 3247 - RNA, 17 nt, Mus musculus
gagagcaucucucagcg

SEQ ID NO: 3248 - RNA, 17 nt, Mus musculus
gagcaucucucagcgca

SEQ ID NO: 3249 - RNA, 17 nt, Mus musculus
gcaucucucagcgcaug

SEQ ID NO: 3250 - RNA, 17 nt, Mus musculus
augacggucauagaagg

SEQ ID NO: 3251 - RNA, 17 nt, Mus musculus
acggucauagaaggaac

SEQ ID NO: 3252 - RNA, 17 nt, Mus musculus
gaacaaauaagacgguu

SEQ ID NO: 3253 - RNA, 17 nt, Mus musculus
aagacgguuagcacauu

SEQ ID NO: 3254 - RNA, 17 nt, Mus musculus
agacgguuagcacauug

SEQ ID NO: 3255 - RNA, 17 nt, Mus musculus
uagcacauugguggugg

SEQ ID NO: 3256 - RNA, 17 nt, Mus musculus
ggcugacucucagaccc

SEQ ID NO: 3257 - RNA, 17 nt, Mus musculus
cugacucucagaccccu

SEQ ID NO: 3258 - RNA, 17 nt, Mus musculus
ccuggaaucuacagcug

SEQ ID NO: 3259 - RNA, 17 nt, Mus musculus
uggaaucuacagcugcc

SEQ ID NO: 3260 - RNA, 17 nt, Mus musculus
ccgggccuucaauaaaa

SEQ ID NO: 3261 - RNA, 17 nt, Mus musculus
cgggccuucaauaaaau

SEQ ID NO: 3262 - RNA, 17 nt, Mus musculus
ccuucaauaaaauaggg

SEQ ID NO: 3263 - RNA, 17 nt, Mus musculus
aauaaaauagggacugu

SEQ ID NO: 3264 - RNA, 17 nt, Mus musculus
agaaacauaaaauuuua

SEQ ID NO: 3265 - RNA, 17 nt, Mus musculus
cauaaaauuuuauguca

SEQ ID NO: 3266 - RNA, 17 nt, Mus musculus
auaaaauuuuaugucac

SEQ ID NO: 3267 - RNA, 17 nt, Mus musculus
uaaaauuuuaugucaca

SEQ ID NO: 3268 - RNA, 17 nt, Mus musculus
aaaauuuuaugucacag

SEQ ID NO: 3269 - RNA, 17 nt, Mus musculus
uuuuaugucacagaugu

SEQ ID NO: 3270 - RNA, 17 nt, Mus musculus
gaauggcuuucacguuu

SEQ ID NO: 3271 - RNA, 17 nt, Mus musculus
aauggcuuucacguuuc

SEQ ID NO: 3272 - RNA, 17 nt, Mus musculus
auggcuuucacguuucc

SEQ ID NO: 3273 - RNA, 17 nt, Mus musculus
uuucacguuuccuugga

SEQ ID NO: 3274 - RNA, 17 nt, Mus musculus
uucacguuuccuuggaa

SEQ ID NO: 3275 - RNA, 17 nt, Mus musculus
ucacguuuccuuggaaa

SEQ ID NO: 3276 - RNA, 17 nt, Mus musculus
cguuuccuuggaaaaga

SEQ ID NO: 3277 - RNA, 17 nt, Mus musculus
gaaacuguccugugugg

SEQ ID NO: 3278 - RNA, 17 nt, Mus musculus
uguguggucaauaaauu

SEQ ID NO: 3279 - RNA, 17 nt, Mus musculus
uggucaauaaauuccug

SEQ ID NO: 3280 - RNA, 17 nt, Mus musculus
caauaaauuccuguaca

SEQ ID NO: 3281 - RNA, 17 nt, Mus musculus
aauaaauuccuguacag

SEQ ID NO: 3282 - RNA, 17 nt, Mus musculus
auuccuguacagagaca

SEQ ID NO: 3283 - RNA, 17 nt, Mus musculus
agagacauuaccuggau

SEQ ID NO: 3284 - RNA, 17 nt, Mus musculus
gagacauuaccuggauu

SEQ ID NO: 3285 - RNA, 17 nt, Mus musculus
accuggauucugcuacg

SEQ ID NO: 3286 - RNA, 17 nt, Mus musculus
ccuggauucugcuacgg

SEQ ID NO: 3287 - RNA, 17 nt, Mus musculus
auucugcuacggacagu

SEQ ID NO: 3288 - RNA, 17 nt, Mus musculus
cggacaguuaacaacag

SEQ ID NO: 3289 - RNA, 17 nt, Mus musculus
ggacaguuaacaacaga

SEQ ID NO: 3290 - RNA, 17 nt, Mus musculus
ugcaccauaguaucagc

SEQ ID NO: 3291 - RNA, 17 nt, Mus musculus
accauaguaucagcaag

SEQ ID NO: 3292 - RNA, 17 nt, Mus musculus
cauaguaucagcaagca

SEQ ID NO: 3293 - RNA, 17 nt, Mus musculus
ccaccacucaagauuac

SEQ ID NO: 3294 - RNA, 17 nt, Mus musculus
cucaagauuacuccauc

SEQ ID NO: 3295 - RNA, 17 nt, Mus musculus
ucaagauuacuccauca

SEQ ID NO: 3296 - RNA, 17 nt, Mus musculus
agauuacuccaucacuc

SEQ ID NO: 3297 - RNA, 17 nt, Mus musculus
uacuccaucacucugaa

SEQ ID NO: 3298 - RNA, 17 nt, Mus musculus
ccaucacucugaaccuu

SEQ ID NO: 3299 - RNA, 17 nt, Mus musculus
cugaaccuugucaucaa

SEQ ID NO: 3300 - RNA, 17 nt, Mus musculus
aaccuugucaucaagaa

SEQ ID NO: 3301 - RNA, 17 nt, Mus musculus
cuugucaucaagaacgu

SEQ ID NO: 3302 - RNA, 17 nt, Mus musculus
gaacgugucucuagaag

SEQ ID NO: 3303 - RNA, 17 nt, Mus musculus
acgugucucuagaagac

SEQ ID NO: 3304 - RNA, 17 nt, Mus musculus
gugucucuagaagacuc

SEQ ID NO: 3305 - RNA, 17 nt, Mus musculus
agaagacucgggcaccu

SEQ ID NO: 3306 - RNA, 17 nt, Mus musculus
gggcaccuaugcgugca

SEQ ID NO: 3307 - RNA, 17 nt, Mus musculus
aggaacauauacacagg

SEQ ID NO: 3308 - RNA, 17 nt, Mus musculus
gaacauauacacagggg

SEQ ID NO: 3309 - RNA, 17 nt, Mus musculus
gaagacauccuucggaa

SEQ ID NO: 3310 - RNA, 17 nt, Mus musculus
gacauccuucggaagac

SEQ ID NO: 3311 - RNA, 17 nt, Mus musculus
acauccuucggaagaca

SEQ ID NO: 3312 - RNA, 17 nt, Mus musculus
acagaaguucucguuag

SEQ ID NO: 3313 - RNA, 17 nt, Mus musculus
cagaaguucucguuaga

SEQ ID NO: 3314 - RNA, 17 nt, Mus musculus
gaaguucucguuagaga

SEQ ID NO: 3315 - RNA, 17 nt, Mus musculus
guucucguuagagauuc

SEQ ID NO: 3316 - RNA, 17 nt, Mus musculus
uucucguuagagauucg

SEQ ID NO: 3317 - RNA, 17 nt, Mus musculus
uuagagauucggaagcg

SEQ ID NO: 3318 - RNA, 17 nt, Mus musculus
uagagauucggaagcgc

SEQ ID NO: 3319 - RNA, 17 nt, Mus musculus
caccugcuucaaaaccu

SEQ ID NO: 3320 - RNA, 17 nt, Mus musculus
accugcuucaaaaccuc

SEQ ID NO: 3321 - RNA, 17 nt, Mus musculus
caaaaccucagugacua

SEQ ID NO: 3322 - RNA, 17 nt, Mus musculus
cagugacuacgaggucu

SEQ ID NO: 3323 - RNA, 17 nt, Mus musculus
uacgaggucuccaucag

SEQ ID NO: 3324 - RNA, 17 nt, Mus musculus
cgaggucuccaucagug

SEQ ID NO: 3325 - RNA, 17 nt, Mus musculus
gucuccaucaguggcuc

SEQ ID NO: 3326 - RNA, 17 nt, Mus musculus
caguggcucuacgaccu

SEQ ID NO: 3327 - RNA, 17 nt, Mus musculus
guggcucuacgaccuua

SEQ ID NO: 3328 - RNA, 17 nt, Mus musculus
uacgaccuuagacuguc

SEQ ID NO: 3329 - RNA, 17 nt, Mus musculus
acgaccuuagacuguca

SEQ ID NO: 3330 - RNA, 17 nt, Mus musculus
uagacugucaagcuaga

SEQ ID NO: 3331 - RNA, 17 nt, Mus musculus
gucaagcuagagguguc

SEQ ID NO: 3332 - RNA, 17 nt, Mus musculus
agagguguccccgcgcc

SEQ ID NO: 3333 - RNA, 17 nt, Mus musculus
ccgcgccucagaucacu

SEQ ID NO: 3334 - RNA, 17 nt, Mus musculus
agaucacuugguucaaa

SEQ ID NO: 3335 - RNA, 17 nt, Mus musculus
cacuugguucaaaaaca

SEQ ID NO: 3336 - RNA, 17 nt, Mus musculus
acuugguucaaaaacaa

SEQ ID NO: 3337 - RNA, 17 nt, Mus musculus
ccgggaauuauuuuagg

SEQ ID NO: 3338 - RNA, 17 nt, Mus musculus
cgggaauuauuuuagga

SEQ ID NO: 3339 - RNA, 17 nt, Mus musculus
gaaagagucacagagga

SEQ ID NO: 3340 - RNA, 17 nt, Mus musculus
gagggugucuauaggug

SEQ ID NO: 3341 - RNA, 17 nt, Mus musculus
gggugucuauaggugcc

SEQ ID NO: 3342 - RNA, 17 nt, Mus musculus
gugucuauaggugccga

SEQ ID NO: 3343 - RNA, 17 nt, Mus musculus
cgcagccuaccucaccg

SEQ ID NO: 3344 - RNA, 17 nt, Mus musculus
gccuaccucaccgugca

SEQ ID NO: 3345 - RNA, 17 nt, Mus musculus
aggaaccucagacaagu

SEQ ID NO: 3346 - RNA, 17 nt, Mus musculus
agacaagucaaaccugg

SEQ ID NO: 3347 - RNA, 17 nt, Mus musculus
gagcugaucacgcucac

SEQ ID NO: 3348 - RNA, 17 nt, Mus musculus
aucacgcucacgugcac

SEQ ID NO: 3349 - RNA, 17 nt, Mus musculus
gcgacccucuuuuggcu

SEQ ID NO: 3350 - RNA, 17 nt, Mus musculus
gacccucuuuuggcucc

SEQ ID NO: 3351 - RNA, 17 nt, Mus musculus
acccucuuuuggcuccu

SEQ ID NO: 3352 - RNA, 17 nt, Mus musculus
cccucuuuuggcuccuu

SEQ ID NO: 3353 - RNA, 17 nt, Mus musculus
uuuuggcuccuucuaac

SEQ ID NO: 3354 - RNA, 17 nt, Mus musculus
uggcuccuucuaacucu

SEQ ID NO: 3355 - RNA, 17 nt, Mus musculus
ggcuccuucuaacucuc

SEQ ID NO: 3356 - RNA, 17 nt, Mus musculus
cuccuucuaacucucuu

SEQ ID NO: 3357 - RNA, 17 nt, Mus musculus
uucuaacucucuucauc

SEQ ID NO: 3358 - RNA, 17 nt, Mus musculus
cuaacucucuucaucag

SEQ ID NO: 3359 - RNA, 17 nt, Mus musculus
aacucucuucaucagaa

SEQ ID NO: 3360 - RNA, 17 nt, Mus musculus
acucucuucaucagaaa

SEQ ID NO: 3361 - RNA, 17 nt, Mus musculus
cucuucaucagaaaacu

SEQ ID NO: 3362 - RNA, 17 nt, Mus musculus
gaagcggucuucuuccg

SEQ ID NO: 3363 - RNA, 17 nt, Mus musculus
agcggucuucuuccgaa

SEQ ID NO: 3364 - RNA, 17 nt, Mus musculus
gcggucuucuuccgaag

SEQ ID NO: 3365 - RNA, 17 nt, Mus musculus
ggucuucuuccgaagua

SEQ ID NO: 3366 - RNA, 17 nt, Mus musculus
gucuucuuccgaaguaa

SEQ ID NO: 3367 - RNA, 17 nt, Mus musculus
uccgaaguaaagacaga

SEQ ID NO: 3368 - RNA, 17 nt, Mus musculus
gacagacuaccugucaa

SEQ ID NO: 3369 - RNA, 17 nt, Mus musculus
cuaccugucaaucauua

SEQ ID NO: 3370 - RNA, 17 nt, Mus musculus
cugucaaucauuaugga

SEQ ID NO: 3371 - RNA, 17 nt, Mus musculus
ucaaucauuauggaccc

SEQ ID NO: 3372 - RNA, 17 nt, Mus musculus
caaucauuauggaccca

SEQ ID NO: 3373 - RNA, 17 nt, Mus musculus
gaugaaguuccccugga

SEQ ID NO: 3374 - RNA, 17 nt, Mus musculus
augaaguuccccuggau

SEQ ID NO: 3375 - RNA, 17 nt, Mus musculus
gcugcccuaugaugcca

SEQ ID NO: 3376 - RNA, 17 nt, Mus musculus
gugggaguuugcacggg

SEQ ID NO: 3377 - RNA, 17 nt, Mus musculus
ugggaguuugcacggga

SEQ ID NO: 3378 - RNA, 17 nt, Mus musculus
cugaaacuaggcaaauc

SEQ ID NO: 3379 - RNA, 17 nt, Mus musculus
aggcaaaucgcucggaa

SEQ ID NO: 3380 - RNA, 17 nt, Mus musculus
aaaucgcucggaagagg

SEQ ID NO: 3381 - RNA, 17 nt, Mus musculus
gaggggcuuuugggaaa

SEQ ID NO: 3382 - RNA, 17 nt, Mus musculus
aggggcuuuugggaaag

SEQ ID NO: 3383 - RNA, 17 nt, Mus musculus
ggggcuuuugggaaagu

SEQ ID NO: 3384 - RNA, 17 nt, Mus musculus
gggaaagucguucaagc

SEQ ID NO: 3385 - RNA, 17 nt, Mus musculus
aaagucguucaagccuc

SEQ ID NO: 3386 - RNA, 17 nt, Mus musculus
aagucguucaagccucu

SEQ ID NO: 3387 - RNA, 17 nt, Mus musculus
ucaagccucugcauuug

SEQ ID NO: 3388 - RNA, 17 nt, Mus musculus
cucugcauuuggcauua

SEQ ID NO: 3389 - RNA, 17 nt, Mus musculus
ucugcauuuggcauuaa

SEQ ID NO: 3390 - RNA, 17 nt, Mus musculus
uaagaaaucacccaccu

SEQ ID NO: 3391 - RNA, 17 nt, Mus musculus
gaagauguugaaagagg

SEQ ID NO: 3392 - RNA, 17 nt, Mus musculus
cagugaguacaaagcuc

SEQ ID NO: 3393 - RNA, 17 nt, Mus musculus
acaaagcucugaugacc

SEQ ID NO: 3394 - RNA, 17 nt, Mus musculus
accgaacucaagaucuu

SEQ ID NO: 3395 - RNA, 17 nt, Mus musculus
cucaagaucuugaccca

SEQ ID NO: 3396 - RNA, 17 nt, Mus musculus
caagaucuugacccaca

SEQ ID NO: 3397 - RNA, 17 nt, Mus musculus
acccacaucggccauca

SEQ ID NO: 3398 - RNA, 17 nt, Mus musculus
ucggccaucaucugaau

SEQ ID NO: 3399 - RNA, 17 nt, Mus musculus
gccaucaucugaaugug

SEQ ID NO: 3400 - RNA, 17 nt, Mus musculus
aaugugguuaaccuccu

SEQ ID NO: 3401 - RNA, 17 nt, Mus musculus
augugguuaaccuccug

SEQ ID NO: 3402 - RNA, 17 nt, Mus musculus
guuaaccuccugggagc

SEQ ID NO: 3403 - RNA, 17 nt, Mus musculus
auggugaucguggaaua

SEQ ID NO: 3404 - RNA, 17 nt, Mus musculus
cguggaauacugcaaau

SEQ ID NO: 3405 - RNA, 17 nt, Mus musculus
cugcaaauacggaaacc

SEQ ID NO: 3406 - RNA, 17 nt, Mus musculus
aaaccuguccaacuacc

SEQ ID NO: 3407 - RNA, 17 nt, Mus musculus
guccaacuaccucaaga

SEQ ID NO: 3408 - RNA, 17 nt, Mus musculus
acgugacuuauucuguc

SEQ ID NO: 3409 - RNA, 17 nt, Mus musculus
cgugacuuauucugucu

SEQ ID NO: 3410 - RNA, 17 nt, Mus musculus
ugacuuauucugucuca

SEQ ID NO: 3411 - RNA, 17 nt, Mus musculus
gacuuauucugucucaa

SEQ ID NO: 3412 - RNA, 17 nt, Mus musculus
uauucugucucaacaag

SEQ ID NO: 3413 - RNA, 17 nt, Mus musculus
uucugucucaacaagga

SEQ ID NO: 3414 - RNA, 17 nt, Mus musculus
cgcagccuugcauaugg

SEQ ID NO: 3415 - RNA, 17 nt, Mus musculus
ccuugcauauggagcuc

SEQ ID NO: 3416 - RNA, 17 nt, Mus musculus
auggagcucaagaaaga

SEQ ID NO: 3417 - RNA, 17 nt, Mus musculus
ccccgccuagacagugu

SEQ ID NO: 3418 - RNA, 17 nt, Mus musculus
gacagugucagcagcuc

SEQ ID NO: 3419 - RNA, 17 nt, Mus musculus
cagcagcucaaguguca

SEQ ID NO: 3420 - RNA, 17 nt, Mus musculus
ucaagugucaccagcuc

SEQ ID NO: 3421 - RNA, 17 nt, Mus musculus
caccagcuccagcuucc

SEQ ID NO: 3422 - RNA, 17 nt, Mus musculus
cuccagcuucccugaag

SEQ ID NO: 3423 - RNA, 17 nt, Mus musculus
uccagcuucccugaaga

SEQ ID NO: 3424 - RNA, 17 nt, Mus musculus
acgaggauuacagugag

SEQ ID NO: 3425 - RNA, 17 nt, Mus musculus
cgaggauuacagugaga

SEQ ID NO: 3426 - RNA, 17 nt, Mus musculus
agugagaucuccaagca

SEQ ID NO: 3427 - RNA, 17 nt, Mus musculus
ugagaucuccaagcagc

SEQ ID NO: 3428 - RNA, 17 nt, Mus musculus
cagccccucaccaugga

SEQ ID NO: 3429 - RNA, 17 nt, Mus musculus
gaccugauuuccuacag

SEQ ID NO: 3430 - RNA, 17 nt, Mus musculus
accugauuuccuacagu

SEQ ID NO: 3431 - RNA, 17 nt, Mus musculus
ccugauuuccuacaguu

SEQ ID NO: 3432 - RNA, 17 nt, Mus musculus
gauuuccuacaguuucc

SEQ ID NO: 3433 - RNA, 17 nt, Mus musculus
ccuacaguuuccaagug

SEQ ID NO: 3434 - RNA, 17 nt, Mus musculus
cuacaguuuccaagugg

SEQ ID NO: 3435 - RNA, 17 nt, Mus musculus
uacaguuuccaaguggc

SEQ ID NO: 3436 - RNA, 17 nt, Mus musculus
cauggaguuucuguccu

SEQ ID NO: 3437 - RNA, 17 nt, Mus musculus
auggaguuucuguccuc

SEQ ID NO: 3438 - RNA, 17 nt, Mus musculus
uggaguuucuguccucc

SEQ ID NO: 3439 - RNA, 17 nt, Mus musculus
guuucuguccuccagaa

SEQ ID NO: 3440 - RNA, 17 nt, Mus musculus
ucuguccuccagaaagu

SEQ ID NO: 3441 - RNA, 17 nt, Mus musculus
agaaacauccuuuuauc

SEQ ID NO: 3442 - RNA, 17 nt, Mus musculus
aacauccuuuuaucuga

SEQ ID NO: 3443 - RNA, 17 nt, Mus musculus
acauccuuuuaucugag

SEQ ID NO: 3444 - RNA, 17 nt, Mus musculus
cauccuuuuaucugaga

SEQ ID NO: 3445 - RNA, 17 nt, Mus musculus
auccuuuuaucugagaa

SEQ ID NO: 3446 - RNA, 17 nt, Mus musculus
ccuuuuaucugagaaca

SEQ ID NO: 3447 - RNA, 17 nt, Mus musculus
gugaagauuugcgacuu

SEQ ID NO: 3448 - RNA, 17 nt, Mus musculus
ugaagauuugcgacuuu

SEQ ID NO: 3449 - RNA, 17 nt, Mus musculus
uugcgacuuuggccugg

SEQ ID NO: 3450 - RNA, 17 nt, Mus musculus
ugcgacuuuggccuggc

SEQ ID NO: 3451 - RNA, 17 nt, Mus musculus
auauuuauaagaacccu

SEQ ID NO: 3452 - RNA, 17 nt, Mus musculus
acccugauuaugugagg

SEQ ID NO: 3453 - RNA, 17 nt, Mus musculus
cccugauuaugugagga

SEQ ID NO: 3454 - RNA, 17 nt, Mus musculus
gaggagauacucgacuu

SEQ ID NO: 3455 - RNA, 17 nt, Mus musculus
gagauacucgacuuccc

SEQ ID NO: 3456 - RNA, 17 nt, Mus musculus
acucgacuuccccuaaa

SEQ ID NO: 3457 - RNA, 17 nt, Mus musculus
cucgacuuccccuaaaa

SEQ ID NO: 3458 - RNA, 17 nt, Mus musculus
cuuccccuaaaauggau

SEQ ID NO: 3459 - RNA, 17 nt, Mus musculus
ggauggcuccugaaucc

SEQ ID NO: 3460 - RNA, 17 nt, Mus musculus
uccugaauccaucuuug

SEQ ID NO: 3461 - RNA, 17 nt, Mus musculus
gaauccaucuuugacaa

SEQ ID NO: 3462 - RNA, 17 nt, Mus musculus
auccaucuuugacaagg

SEQ ID NO: 3463 - RNA, 17 nt, Mus musculus
uccaucuuugacaaggu

SEQ ID NO: 3464 - RNA, 17 nt, Mus musculus
gacaaggucuacagcac

SEQ ID NO: 3465 - RNA, 17 nt, Mus musculus
caaggucuacagcacca

SEQ ID NO: 3466 - RNA, 17 nt, Mus musculus
ugugugguccuauggcg

SEQ ID NO: 3467 - RNA, 17 nt, Mus musculus
gugguccuauggcgugu

SEQ ID NO: 3468 - RNA, 17 nt, Mus musculus
uggcguguugcuguggg

SEQ ID NO: 3469 - RNA, 17 nt, Mus musculus
ugggagaucuucuccuu

SEQ ID NO: 3470 - RNA, 17 nt, Mus musculus
ggagaucuucuccuuag

SEQ ID NO: 3471 - RNA, 17 nt, Mus musculus
gagaucuucuccuuagg

SEQ ID NO: 3472 - RNA, 17 nt, Mus musculus
gaucuucuccuuagggg

SEQ ID NO: 3473 - RNA, 17 nt, Mus musculus
cuucuccuuaggggguu

SEQ ID NO: 3474 - RNA, 17 nt, Mus musculus
uucuccuuaggggguuc

SEQ ID NO: 3475 - RNA, 17 nt, Mus musculus
uaggggguucuccauac

SEQ ID NO: 3476 - RNA, 17 nt, Mus musculus
aggggguucuccauacc

SEQ ID NO: 3477 - RNA, 17 nt, Mus musculus
gggguucuccauaccca

SEQ ID NO: 3478 - RNA, 17 nt, Mus musculus
uucuccauacccaggag

SEQ ID NO: 3479 - RNA, 17 nt, Mus musculus
ugaagacuucugcagcc

SEQ ID NO: 3480 - RNA, 17 nt, Mus musculus
gaagacuucugcagccg

SEQ ID NO: 3481 - RNA, 17 nt, Mus musculus
cccggaguaugccacac

SEQ ID NO: 3482 - RNA, 17 nt, Mus musculus
ccugaaaucuaccaaau

SEQ ID NO: 3483 - RNA, 17 nt, Mus musculus
ugaaaucuaccaaauca

SEQ ID NO: 3484 - RNA, 17 nt, Mus musculus
uaccaaaucauguugga

SEQ ID NO: 3485 - RNA, 17 nt, Mus musculus
aaucauguuggauugcu

SEQ ID NO: 3486 - RNA, 17 nt, Mus musculus
uguuggauugcuggcac

SEQ ID NO: 3487 - RNA, 17 nt, Mus musculus
gccccgguuugcugaac

SEQ ID NO: 3488 - RNA, 17 nt, Mus musculus
ccccgguuugcugaacu

SEQ ID NO: 3489 - RNA, 17 nt, Mus musculus
gcugaacuuguggagaa

SEQ ID NO: 3490 - RNA, 17 nt, Mus musculus
gagaaacuuggugaccu

SEQ ID NO: 3491 - RNA, 17 nt, Mus musculus
gaccugcuucaagccaa

SEQ ID NO: 3492 - RNA, 17 nt, Mus musculus
accugcuucaagccaac

SEQ ID NO: 3493 - RNA, 17 nt, Mus musculus
gccaacguccaacagga

SEQ ID NO: 3494 - RNA, 17 nt, Mus musculus
ggaaagauuacaucccc

SEQ ID NO: 3495 - RNA, 17 nt, Mus musculus
gaaagauuacauccccc

SEQ ID NO: 3496 - RNA, 17 nt, Mus musculus
gauuacaucccccucaa

SEQ ID NO: 3497 - RNA, 17 nt, Mus musculus
aucccccucaaugccau

SEQ ID NO: 3498 - RNA, 17 nt, Mus musculus
aaugccauacugacuag

SEQ ID NO: 3499 - RNA, 17 nt, Mus musculus
uacugacuagaaacagu

SEQ ID NO: 3500 - RNA, 17 nt, Mus musculus
gaaacaguagcuucaca

SEQ ID NO: 3501 - RNA, 17 nt, Mus musculus
caguagcuucacauacu

SEQ ID NO: 3502 - RNA, 17 nt, Mus musculus
aguagcuucacauacuc

SEQ ID NO: 3503 - RNA, 17 nt, Mus musculus
cuucacauacucgaccc

SEQ ID NO: 3504 - RNA, 17 nt, Mus musculus
cacauacucgaccccca

SEQ ID NO: 3505 - RNA, 17 nt, Mus musculus
ccccaccuucucugagg

SEQ ID NO: 3506 - RNA, 17 nt, Mus musculus
cccaccuucucugagga

SEQ ID NO: 3507 - RNA, 17 nt, Mus musculus
caccuucucugaggacc

SEQ ID NO: 3508 - RNA, 17 nt, Mus musculus
gaggaccuuuucaagga

SEQ ID NO: 3509 - RNA, 17 nt, Mus musculus
aggaccuuuucaaggac

SEQ ID NO: 3510 - RNA, 17 nt, Mus musculus
ggaccuuuucaaggacg

SEQ ID NO: 3511 - RNA, 17 nt, Mus musculus
gaccuuuucaaggacgg

SEQ ID NO: 3512 - RNA, 17 nt, Mus musculus
ggacggcuuugcagauc

SEQ ID NO: 3513 - RNA, 17 nt, Mus musculus
gacggcuuugcagaucc

SEQ ID NO: 3514 - RNA, 17 nt, Mus musculus
uugcagauccacauuuu

SEQ ID NO: 3515 - RNA, 17 nt, Mus musculus
auccacauuuucauucc

SEQ ID NO: 3516 - RNA, 17 nt, Mus musculus
uccacauuuucauuccg

SEQ ID NO: 3517 - RNA, 17 nt, Mus musculus
ccacauuuucauuccgg

SEQ ID NO: 3518 - RNA, 17 nt, Mus musculus
cacauuuucauuccgga

SEQ ID NO: 3519 - RNA, 17 nt, Mus musculus
auuuucauuccggaagc

SEQ ID NO: 3520 - RNA, 17 nt, Mus musculus
uuuucauuccggaagcu

SEQ ID NO: 3521 - RNA, 17 nt, Mus musculus
cggaagcucugaugaug

SEQ ID NO: 3522 - RNA, 17 nt, Mus musculus
ugugagauauguaaacg

SEQ ID NO: 3523 - RNA, 17 nt, Mus musculus
agauauguaaacgcuuu

SEQ ID NO: 3524 - RNA, 17 nt, Mus musculus
uaaacgcuuucaaauuc

SEQ ID NO: 3525 - RNA, 17 nt, Mus musculus
aaacgcuuucaaauuca

SEQ ID NO: 3526 - RNA, 17 nt, Mus musculus
aacgcuuucaaauucau

SEQ ID NO: 3527 - RNA, 17 nt, Mus musculus
uuucaaauucaugagcc

SEQ ID NO: 3528 - RNA, 17 nt, Mus musculus
uucaaauucaugagccu

SEQ ID NO: 3529 - RNA, 17 nt, Mus musculus
caaaaccuuugaggagc

SEQ ID NO: 3530 - RNA, 17 nt, Mus musculus
aaaaccuuugaggagcu

SEQ ID NO: 3531 - RNA, 17 nt, Mus musculus
gaggagcuuucaccgaa

SEQ ID NO: 3532 - RNA, 17 nt, Mus musculus
aggagcuuucaccgaac

SEQ ID NO: 3533 - RNA, 17 nt, Mus musculus
ggagcuuucaccgaacu

SEQ ID NO: 3534 - RNA, 17 nt, Mus musculus
accgaacuccaccucca

SEQ ID NO: 3535 - RNA, 17 nt, Mus musculus
cuccaccuccauguuug

SEQ ID NO: 3536 - RNA, 17 nt, Mus musculus
cuccauguuugaggacu

SEQ ID NO: 3537 - RNA, 17 nt, Mus musculus
uccauguuugaggacua

SEQ ID NO: 3538 - RNA, 17 nt, Mus musculus
ugaggacuaucagcugg

SEQ ID NO: 3539 - RNA, 17 nt, Mus musculus
aggacuaucagcuggac

SEQ ID NO: 3540 - RNA, 17 nt, Mus musculus
uggacacuagcacucug

SEQ ID NO: 3541 - RNA, 17 nt, Mus musculus
cuagcacucugcugggc

SEQ ID NO: 3542 - RNA, 17 nt, Mus musculus
gcugggcucccccuugc

SEQ ID NO: 3543 - RNA, 17 nt, Mus musculus
cucccccuugcugaagc

SEQ ID NO: 3544 - RNA, 17 nt, Mus musculus
gaagcgguucaccugga

SEQ ID NO: 3545 - RNA, 17 nt, Mus musculus
aagcgguucaccuggac

SEQ ID NO: 3546 - RNA, 17 nt, Mus musculus
caaggccuccaugaaga

SEQ ID NO: 3547 - RNA, 17 nt, Mus musculus
augaagauagacuugag

SEQ ID NO: 3548 - RNA, 17 nt, Mus musculus
gauagacuugagaauag

SEQ ID NO: 3549 - RNA, 17 nt, Mus musculus
uugagaauagcgaguaa

SEQ ID NO: 3550 - RNA, 17 nt, Mus musculus
uagcgaguaaaagcaag

SEQ ID NO: 3551 - RNA, 17 nt, Mus musculus
gcgggacuuuccgaucu

SEQ ID NO: 3552 - RNA, 17 nt, Mus musculus
cgggacuuuccgaucug

SEQ ID NO: 3553 - RNA, 17 nt, Mus musculus
gggacuuuccgaucugc

SEQ ID NO: 3554 - RNA, 17 nt, Mus musculus
uuuccgaucugccgagg

SEQ ID NO: 3555 - RNA, 17 nt, Mus musculus
gcccagcuucugcuucu

SEQ ID NO: 3556 - RNA, 17 nt, Mus musculus
cccagcuucugcuucuc

SEQ ID NO: 3557 - RNA, 17 nt, Mus musculus
cuucugcuucuccagcu

SEQ ID NO: 3558 - RNA, 17 nt, Mus musculus
uucugcuucuccagcug

SEQ ID NO: 3559 - RNA, 17 nt, Mus musculus
cugcuucuccagcugug

SEQ ID NO: 3560 - RNA, 17 nt, Mus musculus
ggccacaucaggcccgu

SEQ ID NO: 3561 - RNA, 17 nt, Mus musculus
cgaugaaucugagcugg

SEQ ID NO: 3562 - RNA, 17 nt, Mus musculus
aaaggaguccugcuguu

SEQ ID NO: 3563 - RNA, 17 nt, Mus musculus
ccugcuguucuccaccc

SEQ ID NO: 3564 - RNA, 17 nt, Mus musculus
cugcuguucuccacccc

SEQ ID NO: 3565 - RNA, 17 nt, Mus musculus
gcuguucuccaccccca

SEQ ID NO: 3566 - RNA, 17 nt, Mus musculus
cccagacuacaacuccg

SEQ ID NO: 3567 - RNA, 17 nt, Mus musculus
cuacaacuccguggugu

SEQ ID NO: 3568 - RNA, 17 nt, Mus musculus
cgugguguuguacuccu

SEQ ID NO: 3569 - RNA, 17 nt, Mus musculus
gguguuguacuccuccc

SEQ ID NO: 3570 - RNA, 17 nt, Mus musculus
guuguacuccuccccgc

SEQ ID NO: 3571 - RNA, 17 nt, Mus musculus
guacuccuccccgcccg

SEQ ID NO: 3572 - RNA, 17 nt, Mus musculus
gcccgccuaaagcuucu

SEQ ID NO: 3573 - RNA, 17 nt, Mus musculus
cuaaagcuucucaccag

SEQ ID NO: 3574 - RNA, 17 nt, Mus musculus
uaaagcuucucaccagc

SEQ ID NO: 3575 - RNA, 17 nt, Mus musculus
aagcuucucaccagccc

SEQ ID NO: 3576 - RNA, 17 nt, Mus musculus
cugacaguauuauacau

SEQ ID NO: 3577 - RNA, 17 nt, Mus musculus
gacaguauuauacaucu

SEQ ID NO: 3578 - RNA, 17 nt, Mus musculus
acaguauuauacaucua

SEQ ID NO: 3579 - RNA, 17 nt, Mus musculus
aguauuauacaucuaug

SEQ ID NO: 3580 - RNA, 17 nt, Mus musculus
uuauacaucuaugaguu

SEQ ID NO: 3581 - RNA, 17 nt, Mus musculus
auacaucuaugaguuua

SEQ ID NO: 3582 - RNA, 17 nt, Mus musculus
cuaugaguuuacaccua

SEQ ID NO: 3583 - RNA, 17 nt, Mus musculus
uaugaguuuacaccuau

SEQ ID NO: 3584 - RNA, 17 nt, Mus musculus
augaguuuacaccuauu

SEQ ID NO: 3585 - RNA, 17 nt, Mus musculus
uuacaccuauuccgcuc

SEQ ID NO: 3586 - RNA, 17 nt, Mus musculus
acaccuauuccgcucca

SEQ ID NO: 3587 - RNA, 17 nt, Mus musculus
caccuauuccgcuccac

SEQ ID NO: 3588 - RNA, 17 nt, Mus musculus
auuccgcuccacaggag

SEQ ID NO: 3589 - RNA, 17 nt, Mus musculus
cagcugcuuuucgugac

SEQ ID NO: 3590 - RNA, 17 nt, Mus musculus
agcugcuuuucgugacc

SEQ ID NO: 3591 - RNA, 17 nt, Mus musculus
gcugcuuuucgugaccu

SEQ ID NO: 3592 - RNA, 17 nt, Mus musculus
cugcuuuucgugaccuu

SEQ ID NO: 3593 - RNA, 17 nt, Mus musculus
cgugaccuuuaaucgug

SEQ ID NO: 3594 - RNA, 17 nt, Mus musculus
gugaccuuuaaucgugc

SEQ ID NO: 3595 - RNA, 17 nt, Mus musculus
ugaccuuuaaucgugcu

SEQ ID NO: 3596 - RNA, 17 nt, Mus musculus
ccuuuaaucgugcuuuu

SEQ ID NO: 3597 - RNA, 17 nt, Mus musculus
aucgugcuuuuuuguuu

SEQ ID NO: 3598 - RNA, 17 nt, Mus musculus
ucgugcuuuuuuguuuu

SEQ ID NO: 3599 - RNA, 17 nt, Mus musculus
cgugcuuuuuuguuuuu

SEQ ID NO: 3600 - RNA, 17 nt, Mus musculus
gugcuuuuuuguuuuuu

SEQ ID NO: 3601 - RNA, 17 nt, Mus musculus
ugcuuuuuuguuuuuug

SEQ ID NO: 3602 - RNA, 17 nt, Mus musculus
uuuuuuguuuuuuguuu

SEQ ID NO: 3603 - RNA, 17 nt, Mus musculus
uuuuuguuuuuuguuuu

SEQ ID NO: 3604 - RNA, 17 nt, Mus musculus
uuuuguuuuuuguuuug

SEQ ID NO: 3605 - RNA, 17 nt, Mus musculus
uuuguuuuuuguuuugu

SEQ ID NO: 3606 - RNA, 17 nt, Mus musculus
uuguuuuuuguuuuguu

SEQ ID NO: 3607 - RNA, 17 nt, Mus musculus
uuuuuuguuuuguuugu

SEQ ID NO: 3608 - RNA, 17 nt, Mus musculus
uuuuuguuuuguuuguu

SEQ ID NO: 3609 - RNA, 17 nt, Mus musculus
uuuuguuuuguuuguug

SEQ ID NO: 3610 - RNA, 17 nt, Mus musculus
uguuuuguuuguuguug

SEQ ID NO: 3611 - RNA, 17 nt, Mus musculus
guuuuguuuguuguugc

SEQ ID NO: 3612 - RNA, 17 nt, Mus musculus
uuguuuguuguugcugu

SEQ ID NO: 3613 - RNA, 17 nt, Mus musculus
uuuguuguugcuguuuu

SEQ ID NO: 3614 - RNA, 17 nt, Mus musculus
guugcuguuuugacuaa

SEQ ID NO: 3615 - RNA, 17 nt, Mus musculus
uugcuguuuugacuaac

SEQ ID NO: 3616 - RNA, 17 nt, Mus musculus
ugcuguuuugacuaaca

SEQ ID NO: 3617 - RNA, 17 nt, Mus musculus
aagaauguaaccccagu

SEQ ID NO: 3618 - RNA, 17 nt, Mus musculus
accccaguuagugacgu

SEQ ID NO: 3619 - RNA, 17 nt, Mus musculus
ccccaguuagugacgug

SEQ ID NO: 3620 - RNA, 17 nt, Mus musculus
ugaagaauacuauuguu

SEQ ID NO: 3621 - RNA, 17 nt, Mus musculus
agaauacuauuguuaga

SEQ ID NO: 3622 - RNA, 17 nt, Mus musculus
aauacuauuguuagaga

SEQ ID NO: 3623 - RNA, 17 nt, Mus musculus
acuauuguuagagaaau

SEQ ID NO: 3624 - RNA, 17 nt, Mus musculus
cuauuguuagagaaauc

SEQ ID NO: 3625 - RNA, 17 nt, Mus musculus
agagaaaucccccccgc

SEQ ID NO: 3626 - RNA, 17 nt, Mus musculus
caaagccucaggguaac

SEQ ID NO: 3627 - RNA, 17 nt, Mus musculus
cucaggguaaccuggac

SEQ ID NO: 3628 - RNA, 17 nt, Mus musculus
aggugccucuggcgacc

SEQ ID NO: 3629 - RNA, 17 nt, Mus musculus
cccacccucccugcagc

SEQ ID NO: 3630 - RNA, 17 nt, Mus musculus
gugggacuagaggcagu

SEQ ID NO: 3631 - RNA, 17 nt, Mus musculus
gaggcaguaagcccauu

SEQ ID NO: 3632 - RNA, 17 nt, Mus musculus
aagcccauuagcucaug

SEQ ID NO: 3633 - RNA, 17 nt, Mus musculus
agcccauuagcucaugg

SEQ ID NO: 3634 - RNA, 17 nt, Mus musculus
cauuagcucauggcugc

SEQ ID NO: 3635 - RNA, 17 nt, Mus musculus
gaccugcucugucucuc

SEQ ID NO: 3636 - RNA, 17 nt, Mus musculus
ugcucugucucucuuau

SEQ ID NO: 3637 - RNA, 17 nt, Mus musculus
cucugucucucuuaugg

SEQ ID NO: 3638 - RNA, 17 nt, Mus musculus
cugucucucuuauggag

SEQ ID NO: 3639 - RNA, 17 nt, Mus musculus
gucucucuuauggagga

SEQ ID NO: 3640 - RNA, 17 nt, Mus musculus
ucucucuuauggaggaa

SEQ ID NO: 3641 - RNA, 17 nt, Mus musculus
aaaaggcuuugggaugc

SEQ ID NO: 3642 - RNA, 17 nt, Mus musculus
aaaggcuuugggaugcg

SEQ ID NO: 3643 - RNA, 17 nt, Mus musculus
ggaugcguccguccugu

SEQ ID NO: 3644 - RNA, 17 nt, Mus musculus
gcguccguccuguggag

SEQ ID NO: 3645 - RNA, 17 nt, Mus musculus
agggggcuccgcuaugc

SEQ ID NO: 3646 - RNA, 17 nt, Mus musculus
gcuccgcuaugccacuu

SEQ ID NO: 3647 - RNA, 17 nt, Mus musculus
augccacuucagugacu

SEQ ID NO: 3648 - RNA, 17 nt, Mus musculus
ugccacuucagugacuu

SEQ ID NO: 3649 - RNA, 17 nt, Mus musculus
cagugacuucucacucc

SEQ ID NO: 3650 - RNA, 17 nt, Mus musculus
agugacuucucacuccu

SEQ ID NO: 3651 - RNA, 17 nt, Mus musculus
ugacuucucacuccugg

SEQ ID NO: 3652 - RNA, 17 nt, Mus musculus
uucucacuccuggccuc

SEQ ID NO: 3653 - RNA, 17 nt, Mus musculus
ccuggccuccgcuguuu

SEQ ID NO: 3654 - RNA, 17 nt, Mus musculus
uccgcuguuucgggccc

SEQ ID NO: 3655 - RNA, 17 nt, Mus musculus
ccgcuguuucgggcccc

SEQ ID NO: 3656 - RNA, 17 nt, Mus musculus
cgcuguuucgggccccc

SEQ ID NO: 3657 - RNA, 17 nt, Mus musculus
ggcccccuuccaagagg

SEQ ID NO: 3658 - RNA, 17 nt, Mus musculus
gcccccuuccaagaggu

SEQ ID NO: 3659 - RNA, 17 nt, Mus musculus
caagagguaucagagca

SEQ ID NO: 3660 - RNA, 17 nt, Mus musculus
agagguaucagagcaga

SEQ ID NO: 3661 - RNA, 17 nt, Mus musculus
agggacguuuccuagac

SEQ ID NO: 3662 - RNA, 17 nt, Mus musculus
gggacguuuccuagacc

SEQ ID NO: 3663 - RNA, 17 nt, Mus musculus
ggacguuuccuagacca

SEQ ID NO: 3664 - RNA, 17 nt, Mus musculus
cguuuccuagaccaggg

SEQ ID NO: 3665 - RNA, 17 nt, Mus musculus
gcacauguucucgggaa

SEQ ID NO: 3666 - RNA, 17 nt, Mus musculus
cacauguucucgggaac

SEQ ID NO: 3667 - RNA, 17 nt, Mus musculus
cauguucucgggaacca

SEQ ID NO: 3668 - RNA, 17 nt, Mus musculus
accacaguuaaucuuaa

SEQ ID NO: 3669 - RNA, 17 nt, Mus musculus
ccacaguuaaucuuaaa

SEQ ID NO: 3670 - RNA, 17 nt, Mus musculus
caguuaaucuuaaaucu

SEQ ID NO: 3671 - RNA, 17 nt, Mus musculus
guuaaucuuaaaucuuu

SEQ ID NO: 3672 - RNA, 17 nt, Mus musculus
uuaaucuuaaaucuuuu

SEQ ID NO: 3673 - RNA, 17 nt, Mus musculus
ucuuaaaucuuuucccg

SEQ ID NO: 3674 - RNA, 17 nt, Mus musculus
uuaaaucuuuucccggg

SEQ ID NO: 3675 - RNA, 17 nt, Mus musculus
uaaaucuuuucccggga

SEQ ID NO: 3676 - RNA, 17 nt, Mus musculus
aaaucuuuucccgggag

SEQ ID NO: 3677 - RNA, 17 nt, Mus musculus
aaucuuuucccgggagu

SEQ ID NO: 3678 - RNA, 17 nt, Mus musculus
ccgggagucuucuguug

SEQ ID NO: 3679 - RNA, 17 nt, Mus musculus
gggagucuucuguuguc

SEQ ID NO: 3680 - RNA, 17 nt, Mus musculus
ggagucuucuguugucu

SEQ ID NO: 3681 - RNA, 17 nt, Mus musculus
ucuucuguugucuguuu

SEQ ID NO: 3682 - RNA, 17 nt, Mus musculus
ucuguugucuguuuacc

SEQ ID NO: 3683 - RNA, 17 nt, Mus musculus
uugucuguuuaccaucc

SEQ ID NO: 3684 - RNA, 17 nt, Mus musculus
ugucuguuuaccaucca

SEQ ID NO: 3685 - RNA, 17 nt, Mus musculus
gucuguuuaccauccaa

SEQ ID NO: 3686 - RNA, 17 nt, Mus musculus
uuuaccauccaaagcau

SEQ ID NO: 3687 - RNA, 17 nt, Mus musculus
caaagcauauuuaacau

SEQ ID NO: 3688 - RNA, 17 nt, Mus musculus
aagcauauuuaacaugu

SEQ ID NO: 3689 - RNA, 17 nt, Mus musculus
agcauauuuaacaugug

SEQ ID NO: 3690 - RNA, 17 nt, Mus musculus
gcauauuuaacaugugu

SEQ ID NO: 3691 - RNA, 17 nt, Mus musculus
acaugugucaguggggg

SEQ ID NO: 3692 - RNA, 17 nt, Mus musculus
guggcgcuuggcuucug

SEQ ID NO: 3693 - RNA, 17 nt, Mus musculus
gcuuggcuucugaggcc

SEQ ID NO: 3694 - RNA, 17 nt, Mus musculus
cuuggcuucugaggcca

SEQ ID NO: 3695 - RNA, 17 nt, Mus musculus
agagccaucaucaguuc

SEQ ID NO: 3696 - RNA, 17 nt, Mus musculus
gccaucaucaguuccuc

SEQ ID NO: 3697 - RNA, 17 nt, Mus musculus
ucaucaguuccucuagu

SEQ ID NO: 3698 - RNA, 17 nt, Mus musculus
caucaguuccucuagug

SEQ ID NO: 3699 - RNA, 17 nt, Mus musculus
caguuccucuagugaga

SEQ ID NO: 3700 - RNA, 17 nt, Mus musculus
guuccucuagugagaug

SEQ ID NO: 3701 - RNA, 17 nt, Mus musculus
agaugcauugaggucau

SEQ ID NO: 3702 - RNA, 17 nt, Mus musculus
auugaggucauacccaa

SEQ ID NO: 3703 - RNA, 17 nt, Mus musculus
gaggucauacccaagcu

SEQ ID NO: 3704 - RNA, 17 nt, Mus musculus
cccaagcuugcaggccu

SEQ ID NO: 3705 - RNA, 17 nt, Mus musculus
ccugaccuucgcauacu

SEQ ID NO: 3706 - RNA, 17 nt, Mus musculus
cugaccuucgcauacug

SEQ ID NO: 3707 - RNA, 17 nt, Mus musculus
cuucgcauacugcucac

SEQ ID NO: 3708 - RNA, 17 nt, Mus musculus
auacugcucacggggag

SEQ ID NO: 3709 - RNA, 17 nt, Mus musculus
cggggaguuaagugguc

SEQ ID NO: 3710 - RNA, 17 nt, Mus musculus
ggggaguuaaguggucc

SEQ ID NO: 3711 - RNA, 17 nt, Mus musculus
uaagugguccaguuugg

SEQ ID NO: 3712 - RNA, 17 nt, Mus musculus
gguccaguuuggccuag

SEQ ID NO: 3713 - RNA, 17 nt, Mus musculus
guccaguuuggccuagu

SEQ ID NO: 3714 - RNA, 17 nt, Mus musculus
uuuggccuaguaagguu

SEQ ID NO: 3715 - RNA, 17 nt, Mus musculus
ggccuaguaagguugcc

SEQ ID NO: 3716 - RNA, 17 nt, Mus musculus
aguaagguugccuacug

SEQ ID NO: 3717 - RNA, 17 nt, Mus musculus
gguugccuacugauggg

SEQ ID NO: 3718 - RNA, 17 nt, Mus musculus
gaugggcucaaaagcca

SEQ ID NO: 3719 - RNA, 17 nt, Mus musculus
agccacauuuuaaacag

SEQ ID NO: 3720 - RNA, 17 nt, Mus musculus
gccacauuuuaaacagg

SEQ ID NO: 3721 - RNA, 17 nt, Mus musculus
ccacauuuuaaacaggu

SEQ ID NO: 3722 - RNA, 17 nt, Mus musculus
cacauuuuaaacagguu

SEQ ID NO: 3723 - RNA, 17 nt, Mus musculus
aaacagguuuuaucuca

SEQ ID NO: 3724 - RNA, 17 nt, Mus musculus
aacagguuuuaucucaa

SEQ ID NO: 3725 - RNA, 17 nt, Mus musculus
acagguuuuaucucaag

SEQ ID NO: 3726 - RNA, 17 nt, Mus musculus
cagguuuuaucucaagu

SEQ ID NO: 3727 - RNA, 17 nt, Mus musculus
gguuuuaucucaaguau

SEQ ID NO: 3728 - RNA, 17 nt, Mus musculus
uuuuaucucaaguauua

SEQ ID NO: 3729 - RNA, 17 nt, Mus musculus
ucucaaguauuaauaua

SEQ ID NO: 3730 - RNA, 17 nt, Mus musculus
ucaaguauuaauauaua

SEQ ID NO: 3731 - RNA, 17 nt, Mus musculus
caaguauuaauauauag

SEQ ID NO: 3732 - RNA, 17 nt, Mus musculus
guauuaauauauagaca

SEQ ID NO: 3733 - RNA, 17 nt, Mus musculus
auuaauauauagacaag

SEQ ID NO: 3734 - RNA, 17 nt, Mus musculus
uaauauauagacaagac

SEQ ID NO: 3735 - RNA, 17 nt, Mus musculus
aagacacuuaugcauua

SEQ ID NO: 3736 - RNA, 17 nt, Mus musculus
agacacuuaugcauuau

SEQ ID NO: 3737 - RNA, 17 nt, Mus musculus
uuaugcauuauccuguu

SEQ ID NO: 3738 - RNA, 17 nt, Mus musculus
uaugcauuauccuguuu

SEQ ID NO: 3739 - RNA, 17 nt, Mus musculus
ugcauuauccuguuuua

SEQ ID NO: 3740 - RNA, 17 nt, Mus musculus
uauccuguuuuauauau

SEQ ID NO: 3741 - RNA, 17 nt, Mus musculus
auccuguuuuauauauc

SEQ ID NO: 3742 - RNA, 17 nt, Mus musculus
uccuguuuuauauaucc

SEQ ID NO: 3743 - RNA, 17 nt, Mus musculus
ccuguuuuauauaucca

SEQ ID NO: 3744 - RNA, 17 nt, Mus musculus
uguuuuauauauccaau

SEQ ID NO: 3745 - RNA, 17 nt, Mus musculus
uuuuauauauccaauga

SEQ ID NO: 3746 - RNA, 17 nt, Mus musculus
uuauauauccaaugaau

SEQ ID NO: 3747 - RNA, 17 nt, Mus musculus
caaugaauauaacuggg

SEQ ID NO: 3748 - RNA, 17 nt, Mus musculus
augaauauaacuggggc

SEQ ID NO: 3749 - RNA, 17 nt, Mus musculus
gggcgaguuaagaguca

SEQ ID NO: 3750 - RNA, 17 nt, Mus musculus
ggcgaguuaagagucau

SEQ ID NO: 3751 - RNA, 17 nt, Mus musculus
uuaagagucauggucua

SEQ ID NO: 3752 - RNA, 17 nt, Mus musculus
gucauggucuagaaaag

SEQ ID NO: 3753 - RNA, 17 nt, Mus musculus
cauggucuagaaaaggg

SEQ ID NO: 3754 - RNA, 17 nt, Mus musculus
aaagggguuucucugua

SEQ ID NO: 3755 - RNA, 17 nt, Mus musculus
aagggguuucucuguac

SEQ ID NO: 3756 - RNA, 17 nt, Mus musculus
agggguuucucuguacc

SEQ ID NO: 3757 - RNA, 17 nt, Mus musculus
ggguuucucuguaccca

SEQ ID NO: 3758 - RNA, 17 nt, Mus musculus
uucucuguacccaaauc

SEQ ID NO: 3759 - RNA, 17 nt, Mus musculus
acccaaaucgggcuggu

SEQ ID NO: 3760 - RNA, 17 nt, Mus musculus
gggcugguuggaccaag

SEQ ID NO: 3761 - RNA, 17 nt, Mus musculus
agagugguugucccagc

SEQ ID NO: 3762 - RNA, 17 nt, Mus musculus
gugguugucccagcuau

SEQ ID NO: 3763 - RNA, 17 nt, Mus musculus
ucccagcuauaguuacu

SEQ ID NO: 3764 - RNA, 17 nt, Mus musculus
ccagcuauaguuacuaa

SEQ ID NO: 3765 - RNA, 17 nt, Mus musculus
gcuauaguuacuaaacu

SEQ ID NO: 3766 - RNA, 17 nt, Mus musculus
cuauaguuacuaaacua

SEQ ID NO: 3767 - RNA, 17 nt, Mus musculus
uaguuacuaaacuacuc

SEQ ID NO: 3768 - RNA, 17 nt, Mus musculus
acuaaacuacucaccca

SEQ ID NO: 3769 - RNA, 17 nt, Mus musculus
aaacuacucacccaaag

SEQ ID NO: 3770 - RNA, 17 nt, Mus musculus
cccaaaguugggaccuc

SEQ ID NO: 3771 - RNA, 17 nt, Mus musculus
ugggaccucacuggcuu

SEQ ID NO: 3772 - RNA, 17 nt, Mus musculus
cacuggcuucucuuuac

SEQ ID NO: 3773 - RNA, 17 nt, Mus musculus
acuggcuucucuuuacu

SEQ ID NO: 3774 - RNA, 17 nt, Mus musculus
uggcuucucuuuacuuc

SEQ ID NO: 3775 - RNA, 17 nt, Mus musculus
gcuucucuuuacuucau

SEQ ID NO: 3776 - RNA, 17 nt, Mus musculus
cuucucuuuacuucauc

SEQ ID NO: 3777 - RNA, 17 nt, Mus musculus
uucucuuuacuucauca

SEQ ID NO: 3778 - RNA, 17 nt, Mus musculus
ucuuuacuucaucaugg

SEQ ID NO: 3779 - RNA, 17 nt, Mus musculus
cuuuacuucaucaugga

SEQ ID NO: 3780 - RNA, 17 nt, Mus musculus
uacuucaucauggauuu

SEQ ID NO: 3781 - RNA, 17 nt, Mus musculus
ucauggauuucaccauc

SEQ ID NO: 3782 - RNA, 17 nt, Mus musculus
cauggauuucaccaucc

SEQ ID NO: 3783 - RNA, 17 nt, Mus musculus
auggauuucaccauccc

SEQ ID NO: 3784 - RNA, 17 nt, Mus musculus
uucaccaucccaaggca

SEQ ID NO: 3785 - RNA, 17 nt, Mus musculus
aaggcagucugagagga

SEQ ID NO: 3786 - RNA, 17 nt, Mus musculus
gaggagcuaaagaguau

SEQ ID NO: 3787 - RNA, 17 nt, Mus musculus
uaaagaguaucagccca

SEQ ID NO: 3788 - RNA, 17 nt, Mus musculus
aagaguaucagcccaua

SEQ ID NO: 3789 - RNA, 17 nt, Mus musculus
cagcccauauuuauuaa

SEQ ID NO: 3790 - RNA, 17 nt, Mus musculus
gcccauauuuauuaagc

SEQ ID NO: 3791 - RNA, 17 nt, Mus musculus
cccauauuuauuaagca

SEQ ID NO: 3792 - RNA, 17 nt, Mus musculus
ccauauuuauuaagcac

SEQ ID NO: 3793 - RNA, 17 nt, Mus musculus
auauuuauuaagcacuu

SEQ ID NO: 3794 - RNA, 17 nt, Mus musculus
uauuuauuaagcacuuu

SEQ ID NO: 3795 - RNA, 17 nt, Mus musculus
uaagcacuuuaugcucc

SEQ ID NO: 3796 - RNA, 17 nt, Mus musculus
aagcacuuuaugcuccu

SEQ ID NO: 3797 - RNA, 17 nt, Mus musculus
agcacuuuaugcuccuu

SEQ ID NO: 3798 - RNA, 17 nt, Mus musculus
uuuaugcuccuuggcac

SEQ ID NO: 3799 - RNA, 17 nt, Mus musculus
augcuccuuggcacagc

SEQ ID NO: 3800 - RNA, 17 nt, Mus musculus
ugauguguaauuuaugc

SEQ ID NO: 3801 - RNA, 17 nt, Mus musculus
uguguaauuuaugcaag

SEQ ID NO: 3802 - RNA, 17 nt, Mus musculus
guguaauuuaugcaagc

SEQ ID NO: 3803 - RNA, 17 nt, Mus musculus
uguaauuuaugcaagcu

SEQ ID NO: 3804 - RNA, 17 nt, Mus musculus
ugcaagcucccucucca

SEQ ID NO: 3805 - RNA, 17 nt, Mus musculus
agcucccucuccagcua

SEQ ID NO: 3806 - RNA, 17 nt, Mus musculus
cucccucuccagcuagg

SEQ ID NO: 3807 - RNA, 17 nt, Mus musculus
cuccagcuaggacucag

SEQ ID NO: 3808 - RNA, 17 nt, Mus musculus
cuaggacucaggauauu

SEQ ID NO: 3809 - RNA, 17 nt, Mus musculus
cucaggauauuagucaa

SEQ ID NO: 3810 - RNA, 17 nt, Mus musculus
caggauauuagucaaug

SEQ ID NO: 3811 - RNA, 17 nt, Mus musculus
aggauauuagucaauga

SEQ ID NO: 3812 - RNA, 17 nt, Mus musculus
auauuagucaaugagcc

SEQ ID NO: 3813 - RNA, 17 nt, Mus musculus
ugagccaucaaaaggaa

SEQ ID NO: 3814 - RNA, 17 nt, Mus musculus
aaaaaccuaucuuauuu

SEQ ID NO: 3815 - RNA, 17 nt, Mus musculus
aaaccuaucuuauuuuc

SEQ ID NO: 3816 - RNA, 17 nt, Mus musculus
accuaucuuauuuucau

SEQ ID NO: 3817 - RNA, 17 nt, Mus musculus
ccuaucuuauuuucauc

SEQ ID NO: 3818 - RNA, 17 nt, Mus musculus
uaucuuauuuucaucug

SEQ ID NO: 3819 - RNA, 17 nt, Mus musculus
aucuuauuuucaucugu

SEQ ID NO: 3820 - RNA, 17 nt, Mus musculus
ucuuauuuucaucuguu

SEQ ID NO: 3821 - RNA, 17 nt, Mus musculus
cuuauuuucaucuguuu

SEQ ID NO: 3822 - RNA, 17 nt, Mus musculus
auuuucaucuguuucau

SEQ ID NO: 3823 - RNA, 17 nt, Mus musculus
ucaucuguuucauaccu

SEQ ID NO: 3824 - RNA, 17 nt, Mus musculus
caucuguuucauaccuu

SEQ ID NO: 3825 - RNA, 17 nt, Mus musculus
aucuguuucauaccuug

SEQ ID NO: 3826 - RNA, 17 nt, Mus musculus
uguuucauaccuugucu

SEQ ID NO: 3827 - RNA, 17 nt, Mus musculus
ucauaccuugucugggg

SEQ ID NO: 3828 - RNA, 17 nt, Mus musculus
uaccuugucuggggucu

SEQ ID NO: 3829 - RNA, 17 nt, Mus musculus
ucuggggucuaaugacg

SEQ ID NO: 3830 - RNA, 17 nt, Mus musculus
uggggucuaaugacgau

SEQ ID NO: 3831 - RNA, 17 nt, Mus musculus
aacaggguagacauggg

SEQ ID NO: 3832 - RNA, 17 nt, Mus musculus
gacaggguagaaaaggg

SEQ ID NO: 3833 - RNA, 17 nt, Mus musculus
ugcccgcucuuuggggu

SEQ ID NO: 3834 - RNA, 17 nt, Mus musculus
cccgcucuuuggggucu

SEQ ID NO: 3835 - RNA, 17 nt, Mus musculus
ccgcucuuuggggucua

SEQ ID NO: 3836 - RNA, 17 nt, Mus musculus
uuuggggucuagagaug

SEQ ID NO: 3837 - RNA, 17 nt, Mus musculus
uggggucuagagaugag

SEQ ID NO: 3838 - RNA, 17 nt, Mus musculus
cccugggucucuaaaau

SEQ ID NO: 3839 - RNA, 17 nt, Mus musculus
cugggucucuaaaaugg

SEQ ID NO: 3840 - RNA, 17 nt, Mus musculus
gggucucuaaaauggcu

SEQ ID NO: 3841 - RNA, 17 nt, Mus musculus
aaauggcucucuuagaa

SEQ ID NO: 3842 - RNA, 17 nt, Mus musculus
auggcucucuuagaagu

SEQ ID NO: 3843 - RNA, 17 nt, Mus musculus
ggcucucuuagaaguug

SEQ ID NO: 3844 - RNA, 17 nt, Mus musculus
gcucucuuagaaguugu

SEQ ID NO: 3845 - RNA, 17 nt, Mus musculus
uuagaaguuguaugugc

SEQ ID NO: 3846 - RNA, 17 nt, Mus musculus
gaaguuguaugugcaaa

SEQ ID NO: 3847 - RNA, 17 nt, Mus musculus
gugcaaauuauggucug

SEQ ID NO: 3848 - RNA, 17 nt, Mus musculus
ugcaaauuauggucugu

SEQ ID NO: 3849 - RNA, 17 nt, Mus musculus
auuauggucugugugcu

SEQ ID NO: 3850 - RNA, 17 nt, Mus musculus
ugugugcuuaggucgug

SEQ ID NO: 3851 - RNA, 17 nt, Mus musculus
gugugcuuaggucgugc

SEQ ID NO: 3852 - RNA, 17 nt, Mus musculus
gcuuaggucgugcacac

SEQ ID NO: 3853 - RNA, 17 nt, Mus musculus
gagccggucacagcugg

SEQ ID NO: 3854 - RNA, 17 nt, Mus musculus
cgaugaauagcugcuuu

SEQ ID NO: 3855 - RNA, 17 nt, Mus musculus
uagcugcuuugggagag

SEQ ID NO: 3856 - RNA, 17 nt, Mus musculus
agcugcuuugggagagc

SEQ ID NO: 3857 - RNA, 17 nt, Mus musculus
agcaugcuagccacuua

SEQ ID NO: 3858 - RNA, 17 nt, Mus musculus
uagccacuuaauucucu

SEQ ID NO: 3859 - RNA, 17 nt, Mus musculus
agccacuuaauucucug

SEQ ID NO: 3860 - RNA, 17 nt, Mus musculus
cacuuaauucucugacc

SEQ ID NO: 3861 - RNA, 17 nt, Mus musculus
acuuaauucucugaccg

SEQ ID NO: 3862 - RNA, 17 nt, Mus musculus
uuaauucucugaccggg

SEQ ID NO: 3863 - RNA, 17 nt, Mus musculus
gccagcaucauggguac

SEQ ID NO: 3864 - RNA, 17 nt, Mus musculus
ucauggguaccugcucc

SEQ ID NO: 3865 - RNA, 17 nt, Mus musculus
uaccugcuccccugugu

SEQ ID NO: 3866 - RNA, 17 nt, Mus musculus
cccuguguaccccaucc

SEQ ID NO: 3867 - RNA, 17 nt, Mus musculus
uaccccauccuuaaggu

SEQ ID NO: 3868 - RNA, 17 nt, Mus musculus
cccauccuuaagguuuu

SEQ ID NO: 3869 - RNA, 17 nt, Mus musculus
ccauccuuaagguuuuc

SEQ ID NO: 3870 - RNA, 17 nt, Mus musculus
cuuaagguuuucugucu

SEQ ID NO: 3871 - RNA, 17 nt, Mus musculus
uuaagguuuucugucug

SEQ ID NO: 3872 - RNA, 17 nt, Mus musculus
uaagguuuucugucuga

SEQ ID NO: 3873 - RNA, 17 nt, Mus musculus
aagguuuucugucugau

SEQ ID NO: 3874 - RNA, 17 nt, Mus musculus
uuuucugucugaugaga

SEQ ID NO: 3875 - RNA, 17 nt, Mus musculus
agugcaauccccacuga

SEQ ID NO: 3876 - RNA, 17 nt, Mus musculus
cuguggcucuuggugca

SEQ ID NO: 3877 - RNA, 17 nt, Mus musculus
guggcucuuggugcacu

SEQ ID NO: 3878 - RNA, 17 nt, Mus musculus
ggugcacucaccagcca

SEQ ID NO: 3879 - RNA, 17 nt, Mus musculus
ccaggacuagacaagua

SEQ ID NO: 3880 - RNA, 17 nt, Mus musculus
agacaaguaggaaaggg

SEQ ID NO: 3881 - RNA, 17 nt, Mus musculus
aaagggcuucuagccac

SEQ ID NO: 3882 - RNA, 17 nt, Mus musculus
aagggcuucuagccaca

SEQ ID NO: 3883 - RNA, 17 nt, Mus musculus
gggcuucuagccacacu

SEQ ID NO: 3884 - RNA, 17 nt, Mus musculus
aagaaaaucagguaggg

SEQ ID NO: 3885 - RNA, 17 nt, Mus musculus
aaucagguagggcuggc

SEQ ID NO: 3886 - RNA, 17 nt, Mus musculus
aaagacaucuuugucca

SEQ ID NO: 3887 - RNA, 17 nt, Mus musculus
agacaucuuuguccauu

SEQ ID NO: 3888 - RNA, 17 nt, Mus musculus
gacaucuuuguccauuc

SEQ ID NO: 3889 - RNA, 17 nt, Mus musculus
aucuuuguccauucgca

SEQ ID NO: 3890 - RNA, 17 nt, Mus musculus
uuguccauucgcaaaag

SEQ ID NO: 3891 - RNA, 17 nt, Mus musculus
uguccauucgcaaaagc

SEQ ID NO: 3892 - RNA, 17 nt, Mus musculus
caaaagcucuugucggc

SEQ ID NO: 3893 - RNA, 17 nt, Mus musculus
aaagcucuugucggcug

SEQ ID NO: 3894 - RNA, 17 nt, Mus musculus
gcucuugucggcugcag

SEQ ID NO: 3895 - RNA, 17 nt, Mus musculus
caguguguaagucaggc

SEQ ID NO: 3896 - RNA, 17 nt, Mus musculus
guguaagucaggcgaug

SEQ ID NO: 3897 - RNA, 17 nt, Mus musculus
cagaggcuaccagagaa

SEQ ID NO: 3898 - RNA, 17 nt, Mus musculus
ccugagguuucucaucc

SEQ ID NO: 3899 - RNA, 17 nt, Mus musculus
cugagguuucucaucca

SEQ ID NO: 3900 - RNA, 17 nt, Mus musculus
ugagguuucucauccag

SEQ ID NO: 3901 - RNA, 17 nt, Mus musculus
agguuucucauccagau

SEQ ID NO: 3902 - RNA, 17 nt, Mus musculus
uuucucauccagauauc

SEQ ID NO: 3903 - RNA, 17 nt, Mus musculus
auccagauauccagcaa

SEQ ID NO: 3904 - RNA, 17 nt, Mus musculus
ccagauauccagcaauu

SEQ ID NO: 3905 - RNA, 17 nt, Mus musculus
ccagcaauuggggggug

SEQ ID NO: 3906 - RNA, 17 nt, Mus musculus
aagaccauagauggucc

SEQ ID NO: 3907 - RNA, 17 nt, Mus musculus
uagaugguccuguauua

SEQ ID NO: 3908 - RNA, 17 nt, Mus musculus
gguccuguauuauuccg

SEQ ID NO: 3909 - RNA, 17 nt, Mus musculus
uccuguauuauuccgau

SEQ ID NO: 3910 - RNA, 17 nt, Mus musculus
ccuguauuauuccgauu

SEQ ID NO: 3911 - RNA, 17 nt, Mus musculus
uguauuauuccgauuuu

SEQ ID NO: 3912 - RNA, 17 nt, Mus musculus
guauuauuccgauuuua

SEQ ID NO: 3913 - RNA, 17 nt, Mus musculus
auuccgauuuuaauaau

SEQ ID NO: 3914 - RNA, 17 nt, Mus musculus
uuccgauuuuaauaauc

SEQ ID NO: 3915 - RNA, 17 nt, Mus musculus
uccgauuuuaauaaucu

SEQ ID NO: 3916 - RNA, 17 nt, Mus musculus
ccgauuuuaauaaucua

SEQ ID NO: 3917 - RNA, 17 nt, Mus musculus
auuuuaauaaucuaauu

SEQ ID NO: 3918 - RNA, 17 nt, Mus musculus
uuaauaaucuaauucgu

SEQ ID NO: 3919 - RNA, 17 nt, Mus musculus
aauaaucuaauucguga

SEQ ID NO: 3920 - RNA, 17 nt, Mus musculus
aaucuaauucgugauca

SEQ ID NO: 3921 - RNA, 17 nt, Mus musculus
aucuaauucgugaucau

SEQ ID NO: 3922 - RNA, 17 nt, Mus musculus
uucgugaucauuaagag

SEQ ID NO: 3923 - RNA, 17 nt, Mus musculus
gugaucauuaagagacu

SEQ ID NO: 3924 - RNA, 17 nt, Mus musculus
ugaucauuaagagacuu

SEQ ID NO: 3925 - RNA, 17 nt, Mus musculus
aagagacuuuaguaaau

SEQ ID NO: 3926 - RNA, 17 nt, Mus musculus
agagacuuuaguaaaug

SEQ ID NO: 3927 - RNA, 17 nt, Mus musculus
gagacuuuaguaaaugu

SEQ ID NO: 3928 - RNA, 17 nt, Mus musculus
acuuuaguaaauguccc

SEQ ID NO: 3929 - RNA, 17 nt, Mus musculus
guaaaugucccuuuucc

SEQ ID NO: 3930 - RNA, 17 nt, Mus musculus
augucccuuuucccaca

SEQ ID NO: 3931 - RNA, 17 nt, Mus musculus
ugucccuuuucccacaa

SEQ ID NO: 3932 - RNA, 17 nt, Mus musculus
gucccuuuucccacaaa

SEQ ID NO: 3933 - RNA, 17 nt, Mus musculus
ucccuuuucccacaaaa

SEQ ID NO: 3934 - RNA, 17 nt, Mus musculus
acaaaaguaaagaaaag

SEQ ID NO: 3935 - RNA, 17 nt, Mus musculus
gaaaagcuaucgggauu

SEQ ID NO: 3936 - RNA, 17 nt, Mus musculus
aaagcuaucgggauucu

SEQ ID NO: 3937 - RNA, 17 nt, Mus musculus
aucgggauucucugguu

SEQ ID NO: 3938 - RNA, 17 nt, Mus musculus
ucgggauucucugguuc

SEQ ID NO: 3939 - RNA, 17 nt, Mus musculus
gggauucucugguucug

SEQ ID NO: 3940 - RNA, 17 nt, Mus musculus
ucucugguucugcuuaa

SEQ ID NO: 3941 - RNA, 17 nt, Mus musculus
cucugguucugcuuaaa

SEQ ID NO: 3942 - RNA, 17 nt, Mus musculus
guucugcuuaaagacuu

SEQ ID NO: 3943 - RNA, 17 nt, Mus musculus
uucugcuuaaagacuua

SEQ ID NO: 3944 - RNA, 17 nt, Mus musculus
uaaagacuuagcuuugg

SEQ ID NO: 3945 - RNA, 17 nt, Mus musculus
aaagacuuagcuuugga

SEQ ID NO: 3946 - RNA, 17 nt, Mus musculus
acuuagcuuuggagccu

SEQ ID NO: 3947 - RNA, 17 nt, Mus musculus
cuuagcuuuggagccua

SEQ ID NO: 3948 - RNA, 17 nt, Mus musculus
uggagccuaugaaaguu

SEQ ID NO: 3949 - RNA, 17 nt, Mus musculus
augaaaguugaucagcc

SEQ ID NO: 3950 - RNA, 18 nt, Mus musculus
auggucagcugcugggac

SEQ ID NO: 3951 - RNA, 18 nt, Mus musculus
gucagcugcugggacacc

SEQ ID NO: 3952 - RNA, 18 nt, Mus musculus
caccgcggucuugccuua

SEQ ID NO: 3953 - RNA, 18 nt, Mus musculus
acgcgcugcucggguguc

SEQ ID NO: 3954 - RNA, 18 nt, Mus musculus
ggugucugcuucucacag

SEQ ID NO: 3955 - RNA, 18 nt, Mus musculus
caggccagacucucuuuc

SEQ ID NO: 3956 - RNA, 18 nt, Mus musculus
ggaggcagcccacucaug

SEQ ID NO: 3957 - RNA, 18 nt, Mus musculus
ggucucugcccacgaccg

SEQ ID NO: 3958 - RNA, 18 nt, Mus musculus
cccaucggccugugggag

SEQ ID NO: 3959 - RNA, 18 nt, Mus musculus
gaagacagcucaucaucc

SEQ ID NO: 3960 - RNA, 18 nt, Mus musculus
auccccugccgggugacg

SEQ ID NO: 3961 - RNA, 18 nt, Mus musculus
uaccccugaugggcaaag

SEQ ID NO: 3962 - RNA, 18 nt, Mus musculus
uaggacugcugaacugcg

SEQ ID NO: 3963 - RNA, 18 nt, Mus musculus
acuaucugacccaucggc

SEQ ID NO: 3964 - RNA, 18 nt, Mus musculus
aucggcagaccaauacaa

SEQ ID NO: 3965 - RNA, 18 nt, Mus musculus
uacgcccgccgagcccag

SEQ ID NO: 3966 - RNA, 18 nt, Mus musculus
ugagacugcuccacgggc

SEQ ID NO: 3967 - RNA, 18 nt, Mus musculus
acgggcagacucuugucc

SEQ ID NO: 3968 - RNA, 18 nt, Mus musculus
ggcagcggauugaccgga

SEQ ID NO: 3969 - RNA, 18 nt, Mus musculus
uacaccugucgcgugaag

SEQ ID NO: 3970 - RNA, 18 nt, Mus musculus
cguuccagucuuucaaca

SEQ ID NO: 3971 - RNA, 18 nt, Mus musculus
ggaagcagccggugcagg

SEQ ID NO: 3972 - RNA, 18 nt, Mus musculus
gaagacgguccuaucggc

SEQ ID NO: 3973 - RNA, 18 nt, Mus musculus
ccuaucggcuguccauga

SEQ ID NO: 3974 - RNA, 18 nt, Mus musculus
aucggcuguccaugaaag

SEQ ID NO: 3975 - RNA, 18 nt, Mus musculus
gaagucugcucgcuauuu

SEQ ID NO: 3976 - RNA, 18 nt, Mus musculus
aaccucagaucuacgaaa

SEQ ID NO: 3977 - RNA, 18 nt, Mus musculus
ucuauccgcugggcagca

SEQ ID NO: 3978 - RNA, 18 nt, Mus musculus
gguggcugacucucagac

SEQ ID NO: 3979 - RNA, 18 nt, Mus musculus
acucucagaccccuggaa

SEQ ID NO: 3980 - RNA, 18 nt, Mus musculus
aucuacagcugccgggcc

SEQ ID NO: 3981 - RNA, 18 nt, Mus musculus
uacagcugccgggccuuc

SEQ ID NO: 3982 - RNA, 18 nt, Mus musculus
ugucacagaugugccgaa

SEQ ID NO: 3983 - RNA, 18 nt, Mus musculus
gaugccagccgaaggaga

SEQ ID NO: 3984 - RNA, 18 nt, Mus musculus
ugaaacuguccugugugg

SEQ ID NO: 3985 - RNA, 18 nt, Mus musculus
cacaccugcuucaaaacc

SEQ ID NO: 3986 - RNA, 18 nt, Mus musculus
cgccucagaucacuuggu

SEQ ID NO: 3987 - RNA, 18 nt, Mus musculus
aagcgcagccuaccucac

SEQ ID NO: 3988 - RNA, 18 nt, Mus musculus
uggagcugaucacgcuca

SEQ ID NO: 3989 - RNA, 18 nt, Mus musculus
ugaagcggucuucuuccg

SEQ ID NO: 3990 - RNA, 18 nt, Mus musculus
aaagacagacuaccuguc

SEQ ID NO: 3991 - RNA, 18 nt, Mus musculus
gugaacggcugcccuaug

SEQ ID NO: 3992 - RNA, 18 nt, Mus musculus
aacggcugcccuaugaug

SEQ ID NO: 3993 - RNA, 18 nt, Mus musculus
cccaccugccggacugug

SEQ ID NO: 3994 - RNA, 18 nt, Mus musculus
ccugccggacuguggcug

SEQ ID NO: 3995 - RNA, 18 nt, Mus musculus
aagcucugaugaccgaac

SEQ ID NO: 3996 - RNA, 18 nt, Mus musculus
ggccucugauggugaucg

SEQ ID NO: 3997 - RNA, 18 nt, Mus musculus
gaaaccuguccaacuacc

SEQ ID NO: 3998 - RNA, 18 nt, Mus musculus
uuauucugucucaacaag

SEQ ID NO: 3999 - RNA, 18 nt, Mus musculus
ggacgcagccuugcauau

SEQ ID NO: 4000 - RNA, 18 nt, Mus musculus
aagccccgccuagacagu

SEQ ID NO: 4001 - RNA, 18 nt, Mus musculus
gucagcagcucaaguguc

SEQ ID NO: 4002 - RNA, 18 nt, Mus musculus
gucaccagcuccagcuuc

SEQ ID NO: 4003 - RNA, 18 nt, Mus musculus
agcuccagcuucccugaa

SEQ ID NO: 4004 - RNA, 18 nt, Mus musculus
ccaagcagccccucacca

SEQ ID NO: 4005 - RNA, 18 nt, Mus musculus
aagaccugauuuccuaca

SEQ ID NO: 4006 - RNA, 18 nt, Mus musculus
uccuacaguuuccaagug

SEQ ID NO: 4007 - RNA, 18 nt, Mus musculus
aguuucuguccuccagaa

SEQ ID NO: 4008 - RNA, 18 nt, Mus musculus
gaacccugauuaugugag

SEQ ID NO: 4009 - RNA, 18 nt, Mus musculus
uucugcagccgccugaag

SEQ ID NO: 4010 - RNA, 18 nt, Mus musculus
ugcagccgccugaaggaa

SEQ ID NO: 4011 - RNA, 18 nt, Mus musculus
gcaugcggaugagaaccc

SEQ ID NO: 4012 - RNA, 18 nt, Mus musculus
ggccccgguuugcugaac

SEQ ID NO: 4013 - RNA, 18 nt, Mus musculus
gugaccugcuucaagcca

SEQ ID NO: 4014 - RNA, 18 nt, Mus musculus
ccauacugacuagaaaca

SEQ ID NO: 4015 - RNA, 18 nt, Mus musculus
aaggacggcuuugcagau

SEQ ID NO: 4016 - RNA, 18 nt, Mus musculus
cuuugcagauccacauuu

SEQ ID NO: 4017 - RNA, 18 nt, Mus musculus
aagcucugaugaugugag

SEQ ID NO: 4018 - RNA, 18 nt, Mus musculus
acuaucagcuggacacua

SEQ ID NO: 4019 - RNA, 18 nt, Mus musculus
gcacucugcugggcuccc

SEQ ID NO: 4020 - RNA, 18 nt, Mus musculus
ugaagcgguucaccugga

SEQ ID NO: 4021 - RNA, 18 nt, Mus musculus
acuuuccgaucugccgag

SEQ ID NO: 4022 - RNA, 18 nt, Mus musculus
ccgaucugccgaggccca

SEQ ID NO: 4023 - RNA, 18 nt, Mus musculus
aggcccagcuucugcuuc

SEQ ID NO: 4024 - RNA, 18 nt, Mus musculus
agcuucugcuucuccagc

SEQ ID NO: 4025 - RNA, 18 nt, Mus musculus
uucuccagcuguggccac

SEQ ID NO: 4026 - RNA, 18 nt, Mus musculus
gaguccugcuguucucca

SEQ ID NO: 4027 - RNA, 18 nt, Mus musculus
uccugcuguucuccaccc

SEQ ID NO: 4028 - RNA, 18 nt, Mus musculus
acccccagacuacaacuc

SEQ ID NO: 4029 - RNA, 18 nt, Mus musculus
ccuccccgcccgccuaaa

SEQ ID NO: 4030 - RNA, 18 nt, Mus musculus
cccgcccgccuaaagcuu

SEQ ID NO: 4031 - RNA, 18 nt, Mus musculus
cucaccagccccgacaac

SEQ ID NO: 4032 - RNA, 18 nt, Mus musculus
acaaccagccccugacag

SEQ ID NO: 4033 - RNA, 18 nt, Mus musculus
cuauuccgcuccacagga

SEQ ID NO: 4034 - RNA, 18 nt, Mus musculus
ggagccagcugcuuuucg

SEQ ID NO: 4035 - RNA, 18 nt, Mus musculus
gccagcugcuuuucguga

SEQ ID NO: 4036 - RNA, 18 nt, Mus musculus
uguugcuguuuugacuaa

SEQ ID NO: 4037 - RNA, 18 nt, Mus musculus
ggcgaccgcccgcccacc

SEQ ID NO: 4038 - RNA, 18 nt, Mus musculus
accgcccgcccaccggcc

SEQ ID NO: 4039 - RNA, 18 nt, Mus musculus
cccugcagcugugggacu

SEQ ID NO: 4040 - RNA, 18 nt, Mus musculus
augcacugaccugcucug

SEQ ID NO: 4041 - RNA, 18 nt, Mus musculus
cugaccugcucugucucu

SEQ ID NO: 4042 - RNA, 18 nt, Mus musculus
cugcucugucucucuuau

SEQ ID NO: 4043 - RNA, 18 nt, Mus musculus
ugcguccguccuguggag

SEQ ID NO: 4044 - RNA, 18 nt, Mus musculus
ggccuccgcuguuucggg

SEQ ID NO: 4045 - RNA, 18 nt, Mus musculus
cuccgcuguuucgggccc

SEQ ID NO: 4046 - RNA, 18 nt, Mus musculus
gucuucuguugucuguuu

SEQ ID NO: 4047 - RNA, 18 nt, Mus musculus
guugucuguuuaccaucc

SEQ ID NO: 4048 - RNA, 18 nt, Mus musculus
aucaucaguuccucuagu

SEQ ID NO: 4049 - RNA, 18 nt, Mus musculus
caggccugaccuucgcau

SEQ ID NO: 4050 - RNA, 18 nt, Mus musculus
gcauacugcucacgggga

SEQ ID NO: 4051 - RNA, 18 nt, Mus musculus
ugguccaguuuggccuag

SEQ ID NO: 4052 - RNA, 18 nt, Mus musculus
gccuacugaugggcucaa

SEQ ID NO: 4053 - RNA, 18 nt, Mus musculus
uuauccuguuuuauauau

SEQ ID NO: 4054 - RNA, 18 nt, Mus musculus
caaggcagucugagagga

SEQ ID NO: 4055 - RNA, 18 nt, Mus musculus
aguaucagcccauauuua

SEQ ID NO: 4056 - RNA, 18 nt, Mus musculus
uucaucuguuucauaccu

SEQ ID NO: 4057 - RNA, 18 nt, Mus musculus
ggugcccgcucuuugggg

SEQ ID NO: 4058 - RNA, 18 nt, Mus musculus
cacaccugccggagccgg

SEQ ID NO: 4059 - RNA, 18 nt, Mus musculus
ggucacagcugggcagac

SEQ ID NO: 4060 - RNA, 18 nt, Mus musculus
cugggcagacgaugaaua

SEQ ID NO: 4061 - RNA, 18 nt, Mus musculus
aauagcugcuuugggaga

SEQ ID NO: 4062 - RNA, 18 nt, Mus musculus
auucucugaccgggccag

SEQ ID NO: 4063 - RNA, 18 nt, Mus musculus
gguaccugcuccccugug

SEQ ID NO: 4064 - RNA, 18 nt, Mus musculus
guuuucugucugaugaga

SEQ ID NO: 4065 - RNA, 18 nt, Mus musculus
ucugucugaugagacugg

SEQ ID NO: 4066 - RNA, 18 nt, Mus musculus
ugagacagccugcagccc

SEQ ID NO: 4067 - RNA, 18 nt, Mus musculus
gccugcagcccacugugg

SEQ ID NO: 4068 - RNA, 18 nt, Mus musculus
cuugucggcugcagugug

SEQ ID NO: 4069 - RNA, 18 nt, Mus musculus
agaaacggaugagaacag

SEQ ID NO: 4070 - RNA, 18 nt, Mus musculus
aacagcagccugagguuu

SEQ ID NO: 4071 - RNA, 18 nt, Mus musculus
uuauuccgauuuuaauaa

SEQ ID NO: 4072 - RNA, 18 nt, Mus musculus
ugguucugcuuaaagacu

SEQ ID NO: 4073 - RNA, 15 nt, Homo sapiens
ccgggauauuuauaa

SEQ ID NO: 4074 - RNA, 15 nt, Homo sapiens
aauguauacacaggg

SEQ ID NO: 4075 - RNA, 15 nt, Homo sapiens
ugcaaauauggaaau

SEQ ID NO: 4076 - RNA, 15 nt, Homo sapiens
cucccuuaugaugcc

SEQ ID NO: 4077 - RNA, 15 nt, Homo sapiens
guugaauacugcaaa

SEQ ID NO: 4078 - RNA, 15 nt, Homo sapiens
uaugguuaaaagaug

SEQ ID NO: 4079 - RNA, 15 nt, Homo sapiens
gggauauuuauaaga

SEQ ID NO: 4080 - RNA, 15 nt, Homo sapiens
ggauauuuauaagaa

SEQ ID NO: 4081 - RNA, 15 nt, Homo sapiens
acgugguuaaccugc

SEQ ID NO: 4082 - RNA, 15 nt, Homo sapiens
uauuucuagucauga

SEQ ID NO: 4083 - RNA, 15 nt, Homo sapiens
caauaauagaaggaa

SEQ ID NO: 4084 - RNA, 15 nt, Homo sapiens
gagacuuaaacuggg

SEQ ID NO: 4085 - RNA, 15 nt, Homo sapiens
gaugacuaccagggc

SEQ ID NO: 4086 - RNA, 15 nt, Homo sapiens
uuaauguagaaagaa

SEQ ID NO: 4087 - RNA, 15 nt, Homo sapiens
gccauuuaugacaaa

SEQ ID NO: 4088 - RNA, 15 nt, Homo sapiens
gucaaauuacuuaga

SEQ ID NO: 4089 - RNA, 15 nt, Homo sapiens
auaaaguugggacug

SEQ ID NO: 4090 - RNA, 15 nt, Homo sapiens
acuugguuuaaaaac

SEQ ID NO: 4091 - RNA, 15 nt, Homo sapiens
aagugguucaagcau

SEQ ID NO: 4092 - RNA, 15 nt, Homo sapiens
uucuccuuagguggg

SEQ ID NO: 4093 - RNA, 15 nt, Homo sapiens
ucuccuuaggugggu

SEQ ID NO: 4094 - RNA, 15 nt, Homo sapiens
guacucuacuccuga

SEQ ID NO: 4095 - RNA, 15 nt, Homo sapiens
agcaccuugguugug

SEQ ID NO: 4096 - RNA, 15 nt, Homo sapiens
ggcaaaucacuugga

SEQ ID NO: 4097 - RNA, 15 nt, Homo sapiens
caagcaucagcauuu

SEQ ID NO: 4098 - RNA, 15 nt, Homo sapiens
gagagcuccugagua

SEQ ID NO: 4099 - RNA, 15 nt, Homo sapiens
aaggccucgcucaag

SEQ ID NO: 4100 - RNA, 15 nt, Homo sapiens
ucuccauaucaaaac

SEQ ID NO: 4101 - RNA, 15 nt, Homo sapiens
auguauuuuguauac

SEQ ID NO: 4102 - RNA, 15 nt, Homo sapiens
cuagaauuucuggaa

SEQ ID NO: 4103 - RNA, 15 nt, Homo sapiens
cucucuucuggcucc

SEQ ID NO: 4104 - RNA, 15 nt, Homo sapiens
cuguacuccacccca

SEQ ID NO: 4105 - RNA, 15 nt, Homo sapiens
acaugguuugguccu

SEQ ID NO: 4106 - RNA, 15 nt, Homo sapiens
auggucuuugccuga

SEQ ID NO: 4107 - RNA, 15 nt, Homo sapiens
gcaccauaccuccug

SEQ ID NO: 4108 - RNA, 15 nt, Homo sapiens
gggcuuuuggaaaag

SEQ ID NO: 4109 - RNA, 15 nt, Homo sapiens
ccagacuacaacucg

SEQ ID NO: 4110 - RNA, 15 nt, Homo sapiens
guuuucuccauauca

SEQ ID NO: 4111 - RNA, 15 nt, Homo sapiens
agaauguaugccucu

SEQ ID NO: 4112 - RNA, 15 nt, Homo sapiens
auucccuagugagcc

SEQ ID NO: 4113 - RNA, 15 nt, Homo sapiens
uguuguuccucuucu

SEQ ID NO: 4114 - RNA, 15 nt, Homo sapiens
gcuuccuuuuaucca

SEQ ID NO: 4115 - RNA, 15 nt, Homo sapiens
uauauauucucugcu

SEQ ID NO: 4116 - RNA, 15 nt, Homo sapiens
aguguauccacaggg

SEQ ID NO: 4117 - RNA, 15 nt, Homo sapiens
ugcaaauuuggaaac

SEQ ID NO: 4118 - RNA, 15 nt, Homo sapiens
cugccuuaugaugcc

SEQ ID NO: 4119 - RNA, 15 nt, Homo sapiens
guggaauucugcaaa

SEQ ID NO: 4120 - RNA, 15 nt, Homo sapiens
ugugguuuaaagaua

SEQ ID NO: 4121 - RNA, 15 nt, Homo sapiens
gggauauuuauaaag

SEQ ID NO: 4122 - RNA, 15 nt, Homo sapiens
ggauauuuauaaaga

SEQ ID NO: 4123 - RNA, 15 nt, Homo sapiens
auguggucaaccuuc

SEQ ID NO: 4124 - RNA, 15 nt, Homo sapiens
uacuucuugucauca

SEQ ID NO: 4125 - RNA, 15 nt, Homo sapiens
cucuaauugaaggaa

SEQ ID NO: 4126 - RNA, 15 nt, Homo sapiens
uugacuucaacuggg

SEQ ID NO: 4127 - RNA, 15 nt, Homo sapiens
gaggacuuccaggga

SEQ ID NO: 4128 - RNA, 15 nt, Homo sapiens
aaaauguugaaagaa

SEQ ID NO: 4129 - RNA, 15 nt, Homo sapiens
acaauuuuugacaga

SEQ ID NO: 4130 - RNA, 15 nt, Homo sapiens
uucaaauuacuugca

SEQ ID NO: 4131 - RNA, 15 nt, Homo sapiens
acaaagucgggagag

SEQ ID NO: 4132 - RNA, 15 nt, Homo sapiens
aaaugguauaaaaau

SEQ ID NO: 4133 - RNA, 15 nt, Homo sapiens
acaugguacaagcuu

SEQ ID NO: 4134 - RNA, 15 nt, Homo sapiens
uuuuccuuaggugcu

SEQ ID NO: 4135 - RNA, 15 nt, Homo sapiens
uuuccuuaggugcuu

SEQ ID NO: 4136 - RNA, 15 nt, Homo sapiens
gagcucuccuccugu

SEQ ID NO: 4137 - RNA, 15 nt, Homo sapiens
aguaccuugguuacc

SEQ ID NO: 4138 - RNA, 15 nt, Homo sapiens
gaagcaucagcauaa

SEQ ID NO: 4139 - RNA, 15 nt, Homo sapiens
ggaagcuccugaaga

SEQ ID NO: 4140 - RNA, 15 nt, Homo sapiens
ucugccuugcucaag

SEQ ID NO: 4141 - RNA, 15 nt, Homo sapiens
gguccauuucaaauc

SEQ ID NO: 4142 - RNA, 15 nt, Homo sapiens
gucuauuauguacau

SEQ ID NO: 4143 - RNA, 15 nt, Homo sapiens
auggaaucucuggug

SEQ ID NO: 4144 - RNA, 15 nt, Homo sapiens
uguucuucuggcuac

SEQ ID NO: 4145 - RNA, 15 nt, Homo sapiens
uuauacuacaccaga

SEQ ID NO: 4146 - RNA, 15 nt, Homo sapiens
cagugguaugguucu

SEQ ID NO: 4147 - RNA, 15 nt, Homo sapiens
acggucuaugccauu

SEQ ID NO: 4148 - RNA, 15 nt, Homo sapiens
augccauuccucccc

SEQ ID NO: 4149 - RNA, 15 nt, Homo sapiens
uugcuuuuggaagug

SEQ ID NO: 4150 - RNA, 15 nt, Homo sapiens
auugacuucaacugg

SEQ ID NO: 4151 - RNA, 15 nt, Homo sapiens
ugcuucuccauaucc

SEQ ID NO: 4152 - RNA, 15 nt, Homo sapiens
acuaugucugccuug

SEQ ID NO: 4153 - RNA, 15 nt, Homo sapiens
auacccuugugaaga

SEQ ID NO: 4154 - RNA, 15 nt, Homo sapiens
uaguguuucucuuga

SEQ ID NO: 4155 - RNA, 15 nt, Homo sapiens
auauccucuuaucgg

SEQ ID NO: 4156 - RNA, 15 nt, Homo sapiens
gaaauauccucuuau

SEQ ID NO: 4157 - RNA, 17 nt, Homo sapiens
gcggacacuccucucgg

SEQ ID NO: 4158 - RNA, 17 nt, Homo sapiens
ggacacuccucucggcu

SEQ ID NO: 4159 - RNA, 17 nt, Homo sapiens
gacacuccucucggcuc

SEQ ID NO: 4160 - RNA, 17 nt, Homo sapiens
cacuccucucggcuccu

SEQ ID NO: 4161 - RNA, 17 nt, Homo sapiens
cucucggcuccuccccg

SEQ ID NO: 4162 - RNA, 17 nt, Homo sapiens
cucggcuccuccccggc

SEQ ID NO: 4163 - RNA, 17 nt, Homo sapiens
ucggcuccuccccggca

SEQ ID NO: 4164 - RNA, 17 nt, Homo sapiens
ggcuccuccccggcagc

SEQ ID NO: 4165 - RNA, 17 nt, Homo sapiens
gcuccuccccggcagcg

SEQ ID NO: 4166 - RNA, 17 nt, Homo sapiens
cuccuccccggcagcgg

SEQ ID NO: 4167 - RNA, 17 nt, Homo sapiens
uccccggcagcggcggc

SEQ ID NO: 4168 - RNA, 17 nt, Homo sapiens
gcggcggcucggagcgg

SEQ ID NO: 4169 - RNA, 17 nt, Homo sapiens
gagcgggcuccggggcu

SEQ ID NO: 4170 - RNA, 17 nt, Homo sapiens
gcgggcuccggggcucg

SEQ ID NO: 4171 - RNA, 17 nt, Homo sapiens
uccggggcucgggugca

SEQ ID NO: 4172 - RNA, 17 nt, Homo sapiens
ucgggugcagcggccag

SEQ ID NO: 4173 - RNA, 17 nt, Homo sapiens
gcagcggccagcgggcc

SEQ ID NO: 4174 - RNA, 17 nt, Homo sapiens
cagcggccagcgggccu

SEQ ID NO: 4175 - RNA, 17 nt, Homo sapiens
cagcgggccuggcggcg

SEQ ID NO: 4176 - RNA, 17 nt, Homo sapiens
agcgggccuggcggcga

SEQ ID NO: 4177 - RNA, 17 nt, Homo sapiens
aggauuacccggggaag

SEQ ID NO: 4178 - RNA, 17 nt, Homo sapiens
ggauuacccggggaagu

SEQ ID NO: 4179 - RNA, 17 nt, Homo sapiens
ugguugucuccuggcug

SEQ ID NO: 4180 - RNA, 17 nt, Homo sapiens
guugucuccuggcugga

SEQ ID NO: 4181 - RNA, 17 nt, Homo sapiens
uugucuccuggcuggag

SEQ ID NO: 4182 - RNA, 17 nt, Homo sapiens
cuccuggcuggagccgc

SEQ ID NO: 4183 - RNA, 17 nt, Homo sapiens
gcuggagccgcgagacg

SEQ ID NO: 4184 - RNA, 17 nt, Homo sapiens
acgggcgcucagggcgc

SEQ ID NO: 4185 - RNA, 17 nt, Homo sapiens
gggcgcucagggcgcgg

SEQ ID NO: 4186 - RNA, 17 nt, Homo sapiens
cgcggggccggcggcgg

SEQ ID NO: 4187 - RNA, 17 nt, Homo sapiens
ggacggacucuggcggc

SEQ ID NO: 4188 - RNA, 17 nt, Homo sapiens
acggacucuggcggccg

SEQ ID NO: 4189 - RNA, 17 nt, Homo sapiens
cuggcggccgggucguu

SEQ ID NO: 4190 - RNA, 17 nt, Homo sapiens
ucguuggccgggggagc

SEQ ID NO: 4191 - RNA, 17 nt, Homo sapiens
gcgcgggcaccgggcga

SEQ ID NO: 4192 - RNA, 17 nt, Homo sapiens
gcgggcaccgggcgagc

SEQ ID NO: 4193 - RNA, 17 nt, Homo sapiens
gggcgagcaggccgcgu

SEQ ID NO: 4194 - RNA, 17 nt, Homo sapiens
gagcaggccgcgucgcg

SEQ ID NO: 4195 - RNA, 17 nt, Homo sapiens
cgucgcgcucaccaugg

SEQ ID NO: 4196 - RNA, 17 nt, Homo sapiens
ucgcgcucaccaugguc

SEQ ID NO: 4197 - RNA, 17 nt, Homo sapiens
gcgcucaccauggucag

SEQ ID NO: 4198 - RNA, 17 nt, Homo sapiens
cgcucaccauggucagc

SEQ ID NO: 4199 - RNA, 17 nt, Homo sapiens
ccauggucagcuacugg

SEQ ID NO: 4200 - RNA, 17 nt, Homo sapiens
uggucagcuacugggac

SEQ ID NO: 4201 - RNA, 17 nt, Homo sapiens
ucagcuacugggacacc

SEQ ID NO: 4202 - RNA, 17 nt, Homo sapiens
acugggacaccgggguc

SEQ ID NO: 4203 - RNA, 17 nt, Homo sapiens
ugggacaccgggguccu

SEQ ID NO: 4204 - RNA, 17 nt, Homo sapiens
ccgggguccugcugugc

SEQ ID NO: 4205 - RNA, 17 nt, Homo sapiens
cgggguccugcugugcg

SEQ ID NO: 4206 - RNA, 17 nt, Homo sapiens
gguccugcugugcgcgc

SEQ ID NO: 4207 - RNA, 17 nt, Homo sapiens
gugcgcgcugcucagcu

SEQ ID NO: 4208 - RNA, 17 nt, Homo sapiens
cgcgcugcucagcuguc

SEQ ID NO: 4209 - RNA, 17 nt, Homo sapiens
cgcugcucagcugucug

SEQ ID NO: 4210 - RNA, 17 nt, Homo sapiens
ugcucagcugucugcuu

SEQ ID NO: 4211 - RNA, 17 nt, Homo sapiens
cagcugucugcuucuca

SEQ ID NO: 4212 - RNA, 17 nt, Homo sapiens
cugucugcuucucacag

SEQ ID NO: 4213 - RNA, 17 nt, Homo sapiens
ucugcuucucacaggau

SEQ ID NO: 4214 - RNA, 17 nt, Homo sapiens
ugcuucucacaggaucu

SEQ ID NO: 4215 - RNA, 17 nt, Homo sapiens
cuucucacaggaucuag

SEQ ID NO: 4216 - RNA, 17 nt, Homo sapiens
acaggaucuaguucagg

SEQ ID NO: 4217 - RNA, 17 nt, Homo sapiens
ucuaguucagguucaaa

SEQ ID NO: 4218 - RNA, 17 nt, Homo sapiens
ucagguucaaaauuaaa

SEQ ID NO: 4219 - RNA, 17 nt, Homo sapiens
aaaagauccugaacuga

SEQ ID NO: 4220 - RNA, 17 nt, Homo sapiens
aaagauccugaacugag

SEQ ID NO: 4221 - RNA, 17 nt, Homo sapiens
uccugaacugaguuuaa

SEQ ID NO: 4222 - RNA, 17 nt, Homo sapiens
uaaaaggcacccagcac

SEQ ID NO: 4223 - RNA, 17 nt, Homo sapiens
aaaggcacccagcacau

SEQ ID NO: 4224 - RNA, 17 nt, Homo sapiens
aaggcacccagcacauc

SEQ ID NO: 4225 - RNA, 17 nt, Homo sapiens
aggcacccagcacauca

SEQ ID NO: 4226 - RNA, 17 nt, Homo sapiens
cacccagcacaucaugc

SEQ ID NO: 4227 - RNA, 17 nt, Homo sapiens
cccagcacaucaugcaa

SEQ ID NO: 4228 - RNA, 17 nt, Homo sapiens
agcacaucaugcaagca

SEQ ID NO: 4229 - RNA, 17 nt, Homo sapiens
caucaugcaagcaggcc

SEQ ID NO: 4230 - RNA, 17 nt, Homo sapiens
augcaagcaggccagac

SEQ ID NO: 4231 - RNA, 17 nt, Homo sapiens
aagcaggccagacacug

SEQ ID NO: 4232 - RNA, 17 nt, Homo sapiens
agcaggccagacacugc

SEQ ID NO: 4233 - RNA, 17 nt, Homo sapiens
ggccagacacugcaucu

SEQ ID NO: 4234 - RNA, 17 nt, Homo sapiens
ccagacacugcaucucc

SEQ ID NO: 4235 - RNA, 17 nt, Homo sapiens
gacacugcaucuccaau

SEQ ID NO: 4236 - RNA, 17 nt, Homo sapiens
acugcaucuccaaugca

SEQ ID NO: 4237 - RNA, 17 nt, Homo sapiens
ugcaucuccaaugcagg

SEQ ID NO: 4238 - RNA, 17 nt, Homo sapiens
gcaucuccaaugcaggg

SEQ ID NO: 4239 - RNA, 17 nt, Homo sapiens
uccaaugcaggggggaa

SEQ ID NO: 4240 - RNA, 17 nt, Homo sapiens
ggggaagcagcccauaa

SEQ ID NO: 4241 - RNA, 17 nt, Homo sapiens
gaagcagcccauaaaug

SEQ ID NO: 4242 - RNA, 17 nt, Homo sapiens
aagcagcccauaaaugg

SEQ ID NO: 4243 - RNA, 17 nt, Homo sapiens
agcagcccauaaauggu

SEQ ID NO: 4244 - RNA, 17 nt, Homo sapiens
aaauggucuuugccuga

SEQ ID NO: 4245 - RNA, 17 nt, Homo sapiens
gucuuugccugaaaugg

SEQ ID NO: 4246 - RNA, 17 nt, Homo sapiens
ucuuugccugaaauggu

SEQ ID NO: 4247 - RNA, 17 nt, Homo sapiens
cgaaaggcugagcauaa

SEQ ID NO: 4248 - RNA, 17 nt, Homo sapiens
ggcugagcauaacuaaa

SEQ ID NO: 4249 - RNA, 17 nt, Homo sapiens
agcauaacuaaaucugc

SEQ ID NO: 4250 - RNA, 17 nt, Homo sapiens
acuaaaucugccugugg

SEQ ID NO: 4251 - RNA, 17 nt, Homo sapiens
aaaucugccuguggaag

SEQ ID NO: 4252 - RNA, 17 nt, Homo sapiens
aaucugccuguggaaga

SEQ ID NO: 4253 - RNA, 17 nt, Homo sapiens
gaaauggcaaacaauuc

SEQ ID NO: 4254 - RNA, 17 nt, Homo sapiens
uggcaaacaauucugca

SEQ ID NO: 4255 - RNA, 17 nt, Homo sapiens
aacaauucugcaguacu

SEQ ID NO: 4256 - RNA, 17 nt, Homo sapiens
aauucugcaguacuuua

SEQ ID NO: 4257 - RNA, 17 nt, Homo sapiens
ugcaguacuuuaaccuu

SEQ ID NO: 4258 - RNA, 17 nt, Homo sapiens
acuuuaaccuugaacac

SEQ ID NO: 4259 - RNA, 17 nt, Homo sapiens
cuuuaaccuugaacaca

SEQ ID NO: 4260 - RNA, 17 nt, Homo sapiens
ccuugaacacagcucaa

SEQ ID NO: 4261 - RNA, 17 nt, Homo sapiens
uugaacacagcucaagc

SEQ ID NO: 4262 - RNA, 17 nt, Homo sapiens
aacacagcucaagcaaa

SEQ ID NO: 4263 - RNA, 17 nt, Homo sapiens
cacagcucaagcaaacc

SEQ ID NO: 4264 - RNA, 17 nt, Homo sapiens
gcucaagcaaaccacac

SEQ ID NO: 4265 - RNA, 17 nt, Homo sapiens
aagcaaaccacacuggc

SEQ ID NO: 4266 - RNA, 17 nt, Homo sapiens
agcaaaccacacuggcu

SEQ ID NO: 4267 - RNA, 17 nt, Homo sapiens
caaaccacacuggcuuc

SEQ ID NO: 4268 - RNA, 17 nt, Homo sapiens
aaccacacuggcuucua

SEQ ID NO: 4269 - RNA, 17 nt, Homo sapiens
acacuggcuucuacagc

SEQ ID NO: 4270 - RNA, 17 nt, Homo sapiens
cuggcuucuacagcugc

SEQ ID NO: 4271 - RNA, 17 nt, Homo sapiens
gcuucuacagcugcaaa

SEQ ID NO: 4272 - RNA, 17 nt, Homo sapiens
ucuacagcugcaaauau

SEQ ID NO: 4273 - RNA, 17 nt, Homo sapiens
acagcugcaaauaucua

SEQ ID NO: 4274 - RNA, 17 nt, Homo sapiens
caaauaucuagcuguac

SEQ ID NO: 4275 - RNA, 17 nt, Homo sapiens
uaucuagcuguaccuac

SEQ ID NO: 4276 - RNA, 17 nt, Homo sapiens
agcuguaccuacuucaa

SEQ ID NO: 4277 - RNA, 17 nt, Homo sapiens
gcuguaccuacuucaaa

SEQ ID NO: 4278 - RNA, 17 nt, Homo sapiens
guaccuacuucaaagaa

SEQ ID NO: 4279 - RNA, 17 nt, Homo sapiens
ccuacuucaaagaagaa

SEQ ID NO: 4280 - RNA, 17 nt, Homo sapiens
aaggaaacagaaucugc

SEQ ID NO: 4281 - RNA, 17 nt, Homo sapiens
acagaaucugcaaucua

SEQ ID NO: 4282 - RNA, 17 nt, Homo sapiens
gaaucugcaaucuauau

SEQ ID NO: 4283 - RNA, 17 nt, Homo sapiens
cugcaaucuauauauuu

SEQ ID NO: 4284 - RNA, 17 nt, Homo sapiens
agugauacagguagacc

SEQ ID NO: 4285 - RNA, 17 nt, Homo sapiens
agguagaccuuucguag

SEQ ID NO: 4286 - RNA, 17 nt, Homo sapiens
gguagaccuuucguaga

SEQ ID NO: 4287 - RNA, 17 nt, Homo sapiens
agauguacagugaaauc

SEQ ID NO: 4288 - RNA, 17 nt, Homo sapiens
gugaaauccccgaaauu

SEQ ID NO: 4289 - RNA, 17 nt, Homo sapiens
ugaaauccccgaaauua

SEQ ID NO: 4290 - RNA, 17 nt, Homo sapiens
gaaauccccgaaauuau

SEQ ID NO: 4291 - RNA, 17 nt, Homo sapiens
aauuauacacaugacug

SEQ ID NO: 4292 - RNA, 17 nt, Homo sapiens
uuauacacaugacugaa

SEQ ID NO: 4293 - RNA, 17 nt, Homo sapiens
cacaugacugaaggaag

SEQ ID NO: 4294 - RNA, 17 nt, Homo sapiens
aagggagcucgucauuc

SEQ ID NO: 4295 - RNA, 17 nt, Homo sapiens
agcucgucauucccugc

SEQ ID NO: 4296 - RNA, 17 nt, Homo sapiens
cgucauucccugccggg

SEQ ID NO: 4297 - RNA, 17 nt, Homo sapiens
gucauucccugccgggu

SEQ ID NO: 4298 - RNA, 17 nt, Homo sapiens
ucauucccugccggguu

SEQ ID NO: 4299 - RNA, 17 nt, Homo sapiens
uucccugccggguuacg

SEQ ID NO: 4300 - RNA, 17 nt, Homo sapiens
guuacgucaccuaacau

SEQ ID NO: 4301 - RNA, 17 nt, Homo sapiens
uacgucaccuaacauca

SEQ ID NO: 4302 - RNA, 17 nt, Homo sapiens
acgucaccuaacaucac

SEQ ID NO: 4303 - RNA, 17 nt, Homo sapiens
caccuaacaucacuguu

SEQ ID NO: 4304 - RNA, 17 nt, Homo sapiens
cuaacaucacuguuacu

SEQ ID NO: 4305 - RNA, 17 nt, Homo sapiens
aacaucacuguuacuuu

SEQ ID NO: 4306 - RNA, 17 nt, Homo sapiens
acuguuacuuuaaaaaa

SEQ ID NO: 4307 - RNA, 17 nt, Homo sapiens
aaaguuuccacuugaca

SEQ ID NO: 4308 - RNA, 17 nt, Homo sapiens
aaguuuccacuugacac

SEQ ID NO: 4309 - RNA, 17 nt, Homo sapiens
guuuccacuugacacuu

SEQ ID NO: 4310 - RNA, 17 nt, Homo sapiens
cacuugacacuuugauc

SEQ ID NO: 4311 - RNA, 17 nt, Homo sapiens
cuugacacuuugauccc

SEQ ID NO: 4312 - RNA, 17 nt, Homo sapiens
cuuugaucccugaugga

SEQ ID NO: 4313 - RNA, 17 nt, Homo sapiens
uuugaucccugauggaa

SEQ ID NO: 4314 - RNA, 17 nt, Homo sapiens
uugaucccugauggaaa

SEQ ID NO: 4315 - RNA, 17 nt, Homo sapiens
gaaaacgcauaaucugg

SEQ ID NO: 4316 - RNA, 17 nt, Homo sapiens
gcauaaucugggacagu

SEQ ID NO: 4317 - RNA, 17 nt, Homo sapiens
ucugggacaguagaaag

SEQ ID NO: 4318 - RNA, 17 nt, Homo sapiens
gaaagggcuucaucaua

SEQ ID NO: 4319 - RNA, 17 nt, Homo sapiens
agggcuucaucauauca

SEQ ID NO: 4320 - RNA, 17 nt, Homo sapiens
gcuucaucauaucaaau

SEQ ID NO: 4321 - RNA, 17 nt, Homo sapiens
aucauaucaaaugcaac

SEQ ID NO: 4322 - RNA, 17 nt, Homo sapiens
ucaaaugcaacguacaa

SEQ ID NO: 4323 - RNA, 17 nt, Homo sapiens
caacguacaaagaaaua

SEQ ID NO: 4324 - RNA, 17 nt, Homo sapiens
aauagggcuucugaccu

SEQ ID NO: 4325 - RNA, 17 nt, Homo sapiens
agggcuucugaccugug

SEQ ID NO: 4326 - RNA, 17 nt, Homo sapiens
cuucugaccugugaagc

SEQ ID NO: 4327 - RNA, 17 nt, Homo sapiens
uucugaccugugaagca

SEQ ID NO: 4328 - RNA, 17 nt, Homo sapiens
ugugaagcaacagucaa

SEQ ID NO: 4329 - RNA, 17 nt, Homo sapiens
gaagcaacagucaaugg

SEQ ID NO: 4330 - RNA, 17 nt, Homo sapiens
caacagucaaugggcau

SEQ ID NO: 4331 - RNA, 17 nt, Homo sapiens
caaugggcauuuguaua

SEQ ID NO: 4332 - RNA, 17 nt, Homo sapiens
uauaagacaaacuaucu

SEQ ID NO: 4333 - RNA, 17 nt, Homo sapiens
agacaaacuaucucaca

SEQ ID NO: 4334 - RNA, 17 nt, Homo sapiens
aaacuaucucacacauc

SEQ ID NO: 4335 - RNA, 17 nt, Homo sapiens
acuaucucacacaucga

SEQ ID NO: 4336 - RNA, 17 nt, Homo sapiens
uaucucacacaucgaca

SEQ ID NO: 4337 - RNA, 17 nt, Homo sapiens
ucucacacaucgacaaa

SEQ ID NO: 4338 - RNA, 17 nt, Homo sapiens
acaucgacaaaccaaua

SEQ ID NO: 4339 - RNA, 17 nt, Homo sapiens
cgacaaaccaauacaau

SEQ ID NO: 4340 - RNA, 17 nt, Homo sapiens
gacaaaccaauacaauc

SEQ ID NO: 4341 - RNA, 17 nt, Homo sapiens
accaauacaaucauaga

SEQ ID NO: 4342 - RNA, 17 nt, Homo sapiens
auacaaucauagauguc

SEQ ID NO: 4343 - RNA, 17 nt, Homo sapiens
uagauguccaaauaagc

SEQ ID NO: 4344 - RNA, 17 nt, Homo sapiens
agauguccaaauaagca

SEQ ID NO: 4345 - RNA, 17 nt, Homo sapiens
aaauaagcacaccacgc

SEQ ID NO: 4346 - RNA, 17 nt, Homo sapiens
auaagcacaccacgccc

SEQ ID NO: 4347 - RNA, 17 nt, Homo sapiens
aagcacaccacgcccag

SEQ ID NO: 4348 - RNA, 17 nt, Homo sapiens
agcacaccacgcccagu

SEQ ID NO: 4349 - RNA, 17 nt, Homo sapiens
caccacgcccagucaaa

SEQ ID NO: 4350 - RNA, 17 nt, Homo sapiens
accacgcccagucaaau

SEQ ID NO: 4351 - RNA, 17 nt, Homo sapiens
ccacgcccagucaaauu

SEQ ID NO: 4352 - RNA, 17 nt, Homo sapiens
gcccagucaaauuacuu

SEQ ID NO: 4353 - RNA, 17 nt, Homo sapiens
caaauuacuuagaggcc

SEQ ID NO: 4354 - RNA, 17 nt, Homo sapiens
uuagaggccauacucuu

SEQ ID NO: 4355 - RNA, 17 nt, Homo sapiens
uagaggccauacucuug

SEQ ID NO: 4356 - RNA, 17 nt, Homo sapiens
ggccauacucuuguccu

SEQ ID NO: 4357 - RNA, 17 nt, Homo sapiens
ccauacucuuguccuca

SEQ ID NO: 4358 - RNA, 17 nt, Homo sapiens
cucuuguccucaauugu

SEQ ID NO: 4359 - RNA, 17 nt, Homo sapiens
ucuuguccucaauugua

SEQ ID NO: 4360 - RNA, 17 nt, Homo sapiens
uuguccucaauuguacu

SEQ ID NO: 4361 - RNA, 17 nt, Homo sapiens
aauuguacugcuaccac

SEQ ID NO: 4362 - RNA, 17 nt, Homo sapiens
uguacugcuaccacucc

SEQ ID NO: 4363 - RNA, 17 nt, Homo sapiens
acugcuaccacucccuu

SEQ ID NO: 4364 - RNA, 17 nt, Homo sapiens
cugcuaccacucccuug

SEQ ID NO: 4365 - RNA, 17 nt, Homo sapiens
gcuaccacucccuugaa

SEQ ID NO: 4366 - RNA, 17 nt, Homo sapiens
uaccacucccuugaaca

SEQ ID NO: 4367 - RNA, 17 nt, Homo sapiens
accacucccuugaacac

SEQ ID NO: 4368 - RNA, 17 nt, Homo sapiens
ccacucccuugaacacg

SEQ ID NO: 4369 - RNA, 17 nt, Homo sapiens
ccuugaacacgagaguu

SEQ ID NO: 4370 - RNA, 17 nt, Homo sapiens
gagaguucaaaugaccu

SEQ ID NO: 4371 - RNA, 17 nt, Homo sapiens
caaaugaccuggaguua

SEQ ID NO: 4372 - RNA, 17 nt, Homo sapiens
aaaugaccuggaguuac

SEQ ID NO: 4373 - RNA, 17 nt, Homo sapiens
ggaguuacccugaugaa

SEQ ID NO: 4374 - RNA, 17 nt, Homo sapiens
gaguuacccugaugaaa

SEQ ID NO: 4375 - RNA, 17 nt, Homo sapiens
aguuacccugaugaaaa

SEQ ID NO: 4376 - RNA, 17 nt, Homo sapiens
aagagagcuuccguaag

SEQ ID NO: 4377 - RNA, 17 nt, Homo sapiens
agagcuuccguaaggcg

SEQ ID NO: 4378 - RNA, 17 nt, Homo sapiens
gaauugaccaaagcaau

SEQ ID NO: 4379 - RNA, 17 nt, Homo sapiens
aauugaccaaagcaauu

SEQ ID NO: 4380 - RNA, 17 nt, Homo sapiens
accaaagcaauucccau

SEQ ID NO: 4381 - RNA, 17 nt, Homo sapiens
agcaauucccaugccaa

SEQ ID NO: 4382 - RNA, 17 nt, Homo sapiens
gcaauucccaugccaac

SEQ ID NO: 4383 - RNA, 17 nt, Homo sapiens
caauucccaugccaaca

SEQ ID NO: 4384 - RNA, 17 nt, Homo sapiens
ucccaugccaacauauu

SEQ ID NO: 4385 - RNA, 17 nt, Homo sapiens
cccaugccaacauauuc

SEQ ID NO: 4386 - RNA, 17 nt, Homo sapiens
augccaacauauucuac

SEQ ID NO: 4387 - RNA, 17 nt, Homo sapiens
acauauucuacaguguu

SEQ ID NO: 4388 - RNA, 17 nt, Homo sapiens
uauucuacaguguucuu

SEQ ID NO: 4389 - RNA, 17 nt, Homo sapiens
caguguucuuacuauug

SEQ ID NO: 4390 - RNA, 17 nt, Homo sapiens
guucuuacuauugacaa

SEQ ID NO: 4391 - RNA, 17 nt, Homo sapiens
cuauugacaaaaugcag

SEQ ID NO: 4392 - RNA, 17 nt, Homo sapiens
caaaaugcagaacaaag

SEQ ID NO: 4393 - RNA, 17 nt, Homo sapiens
ugcagaacaaagacaaa

SEQ ID NO: 4394 - RNA, 17 nt, Homo sapiens
acaaagacaaaggacuu

SEQ ID NO: 4395 - RNA, 17 nt, Homo sapiens
caaaggacuuuauacuu

SEQ ID NO: 4396 - RNA, 17 nt, Homo sapiens
cuuuauacuugucgugu

SEQ ID NO: 4397 - RNA, 17 nt, Homo sapiens
gaguggaccaucauuca

SEQ ID NO: 4398 - RNA, 17 nt, Homo sapiens
aguggaccaucauucaa

SEQ ID NO: 4399 - RNA, 17 nt, Homo sapiens
ggaccaucauucaaauc

SEQ ID NO: 4400 - RNA, 17 nt, Homo sapiens
caucauucaaaucuguu

SEQ ID NO: 4401 - RNA, 17 nt, Homo sapiens
uucaaaucuguuaacac

SEQ ID NO: 4402 - RNA, 17 nt, Homo sapiens
cuguuaacaccucagug

SEQ ID NO: 4403 - RNA, 17 nt, Homo sapiens
guuaacaccucagugca

SEQ ID NO: 4404 - RNA, 17 nt, Homo sapiens
uuaacaccucagugcau

SEQ ID NO: 4405 - RNA, 17 nt, Homo sapiens
aacaccucagugcauau

SEQ ID NO: 4406 - RNA, 17 nt, Homo sapiens
cucagugcauauauaug

SEQ ID NO: 4407 - RNA, 17 nt, Homo sapiens
gauaaagcauucaucac

SEQ ID NO: 4408 - RNA, 17 nt, Homo sapiens
aagcauucaucacugug

SEQ ID NO: 4409 - RNA, 17 nt, Homo sapiens
cauucaucacugugaaa

SEQ ID NO: 4410 - RNA, 17 nt, Homo sapiens
uucaucacugugaaaca

SEQ ID NO: 4411 - RNA, 17 nt, Homo sapiens
ugugaaacaucgaaaac

SEQ ID NO: 4412 - RNA, 17 nt, Homo sapiens
ucgaaaacagcaggugc

SEQ ID NO: 4413 - RNA, 17 nt, Homo sapiens
aaaacagcaggugcuug

SEQ ID NO: 4414 - RNA, 17 nt, Homo sapiens
gcaggugcuugaaaccg

SEQ ID NO: 4415 - RNA, 17 nt, Homo sapiens
cuugaaaccguagcugg

SEQ ID NO: 4416 - RNA, 17 nt, Homo sapiens
accguagcuggcaagcg

SEQ ID NO: 4417 - RNA, 17 nt, Homo sapiens
uagcuggcaagcggucu

SEQ ID NO: 4418 - RNA, 17 nt, Homo sapiens
aagcggucuuaccggcu

SEQ ID NO: 4419 - RNA, 17 nt, Homo sapiens
ggucuuaccggcucucu

SEQ ID NO: 4420 - RNA, 17 nt, Homo sapiens
uuaccggcucucuauga

SEQ ID NO: 4421 - RNA, 17 nt, Homo sapiens
accggcucucuaugaaa

SEQ ID NO: 4422 - RNA, 17 nt, Homo sapiens
cggcucucuaugaaagu

SEQ ID NO: 4423 - RNA, 17 nt, Homo sapiens
gugaaggcauuucccuc

SEQ ID NO: 4424 - RNA, 17 nt, Homo sapiens
ggcauuucccucgccgg

SEQ ID NO: 4425 - RNA, 17 nt, Homo sapiens
gcauuucccucgccgga

SEQ ID NO: 4426 - RNA, 17 nt, Homo sapiens
cauuucccucgccggaa

SEQ ID NO: 4427 - RNA, 17 nt, Homo sapiens
ucccucgccggaaguug

SEQ ID NO: 4428 - RNA, 17 nt, Homo sapiens
uggguuaccugcgacug

SEQ ID NO: 4429 - RNA, 17 nt, Homo sapiens
ggguuaccugcgacuga

SEQ ID NO: 4430 - RNA, 17 nt, Homo sapiens
ccugcgacugagaaauc

SEQ ID NO: 4431 - RNA, 17 nt, Homo sapiens
gagaaaucugcucgcua

SEQ ID NO: 4432 - RNA, 17 nt, Homo sapiens
aaaucugcucgcuauuu

SEQ ID NO: 4433 - RNA, 17 nt, Homo sapiens
cugcucgcuauuugacu

SEQ ID NO: 4434 - RNA, 17 nt, Homo sapiens
uauuugacucguggcua

SEQ ID NO: 4435 - RNA, 17 nt, Homo sapiens
cucguggcuacucguua

SEQ ID NO: 4436 - RNA, 17 nt, Homo sapiens
guggcuacucguuaauu

SEQ ID NO: 4437 - RNA, 17 nt, Homo sapiens
uaauuaucaaggacgua

SEQ ID NO: 4438 - RNA, 17 nt, Homo sapiens
gacguaacugaagagga

SEQ ID NO: 4439 - RNA, 17 nt, Homo sapiens
gaggaugcagggaauua

SEQ ID NO: 4440 - RNA, 17 nt, Homo sapiens
aauuauacaaucuugcu

SEQ ID NO: 4441 - RNA, 17 nt, Homo sapiens
auacaaucuugcugagc

SEQ ID NO: 4442 - RNA, 17 nt, Homo sapiens
aaucuugcugagcauaa

SEQ ID NO: 4443 - RNA, 17 nt, Homo sapiens
ugcugagcauaaaacag

SEQ ID NO: 4444 - RNA, 17 nt, Homo sapiens
cauaaaacagucaaaug

SEQ ID NO: 4445 - RNA, 17 nt, Homo sapiens
aaacagucaaauguguu

SEQ ID NO: 4446 - RNA, 17 nt, Homo sapiens
uuaaaaaccucacugcc

SEQ ID NO: 4447 - RNA, 17 nt, Homo sapiens
uaaaaaccucacugcca

SEQ ID NO: 4448 - RNA, 17 nt, Homo sapiens
aaaaccucacugccacu

SEQ ID NO: 4449 - RNA, 17 nt, Homo sapiens
aaccucacugccacucu

SEQ ID NO: 4450 - RNA, 17 nt, Homo sapiens
cucacugccacucuaau

SEQ ID NO: 4451 - RNA, 17 nt, Homo sapiens
ucacugccacucuaauu

SEQ ID NO: 4452 - RNA, 17 nt, Homo sapiens
acugccacucuaauugu

SEQ ID NO: 4453 - RNA, 17 nt, Homo sapiens
ugccacucuaauuguca

SEQ ID NO: 4454 - RNA, 17 nt, Homo sapiens
uaauugucaaugugaaa

SEQ ID NO: 4455 - RNA, 17 nt, Homo sapiens
ugugaaaccccagauuu

SEQ ID NO: 4456 - RNA, 17 nt, Homo sapiens
gugaaaccccagauuua

SEQ ID NO: 4457 - RNA, 17 nt, Homo sapiens
ugaaaccccagauuuac

SEQ ID NO: 4458 - RNA, 17 nt, Homo sapiens
gaaaccccagauuuacg

SEQ ID NO: 4459 - RNA, 17 nt, Homo sapiens
gaaaaggccgugucauc

SEQ ID NO: 4460 - RNA, 17 nt, Homo sapiens
gccgugucaucguuucc

SEQ ID NO: 4461 - RNA, 17 nt, Homo sapiens
aucguuuccagacccgg

SEQ ID NO: 4462 - RNA, 17 nt, Homo sapiens
ucguuuccagacccggc

SEQ ID NO: 4463 - RNA, 17 nt, Homo sapiens
uuccagacccggcucuc

SEQ ID NO: 4464 - RNA, 17 nt, Homo sapiens
uccagacccggcucucu

SEQ ID NO: 4465 - RNA, 17 nt, Homo sapiens
gacccggcucucuaccc

SEQ ID NO: 4466 - RNA, 17 nt, Homo sapiens
cccggcucucuacccac

SEQ ID NO: 4467 - RNA, 17 nt, Homo sapiens
cggcucucuacccacug

SEQ ID NO: 4468 - RNA, 17 nt, Homo sapiens
cucucuacccacugggc

SEQ ID NO: 4469 - RNA, 17 nt, Homo sapiens
ucucuacccacugggca

SEQ ID NO: 4470 - RNA, 17 nt, Homo sapiens
cucuacccacugggcag

SEQ ID NO: 4471 - RNA, 17 nt, Homo sapiens
cuacccacugggcagca

SEQ ID NO: 4472 - RNA, 17 nt, Homo sapiens
cacugggcagcagacaa

SEQ ID NO: 4473 - RNA, 17 nt, Homo sapiens
ugggcagcagacaaauc

SEQ ID NO: 4474 - RNA, 17 nt, Homo sapiens
cagcagacaaauccuga

SEQ ID NO: 4475 - RNA, 17 nt, Homo sapiens
gacaaauccugacuugu

SEQ ID NO: 4476 - RNA, 17 nt, Homo sapiens
acaaauccugacuugua

SEQ ID NO: 4477 - RNA, 17 nt, Homo sapiens
auccugacuuguaccgc

SEQ ID NO: 4478 - RNA, 17 nt, Homo sapiens
acuuguaccgcauaugg

SEQ ID NO: 4479 - RNA, 17 nt, Homo sapiens
uguaccgcauaugguau

SEQ ID NO: 4480 - RNA, 17 nt, Homo sapiens
augguaucccucaaccu

SEQ ID NO: 4481 - RNA, 17 nt, Homo sapiens
ugguaucccucaaccua

SEQ ID NO: 4482 - RNA, 17 nt, Homo sapiens
gguaucccucaaccuac

SEQ ID NO: 4483 - RNA, 17 nt, Homo sapiens
uaucccucaaccuacaa

SEQ ID NO: 4484 - RNA, 17 nt, Homo sapiens
cccucaaccuacaauca

SEQ ID NO: 4485 - RNA, 17 nt, Homo sapiens
ccucaaccuacaaucaa

SEQ ID NO: 4486 - RNA, 17 nt, Homo sapiens
caaccuacaaucaagug

SEQ ID NO: 4487 - RNA, 17 nt, Homo sapiens
cuacaaucaagugguuc

SEQ ID NO: 4488 - RNA, 17 nt, Homo sapiens
agugguucuggcacccc

SEQ ID NO: 4489 - RNA, 17 nt, Homo sapiens
guucuggcaccccugua

SEQ ID NO: 4490 - RNA, 17 nt, Homo sapiens
ucuggcaccccuguaac

SEQ ID NO: 4491 - RNA, 17 nt, Homo sapiens
cuggcaccccuguaacc

SEQ ID NO: 4492 - RNA, 17 nt, Homo sapiens
uggcaccccuguaacca

SEQ ID NO: 4493 - RNA, 17 nt, Homo sapiens
ggcaccccuguaaccau

SEQ ID NO: 4494 - RNA, 17 nt, Homo sapiens
ccuguaaccauaaucau

SEQ ID NO: 4495 - RNA, 17 nt, Homo sapiens
cuguaaccauaaucauu

SEQ ID NO: 4496 - RNA, 17 nt, Homo sapiens
ccauaaucauuccgaag

SEQ ID NO: 4497 - RNA, 17 nt, Homo sapiens
aaucauuccgaagcaag

SEQ ID NO: 4498 - RNA, 17 nt, Homo sapiens
uccgaagcaagguguga

SEQ ID NO: 4499 - RNA, 17 nt, Homo sapiens
ggugugacuuuuguucc

SEQ ID NO: 4500 - RNA, 17 nt, Homo sapiens
uuuuguuccaauaauga

SEQ ID NO: 4501 - RNA, 17 nt, Homo sapiens
uuuguuccaauaaugaa

SEQ ID NO: 4502 - RNA, 17 nt, Homo sapiens
gaagaguccuuuauccu

SEQ ID NO: 4503 - RNA, 17 nt, Homo sapiens
aagaguccuuuauccug

SEQ ID NO: 4504 - RNA, 17 nt, Homo sapiens
ccuuuauccuggaugcu

SEQ ID NO: 4505 - RNA, 17 nt, Homo sapiens
cuuuauccuggaugcug

SEQ ID NO: 4506 - RNA, 17 nt, Homo sapiens
cuggaugcugacagcaa

SEQ ID NO: 4507 - RNA, 17 nt, Homo sapiens
augcugacagcaacaug

SEQ ID NO: 4508 - RNA, 17 nt, Homo sapiens
cugacagcaacauggga

SEQ ID NO: 4509 - RNA, 17 nt, Homo sapiens
acagcaacaugggaaac

SEQ ID NO: 4510 - RNA, 17 nt, Homo sapiens
ugggaaacagaauugag

SEQ ID NO: 4511 - RNA, 17 nt, Homo sapiens
uugagagcaucacucag

SEQ ID NO: 4512 - RNA, 17 nt, Homo sapiens
agagcaucacucagcgc

SEQ ID NO: 4513 - RNA, 17 nt, Homo sapiens
agcaucacucagcgcau

SEQ ID NO: 4514 - RNA, 17 nt, Homo sapiens
caucacucagcgcaugg

SEQ ID NO: 4515 - RNA, 17 nt, Homo sapiens
cucagcgcauggcaaua

SEQ ID NO: 4516 - RNA, 17 nt, Homo sapiens
cgcauggcaauaauaga

SEQ ID NO: 4517 - RNA, 17 nt, Homo sapiens
aagauggcuagcaccuu

SEQ ID NO: 4518 - RNA, 17 nt, Homo sapiens
uggcuagcaccuugguu

SEQ ID NO: 4519 - RNA, 17 nt, Homo sapiens
gcuagcaccuugguugu

SEQ ID NO: 4520 - RNA, 17 nt, Homo sapiens
cuagcaccuugguugug

SEQ ID NO: 4521 - RNA, 17 nt, Homo sapiens
guuguggcugacucuag

SEQ ID NO: 4522 - RNA, 17 nt, Homo sapiens
uggcugacucuagaauu

SEQ ID NO: 4523 - RNA, 17 nt, Homo sapiens
gcugacucuagaauuuc

SEQ ID NO: 4524 - RNA, 17 nt, Homo sapiens
agaauuucuggaaucua

SEQ ID NO: 4525 - RNA, 17 nt, Homo sapiens
cuggaaucuacauuugc

SEQ ID NO: 4526 - RNA, 17 nt, Homo sapiens
gaaucuacauuugcaua

SEQ ID NO: 4527 - RNA, 17 nt, Homo sapiens
acauuugcauagcuucc

SEQ ID NO: 4528 - RNA, 17 nt, Homo sapiens
ugcauagcuuccaauaa

SEQ ID NO: 4529 - RNA, 17 nt, Homo sapiens
auagcuuccaauaaagu

SEQ ID NO: 4530 - RNA, 17 nt, Homo sapiens
uagcuuccaauaaaguu

SEQ ID NO: 4531 - RNA, 17 nt, Homo sapiens
guugggacugugggaag

SEQ ID NO: 4532 - RNA, 17 nt, Homo sapiens
gaagaaacauaagcuuu

SEQ ID NO: 4533 - RNA, 17 nt, Homo sapiens
acauaagcuuuuauauc

SEQ ID NO: 4534 - RNA, 17 nt, Homo sapiens
uuuauaucacagaugug

SEQ ID NO: 4535 - RNA, 17 nt, Homo sapiens
uauaucacagaugugcc

SEQ ID NO: 4536 - RNA, 17 nt, Homo sapiens
agaugugccaaaugggu

SEQ ID NO: 4537 - RNA, 17 nt, Homo sapiens
gaugugccaaauggguu

SEQ ID NO: 4538 - RNA, 17 nt, Homo sapiens
uggguuucauguuaacu

SEQ ID NO: 4539 - RNA, 17 nt, Homo sapiens
auguuaacuuggaaaaa

SEQ ID NO: 4540 - RNA, 17 nt, Homo sapiens
aaaaaugccgacggaag

SEQ ID NO: 4541 - RNA, 17 nt, Homo sapiens
gagaggaccugaaacug

SEQ ID NO: 4542 - RNA, 17 nt, Homo sapiens
agaggaccugaaacugu

SEQ ID NO: 4543 - RNA, 17 nt, Homo sapiens
ccugaaacugucuugca

SEQ ID NO: 4544 - RNA, 17 nt, Homo sapiens
aaacugucuugcacagu

SEQ ID NO: 4545 - RNA, 17 nt, Homo sapiens
ugucuugcacaguuaac

SEQ ID NO: 4546 - RNA, 17 nt, Homo sapiens
ucuugcacaguuaacaa

SEQ ID NO: 4547 - RNA, 17 nt, Homo sapiens
caguuaacaaguucuua

SEQ ID NO: 4548 - RNA, 17 nt, Homo sapiens
acaaguucuuauacaga

SEQ ID NO: 4549 - RNA, 17 nt, Homo sapiens
ucuuauacagagacguu

SEQ ID NO: 4550 - RNA, 17 nt, Homo sapiens
gacguuacuuggauuuu

SEQ ID NO: 4551 - RNA, 17 nt, Homo sapiens
gauuuuacugcggacag

SEQ ID NO: 4552 - RNA, 17 nt, Homo sapiens
cugcggacaguuaauaa

SEQ ID NO: 4553 - RNA, 17 nt, Homo sapiens
uuaauaacagaacaaug

SEQ ID NO: 4554 - RNA, 17 nt, Homo sapiens
aacagaacaaugcacua

SEQ ID NO: 4555 - RNA, 17 nt, Homo sapiens
aacaaugcacuacagua

SEQ ID NO: 4556 - RNA, 17 nt, Homo sapiens
caaugcacuacaguauu

SEQ ID NO: 4557 - RNA, 17 nt, Homo sapiens
ugcacuacaguauuagc

SEQ ID NO: 4558 - RNA, 17 nt, Homo sapiens
guauuagcaagcaaaaa

SEQ ID NO: 4559 - RNA, 17 nt, Homo sapiens
uagcaagcaaaaaaugg

SEQ ID NO: 4560 - RNA, 17 nt, Homo sapiens
aaaauggccaucacuaa

SEQ ID NO: 4561 - RNA, 17 nt, Homo sapiens
aaauggccaucacuaag

SEQ ID NO: 4562 - RNA, 17 nt, Homo sapiens
uggccaucacuaaggag

SEQ ID NO: 4563 - RNA, 17 nt, Homo sapiens
gccaucacuaaggagca

SEQ ID NO: 4564 - RNA, 17 nt, Homo sapiens
uaaggagcacuccauca

SEQ ID NO: 4565 - RNA, 17 nt, Homo sapiens
aggagcacuccaucacu

SEQ ID NO: 4566 - RNA, 17 nt, Homo sapiens
gagcacuccaucacucu

SEQ ID NO: 4567 - RNA, 17 nt, Homo sapiens
agcacuccaucacucuu

SEQ ID NO: 4568 - RNA, 17 nt, Homo sapiens
acuccaucacucuuaau

SEQ ID NO: 4569 - RNA, 17 nt, Homo sapiens
uccaucacucuuaaucu

SEQ ID NO: 4570 - RNA, 17 nt, Homo sapiens
caucacucuuaaucuua

SEQ ID NO: 4571 - RNA, 17 nt, Homo sapiens
ucuuaaucuuaccauca

SEQ ID NO: 4572 - RNA, 17 nt, Homo sapiens
aaucuuaccaucaugaa

SEQ ID NO: 4573 - RNA, 17 nt, Homo sapiens
aucuuaccaucaugaau

SEQ ID NO: 4574 - RNA, 17 nt, Homo sapiens
uuaccaucaugaauguu

SEQ ID NO: 4575 - RNA, 17 nt, Homo sapiens
aauguuucccugcaaga

SEQ ID NO: 4576 - RNA, 17 nt, Homo sapiens
auguuucccugcaagau

SEQ ID NO: 4577 - RNA, 17 nt, Homo sapiens
uguuucccugcaagauu

SEQ ID NO: 4578 - RNA, 17 nt, Homo sapiens
uucccugcaagauucag

SEQ ID NO: 4579 - RNA, 17 nt, Homo sapiens
caagauucaggcaccua

SEQ ID NO: 4580 - RNA, 17 nt, Homo sapiens
auucaggcaccuaugcc

SEQ ID NO: 4581 - RNA, 17 nt, Homo sapiens
ucaggcaccuaugccug

SEQ ID NO: 4582 - RNA, 17 nt, Homo sapiens
caggcaccuaugccugc

SEQ ID NO: 4583 - RNA, 17 nt, Homo sapiens
accuaugccugcagagc

SEQ ID NO: 4584 - RNA, 17 nt, Homo sapiens
ccuaugccugcagagcc

SEQ ID NO: 4585 - RNA, 17 nt, Homo sapiens
augccugcagagccagg

SEQ ID NO: 4586 - RNA, 17 nt, Homo sapiens
ugcagagccaggaaugu

SEQ ID NO: 4587 - RNA, 17 nt, Homo sapiens
gcagagccaggaaugua

SEQ ID NO: 4588 - RNA, 17 nt, Homo sapiens
auguauacacaggggaa

SEQ ID NO: 4589 - RNA, 17 nt, Homo sapiens
guauacacaggggaaga

SEQ ID NO: 4590 - RNA, 17 nt, Homo sapiens
aagaaauccuccagaag

SEQ ID NO: 4591 - RNA, 17 nt, Homo sapiens
agaaauccuccagaaga

SEQ ID NO: 4592 - RNA, 17 nt, Homo sapiens
aaauccuccagaagaaa

SEQ ID NO: 4593 - RNA, 17 nt, Homo sapiens
aauccuccagaagaaag

SEQ ID NO: 4594 - RNA, 17 nt, Homo sapiens
gaaauuacaaucagaga

SEQ ID NO: 4595 - RNA, 17 nt, Homo sapiens
uuacaaucagagaucag

SEQ ID NO: 4596 - RNA, 17 nt, Homo sapiens
cagagaucaggaagcac

SEQ ID NO: 4597 - RNA, 17 nt, Homo sapiens
caggaagcaccauaccu

SEQ ID NO: 4598 - RNA, 17 nt, Homo sapiens
ggaagcaccauaccucc

SEQ ID NO: 4599 - RNA, 17 nt, Homo sapiens
gaagcaccauaccuccu

SEQ ID NO: 4600 - RNA, 17 nt, Homo sapiens
caccauaccuccugcga

SEQ ID NO: 4601 - RNA, 17 nt, Homo sapiens
accauaccuccugcgaa

SEQ ID NO: 4602 - RNA, 17 nt, Homo sapiens
cauaccuccugcgaaac

SEQ ID NO: 4603 - RNA, 17 nt, Homo sapiens
auaccuccugcgaaacc

SEQ ID NO: 4604 - RNA, 17 nt, Homo sapiens
ugcgaaaccucagugau

SEQ ID NO: 4605 - RNA, 17 nt, Homo sapiens
gcgaaaccucagugauc

SEQ ID NO: 4606 - RNA, 17 nt, Homo sapiens
gaaaccucagugaucac

SEQ ID NO: 4607 - RNA, 17 nt, Homo sapiens
cagugaucacacagugg

SEQ ID NO: 4608 - RNA, 17 nt, Homo sapiens
gugaucacacaguggcc

SEQ ID NO: 4609 - RNA, 17 nt, Homo sapiens
gaucacacaguggccau

SEQ ID NO: 4610 - RNA, 17 nt, Homo sapiens
acaguggccaucagcag

SEQ ID NO: 4611 - RNA, 17 nt, Homo sapiens
caguggccaucagcagu

SEQ ID NO: 4612 - RNA, 17 nt, Homo sapiens
uggccaucagcaguucc

SEQ ID NO: 4613 - RNA, 17 nt, Homo sapiens
ccaucagcaguuccacc

SEQ ID NO: 4614 - RNA, 17 nt, Homo sapiens
agcaguuccaccacuuu

SEQ ID NO: 4615 - RNA, 17 nt, Homo sapiens
gcaguuccaccacuuua

SEQ ID NO: 4616 - RNA, 17 nt, Homo sapiens
aguuccaccacuuuaga

SEQ ID NO: 4617 - RNA, 17 nt, Homo sapiens
guuccaccacuuuagac

SEQ ID NO: 4618 - RNA, 17 nt, Homo sapiens
uccaccacuuuagacug

SEQ ID NO: 4619 - RNA, 17 nt, Homo sapiens
cuuuagacugucaugcu

SEQ ID NO: 4620 - RNA, 17 nt, Homo sapiens
agacugucaugcuaaug

SEQ ID NO: 4621 - RNA, 17 nt, Homo sapiens
ugucaugcuaauggugu

SEQ ID NO: 4622 - RNA, 17 nt, Homo sapiens
augguguccccgagccu

SEQ ID NO: 4623 - RNA, 17 nt, Homo sapiens
ugguguccccgagccuc

SEQ ID NO: 4624 - RNA, 17 nt, Homo sapiens
gguguccccgagccuca

SEQ ID NO: 4625 - RNA, 17 nt, Homo sapiens
ccccgagccucagauca

SEQ ID NO: 4626 - RNA, 17 nt, Homo sapiens
cccgagccucagaucac

SEQ ID NO: 4627 - RNA, 17 nt, Homo sapiens
cgagccucagaucacuu

SEQ ID NO: 4628 - RNA, 17 nt, Homo sapiens
cucagaucacuugguuu

SEQ ID NO: 4629 - RNA, 17 nt, Homo sapiens
cagaucacuugguuuaa

SEQ ID NO: 4630 - RNA, 17 nt, Homo sapiens
uuaaaaacaaccacaaa

SEQ ID NO: 4631 - RNA, 17 nt, Homo sapiens
aaaacaaccacaaaaua

SEQ ID NO: 4632 - RNA, 17 nt, Homo sapiens
aaacaaccacaaaauac

SEQ ID NO: 4633 - RNA, 17 nt, Homo sapiens
acaaccacaaaauacaa

SEQ ID NO: 4634 - RNA, 17 nt, Homo sapiens
caaaauacaacaagagc

SEQ ID NO: 4635 - RNA, 17 nt, Homo sapiens
aauacaacaagagccug

SEQ ID NO: 4636 - RNA, 17 nt, Homo sapiens
acaagagccuggaauua

SEQ ID NO: 4637 - RNA, 17 nt, Homo sapiens
caagagccuggaauuau

SEQ ID NO: 4638 - RNA, 17 nt, Homo sapiens
uuuaggaccaggaagca

SEQ ID NO: 4639 - RNA, 17 nt, Homo sapiens
uuaggaccaggaagcag

SEQ ID NO: 4640 - RNA, 17 nt, Homo sapiens
caggaagcagcacgcug

SEQ ID NO: 4641 - RNA, 17 nt, Homo sapiens
gaagcagcacgcuguuu

SEQ ID NO: 4642 - RNA, 17 nt, Homo sapiens
cagcacgcuguuuauug

SEQ ID NO: 4643 - RNA, 17 nt, Homo sapiens
aaagagucacagaagag

SEQ ID NO: 4644 - RNA, 17 nt, Homo sapiens
agagucacagaagagga

SEQ ID NO: 4645 - RNA, 17 nt, Homo sapiens
aaggugucuaucacugc

SEQ ID NO: 4646 - RNA, 17 nt, Homo sapiens
ugucuaucacugcaaag

SEQ ID NO: 4647 - RNA, 17 nt, Homo sapiens
ucuaucacugcaaagcc

SEQ ID NO: 4648 - RNA, 17 nt, Homo sapiens
aucacugcaaagccacc

SEQ ID NO: 4649 - RNA, 17 nt, Homo sapiens
ugcaaagccaccaacca

SEQ ID NO: 4650 - RNA, 17 nt, Homo sapiens
gcaaagccaccaaccag

SEQ ID NO: 4651 - RNA, 17 nt, Homo sapiens
aaagccaccaaccagaa

SEQ ID NO: 4652 - RNA, 17 nt, Homo sapiens
aagccaccaaccagaag

SEQ ID NO: 4653 - RNA, 17 nt, Homo sapiens
ccaccaaccagaagggc

SEQ ID NO: 4654 - RNA, 17 nt, Homo sapiens
caccaaccagaagggcu

SEQ ID NO: 4655 - RNA, 17 nt, Homo sapiens
agaagggcucuguggaa

SEQ ID NO: 4656 - RNA, 17 nt, Homo sapiens
aagggcucuguggaaag

SEQ ID NO: 4657 - RNA, 17 nt, Homo sapiens
gaaaguucagcauaccu

SEQ ID NO: 4658 - RNA, 17 nt, Homo sapiens
aguucagcauaccucac

SEQ ID NO: 4659 - RNA, 17 nt, Homo sapiens
cagcauaccucacuguu

SEQ ID NO: 4660 - RNA, 17 nt, Homo sapiens
agcauaccucacuguuc

SEQ ID NO: 4661 - RNA, 17 nt, Homo sapiens
cauaccucacuguucaa

SEQ ID NO: 4662 - RNA, 17 nt, Homo sapiens
uaccucacuguucaagg

SEQ ID NO: 4663 - RNA, 17 nt, Homo sapiens
cacuguucaaggaaccu

SEQ ID NO: 4664 - RNA, 17 nt, Homo sapiens
caaggaaccucggacaa

SEQ ID NO: 4665 - RNA, 17 nt, Homo sapiens
aaggaaccucggacaag

SEQ ID NO: 4666 - RNA, 17 nt, Homo sapiens
ccucggacaagucuaau

SEQ ID NO: 4667 - RNA, 17 nt, Homo sapiens
gacaagucuaaucugga

SEQ ID NO: 4668 - RNA, 17 nt, Homo sapiens
gucuaaucuggagcuga

SEQ ID NO: 4669 - RNA, 17 nt, Homo sapiens
ucuggagcugaucacuc

SEQ ID NO: 4670 - RNA, 17 nt, Homo sapiens
agcugaucacucuaaca

SEQ ID NO: 4671 - RNA, 17 nt, Homo sapiens
cugaucacucuaacaug

SEQ ID NO: 4672 - RNA, 17 nt, Homo sapiens
gaucacucuaacaugca

SEQ ID NO: 4673 - RNA, 17 nt, Homo sapiens
acucuaacaugcaccug

SEQ ID NO: 4674 - RNA, 17 nt, Homo sapiens
uaacaugcaccugugug

SEQ ID NO: 4675 - RNA, 17 nt, Homo sapiens
acaugcaccuguguggc

SEQ ID NO: 4676 - RNA, 17 nt, Homo sapiens
caugcaccuguguggcu

SEQ ID NO: 4677 - RNA, 17 nt, Homo sapiens
uguguggcugcgacucu

SEQ ID NO: 4678 - RNA, 17 nt, Homo sapiens
gcugcgacucucuucug

SEQ ID NO: 4679 - RNA, 17 nt, Homo sapiens
ugcgacucucuucuggc

SEQ ID NO: 4680 - RNA, 17 nt, Homo sapiens
cgacucucuucuggcuc

SEQ ID NO: 4681 - RNA, 17 nt, Homo sapiens
cucucuucuggcuccua

SEQ ID NO: 4682 - RNA, 17 nt, Homo sapiens
cuucuggcuccuauuaa

SEQ ID NO: 4683 - RNA, 17 nt, Homo sapiens
ucuggcuccuauuaacc

SEQ ID NO: 4684 - RNA, 17 nt, Homo sapiens
cuggcuccuauuaaccc

SEQ ID NO: 4685 - RNA, 17 nt, Homo sapiens
cuauuaacccuccuuau

SEQ ID NO: 4686 - RNA, 17 nt, Homo sapiens
uauuaacccuccuuauc

SEQ ID NO: 4687 - RNA, 17 nt, Homo sapiens
auuaacccuccuuaucc

SEQ ID NO: 4688 - RNA, 17 nt, Homo sapiens
uaacccuccuuauccga

SEQ ID NO: 4689 - RNA, 17 nt, Homo sapiens
aacccuccuuauccgaa

SEQ ID NO: 4690 - RNA, 17 nt, Homo sapiens
uccuuauccgaaaaaug

SEQ ID NO: 4691 - RNA, 17 nt, Homo sapiens
aaaaggucuucuucuga

SEQ ID NO: 4692 - RNA, 17 nt, Homo sapiens
aggucuucuucugaaau

SEQ ID NO: 4693 - RNA, 17 nt, Homo sapiens
ucuucuucugaaauaaa

SEQ ID NO: 4694 - RNA, 17 nt, Homo sapiens
auaaagacugacuaccu

SEQ ID NO: 4695 - RNA, 17 nt, Homo sapiens
agacugacuaccuauca

SEQ ID NO: 4696 - RNA, 17 nt, Homo sapiens
cugacuaccuaucaauu

SEQ ID NO: 4697 - RNA, 17 nt, Homo sapiens
ugacuaccuaucaauua

SEQ ID NO: 4698 - RNA, 17 nt, Homo sapiens
uaccuaucaauuauaau

SEQ ID NO: 4699 - RNA, 17 nt, Homo sapiens
uaauggacccagaugaa

SEQ ID NO: 4700 - RNA, 17 nt, Homo sapiens
aauggacccagaugaag

SEQ ID NO: 4701 - RNA, 17 nt, Homo sapiens
auggacccagaugaagu

SEQ ID NO: 4702 - RNA, 17 nt, Homo sapiens
ugaaguuccuuuggaug

SEQ ID NO: 4703 - RNA, 17 nt, Homo sapiens
gaaguuccuuuggauga

SEQ ID NO: 4704 - RNA, 17 nt, Homo sapiens
ggaugagcagugugagc

SEQ ID NO: 4705 - RNA, 17 nt, Homo sapiens
ugagcggcucccuuaug

SEQ ID NO: 4706 - RNA, 17 nt, Homo sapiens
agcggcucccuuaugau

SEQ ID NO: 4707 - RNA, 17 nt, Homo sapiens
gcggcucccuuaugaug

SEQ ID NO: 4708 - RNA, 17 nt, Homo sapiens
cggcucccuuaugaugc

SEQ ID NO: 4709 - RNA, 17 nt, Homo sapiens
uaugaugccagcaagug

SEQ ID NO: 4710 - RNA, 17 nt, Homo sapiens
augaugccagcaagugg

SEQ ID NO: 4711 - RNA, 17 nt, Homo sapiens
augccagcaagugggag

SEQ ID NO: 4712 - RNA, 17 nt, Homo sapiens
gaguuugcccgggagag

SEQ ID NO: 4713 - RNA, 17 nt, Homo sapiens
aguuugcccgggagaga

SEQ ID NO: 4714 - RNA, 17 nt, Homo sapiens
ggagagacuuaaacugg

SEQ ID NO: 4715 - RNA, 17 nt, Homo sapiens
acuuaaacugggcaaau

SEQ ID NO: 4716 - RNA, 17 nt, Homo sapiens
aacugggcaaaucacuu

SEQ ID NO: 4717 - RNA, 17 nt, Homo sapiens
ggcaaaucacuuggaag

SEQ ID NO: 4718 - RNA, 17 nt, Homo sapiens
caaaucacuuggaagag

SEQ ID NO: 4719 - RNA, 17 nt, Homo sapiens
agaggggcuuuuggaaa

SEQ ID NO: 4720 - RNA, 17 nt, Homo sapiens
agugguucaagcaucag

SEQ ID NO: 4721 - RNA, 17 nt, Homo sapiens
guucaagcaucagcauu

SEQ ID NO: 4722 - RNA, 17 nt, Homo sapiens
caagcaucagcauuugg

SEQ ID NO: 4723 - RNA, 17 nt, Homo sapiens
gcaucagcauuuggcau

SEQ ID NO: 4724 - RNA, 17 nt, Homo sapiens
cauuuggcauuaagaaa

SEQ ID NO: 4725 - RNA, 17 nt, Homo sapiens
aagaaaucaccuacgug

SEQ ID NO: 4726 - RNA, 17 nt, Homo sapiens
gaaaucaccuacgugcc

SEQ ID NO: 4727 - RNA, 17 nt, Homo sapiens
aaaucaccuacgugccg

SEQ ID NO: 4728 - RNA, 17 nt, Homo sapiens
cuacgugccggacugug

SEQ ID NO: 4729 - RNA, 17 nt, Homo sapiens
ugccggacuguggcugu

SEQ ID NO: 4730 - RNA, 17 nt, Homo sapiens
acuguggcugugaaaau

SEQ ID NO: 4731 - RNA, 17 nt, Homo sapiens
gaaaaugcugaaagagg

SEQ ID NO: 4732 - RNA, 17 nt, Homo sapiens
gagggggccacggccag

SEQ ID NO: 4733 - RNA, 17 nt, Homo sapiens
agggggccacggccagc

SEQ ID NO: 4734 - RNA, 17 nt, Homo sapiens
gccacggccagcgagua

SEQ ID NO: 4735 - RNA, 17 nt, Homo sapiens
ccacggccagcgaguac

SEQ ID NO: 4736 - RNA, 17 nt, Homo sapiens
gcgaguacaaagcucug

SEQ ID NO: 4737 - RNA, 17 nt, Homo sapiens
uacaaagcucugaugac

SEQ ID NO: 4738 - RNA, 17 nt, Homo sapiens
caaagcucugaugacug

SEQ ID NO: 4739 - RNA, 17 nt, Homo sapiens
cugaugacugagcuaaa

SEQ ID NO: 4740 - RNA, 17 nt, Homo sapiens
gacugagcuaaaaaucu

SEQ ID NO: 4741 - RNA, 17 nt, Homo sapiens
uaaaaaucuugacccac

SEQ ID NO: 4742 - RNA, 17 nt, Homo sapiens
aucuugacccacauugg

SEQ ID NO: 4743 - RNA, 17 nt, Homo sapiens
ucuugacccacauuggc

SEQ ID NO: 4744 - RNA, 17 nt, Homo sapiens
cuugacccacauuggcc

SEQ ID NO: 4745 - RNA, 17 nt, Homo sapiens
ugacccacauuggccac

SEQ ID NO: 4746 - RNA, 17 nt, Homo sapiens
acauuggccaccaucug

SEQ ID NO: 4747 - RNA, 17 nt, Homo sapiens
cauuggccaccaucuga

SEQ ID NO: 4748 - RNA, 17 nt, Homo sapiens
uuggccaccaucugaac

SEQ ID NO: 4749 - RNA, 17 nt, Homo sapiens
uggccaccaucugaacg

SEQ ID NO: 4750 - RNA, 17 nt, Homo sapiens
ccaccaucugaacgugg

SEQ ID NO: 4751 - RNA, 17 nt, Homo sapiens
ugguuaaccugcuggga

SEQ ID NO: 4752 - RNA, 17 nt, Homo sapiens
gguuaaccugcugggag

SEQ ID NO: 4753 - RNA, 17 nt, Homo sapiens
uaaccugcugggagccu

SEQ ID NO: 4754 - RNA, 17 nt, Homo sapiens
cugggagccugcaccaa

SEQ ID NO: 4755 - RNA, 17 nt, Homo sapiens
ugggagccugcaccaag

SEQ ID NO: 4756 - RNA, 17 nt, Homo sapiens
gagccugcaccaagcaa

SEQ ID NO: 4757 - RNA, 17 nt, Homo sapiens
gccugcaccaagcaagg

SEQ ID NO: 4758 - RNA, 17 nt, Homo sapiens
ccugcaccaagcaagga

SEQ ID NO: 4759 - RNA, 17 nt, Homo sapiens
caccaagcaaggagggc

SEQ ID NO: 4760 - RNA, 17 nt, Homo sapiens
aggagggccucugaugg

SEQ ID NO: 4761 - RNA, 17 nt, Homo sapiens
ggagggccucugauggu

SEQ ID NO: 4762 - RNA, 17 nt, Homo sapiens
agggccucugaugguga

SEQ ID NO: 4763 - RNA, 17 nt, Homo sapiens
uugaauacugcaaauau

SEQ ID NO: 4764 - RNA, 17 nt, Homo sapiens
aauacugcaaauaugga

SEQ ID NO: 4765 - RNA, 17 nt, Homo sapiens
uggaaaucucuccaacu

SEQ ID NO: 4766 - RNA, 17 nt, Homo sapiens
gaaaucucuccaacuac

SEQ ID NO: 4767 - RNA, 17 nt, Homo sapiens
aaucucuccaacuaccu

SEQ ID NO: 4768 - RNA, 17 nt, Homo sapiens
aucucuccaacuaccuc

SEQ ID NO: 4769 - RNA, 17 nt, Homo sapiens
ucuccaacuaccucaag

SEQ ID NO: 4770 - RNA, 17 nt, Homo sapiens
ccaacuaccucaagagc

SEQ ID NO: 4771 - RNA, 17 nt, Homo sapiens
caacuaccucaagagca

SEQ ID NO: 4772 - RNA, 17 nt, Homo sapiens
acuaccucaagagcaaa

SEQ ID NO: 4773 - RNA, 17 nt, Homo sapiens
ucaagagcaaacgugac

SEQ ID NO: 4774 - RNA, 17 nt, Homo sapiens
aacgugacuuauuuuuu

SEQ ID NO: 4775 - RNA, 17 nt, Homo sapiens
auuuuuucucaacaagg

SEQ ID NO: 4776 - RNA, 17 nt, Homo sapiens
uuuuucucaacaaggau

SEQ ID NO: 4777 - RNA, 17 nt, Homo sapiens
uucucaacaaggaugca

SEQ ID NO: 4778 - RNA, 17 nt, Homo sapiens
aaggaugcagcacuaca

SEQ ID NO: 4779 - RNA, 17 nt, Homo sapiens
gaugcagcacuacacau

SEQ ID NO: 4780 - RNA, 17 nt, Homo sapiens
ugcagcacuacacaugg

SEQ ID NO: 4781 - RNA, 17 nt, Homo sapiens
agcacuacacauggagc

SEQ ID NO: 4782 - RNA, 17 nt, Homo sapiens
cacuacacauggagccu

SEQ ID NO: 4783 - RNA, 17 nt, Homo sapiens
cauggagccuaagaaag

SEQ ID NO: 4784 - RNA, 17 nt, Homo sapiens
auggagccuaagaaaga

SEQ ID NO: 4785 - RNA, 17 nt, Homo sapiens
aauggagccaggccugg

SEQ ID NO: 4786 - RNA, 17 nt, Homo sapiens
auggagccaggccugga

SEQ ID NO: 4787 - RNA, 17 nt, Homo sapiens
agccaggccuggaacaa

SEQ ID NO: 4788 - RNA, 17 nt, Homo sapiens
gccaggccuggaacaag

SEQ ID NO: 4789 - RNA, 17 nt, Homo sapiens
ccuggaacaaggcaaga

SEQ ID NO: 4790 - RNA, 17 nt, Homo sapiens
aacaaggcaagaaacca

SEQ ID NO: 4791 - RNA, 17 nt, Homo sapiens
caagaaaccaagacuag

SEQ ID NO: 4792 - RNA, 17 nt, Homo sapiens
aagaaaccaagacuaga

SEQ ID NO: 4793 - RNA, 17 nt, Homo sapiens
accaagacuagauagcg

SEQ ID NO: 4794 - RNA, 17 nt, Homo sapiens
auagcgucaccagcagc

SEQ ID NO: 4795 - RNA, 17 nt, Homo sapiens
agcgucaccagcagcga

SEQ ID NO: 4796 - RNA, 17 nt, Homo sapiens
gcgucaccagcagcgaa

SEQ ID NO: 4797 - RNA, 17 nt, Homo sapiens
ucaccagcagcgaaagc

SEQ ID NO: 4798 - RNA, 17 nt, Homo sapiens
gcgaaagcuuugcgagc

SEQ ID NO: 4799 - RNA, 17 nt, Homo sapiens
uugcgagcuccggcuuu

SEQ ID NO: 4800 - RNA, 17 nt, Homo sapiens
gcgagcuccggcuuuca

SEQ ID NO: 4801 - RNA, 17 nt, Homo sapiens
gcuccggcuuucaggaa

SEQ ID NO: 4802 - RNA, 17 nt, Homo sapiens
cggcuuucaggaagaua

SEQ ID NO: 4803 - RNA, 17 nt, Homo sapiens
uaaaagucugagugaug

SEQ ID NO: 4804 - RNA, 17 nt, Homo sapiens
gaggauucugacgguuu

SEQ ID NO: 4805 - RNA, 17 nt, Homo sapiens
acgguuucuacaaggag

SEQ ID NO: 4806 - RNA, 17 nt, Homo sapiens
guuucuacaaggagccc

SEQ ID NO: 4807 - RNA, 17 nt, Homo sapiens
caaggagcccaucacua

SEQ ID NO: 4808 - RNA, 17 nt, Homo sapiens
aaggagcccaucacuau

SEQ ID NO: 4809 - RNA, 17 nt, Homo sapiens
aggagcccaucacuaug

SEQ ID NO: 4810 - RNA, 17 nt, Homo sapiens
agcccaucacuauggaa

SEQ ID NO: 4811 - RNA, 17 nt, Homo sapiens
cccaucacuauggaaga

SEQ ID NO: 4812 - RNA, 17 nt, Homo sapiens
ggaagaucugauuucuu

SEQ ID NO: 4813 - RNA, 17 nt, Homo sapiens
cugauuucuuacaguuu

SEQ ID NO: 4814 - RNA, 17 nt, Homo sapiens
uuucuuacaguuuucaa

SEQ ID NO: 4815 - RNA, 17 nt, Homo sapiens
caguuuucaaguggcca

SEQ ID NO: 4816 - RNA, 17 nt, Homo sapiens
caaguggccagaggcau

SEQ ID NO: 4817 - RNA, 17 nt, Homo sapiens
aaguggccagaggcaug

SEQ ID NO: 4818 - RNA, 17 nt, Homo sapiens
ccagaggcauggaguuc

SEQ ID NO: 4819 - RNA, 17 nt, Homo sapiens
uggaguuccugucuucc

SEQ ID NO: 4820 - RNA, 17 nt, Homo sapiens
ggaguuccugucuucca

SEQ ID NO: 4821 - RNA, 17 nt, Homo sapiens
uuccugucuuccagaaa

SEQ ID NO: 4822 - RNA, 17 nt, Homo sapiens
cugucuuccagaaagug

SEQ ID NO: 4823 - RNA, 17 nt, Homo sapiens
ugucuuccagaaagugc

SEQ ID NO: 4824 - RNA, 17 nt, Homo sapiens
gaaagugcauucaucgg

SEQ ID NO: 4825 - RNA, 17 nt, Homo sapiens
gugcauucaucgggacc

SEQ ID NO: 4826 - RNA, 17 nt, Homo sapiens
aucgggaccuggcagcg

SEQ ID NO: 4827 - RNA, 17 nt, Homo sapiens
ucgggaccuggcagcga

SEQ ID NO: 4828 - RNA, 17 nt, Homo sapiens
gaccuggcagcgagaaa

SEQ ID NO: 4829 - RNA, 17 nt, Homo sapiens
cgagaaacauucuuuua

SEQ ID NO: 4830 - RNA, 17 nt, Homo sapiens
aaacauucuuuuaucug

SEQ ID NO: 4831 - RNA, 17 nt, Homo sapiens
cuuuuaucugagaacaa

SEQ ID NO: 4832 - RNA, 17 nt, Homo sapiens
cugagaacaacguggug

SEQ ID NO: 4833 - RNA, 17 nt, Homo sapiens
auuuuggccuugcccgg

SEQ ID NO: 4834 - RNA, 17 nt, Homo sapiens
uuuuggccuugcccggg

SEQ ID NO: 4835 - RNA, 17 nt, Homo sapiens
ggccuugcccgggauau

SEQ ID NO: 4836 - RNA, 17 nt, Homo sapiens
gccuugcccgggauauu

SEQ ID NO: 4837 - RNA, 17 nt, Homo sapiens
auaagaaccccgauuau

SEQ ID NO: 4838 - RNA, 17 nt, Homo sapiens
uaagaaccccgauuaug

SEQ ID NO: 4839 - RNA, 17 nt, Homo sapiens
aagaaccccgauuaugu

SEQ ID NO: 4840 - RNA, 17 nt, Homo sapiens
ggagauacucgacuucc

SEQ ID NO: 4841 - RNA, 17 nt, Homo sapiens
uacucgacuuccucuga

SEQ ID NO: 4842 - RNA, 17 nt, Homo sapiens
ucgacuuccucugaaau

SEQ ID NO: 4843 - RNA, 17 nt, Homo sapiens
cgacuuccucugaaaug

SEQ ID NO: 4844 - RNA, 17 nt, Homo sapiens
acuuccucugaaaugga

SEQ ID NO: 4845 - RNA, 17 nt, Homo sapiens
uggauggcucccgaauc

SEQ ID NO: 4846 - RNA, 17 nt, Homo sapiens
gauggcucccgaaucua

SEQ ID NO: 4847 - RNA, 17 nt, Homo sapiens
auggcucccgaaucuau

SEQ ID NO: 4848 - RNA, 17 nt, Homo sapiens
cccgaaucuaucuuuga

SEQ ID NO: 4849 - RNA, 17 nt, Homo sapiens
aaucuaucuuugacaaa

SEQ ID NO: 4850 - RNA, 17 nt, Homo sapiens
ucuuugacaaaaucuac

SEQ ID NO: 4851 - RNA, 17 nt, Homo sapiens
acaaaaucuacagcacc

SEQ ID NO: 4852 - RNA, 17 nt, Homo sapiens
aaaucuacagcaccaag

SEQ ID NO: 4853 - RNA, 17 nt, Homo sapiens
ucuacagcaccaagagc

SEQ ID NO: 4854 - RNA, 17 nt, Homo sapiens
uacagcaccaagagcga

SEQ ID NO: 4855 - RNA, 17 nt, Homo sapiens
acagcaccaagagcgac

SEQ ID NO: 4856 - RNA, 17 nt, Homo sapiens
guguggucuuacggagu

SEQ ID NO: 4857 - RNA, 17 nt, Homo sapiens
aguauugcugugggaaa

SEQ ID NO: 4858 - RNA, 17 nt, Homo sapiens
gggaaaucuucuccuua

SEQ ID NO: 4859 - RNA, 17 nt, Homo sapiens
aaaucuucuccuuaggu

SEQ ID NO: 4860 - RNA, 17 nt, Homo sapiens
aucuucuccuuaggugg

SEQ ID NO: 4861 - RNA, 17 nt, Homo sapiens
ucuucuccuuagguggg

SEQ ID NO: 4862 - RNA, 17 nt, Homo sapiens
ggugggucuccauaccc

SEQ ID NO: 4863 - RNA, 17 nt, Homo sapiens
ugggucuccauacccag

SEQ ID NO: 4864 - RNA, 17 nt, Homo sapiens
gggucuccauacccagg

SEQ ID NO: 4865 - RNA, 17 nt, Homo sapiens
cuccauacccaggagua

SEQ ID NO: 4866 - RNA, 17 nt, Homo sapiens
uccauacccaggaguac

SEQ ID NO: 4867 - RNA, 17 nt, Homo sapiens
ccauacccaggaguaca

SEQ ID NO: 4868 - RNA, 17 nt, Homo sapiens
aggaguacaaauggaug

SEQ ID NO: 4869 - RNA, 17 nt, Homo sapiens
augaggacuuuugcagu

SEQ ID NO: 4870 - RNA, 17 nt, Homo sapiens
acuuuugcagucgccug

SEQ ID NO: 4871 - RNA, 17 nt, Homo sapiens
gcagucgccugagggaa

SEQ ID NO: 4872 - RNA, 17 nt, Homo sapiens
cagucgccugagggaag

SEQ ID NO: 4873 - RNA, 17 nt, Homo sapiens
gggaaggcaugaggaug

SEQ ID NO: 4874 - RNA, 17 nt, Homo sapiens
augagagcuccugagua

SEQ ID NO: 4875 - RNA, 17 nt, Homo sapiens
gagagcuccugaguacu

SEQ ID NO: 4876 - RNA, 17 nt, Homo sapiens
agagcuccugaguacuc

SEQ ID NO: 4877 - RNA, 17 nt, Homo sapiens
cugaguacucuacuccu

SEQ ID NO: 4878 - RNA, 17 nt, Homo sapiens
gaguacucuacuccuga

SEQ ID NO: 4879 - RNA, 17 nt, Homo sapiens
uacucuacuccugaaau

SEQ ID NO: 4880 - RNA, 17 nt, Homo sapiens
cucuacuccugaaaucu

SEQ ID NO: 4881 - RNA, 17 nt, Homo sapiens
ucuacuccugaaaucua

SEQ ID NO: 4882 - RNA, 17 nt, Homo sapiens
cugaaaucuaucagauc

SEQ ID NO: 4883 - RNA, 17 nt, Homo sapiens
aaucuaucagaucaugc

SEQ ID NO: 4884 - RNA, 17 nt, Homo sapiens
aucagaucaugcuggac

SEQ ID NO: 4885 - RNA, 17 nt, Homo sapiens
gaucaugcuggacugcu

SEQ ID NO: 4886 - RNA, 17 nt, Homo sapiens
ugcuggacugcuggcac

SEQ ID NO: 4887 - RNA, 17 nt, Homo sapiens
uggacugcuggcacaga

SEQ ID NO: 4888 - RNA, 17 nt, Homo sapiens
cugcuggcacagagacc

SEQ ID NO: 4889 - RNA, 17 nt, Homo sapiens
gcuggcacagagaccca

SEQ ID NO: 4890 - RNA, 17 nt, Homo sapiens
acagagacccaaaagaa

SEQ ID NO: 4891 - RNA, 17 nt, Homo sapiens
cagagacccaaaagaaa

SEQ ID NO: 4892 - RNA, 17 nt, Homo sapiens
agagacccaaaagaaag

SEQ ID NO: 4893 - RNA, 17 nt, Homo sapiens
agaaaggccaagauuug

SEQ ID NO: 4894 - RNA, 17 nt, Homo sapiens
gaaaggccaagauuugc

SEQ ID NO: 4895 - RNA, 17 nt, Homo sapiens
agauuugcagaacuugu

SEQ ID NO: 4896 - RNA, 17 nt, Homo sapiens
ugcagaacuuguggaaa

SEQ ID NO: 4897 - RNA, 17 nt, Homo sapiens
ggaaaaacuaggugauu

SEQ ID NO: 4898 - RNA, 17 nt, Homo sapiens
ugauuugcuucaagcaa

SEQ ID NO: 4899 - RNA, 17 nt, Homo sapiens
uuugcuucaagcaaaug

SEQ ID NO: 4900 - RNA, 17 nt, Homo sapiens
cuucaagcaaauguaca

SEQ ID NO: 4901 - RNA, 17 nt, Homo sapiens
aaauguacaacaggaug

SEQ ID NO: 4902 - RNA, 17 nt, Homo sapiens
uguacaacaggauggua

SEQ ID NO: 4903 - RNA, 17 nt, Homo sapiens
guaaagacuacauccca

SEQ ID NO: 4904 - RNA, 17 nt, Homo sapiens
aagacuacaucccaauc

SEQ ID NO: 4905 - RNA, 17 nt, Homo sapiens
acuacaucccaaucaau

SEQ ID NO: 4906 - RNA, 17 nt, Homo sapiens
cuacaucccaaucaaug

SEQ ID NO: 4907 - RNA, 17 nt, Homo sapiens
uacaucccaaucaaugc

SEQ ID NO: 4908 - RNA, 17 nt, Homo sapiens
ucccaaucaaugccaua

SEQ ID NO: 4909 - RNA, 17 nt, Homo sapiens
aucaaugccauacugac

SEQ ID NO: 4910 - RNA, 17 nt, Homo sapiens
ucaaugccauacugaca

SEQ ID NO: 4911 - RNA, 17 nt, Homo sapiens
ugccauacugacaggaa

SEQ ID NO: 4912 - RNA, 17 nt, Homo sapiens
auacugacaggaaauag

SEQ ID NO: 4913 - RNA, 17 nt, Homo sapiens
ggguuuacauacucaac

SEQ ID NO: 4914 - RNA, 17 nt, Homo sapiens
uuacauacucaacuccu

SEQ ID NO: 4915 - RNA, 17 nt, Homo sapiens
acauacucaacuccugc

SEQ ID NO: 4916 - RNA, 17 nt, Homo sapiens
uacucaacuccugccuu

SEQ ID NO: 4917 - RNA, 17 nt, Homo sapiens
cucaacuccugccuucu

SEQ ID NO: 4918 - RNA, 17 nt, Homo sapiens
ucaacuccugccuucuc

SEQ ID NO: 4919 - RNA, 17 nt, Homo sapiens
acuccugccuucucuga

SEQ ID NO: 4920 - RNA, 17 nt, Homo sapiens
cuccugccuucucugag

SEQ ID NO: 4921 - RNA, 17 nt, Homo sapiens
cugccuucucugaggac

SEQ ID NO: 4922 - RNA, 17 nt, Homo sapiens
gccuucucugaggacuu

SEQ ID NO: 4923 - RNA, 17 nt, Homo sapiens
cugaggacuucuucaag

SEQ ID NO: 4924 - RNA, 17 nt, Homo sapiens
aggacuucuucaaggaa

SEQ ID NO: 4925 - RNA, 17 nt, Homo sapiens
acuucuucaaggaaagu

SEQ ID NO: 4926 - RNA, 17 nt, Homo sapiens
aguauuucagcuccgaa

SEQ ID NO: 4927 - RNA, 17 nt, Homo sapiens
auuucagcuccgaaguu

SEQ ID NO: 4928 - RNA, 17 nt, Homo sapiens
uucagcuccgaaguuua

SEQ ID NO: 4929 - RNA, 17 nt, Homo sapiens
uuuaauucaggaagcuc

SEQ ID NO: 4930 - RNA, 17 nt, Homo sapiens
caggaagcucugaugau

SEQ ID NO: 4931 - RNA, 17 nt, Homo sapiens
ggaagcucugaugaugu

SEQ ID NO: 4932 - RNA, 17 nt, Homo sapiens
augaugucagauaugua

SEQ ID NO: 4933 - RNA, 17 nt, Homo sapiens
guaaaugcuuucaaguu

SEQ ID NO: 4934 - RNA, 17 nt, Homo sapiens
augcuuucaaguucaug

SEQ ID NO: 4935 - RNA, 17 nt, Homo sapiens
ucaaguucaugagccug

SEQ ID NO: 4936 - RNA, 17 nt, Homo sapiens
ucaugagccuggaaaga

SEQ ID NO: 4937 - RNA, 17 nt, Homo sapiens
caugagccuggaaagaa

SEQ ID NO: 4938 - RNA, 17 nt, Homo sapiens
aaagaaucaaaaccuuu

SEQ ID NO: 4939 - RNA, 17 nt, Homo sapiens
aucaaaaccuuugaaga

SEQ ID NO: 4940 - RNA, 17 nt, Homo sapiens
ucaaaaccuuugaagaa

SEQ ID NO: 4941 - RNA, 17 nt, Homo sapiens
ugaagaacuuuuaccga

SEQ ID NO: 4942 - RNA, 17 nt, Homo sapiens
acuuuuaccgaaugcca

SEQ ID NO: 4943 - RNA, 17 nt, Homo sapiens
ccgaaugccaccuccau

SEQ ID NO: 4944 - RNA, 17 nt, Homo sapiens
cgaaugccaccuccaug

SEQ ID NO: 4945 - RNA, 17 nt, Homo sapiens
aaugccaccuccauguu

SEQ ID NO: 4946 - RNA, 17 nt, Homo sapiens
augccaccuccauguuu

SEQ ID NO: 4947 - RNA, 17 nt, Homo sapiens
gccaccuccauguuuga

SEQ ID NO: 4948 - RNA, 17 nt, Homo sapiens
ccaccuccauguuugau

SEQ ID NO: 4949 - RNA, 17 nt, Homo sapiens
uugaugacuaccagggc

SEQ ID NO: 4950 - RNA, 17 nt, Homo sapiens
augacuaccagggcgac

SEQ ID NO: 4951 - RNA, 17 nt, Homo sapiens
ugacuaccagggcgaca

SEQ ID NO: 4952 - RNA, 17 nt, Homo sapiens
agggcgacagcagcacu

SEQ ID NO: 4953 - RNA, 17 nt, Homo sapiens
gcgacagcagcacucug

SEQ ID NO: 4954 - RNA, 17 nt, Homo sapiens
acagcagcacucuguug

SEQ ID NO: 4955 - RNA, 17 nt, Homo sapiens
agcagcacucuguuggc

SEQ ID NO: 4956 - RNA, 17 nt, Homo sapiens
cagcacucuguuggccu

SEQ ID NO: 4957 - RNA, 17 nt, Homo sapiens
cuguuggccucucccau

SEQ ID NO: 4958 - RNA, 17 nt, Homo sapiens
uguuggccucucccaug

SEQ ID NO: 4959 - RNA, 17 nt, Homo sapiens
uuggccucucccaugcu

SEQ ID NO: 4960 - RNA, 17 nt, Homo sapiens
ggccucucccaugcuga

SEQ ID NO: 4961 - RNA, 17 nt, Homo sapiens
gccucucccaugcugaa

SEQ ID NO: 4962 - RNA, 17 nt, Homo sapiens
ccucucccaugcugaag

SEQ ID NO: 4963 - RNA, 17 nt, Homo sapiens
ucccaugcugaagcgcu

SEQ ID NO: 4964 - RNA, 17 nt, Homo sapiens
ugaagcgcuucaccugg

SEQ ID NO: 4965 - RNA, 17 nt, Homo sapiens
agcgcuucaccuggacu

SEQ ID NO: 4966 - RNA, 17 nt, Homo sapiens
cgcuucaccuggacuga

SEQ ID NO: 4967 - RNA, 17 nt, Homo sapiens
gcuucaccuggacugac

SEQ ID NO: 4968 - RNA, 17 nt, Homo sapiens
accuggacugacagcaa

SEQ ID NO: 4969 - RNA, 17 nt, Homo sapiens
ggacugacagcaaaccc

SEQ ID NO: 4970 - RNA, 17 nt, Homo sapiens
cugacagcaaacccaag

SEQ ID NO: 4971 - RNA, 17 nt, Homo sapiens
cagcaaacccaaggccu

SEQ ID NO: 4972 - RNA, 17 nt, Homo sapiens
agcaaacccaaggccuc

SEQ ID NO: 4973 - RNA, 17 nt, Homo sapiens
gcaaacccaaggccucg

SEQ ID NO: 4974 - RNA, 17 nt, Homo sapiens
cccaaggccucgcucaa

SEQ ID NO: 4975 - RNA, 17 nt, Homo sapiens
ccaaggccucgcucaag

SEQ ID NO: 4976 - RNA, 17 nt, Homo sapiens
ggccucgcucaagauug

SEQ ID NO: 4977 - RNA, 17 nt, Homo sapiens
ccucgcucaagauugac

SEQ ID NO: 4978 - RNA, 17 nt, Homo sapiens
agauugacuugagagua

SEQ ID NO: 4979 - RNA, 17 nt, Homo sapiens
agaguaaccaguaaaag

SEQ ID NO: 4980 - RNA, 17 nt, Homo sapiens
gaguaaccaguaaaagu

SEQ ID NO: 4981 - RNA, 17 nt, Homo sapiens
gucggggcugucugaug

SEQ ID NO: 4982 - RNA, 17 nt, Homo sapiens
gggcugucugaugucag

SEQ ID NO: 4983 - RNA, 17 nt, Homo sapiens
cugaugucagcaggccc

SEQ ID NO: 4984 - RNA, 17 nt, Homo sapiens
augucagcaggcccagu

SEQ ID NO: 4985 - RNA, 17 nt, Homo sapiens
cagcaggcccaguuucu

SEQ ID NO: 4986 - RNA, 17 nt, Homo sapiens
agcaggcccaguuucug

SEQ ID NO: 4987 - RNA, 17 nt, Homo sapiens
gcaggcccaguuucugc

SEQ ID NO: 4988 - RNA, 17 nt, Homo sapiens
ccaguuucugccauucc

SEQ ID NO: 4989 - RNA, 17 nt, Homo sapiens
guuucugccauuccagc

SEQ ID NO: 4990 - RNA, 17 nt, Homo sapiens
uuucugccauuccagcu

SEQ ID NO: 4991 - RNA, 17 nt, Homo sapiens
ugccauuccagcugugg

SEQ ID NO: 4992 - RNA, 17 nt, Homo sapiens
gccauuccagcuguggg

SEQ ID NO: 4993 - RNA, 17 nt, Homo sapiens
auuccagcugugggcac

SEQ ID NO: 4994 - RNA, 17 nt, Homo sapiens
cugugggcacgucagcg

SEQ ID NO: 4995 - RNA, 17 nt, Homo sapiens
ggcacgucagcgaaggc

SEQ ID NO: 4996 - RNA, 17 nt, Homo sapiens
gcgaaggcaagcgcagg

SEQ ID NO: 4997 - RNA, 17 nt, Homo sapiens
gcaagcgcagguucacc

SEQ ID NO: 4998 - RNA, 17 nt, Homo sapiens
gcagguucaccuacgac

SEQ ID NO: 4999 - RNA, 17 nt, Homo sapiens
agguucaccuacgacca

SEQ ID NO: 5000 - RNA, 17 nt, Homo sapiens
gguucaccuacgaccac

SEQ ID NO: 5001 - RNA, 17 nt, Homo sapiens
ccuacgaccacgcugag

SEQ ID NO: 5002 - RNA, 17 nt, Homo sapiens
cuacgaccacgcugagc

SEQ ID NO: 5003 - RNA, 17 nt, Homo sapiens
gaccacgcugagcugga

SEQ ID NO: 5004 - RNA, 17 nt, Homo sapiens
cgcugagcuggaaagga

SEQ ID NO: 5005 - RNA, 17 nt, Homo sapiens
ucgcgugcugcuccccg

SEQ ID NO: 5006 - RNA, 17 nt, Homo sapiens
cgugcugcuccccgccc

SEQ ID NO: 5007 - RNA, 17 nt, Homo sapiens
ugcugcuccccgccccc

SEQ ID NO: 5008 - RNA, 17 nt, Homo sapiens
gcugcuccccgccccca

SEQ ID NO: 5009 - RNA, 17 nt, Homo sapiens
cugcuccccgcccccag

SEQ ID NO: 5010 - RNA, 17 nt, Homo sapiens
cuccccgcccccagacu

SEQ ID NO: 5011 - RNA, 17 nt, Homo sapiens
uccccgcccccagacua

SEQ ID NO: 5012 - RNA, 17 nt, Homo sapiens
ccccgcccccagacuac

SEQ ID NO: 5013 - RNA, 17 nt, Homo sapiens
cccgcccccagacuaca

SEQ ID NO: 5014 - RNA, 17 nt, Homo sapiens
ccgcccccagacuacaa

SEQ ID NO: 5015 - RNA, 17 nt, Homo sapiens
ccccagacuacaacucg

SEQ ID NO: 5016 - RNA, 17 nt, Homo sapiens
cagacuacaacucggug

SEQ ID NO: 5017 - RNA, 17 nt, Homo sapiens
acuacaacucggugguc

SEQ ID NO: 5018 - RNA, 17 nt, Homo sapiens
cggugguccuguacucc

SEQ ID NO: 5019 - RNA, 17 nt, Homo sapiens
ggugguccuguacucca

SEQ ID NO: 5020 - RNA, 17 nt, Homo sapiens
uccuguacuccacccca

SEQ ID NO: 5021 - RNA, 17 nt, Homo sapiens
cuguacuccaccccacc

SEQ ID NO: 5022 - RNA, 17 nt, Homo sapiens
uguacuccaccccaccc

SEQ ID NO: 5023 - RNA, 17 nt, Homo sapiens
uacuccaccccacccau

SEQ ID NO: 5024 - RNA, 17 nt, Homo sapiens
acuccaccccacccauc

SEQ ID NO: 5025 - RNA, 17 nt, Homo sapiens
cuccaccccacccaucu

SEQ ID NO: 5026 - RNA, 17 nt, Homo sapiens
uccaccccacccaucua

SEQ ID NO: 5027 - RNA, 17 nt, Homo sapiens
caccccacccaucuaga

SEQ ID NO: 5028 - RNA, 17 nt, Homo sapiens
accccacccaucuagag

SEQ ID NO: 5029 - RNA, 17 nt, Homo sapiens
ccccacccaucuagagu

SEQ ID NO: 5030 - RNA, 17 nt, Homo sapiens
cacccaucuagaguuug

SEQ ID NO: 5031 - RNA, 17 nt, Homo sapiens
aguuugacacgaagccu

SEQ ID NO: 5032 - RNA, 17 nt, Homo sapiens
cacgaagccuuauuucu

SEQ ID NO: 5033 - RNA, 17 nt, Homo sapiens
acgaagccuuauuucua

SEQ ID NO: 5034 - RNA, 17 nt, Homo sapiens
cuuauuucuagaagcac

SEQ ID NO: 5035 - RNA, 17 nt, Homo sapiens
cuagaagcacaugugua

SEQ ID NO: 5036 - RNA, 17 nt, Homo sapiens
agaagcacauguguauu

SEQ ID NO: 5037 - RNA, 17 nt, Homo sapiens
auuuauacccccaggaa

SEQ ID NO: 5038 - RNA, 17 nt, Homo sapiens
uuuauacccccaggaaa

SEQ ID NO: 5039 - RNA, 17 nt, Homo sapiens
uuauacccccaggaaac

SEQ ID NO: 5040 - RNA, 17 nt, Homo sapiens
uauacccccaggaaacu

SEQ ID NO: 5041 - RNA, 17 nt, Homo sapiens
auacccccaggaaacua

SEQ ID NO: 5042 - RNA, 17 nt, Homo sapiens
caggaaacuagcuuuug

SEQ ID NO: 5043 - RNA, 17 nt, Homo sapiens
aaacuagcuuuugccag

SEQ ID NO: 5044 - RNA, 17 nt, Homo sapiens
gcuuuugccaguauuau

SEQ ID NO: 5045 - RNA, 17 nt, Homo sapiens
cuuuugccaguauuaug

SEQ ID NO: 5046 - RNA, 17 nt, Homo sapiens
uauuaugcauauauaag

SEQ ID NO: 5047 - RNA, 17 nt, Homo sapiens
aaguuuacaccuuuauc

SEQ ID NO: 5048 - RNA, 17 nt, Homo sapiens
guuuacaccuuuaucuu

SEQ ID NO: 5049 - RNA, 17 nt, Homo sapiens
uuuacaccuuuaucuuu

SEQ ID NO: 5050 - RNA, 17 nt, Homo sapiens
ccuuuaucuuuccaugg

SEQ ID NO: 5051 - RNA, 17 nt, Homo sapiens
uaucuuuccaugggagc

SEQ ID NO: 5052 - RNA, 17 nt, Homo sapiens
aucuuuccaugggagcc

SEQ ID NO: 5053 - RNA, 17 nt, Homo sapiens
augggagccagcugcuu

SEQ ID NO: 5054 - RNA, 17 nt, Homo sapiens
ugggagccagcugcuuu

SEQ ID NO: 5055 - RNA, 17 nt, Homo sapiens
gagccagcugcuuuuug

SEQ ID NO: 5056 - RNA, 17 nt, Homo sapiens
ccagcugcuuuuuguga

SEQ ID NO: 5057 - RNA, 17 nt, Homo sapiens
aauagugcuuuuuuuuu

SEQ ID NO: 5058 - RNA, 17 nt, Homo sapiens
uuuuugacuaacaagaa

SEQ ID NO: 5059 - RNA, 17 nt, Homo sapiens
ugacuaacaagaaugua

SEQ ID NO: 5060 - RNA, 17 nt, Homo sapiens
aauguaacuccagauag

SEQ ID NO: 5061 - RNA, 17 nt, Homo sapiens
uguaacuccagauagag

SEQ ID NO: 5062 - RNA, 17 nt, Homo sapiens
guaacuccagauagaga

SEQ ID NO: 5063 - RNA, 17 nt, Homo sapiens
auagugacaagugaaga

SEQ ID NO: 5064 - RNA, 17 nt, Homo sapiens
ugaagaacacuacugcu

SEQ ID NO: 5065 - RNA, 17 nt, Homo sapiens
aagaacacuacugcuaa

SEQ ID NO: 5066 - RNA, 17 nt, Homo sapiens
aacacuacugcuaaauc

SEQ ID NO: 5067 - RNA, 17 nt, Homo sapiens
acuacugcuaaauccuc

SEQ ID NO: 5068 - RNA, 17 nt, Homo sapiens
gcuaaauccucauguua

SEQ ID NO: 5069 - RNA, 17 nt, Homo sapiens
cuaaauccucauguuac

SEQ ID NO: 5070 - RNA, 17 nt, Homo sapiens
aaauccucauguuacuc

SEQ ID NO: 5071 - RNA, 17 nt, Homo sapiens
cauguuacucaguguua

SEQ ID NO: 5072 - RNA, 17 nt, Homo sapiens
uguuacucaguguuaga

SEQ ID NO: 5073 - RNA, 17 nt, Homo sapiens
gagaaauccuuccuaaa

SEQ ID NO: 5074 - RNA, 17 nt, Homo sapiens
agaaauccuuccuaaac

SEQ ID NO: 5075 - RNA, 17 nt, Homo sapiens
aauccuuccuaaaccca

SEQ ID NO: 5076 - RNA, 17 nt, Homo sapiens
auccuuccuaaacccaa

SEQ ID NO: 5077 - RNA, 17 nt, Homo sapiens
uccuaaacccaaugacu

SEQ ID NO: 5078 - RNA, 17 nt, Homo sapiens
ccuaaacccaaugacuu

SEQ ID NO: 5079 - RNA, 17 nt, Homo sapiens
cuaaacccaaugacuuc

SEQ ID NO: 5080 - RNA, 17 nt, Homo sapiens
ccaaugacuucccugcu

SEQ ID NO: 5081 - RNA, 17 nt, Homo sapiens
augacuucccugcucca

SEQ ID NO: 5082 - RNA, 17 nt, Homo sapiens
ugacuucccugcuccaa

SEQ ID NO: 5083 - RNA, 17 nt, Homo sapiens
gacuucccugcuccaac

SEQ ID NO: 5084 - RNA, 17 nt, Homo sapiens
uucccugcuccaacccc

SEQ ID NO: 5085 - RNA, 17 nt, Homo sapiens
cccugcuccaacccccg

SEQ ID NO: 5086 - RNA, 17 nt, Homo sapiens
ccugcuccaacccccgc

SEQ ID NO: 5087 - RNA, 17 nt, Homo sapiens
gcuccaacccccgccac

SEQ ID NO: 5088 - RNA, 17 nt, Homo sapiens
cuccaacccccgccacc

SEQ ID NO: 5089 - RNA, 17 nt, Homo sapiens
uccaacccccgccaccu

SEQ ID NO: 5090 - RNA, 17 nt, Homo sapiens
ccaacccccgccaccuc

SEQ ID NO: 5091 - RNA, 17 nt, Homo sapiens
acccccgccaccucagg

SEQ ID NO: 5092 - RNA, 17 nt, Homo sapiens
cccccgccaccucaggg

SEQ ID NO: 5093 - RNA, 17 nt, Homo sapiens
cccgccaccucagggca

SEQ ID NO: 5094 - RNA, 17 nt, Homo sapiens
ccgccaccucagggcac

SEQ ID NO: 5095 - RNA, 17 nt, Homo sapiens
gccaccucagggcacgc

SEQ ID NO: 5096 - RNA, 17 nt, Homo sapiens
cucagggcacgcaggac

SEQ ID NO: 5097 - RNA, 17 nt, Homo sapiens
gggcacgcaggaccagu

SEQ ID NO: 5098 - RNA, 17 nt, Homo sapiens
cgcaggaccaguuugau

SEQ ID NO: 5099 - RNA, 17 nt, Homo sapiens
gcaggaccaguuugauu

SEQ ID NO: 5100 - RNA, 17 nt, Homo sapiens
ugaggagcugcacugau

SEQ ID NO: 5101 - RNA, 17 nt, Homo sapiens
ggagcugcacugaucac

SEQ ID NO: 5102 - RNA, 17 nt, Homo sapiens
agcugcacugaucaccc

SEQ ID NO: 5103 - RNA, 17 nt, Homo sapiens
cacugaucacccaaugc

SEQ ID NO: 5104 - RNA, 17 nt, Homo sapiens
cugaucacccaaugcau

SEQ ID NO: 5105 - RNA, 17 nt, Homo sapiens
ugaucacccaaugcauc

SEQ ID NO: 5106 - RNA, 17 nt, Homo sapiens
gaucacccaaugcauca

SEQ ID NO: 5107 - RNA, 17 nt, Homo sapiens
cccaaugcaucacguac

SEQ ID NO: 5108 - RNA, 17 nt, Homo sapiens
aaugcaucacguacccc

SEQ ID NO: 5109 - RNA, 17 nt, Homo sapiens
ucacguaccccacuggg

SEQ ID NO: 5110 - RNA, 17 nt, Homo sapiens
cacguaccccacugggc

SEQ ID NO: 5111 - RNA, 17 nt, Homo sapiens
acguaccccacugggcc

SEQ ID NO: 5112 - RNA, 17 nt, Homo sapiens
cguaccccacugggcca

SEQ ID NO: 5113 - RNA, 17 nt, Homo sapiens
uaccccacugggccagc

SEQ ID NO: 5114 - RNA, 17 nt, Homo sapiens
cacugggccagcccugc

SEQ ID NO: 5115 - RNA, 17 nt, Homo sapiens
acugggccagcccugca

SEQ ID NO: 5116 - RNA, 17 nt, Homo sapiens
gggccagcccugcagcc

SEQ ID NO: 5117 - RNA, 17 nt, Homo sapiens
ggccagcccugcagccc

SEQ ID NO: 5118 - RNA, 17 nt, Homo sapiens
gccagcccugcagccca

SEQ ID NO: 5119 - RNA, 17 nt, Homo sapiens
agcccugcagcccaaaa

SEQ ID NO: 5120 - RNA, 17 nt, Homo sapiens
ccugcagcccaaaaccc

SEQ ID NO: 5121 - RNA, 17 nt, Homo sapiens
cugcagcccaaaaccca

SEQ ID NO: 5122 - RNA, 17 nt, Homo sapiens
ugcagcccaaaacccag

SEQ ID NO: 5123 - RNA, 17 nt, Homo sapiens
cccaaaacccagggcaa

SEQ ID NO: 5124 - RNA, 17 nt, Homo sapiens
ccaaaacccagggcaac

SEQ ID NO: 5125 - RNA, 17 nt, Homo sapiens
caaaacccagggcaaca

SEQ ID NO: 5126 - RNA, 17 nt, Homo sapiens
cccagggcaacaagccc

SEQ ID NO: 5127 - RNA, 17 nt, Homo sapiens
agggcaacaagcccguu

SEQ ID NO: 5128 - RNA, 17 nt, Homo sapiens
caacaagcccguuagcc

SEQ ID NO: 5129 - RNA, 17 nt, Homo sapiens
aacaagcccguuagccc

SEQ ID NO: 5130 - RNA, 17 nt, Homo sapiens
ccguuagccccagggga

SEQ ID NO: 5131 - RNA, 17 nt, Homo sapiens
cguuagccccaggggau

SEQ ID NO: 5132 - RNA, 17 nt, Homo sapiens
guuagccccaggggauc

SEQ ID NO: 5133 - RNA, 17 nt, Homo sapiens
uuagccccaggggauca

SEQ ID NO: 5134 - RNA, 17 nt, Homo sapiens
aggggaucacuggcugg

SEQ ID NO: 5135 - RNA, 17 nt, Homo sapiens
gggaucacuggcuggcc

SEQ ID NO: 5136 - RNA, 17 nt, Homo sapiens
ucacuggcuggccugag

SEQ ID NO: 5137 - RNA, 17 nt, Homo sapiens
uggcuggccugagcaac

SEQ ID NO: 5138 - RNA, 17 nt, Homo sapiens
ggcuggccugagcaaca

SEQ ID NO: 5139 - RNA, 17 nt, Homo sapiens
gccugagcaacaucucg

SEQ ID NO: 5140 - RNA, 17 nt, Homo sapiens
ugagcaacaucucggga

SEQ ID NO: 5141 - RNA, 17 nt, Homo sapiens
gcaacaucucgggaguc

SEQ ID NO: 5142 - RNA, 17 nt, Homo sapiens
cgggaguccucuagcag

SEQ ID NO: 5143 - RNA, 17 nt, Homo sapiens
gggaguccucuagcagg

SEQ ID NO: 5144 - RNA, 17 nt, Homo sapiens
gaguccucuagcaggcc

SEQ ID NO: 5145 - RNA, 17 nt, Homo sapiens
ccucuagcaggccuaag

SEQ ID NO: 5146 - RNA, 17 nt, Homo sapiens
uagcaggccuaagacau

SEQ ID NO: 5147 - RNA, 17 nt, Homo sapiens
agcaggccuaagacaug

SEQ ID NO: 5148 - RNA, 17 nt, Homo sapiens
ccuaagacaugugagga

SEQ ID NO: 5149 - RNA, 17 nt, Homo sapiens
aaaaaagcaaaaagcaa

SEQ ID NO: 5150 - RNA, 17 nt, Homo sapiens
caaaaagcaagggagaa

SEQ ID NO: 5151 - RNA, 17 nt, Homo sapiens
agagaaaccgggagaag

SEQ ID NO: 5152 - RNA, 17 nt, Homo sapiens
gagaaggcaugagaaag

SEQ ID NO: 5153 - RNA, 17 nt, Homo sapiens
ugagacgcaccaugugg

SEQ ID NO: 5154 - RNA, 17 nt, Homo sapiens
agacgcaccaugugggc

SEQ ID NO: 5155 - RNA, 17 nt, Homo sapiens
gacgcaccaugugggca

SEQ ID NO: 5156 - RNA, 17 nt, Homo sapiens
augugggcacggagggg

SEQ ID NO: 5157 - RNA, 17 nt, Homo sapiens
gacggggcucagcaaug

SEQ ID NO: 5158 - RNA, 17 nt, Homo sapiens
cggggcucagcaaugcc

SEQ ID NO: 5159 - RNA, 17 nt, Homo sapiens
ggcucagcaaugccauu

SEQ ID NO: 5160 - RNA, 17 nt, Homo sapiens
agcaaugccauuucagu

SEQ ID NO: 5161 - RNA, 17 nt, Homo sapiens
gcaaugccauuucagug

SEQ ID NO: 5162 - RNA, 17 nt, Homo sapiens
gccauuucaguggcuuc

SEQ ID NO: 5163 - RNA, 17 nt, Homo sapiens
ucaguggcuucccagcu

SEQ ID NO: 5164 - RNA, 17 nt, Homo sapiens
guggcuucccagcucug

SEQ ID NO: 5165 - RNA, 17 nt, Homo sapiens
uggcuucccagcucuga

SEQ ID NO: 5166 - RNA, 17 nt, Homo sapiens
ggcuucccagcucugac

SEQ ID NO: 5167 - RNA, 17 nt, Homo sapiens
uucccagcucugacccu

SEQ ID NO: 5168 - RNA, 17 nt, Homo sapiens
cccagcucugacccuuc

SEQ ID NO: 5169 - RNA, 17 nt, Homo sapiens
gcucugacccuucuaca

SEQ ID NO: 5170 - RNA, 17 nt, Homo sapiens
cucugacccuucuacau

SEQ ID NO: 5171 - RNA, 17 nt, Homo sapiens
ucugacccuucuacauu

SEQ ID NO: 5172 - RNA, 17 nt, Homo sapiens
gacccuucuacauuuga

SEQ ID NO: 5173 - RNA, 17 nt, Homo sapiens
ccuucuacauuugaggg

SEQ ID NO: 5174 - RNA, 17 nt, Homo sapiens
uugagggcccagccagg

SEQ ID NO: 5175 - RNA, 17 nt, Homo sapiens
ugagggcccagccagga

SEQ ID NO: 5176 - RNA, 17 nt, Homo sapiens
gagggcccagccaggag

SEQ ID NO: 5177 - RNA, 17 nt, Homo sapiens
ggcccagccaggagcag

SEQ ID NO: 5178 - RNA, 17 nt, Homo sapiens
gcccagccaggagcaga

SEQ ID NO: 5179 - RNA, 17 nt, Homo sapiens
ccaggagcagauggaca

SEQ ID NO: 5180 - RNA, 17 nt, Homo sapiens
agauggacagcgaugag

SEQ ID NO: 5181 - RNA, 17 nt, Homo sapiens
gaggggacauuuucugg

SEQ ID NO: 5182 - RNA, 17 nt, Homo sapiens
acauuuucuggauucug

SEQ ID NO: 5183 - RNA, 17 nt, Homo sapiens
cuggauucugggaggca

SEQ ID NO: 5184 - RNA, 17 nt, Homo sapiens
ugggaggcaagaaaagg

SEQ ID NO: 5185 - RNA, 17 nt, Homo sapiens
aaaaggacaaauaucuu

SEQ ID NO: 5186 - RNA, 17 nt, Homo sapiens
caaauaucuuuuuugga

SEQ ID NO: 5187 - RNA, 17 nt, Homo sapiens
uuuggaacuaaagcaaa

SEQ ID NO: 5188 - RNA, 17 nt, Homo sapiens
acuaaagcaaauuuuag

SEQ ID NO: 5189 - RNA, 17 nt, Homo sapiens
uuuuagaccuuuaccua

SEQ ID NO: 5190 - RNA, 17 nt, Homo sapiens
uuuagaccuuuaccuau

SEQ ID NO: 5191 - RNA, 17 nt, Homo sapiens
accuuuaccuauggaag

SEQ ID NO: 5192 - RNA, 17 nt, Homo sapiens
ccuuuaccuauggaagu

SEQ ID NO: 5193 - RNA, 17 nt, Homo sapiens
agugguucuauguccau

SEQ ID NO: 5194 - RNA, 17 nt, Homo sapiens
ucuauguccauucucau

SEQ ID NO: 5195 - RNA, 17 nt, Homo sapiens
cuauguccauucucauu

SEQ ID NO: 5196 - RNA, 17 nt, Homo sapiens
guccauucucauucgug

SEQ ID NO: 5197 - RNA, 17 nt, Homo sapiens
ccauucucauucguggc

SEQ ID NO: 5198 - RNA, 17 nt, Homo sapiens
uucguggcauguuuuga

SEQ ID NO: 5199 - RNA, 17 nt, Homo sapiens
uuuguagcacugagggu

SEQ ID NO: 5200 - RNA, 17 nt, Homo sapiens
uguagcacugagggugg

SEQ ID NO: 5201 - RNA, 17 nt, Homo sapiens
aggguggcacucaacuc

SEQ ID NO: 5202 - RNA, 17 nt, Homo sapiens
gguggcacucaacucug

SEQ ID NO: 5203 - RNA, 17 nt, Homo sapiens
uggcacucaacucugag

SEQ ID NO: 5204 - RNA, 17 nt, Homo sapiens
cacucaacucugagccc

SEQ ID NO: 5205 - RNA, 17 nt, Homo sapiens
cucaacucugagcccau

SEQ ID NO: 5206 - RNA, 17 nt, Homo sapiens
cucugagcccauacuuu

SEQ ID NO: 5207 - RNA, 17 nt, Homo sapiens
ucugagcccauacuuuu

SEQ ID NO: 5208 - RNA, 17 nt, Homo sapiens
cugagcccauacuuuug

SEQ ID NO: 5209 - RNA, 17 nt, Homo sapiens
gcccauacuuuuggcuc

SEQ ID NO: 5210 - RNA, 17 nt, Homo sapiens
cuuuuggcuccucuagu

SEQ ID NO: 5211 - RNA, 17 nt, Homo sapiens
uuuggcuccucuaguaa

SEQ ID NO: 5212 - RNA, 17 nt, Homo sapiens
uuggcuccucuaguaag

SEQ ID NO: 5213 - RNA, 17 nt, Homo sapiens
ggcuccucuaguaagau

SEQ ID NO: 5214 - RNA, 17 nt, Homo sapiens
uaagaugcacugaaaac

SEQ ID NO: 5215 - RNA, 17 nt, Homo sapiens
agaugcacugaaaacuu

SEQ ID NO: 5216 - RNA, 17 nt, Homo sapiens
cugaaaacuuagccaga

SEQ ID NO: 5217 - RNA, 17 nt, Homo sapiens
aacuuagccagaguuag

SEQ ID NO: 5218 - RNA, 17 nt, Homo sapiens
acuuagccagaguuagg

SEQ ID NO: 5219 - RNA, 17 nt, Homo sapiens
agguugucuccaggcca

SEQ ID NO: 5220 - RNA, 17 nt, Homo sapiens
guugucuccaggccaug

SEQ ID NO: 5221 - RNA, 17 nt, Homo sapiens
uugucuccaggccauga

SEQ ID NO: 5222 - RNA, 17 nt, Homo sapiens
cuccaggccaugauggc

SEQ ID NO: 5223 - RNA, 17 nt, Homo sapiens
uccaggccaugauggcc

SEQ ID NO: 5224 - RNA, 17 nt, Homo sapiens
augauggccuuacacug

SEQ ID NO: 5225 - RNA, 17 nt, Homo sapiens
ugauggccuuacacuga

SEQ ID NO: 5226 - RNA, 17 nt, Homo sapiens
ggccuuacacugaaaau

SEQ ID NO: 5227 - RNA, 17 nt, Homo sapiens
ccuuacacugaaaaugu

SEQ ID NO: 5228 - RNA, 17 nt, Homo sapiens
aaaaugucacauucuau

SEQ ID NO: 5229 - RNA, 17 nt, Homo sapiens
aaugucacauucuauuu

SEQ ID NO: 5230 - RNA, 17 nt, Homo sapiens
ucacauucuauuuuggg

SEQ ID NO: 5231 - RNA, 17 nt, Homo sapiens
auauaguccagacacuu

SEQ ID NO: 5232 - RNA, 17 nt, Homo sapiens
uauaguccagacacuua

SEQ ID NO: 5233 - RNA, 17 nt, Homo sapiens
guccagacacuuaacuc

SEQ ID NO: 5234 - RNA, 17 nt, Homo sapiens
ccagacacuuaacucaa

SEQ ID NO: 5235 - RNA, 17 nt, Homo sapiens
cacuuaacucaauuucu

SEQ ID NO: 5236 - RNA, 17 nt, Homo sapiens
cuuaacucaauuucuug

SEQ ID NO: 5237 - RNA, 17 nt, Homo sapiens
ucaauuucuugguauua

SEQ ID NO: 5238 - RNA, 17 nt, Homo sapiens
uauuauucuguuuugca

SEQ ID NO: 5239 - RNA, 17 nt, Homo sapiens
uguuuugcacaguuagu

SEQ ID NO: 5240 - RNA, 17 nt, Homo sapiens
uuuugcacaguuaguug

SEQ ID NO: 5241 - RNA, 17 nt, Homo sapiens
aagaaagcugagaagaa

SEQ ID NO: 5242 - RNA, 17 nt, Homo sapiens
gaaaaugcaguccugag

SEQ ID NO: 5243 - RNA, 17 nt, Homo sapiens
augcaguccugaggaga

SEQ ID NO: 5244 - RNA, 17 nt, Homo sapiens
ugcaguccugaggagag

SEQ ID NO: 5245 - RNA, 17 nt, Homo sapiens
gaguuuucuccauauca

SEQ ID NO: 5246 - RNA, 17 nt, Homo sapiens
guuuucuccauaucaaa

SEQ ID NO: 5247 - RNA, 17 nt, Homo sapiens
uuuucuccauaucaaaa

SEQ ID NO: 5248 - RNA, 17 nt, Homo sapiens
uccauaucaaaacgagg

SEQ ID NO: 5249 - RNA, 17 nt, Homo sapiens
acgagggcugauggagg

SEQ ID NO: 5250 - RNA, 17 nt, Homo sapiens
aaaaggucaauaagguc

SEQ ID NO: 5251 - RNA, 17 nt, Homo sapiens
auaaggucaagggaaga

SEQ ID NO: 5252 - RNA, 17 nt, Homo sapiens
gggaagaccccgucucu

SEQ ID NO: 5253 - RNA, 17 nt, Homo sapiens
ggaagaccccgucucua

SEQ ID NO: 5254 - RNA, 17 nt, Homo sapiens
gaagaccccgucucuau

SEQ ID NO: 5255 - RNA, 17 nt, Homo sapiens
accccgucucuauacca

SEQ ID NO: 5256 - RNA, 17 nt, Homo sapiens
cccgucucuauaccaac

SEQ ID NO: 5257 - RNA, 17 nt, Homo sapiens
cucuauaccaaccaaac

SEQ ID NO: 5258 - RNA, 17 nt, Homo sapiens
ucuauaccaaccaaacc

SEQ ID NO: 5259 - RNA, 17 nt, Homo sapiens
auaccaaccaaaccaau

SEQ ID NO: 5260 - RNA, 17 nt, Homo sapiens
uaccaaccaaaccaauu

SEQ ID NO: 5261 - RNA, 17 nt, Homo sapiens
aaccaaaccaauucacc

SEQ ID NO: 5262 - RNA, 17 nt, Homo sapiens
accaaaccaauucacca

SEQ ID NO: 5263 - RNA, 17 nt, Homo sapiens
accaauucaccaacaca

SEQ ID NO: 5264 - RNA, 17 nt, Homo sapiens
caauucaccaacacagu

SEQ ID NO: 5265 - RNA, 17 nt, Homo sapiens
aauucaccaacacaguu

SEQ ID NO: 5266 - RNA, 17 nt, Homo sapiens
ucaccaacacaguuggg

SEQ ID NO: 5267 - RNA, 17 nt, Homo sapiens
accaacacaguugggac

SEQ ID NO: 5268 - RNA, 17 nt, Homo sapiens
guugggacccaaaacac

SEQ ID NO: 5269 - RNA, 17 nt, Homo sapiens
uugggacccaaaacaca

SEQ ID NO: 5270 - RNA, 17 nt, Homo sapiens
ugggacccaaaacacag

SEQ ID NO: 5271 - RNA, 17 nt, Homo sapiens
cccaaaacacaggaagu

SEQ ID NO: 5272 - RNA, 17 nt, Homo sapiens
caaaacacaggaaguca

SEQ ID NO: 5273 - RNA, 17 nt, Homo sapiens
aggaagucagucacguu

SEQ ID NO: 5274 - RNA, 17 nt, Homo sapiens
agucagucacguuuccu

SEQ ID NO: 5275 - RNA, 17 nt, Homo sapiens
cacguuuccuuuucauu

SEQ ID NO: 5276 - RNA, 17 nt, Homo sapiens
acguuuccuuuucauuu

SEQ ID NO: 5277 - RNA, 17 nt, Homo sapiens
uccuuuucauuuaaugg

SEQ ID NO: 5278 - RNA, 17 nt, Homo sapiens
ggggauuccacuaucuc

SEQ ID NO: 5279 - RNA, 17 nt, Homo sapiens
gggauuccacuaucuca

SEQ ID NO: 5280 - RNA, 17 nt, Homo sapiens
gauuccacuaucucaca

SEQ ID NO: 5281 - RNA, 17 nt, Homo sapiens
ccacuaucucacacuaa

SEQ ID NO: 5282 - RNA, 17 nt, Homo sapiens
acuaucucacacuaauc

SEQ ID NO: 5283 - RNA, 17 nt, Homo sapiens
uaucucacacuaaucug

SEQ ID NO: 5284 - RNA, 17 nt, Homo sapiens
ucucacacuaaucugaa

SEQ ID NO: 5285 - RNA, 17 nt, Homo sapiens
cacuaaucugaaaggau

SEQ ID NO: 5286 - RNA, 17 nt, Homo sapiens
ggaagagcauuagcugg

SEQ ID NO: 5287 - RNA, 17 nt, Homo sapiens
gcauuagcuggcgcaua

SEQ ID NO: 5288 - RNA, 17 nt, Homo sapiens
gcuggcgcauauuaagc

SEQ ID NO: 5289 - RNA, 17 nt, Homo sapiens
uauuaagcacuuuaagc

SEQ ID NO: 5290 - RNA, 17 nt, Homo sapiens
uuaagcacuuuaagcuc

SEQ ID NO: 5291 - RNA, 17 nt, Homo sapiens
cuuuaagcuccuugagu

SEQ ID NO: 5292 - RNA, 17 nt, Homo sapiens
uuaagcuccuugaguaa

SEQ ID NO: 5293 - RNA, 17 nt, Homo sapiens
uaagcuccuugaguaaa

SEQ ID NO: 5294 - RNA, 17 nt, Homo sapiens
auuuaugcaagguauuu

SEQ ID NO: 5295 - RNA, 17 nt, Homo sapiens
gguauuucuccaguugg

SEQ ID NO: 5296 - RNA, 17 nt, Homo sapiens
uauuucuccaguuggga

SEQ ID NO: 5297 - RNA, 17 nt, Homo sapiens
auuucuccaguugggac

SEQ ID NO: 5298 - RNA, 17 nt, Homo sapiens
guugggacucaggauau

SEQ ID NO: 5299 - RNA, 17 nt, Homo sapiens
ugggacucaggauauua

SEQ ID NO: 5300 - RNA, 17 nt, Homo sapiens
uaaugagccaucacuag

SEQ ID NO: 5301 - RNA, 17 nt, Homo sapiens
aaugagccaucacuaga

SEQ ID NO: 5302 - RNA, 17 nt, Homo sapiens
gagccaucacuagaaga

SEQ ID NO: 5303 - RNA, 17 nt, Homo sapiens
gccaucacuagaagaaa

SEQ ID NO: 5304 - RNA, 17 nt, Homo sapiens
agaaaagcccauuuuca

SEQ ID NO: 5305 - RNA, 17 nt, Homo sapiens
gaaaagcccauuuucaa

SEQ ID NO: 5306 - RNA, 17 nt, Homo sapiens
aaaagcccauuuucaac

SEQ ID NO: 5307 - RNA, 17 nt, Homo sapiens
ccauuuucaacugcuuu

SEQ ID NO: 5308 - RNA, 17 nt, Homo sapiens
uuuucaacugcuuugaa

SEQ ID NO: 5309 - RNA, 17 nt, Homo sapiens
ucaacugcuuugaaacu

SEQ ID NO: 5310 - RNA, 17 nt, Homo sapiens
uuugaaacuugccuggg

SEQ ID NO: 5311 - RNA, 17 nt, Homo sapiens
aaacuugccuggggucu

SEQ ID NO: 5312 - RNA, 17 nt, Homo sapiens
aacuugccuggggucug

SEQ ID NO: 5313 - RNA, 17 nt, Homo sapiens
cuggggucugagcauga

SEQ ID NO: 5314 - RNA, 17 nt, Homo sapiens
gucugagcaugauggga

SEQ ID NO: 5315 - RNA, 17 nt, Homo sapiens
agggagacaggguagga

SEQ ID NO: 5316 - RNA, 17 nt, Homo sapiens
aagggcgccuacucuuc

SEQ ID NO: 5317 - RNA, 17 nt, Homo sapiens
agggcgccuacucuuca

SEQ ID NO: 5318 - RNA, 17 nt, Homo sapiens
gcgccuacucuucaggg

SEQ ID NO: 5319 - RNA, 17 nt, Homo sapiens
gccuacucuucaggguc

SEQ ID NO: 5320 - RNA, 17 nt, Homo sapiens
uacucuucagggucuaa

SEQ ID NO: 5321 - RNA, 17 nt, Homo sapiens
ucagggucuaaagauca

SEQ ID NO: 5322 - RNA, 17 nt, Homo sapiens
uaaagaucaagugggcc

SEQ ID NO: 5323 - RNA, 17 nt, Homo sapiens
aagugggccuuggaucg

SEQ ID NO: 5324 - RNA, 17 nt, Homo sapiens
agugggccuuggaucgc

SEQ ID NO: 5325 - RNA, 17 nt, Homo sapiens
uggaucgcuaagcuggc

SEQ ID NO: 5326 - RNA, 17 nt, Homo sapiens
cgcuaagcuggcucugu

SEQ ID NO: 5327 - RNA, 17 nt, Homo sapiens
aagcuggcucuguuuga

SEQ ID NO: 5328 - RNA, 17 nt, Homo sapiens
gcuggcucuguuugaug

SEQ ID NO: 5329 - RNA, 17 nt, Homo sapiens
uuugaugcuauuuaugc

SEQ ID NO: 5330 - RNA, 17 nt, Homo sapiens
auuuaugcaaguuaggg

SEQ ID NO: 5331 - RNA, 17 nt, Homo sapiens
uuagggucuauguauuu

SEQ ID NO: 5332 - RNA, 17 nt, Homo sapiens
ggaugcgccuacucuuc

SEQ ID NO: 5333 - RNA, 17 nt, Homo sapiens
gaugcgccuacucuuca

SEQ ID NO: 5334 - RNA, 17 nt, Homo sapiens
aggaugucugcaccuuc

SEQ ID NO: 5335 - RNA, 17 nt, Homo sapiens
augucugcaccuucugc

SEQ ID NO: 5336 - RNA, 17 nt, Homo sapiens
gucugcaccuucugcag

SEQ ID NO: 5337 - RNA, 17 nt, Homo sapiens
ucugcaccuucugcagc

SEQ ID NO: 5338 - RNA, 17 nt, Homo sapiens
gcaccuucugcagccag

SEQ ID NO: 5339 - RNA, 17 nt, Homo sapiens
ccuucugcagccaguca

SEQ ID NO: 5340 - RNA, 17 nt, Homo sapiens
ucugcagccagucagaa

SEQ ID NO: 5341 - RNA, 17 nt, Homo sapiens
cugcagccagucagaag

SEQ ID NO: 5342 - RNA, 17 nt, Homo sapiens
agccagucagaagcugg

SEQ ID NO: 5343 - RNA, 17 nt, Homo sapiens
ucagaagcuggagaggc

SEQ ID NO: 5344 - RNA, 17 nt, Homo sapiens
ggagaggcaacagugga

SEQ ID NO: 5345 - RNA, 17 nt, Homo sapiens
gaggcaacaguggauug

SEQ ID NO: 5346 - RNA, 17 nt, Homo sapiens
uggauugcugcuucuug

SEQ ID NO: 5347 - RNA, 17 nt, Homo sapiens
auugcugcuucuugggg

SEQ ID NO: 5348 - RNA, 17 nt, Homo sapiens
gcugcuucuuggggaga

SEQ ID NO: 5349 - RNA, 17 nt, Homo sapiens
gaguaugcuuccuuuua

SEQ ID NO: 5350 - RNA, 17 nt, Homo sapiens
uaugcuuccuuuuaucc

SEQ ID NO: 5351 - RNA, 17 nt, Homo sapiens
augcuuccuuuuaucca

SEQ ID NO: 5352 - RNA, 17 nt, Homo sapiens
cuuuuauccauguaauu

SEQ ID NO: 5353 - RNA, 17 nt, Homo sapiens
uuuuauccauguaauuu

SEQ ID NO: 5354 - RNA, 17 nt, Homo sapiens
aauuuaacuguagaacc

SEQ ID NO: 5355 - RNA, 17 nt, Homo sapiens
uguagaaccugagcucu

SEQ ID NO: 5356 - RNA, 17 nt, Homo sapiens
guagaaccugagcucua

SEQ ID NO: 5357 - RNA, 17 nt, Homo sapiens
accugagcucuaaguaa

SEQ ID NO: 5358 - RNA, 17 nt, Homo sapiens
cugagcucuaaguaacc

SEQ ID NO: 5359 - RNA, 17 nt, Homo sapiens
uaaguaaccgaagaaug

SEQ ID NO: 5360 - RNA, 17 nt, Homo sapiens
auguaugccucuguucu

SEQ ID NO: 5361 - RNA, 17 nt, Homo sapiens
uguaugccucuguucuu

SEQ ID NO: 5362 - RNA, 17 nt, Homo sapiens
uaugccucuguucuuau

SEQ ID NO: 5363 - RNA, 17 nt, Homo sapiens
cucuguucuuaugugcc

SEQ ID NO: 5364 - RNA, 17 nt, Homo sapiens
uuaugugccacauccuu

SEQ ID NO: 5365 - RNA, 17 nt, Homo sapiens
uaugugccacauccuug

SEQ ID NO: 5366 - RNA, 17 nt, Homo sapiens
ugugccacauccuuguu

SEQ ID NO: 5367 - RNA, 17 nt, Homo sapiens
gccacauccuuguuuaa

SEQ ID NO: 5368 - RNA, 17 nt, Homo sapiens
ccacauccuuguuuaaa

SEQ ID NO: 5369 - RNA, 17 nt, Homo sapiens
uuaaaggcucucuguau

SEQ ID NO: 5370 - RNA, 17 nt, Homo sapiens
aaaggcucucuguauga

SEQ ID NO: 5371 - RNA, 17 nt, Homo sapiens
aggcucucuguaugaag

SEQ ID NO: 5372 - RNA, 17 nt, Homo sapiens
gaugggaccgucaucag

SEQ ID NO: 5373 - RNA, 17 nt, Homo sapiens
ggaccgucaucagcaca

SEQ ID NO: 5374 - RNA, 17 nt, Homo sapiens
ccgucaucagcacauuc

SEQ ID NO: 5375 - RNA, 17 nt, Homo sapiens
ucaucagcacauucccu

SEQ ID NO: 5376 - RNA, 17 nt, Homo sapiens
aucagcacauucccuag

SEQ ID NO: 5377 - RNA, 17 nt, Homo sapiens
gcacauucccuagugag

SEQ ID NO: 5378 - RNA, 17 nt, Homo sapiens
cacauucccuagugagc

SEQ ID NO: 5379 - RNA, 17 nt, Homo sapiens
acauucccuagugagcc

SEQ ID NO: 5380 - RNA, 17 nt, Homo sapiens
uagugagccuacuggcu

SEQ ID NO: 5381 - RNA, 17 nt, Homo sapiens
agugagccuacuggcuc

SEQ ID NO: 5382 - RNA, 17 nt, Homo sapiens
gagccuacuggcuccug

SEQ ID NO: 5383 - RNA, 17 nt, Homo sapiens
cuacuggcuccuggcag

SEQ ID NO: 5384 - RNA, 17 nt, Homo sapiens
acuggcuccuggcagcg

SEQ ID NO: 5385 - RNA, 17 nt, Homo sapiens
cuggcuccuggcagcgg

SEQ ID NO: 5386 - RNA, 17 nt, Homo sapiens
cuccuggcagcggcuuu

SEQ ID NO: 5387 - RNA, 17 nt, Homo sapiens
gcagcggcuuuugugga

SEQ ID NO: 5388 - RNA, 17 nt, Homo sapiens
uggaagacucacuagcc

SEQ ID NO: 5389 - RNA, 17 nt, Homo sapiens
gaagacucacuagccag

SEQ ID NO: 5390 - RNA, 17 nt, Homo sapiens
agacucacuagccagaa

SEQ ID NO: 5391 - RNA, 17 nt, Homo sapiens
ucacuagccagaagaga

SEQ ID NO: 5392 - RNA, 17 nt, Homo sapiens
cacuagccagaagagag

SEQ ID NO: 5393 - RNA, 17 nt, Homo sapiens
agugggacaguccucuc

SEQ ID NO: 5394 - RNA, 17 nt, Homo sapiens
ggacaguccucuccacc

SEQ ID NO: 5395 - RNA, 17 nt, Homo sapiens
gacaguccucuccacca

SEQ ID NO: 5396 - RNA, 17 nt, Homo sapiens
caguccucuccaccaag

SEQ ID NO: 5397 - RNA, 17 nt, Homo sapiens
guccucuccaccaagau

SEQ ID NO: 5398 - RNA, 17 nt, Homo sapiens
uccucuccaccaagauc

SEQ ID NO: 5399 - RNA, 17 nt, Homo sapiens
cucuccaccaagaucua

SEQ ID NO: 5400 - RNA, 17 nt, Homo sapiens
ucuccaccaagaucuaa

SEQ ID NO: 5401 - RNA, 17 nt, Homo sapiens
ccaagaucuaaauccaa

SEQ ID NO: 5402 - RNA, 17 nt, Homo sapiens
ucuaaauccaaacaaaa

SEQ ID NO: 5403 - RNA, 17 nt, Homo sapiens
cuaaauccaaacaaaag

SEQ ID NO: 5404 - RNA, 17 nt, Homo sapiens
auccaaacaaaagcagg

SEQ ID NO: 5405 - RNA, 17 nt, Homo sapiens
acaaaagcaggcuagag

SEQ ID NO: 5406 - RNA, 17 nt, Homo sapiens
aagcaggcuagagccag

SEQ ID NO: 5407 - RNA, 17 nt, Homo sapiens
gcuagagccagaagaga

SEQ ID NO: 5408 - RNA, 17 nt, Homo sapiens
cuagagccagaagagag

SEQ ID NO: 5409 - RNA, 17 nt, Homo sapiens
gagaggacaaaucuuug

SEQ ID NO: 5410 - RNA, 17 nt, Homo sapiens
gacaaaucuuuguuguu

SEQ ID NO: 5411 - RNA, 17 nt, Homo sapiens
uguuguuccucuucuuu

SEQ ID NO: 5412 - RNA, 17 nt, Homo sapiens
guuguuccucuucuuua

SEQ ID NO: 5413 - RNA, 17 nt, Homo sapiens
uguuccucuucuuuaca

SEQ ID NO: 5414 - RNA, 17 nt, Homo sapiens
uccucuucuuuacacau

SEQ ID NO: 5415 - RNA, 17 nt, Homo sapiens
uucuuuacacauacgca

SEQ ID NO: 5416 - RNA, 17 nt, Homo sapiens
cuuuacacauacgcaaa

SEQ ID NO: 5417 - RNA, 17 nt, Homo sapiens
acauacgcaaaccaccu

SEQ ID NO: 5418 - RNA, 17 nt, Homo sapiens
acgcaaaccaccuguga

SEQ ID NO: 5419 - RNA, 17 nt, Homo sapiens
cgcaaaccaccugugac

SEQ ID NO: 5420 - RNA, 17 nt, Homo sapiens
caaaccaccugugacag

SEQ ID NO: 5421 - RNA, 17 nt, Homo sapiens
aaaccaccugugacagc

SEQ ID NO: 5422 - RNA, 17 nt, Homo sapiens
ccugugacagcuggcaa

SEQ ID NO: 5423 - RNA, 17 nt, Homo sapiens
gugacagcuggcaauuu

SEQ ID NO: 5424 - RNA, 17 nt, Homo sapiens
cagcuggcaauuuuaua

SEQ ID NO: 5425 - RNA, 17 nt, Homo sapiens
uauaaaucagguaacug

SEQ ID NO: 5426 - RNA, 17 nt, Homo sapiens
cagguaacuggaaggag

SEQ ID NO: 5427 - RNA, 17 nt, Homo sapiens
gguuaaacucagaaaaa

SEQ ID NO: 5428 - RNA, 17 nt, Homo sapiens
uuaaacucagaaaaaag

SEQ ID NO: 5429 - RNA, 17 nt, Homo sapiens
aagaagaccucagucaa

SEQ ID NO: 5430 - RNA, 17 nt, Homo sapiens
agaagaccucagucaau

SEQ ID NO: 5431 - RNA, 17 nt, Homo sapiens
aagaccucagucaauuc

SEQ ID NO: 5432 - RNA, 17 nt, Homo sapiens
ccucagucaauucucua

SEQ ID NO: 5433 - RNA, 17 nt, Homo sapiens
gucaauucucuacuuuu

SEQ ID NO: 5434 - RNA, 17 nt, Homo sapiens
caauucucuacuuuuuu

SEQ ID NO: 5435 - RNA, 17 nt, Homo sapiens
uucucuacuuuuuuuuu

SEQ ID NO: 5436 - RNA, 17 nt, Homo sapiens
uuuuuuuccaaaucaga

SEQ ID NO: 5437 - RNA, 17 nt, Homo sapiens
uuuuuuccaaaucagau

SEQ ID NO: 5438 - RNA, 17 nt, Homo sapiens
uccaaaucagauaauag

SEQ ID NO: 5439 - RNA, 17 nt, Homo sapiens
auaauagcccagcaaau

SEQ ID NO: 5440 - RNA, 17 nt, Homo sapiens
uaauagcccagcaaaua

SEQ ID NO: 5441 - RNA, 17 nt, Homo sapiens
aauagcccagcaaauag

SEQ ID NO: 5442 - RNA, 17 nt, Homo sapiens
agcccagcaaauaguga

SEQ ID NO: 5443 - RNA, 17 nt, Homo sapiens
gugauaacaaauaaaac

SEQ ID NO: 5444 - RNA, 17 nt, Homo sapiens
aauaaaaccuuagcugu

SEQ ID NO: 5445 - RNA, 17 nt, Homo sapiens
auaaaaccuuagcuguu

SEQ ID NO: 5446 - RNA, 17 nt, Homo sapiens
accuuagcuguucaugu

SEQ ID NO: 5447 - RNA, 17 nt, Homo sapiens
agcuguucaugucuuga

SEQ ID NO: 5448 - RNA, 17 nt, Homo sapiens
uucaugucuugauuuca

SEQ ID NO: 5449 - RNA, 17 nt, Homo sapiens
uugauuucaauaauuaa

SEQ ID NO: 5450 - RNA, 17 nt, Homo sapiens
auuaauucuuaaucauu

SEQ ID NO: 5451 - RNA, 17 nt, Homo sapiens
ucuuaaucauuaagaga

SEQ ID NO: 5452 - RNA, 17 nt, Homo sapiens
uaagagaccauaauaaa

SEQ ID NO: 5453 - RNA, 17 nt, Homo sapiens
aagagaccauaauaaau

SEQ ID NO: 5454 - RNA, 17 nt, Homo sapiens
auaaauacuccuuuuca

SEQ ID NO: 5455 - RNA, 17 nt, Homo sapiens
aaauacuccuuuucaag

SEQ ID NO: 5456 - RNA, 17 nt, Homo sapiens
aauacuccuuuucaaga

SEQ ID NO: 5457 - RNA, 17 nt, Homo sapiens
uccuuuucaagagaaaa

SEQ ID NO: 5458 - RNA, 17 nt, Homo sapiens
agaaaagcaaaaccauu

SEQ ID NO: 5459 - RNA, 17 nt, Homo sapiens
agcaaaaccauuagaau

SEQ ID NO: 5460 - RNA, 17 nt, Homo sapiens
gcaaaaccauuagaauu

SEQ ID NO: 5461 - RNA, 17 nt, Homo sapiens
auuguuacucagcuccu

SEQ ID NO: 5462 - RNA, 17 nt, Homo sapiens
uguuacucagcuccuuc

SEQ ID NO: 5463 - RNA, 17 nt, Homo sapiens
uacucagcuccuucaaa

SEQ ID NO: 5464 - RNA, 17 nt, Homo sapiens
cucagcuccuucaaacu

SEQ ID NO: 5465 - RNA, 17 nt, Homo sapiens
ucagcuccuucaaacuc

SEQ ID NO: 5466 - RNA, 17 nt, Homo sapiens
gcuccuucaaacucagg

SEQ ID NO: 5467 - RNA, 17 nt, Homo sapiens
cuucaaacucagguuug

SEQ ID NO: 5468 - RNA, 17 nt, Homo sapiens
ucaaacucagguuugua

SEQ ID NO: 5469 - RNA, 17 nt, Homo sapiens
uuuguagcauacaugag

SEQ ID NO: 5470 - RNA, 17 nt, Homo sapiens
uagcauacaugagucca

SEQ ID NO: 5471 - RNA, 17 nt, Homo sapiens
caugaguccauccauca

SEQ ID NO: 5472 - RNA, 17 nt, Homo sapiens
augaguccauccaucag

SEQ ID NO: 5473 - RNA, 17 nt, Homo sapiens
aguccauccaucaguca

SEQ ID NO: 5474 - RNA, 17 nt, Homo sapiens
guccauccaucagucaa

SEQ ID NO: 5475 - RNA, 17 nt, Homo sapiens
cauccaucagucaaaga

SEQ ID NO: 5476 - RNA, 17 nt, Homo sapiens
caucagucaaagaaugg

SEQ ID NO: 5477 - RNA, 17 nt, Homo sapiens
aaugguuccaucuggag

SEQ ID NO: 5478 - RNA, 17 nt, Homo sapiens
augguuccaucuggagu

SEQ ID NO: 5479 - RNA, 17 nt, Homo sapiens
guuccaucuggagucuu

SEQ ID NO: 5480 - RNA, 17 nt, Homo sapiens
cuggagucuuaauguag

SEQ ID NO: 5481 - RNA, 17 nt, Homo sapiens
auggagacuuguaauaa

SEQ ID NO: 5482 - RNA, 17 nt, Homo sapiens
uaaugagcuaguuacaa

SEQ ID NO: 5483 - RNA, 17 nt, Homo sapiens
cuaguuacaaagugcuu

SEQ ID NO: 5484 - RNA, 17 nt, Homo sapiens
caaagugcuuguucauu

SEQ ID NO: 5485 - RNA, 17 nt, Homo sapiens
gcuuguucauuaaaaua

SEQ ID NO: 5486 - RNA, 17 nt, Homo sapiens
aaaauagcacugaaaau

SEQ ID NO: 5487 - RNA, 17 nt, Homo sapiens
aauagcacugaaaauug

SEQ ID NO: 5488 - RNA, 17 nt, Homo sapiens
auugaaacaugaauuaa

SEQ ID NO: 5489 - RNA, 17 nt, Homo sapiens
gaauuaacugauaauau

SEQ ID NO: 5490 - RNA, 17 nt, Homo sapiens
uaauauuccaaucauuu

SEQ ID NO: 5491 - RNA, 17 nt, Homo sapiens
aauauuccaaucauuug

SEQ ID NO: 5492 - RNA, 17 nt, Homo sapiens
uuccaaucauuugccau

SEQ ID NO: 5493 - RNA, 17 nt, Homo sapiens
ucauuugccauuuauga

SEQ ID NO: 5494 - RNA, 17 nt, Homo sapiens
cauuugccauuuaugac

SEQ ID NO: 5495 - RNA, 17 nt, Homo sapiens
uuuaugacaaaaauggu

SEQ ID NO: 5496 - RNA, 17 nt, Homo sapiens
ugguuggcacuaacaaa

SEQ ID NO: 5497 - RNA, 17 nt, Homo sapiens
guuggcacuaacaaaga

SEQ ID NO: 5498 - RNA, 17 nt, Homo sapiens
gcacuaacaaagaacga

SEQ ID NO: 5499 - RNA, 17 nt, Homo sapiens
gaacgagcacuuccuuu

SEQ ID NO: 5500 - RNA, 17 nt, Homo sapiens
acgagcacuuccuuuca

SEQ ID NO: 5501 - RNA, 17 nt, Homo sapiens
agcacuuccuuucagag

SEQ ID NO: 5502 - RNA, 17 nt, Homo sapiens
gcacuuccuuucagagu

SEQ ID NO: 5503 - RNA, 17 nt, Homo sapiens
uuccuuucagaguuucu

SEQ ID NO: 5504 - RNA, 17 nt, Homo sapiens
agaguuucugagauaau

SEQ ID NO: 5505 - RNA, 17 nt, Homo sapiens
cguggaacagucugggu

SEQ ID NO: 5506 - RNA, 17 nt, Homo sapiens
gaacagucuggguggaa

SEQ ID NO: 5507 - RNA, 17 nt, Homo sapiens
aauggggcugaaaccau

SEQ ID NO: 5508 - RNA, 17 nt, Homo sapiens
gcugaaaccaugugcaa

SEQ ID NO: 5509 - RNA, 17 nt, Homo sapiens
cugaaaccaugugcaag

SEQ ID NO: 5510 - RNA, 17 nt, Homo sapiens
ccaugugcaagucugug

SEQ ID NO: 5511 - RNA, 17 nt, Homo sapiens
ugcaagucugugucuug

SEQ ID NO: 5512 - RNA, 17 nt, Homo sapiens
ucugugucuugucaguc

SEQ ID NO: 5513 - RNA, 17 nt, Homo sapiens
gucuugucaguccaaga

SEQ ID NO: 5514 - RNA, 17 nt, Homo sapiens
ugucaguccaagaagug

SEQ ID NO: 5515 - RNA, 17 nt, Homo sapiens
gucaguccaagaaguga

SEQ ID NO: 5516 - RNA, 17 nt, Homo sapiens
gaagugacaccgagaug

SEQ ID NO: 5517 - RNA, 17 nt, Homo sapiens
agugacaccgagauguu

SEQ ID NO: 5518 - RNA, 17 nt, Homo sapiens
uuagggacccgugccuu

SEQ ID NO: 5519 - RNA, 17 nt, Homo sapiens
uagggacccgugccuug

SEQ ID NO: 5520 - RNA, 17 nt, Homo sapiens
acccgugccuuguuucc

SEQ ID NO: 5521 - RNA, 17 nt, Homo sapiens
cccgugccuuguuuccu

SEQ ID NO: 5522 - RNA, 17 nt, Homo sapiens
cuuguuuccuagcccac

SEQ ID NO: 5523 - RNA, 17 nt, Homo sapiens
uuguuuccuagcccaca

SEQ ID NO: 5524 - RNA, 17 nt, Homo sapiens
uuccuagcccacaagaa

SEQ ID NO: 5525 - RNA, 17 nt, Homo sapiens
uccuagcccacaagaau

SEQ ID NO: 5526 - RNA, 17 nt, Homo sapiens
ccuagcccacaagaaug

SEQ ID NO: 5527 - RNA, 17 nt, Homo sapiens
uagcccacaagaaugca

SEQ ID NO: 5528 - RNA, 17 nt, Homo sapiens
aagaaugcaaacaucaa

SEQ ID NO: 5529 - RNA, 17 nt, Homo sapiens
augcaaacaucaaacag

SEQ ID NO: 5530 - RNA, 17 nt, Homo sapiens
caaacaucaaacagaua

SEQ ID NO: 5531 - RNA, 17 nt, Homo sapiens
caucaaacagauacucg

SEQ ID NO: 5532 - RNA, 17 nt, Homo sapiens
acagauacucgcuagcc

SEQ ID NO: 5533 - RNA, 17 nt, Homo sapiens
auacucgcuagccucau

SEQ ID NO: 5534 - RNA, 17 nt, Homo sapiens
ucgcuagccucauuuaa

SEQ ID NO: 5535 - RNA, 17 nt, Homo sapiens
cgcuagccucauuuaaa

SEQ ID NO: 5536 - RNA, 17 nt, Homo sapiens
cuagccucauuuaaauu

SEQ ID NO: 5537 - RNA, 17 nt, Homo sapiens
aggagugcaucuuuggc

SEQ ID NO: 5538 - RNA, 17 nt, Homo sapiens
agugcaucuuuggccga

SEQ ID NO: 5539 - RNA, 17 nt, Homo sapiens
ucuuuggccgacagugg

SEQ ID NO: 5540 - RNA, 17 nt, Homo sapiens
uggccgacaguggugua

SEQ ID NO: 5541 - RNA, 17 nt, Homo sapiens
gguguaacugugugugu

SEQ ID NO: 5542 - RNA, 17 nt, Homo sapiens
uuuugugcauaacuauu

SEQ ID NO: 5543 - RNA, 17 nt, Homo sapiens
ugcauaacuauuuaagg

SEQ ID NO: 5544 - RNA, 17 nt, Homo sapiens
aaggaaacuggaauuuu

SEQ ID NO: 5545 - RNA, 17 nt, Homo sapiens
aaaguuacuuuuauaca

SEQ ID NO: 5546 - RNA, 17 nt, Homo sapiens
uuuuauacaaaccaaga

SEQ ID NO: 5547 - RNA, 17 nt, Homo sapiens
auacaaaccaagaauau

SEQ ID NO: 5548 - RNA, 17 nt, Homo sapiens
uacaaaccaagaauaua

SEQ ID NO: 5549 - RNA, 17 nt, Homo sapiens
auauaugcuacagauau

SEQ ID NO: 5550 - RNA, 17 nt, Homo sapiens
uaugcuacagauauaag

SEQ ID NO: 5551 - RNA, 17 nt, Homo sapiens
uauaagacagacauggu

SEQ ID NO: 5552 - RNA, 17 nt, Homo sapiens
agacagacaugguuugg

SEQ ID NO: 5553 - RNA, 17 nt, Homo sapiens
guuugguccuauauuuc

SEQ ID NO: 5554 - RNA, 17 nt, Homo sapiens
uuugguccuauauuucu

SEQ ID NO: 5555 - RNA, 17 nt, Homo sapiens
uauauuucuagucauga

SEQ ID NO: 5556 - RNA, 17 nt, Homo sapiens
uucuagucaugaugaau

SEQ ID NO: 5557 - RNA, 17 nt, Homo sapiens
uuguauaccaucuucau

SEQ ID NO: 5558 - RNA, 17 nt, Homo sapiens
uguauaccaucuucaua

SEQ ID NO: 5559 - RNA, 17 nt, Homo sapiens
auaccaucuucauauaa

SEQ ID NO: 5560 - RNA, 17 nt, Homo sapiens
ccaucuucauauaauau

SEQ ID NO: 5561 - RNA, 17 nt, Homo sapiens
uaauauacuuaaaaaua

SEQ ID NO: 5562 - RNA, 17 nt, Homo sapiens
aauauuucuuaauuggg

SEQ ID NO: 5563 - RNA, 17 nt, Homo sapiens
aaucguaccaacuuaau

SEQ ID NO: 5564 - RNA, 17 nt, Homo sapiens
aucguaccaacuuaauu

SEQ ID NO: 5565 - RNA, 17 nt, Homo sapiens
guaccaacuuaauugau

SEQ ID NO: 5566 - RNA, 17 nt, Homo sapiens
ugauaaacuuggcaacu

SEQ ID NO: 5567 - RNA, 17 nt, Homo sapiens
aacuuggcaacugcuuu

SEQ ID NO: 5568 - RNA, 17 nt, Homo sapiens
uuggcaacugcuuuuau

SEQ ID NO: 5569 - RNA, 17 nt, Homo sapiens
gcaacugcuuuuauguu

SEQ ID NO: 5570 - RNA, 17 nt, Homo sapiens
uuauguucugucuccuu

SEQ ID NO: 5571 - RNA, 17 nt, Homo sapiens
guucugucuccuuccau

SEQ ID NO: 5572 - RNA, 17 nt, Homo sapiens
ucugucuccuuccauaa

SEQ ID NO: 5573 - RNA, 17 nt, Homo sapiens
cugucuccuuccauaaa

SEQ ID NO: 5574 - RNA, 17 nt, Homo sapiens
ucuccuuccauaaauuu

SEQ ID NO: 5575 - RNA, 17 nt, Homo sapiens
cuccuuccauaaauuuu

SEQ ID NO: 5576 - RNA, 17 nt, Homo sapiens
aauuuuucaaaauacua

SEQ ID NO: 5577 - RNA, 17 nt, Homo sapiens
caaaauacuaauucaac

SEQ ID NO: 5578 - RNA, 17 nt, Homo sapiens
acuaauucaacaaagaa

SEQ ID NO: 5579 - RNA, 17 nt, Homo sapiens
aauucaacaaagaaaaa

SEQ ID NO: 5580 - RNA, 17 nt, Homo sapiens
gaaaaagcucuuuuuuu

SEQ ID NO: 5581 - RNA, 17 nt, Homo sapiens
aaaagcucuuuuuuuuc

SEQ ID NO: 5582 - RNA, 17 nt, Homo sapiens
uuuuuuuccuaaaauaa

SEQ ID NO: 5583 - RNA, 17 nt, Homo sapiens
uuuuuuccuaaaauaaa

SEQ ID NO: 5584 - RNA, 17 nt, Homo sapiens
aaauaaacucaaauuua

SEQ ID NO: 5585 - RNA, 17 nt, Homo sapiens
auaaacucaaauuuauc

SEQ ID NO: 5586 - RNA, 17 nt, Homo sapiens
aauuuauccuuguuuag

SEQ ID NO: 5587 - RNA, 17 nt, Homo sapiens
auuuauccuuguuuaga

SEQ ID NO: 5588 - RNA, 17 nt, Homo sapiens
uuuagagcagagaaaaa

SEQ ID NO: 5589 - RNA, 17 nt, Homo sapiens
agaaaaacuuugaaaug

SEQ ID NO: 5590 - RNA, 17 nt, Homo sapiens
aaauggucucaaaaaau

SEQ ID NO: 5591 - RNA, 17 nt, Homo sapiens
auggucucaaaaaauug

SEQ ID NO: 5592 - RNA, 17 nt, Homo sapiens
aaaauugcuaaauauuu

SEQ ID NO: 5593 - RNA, 17 nt, Homo sapiens
auauuuucaauggaaaa

SEQ ID NO: 5594 - RNA, 17 nt, Homo sapiens
uggaaaacuaaauguua

SEQ ID NO: 5595 - RNA, 17 nt, Homo sapiens
aguuuagcugauuguau

SEQ ID NO: 5596 - RNA, 17 nt, Homo sapiens
uuucgaaccuuucacuu

SEQ ID NO: 5597 - RNA, 17 nt, Homo sapiens
uucgaaccuuucacuuu

SEQ ID NO: 5598 - RNA, 17 nt, Homo sapiens
aaccuuucacuuuuugu

SEQ ID NO: 5599 - RNA, 17 nt, Homo sapiens
ccuuucacuuuuuguuu

SEQ ID NO: 5600 - RNA, 17 nt, Homo sapiens
uguuuuaccuauuucac

SEQ ID NO: 5601 - RNA, 17 nt, Homo sapiens
guuuuaccuauuucaca

SEQ ID NO: 5602 - RNA, 17 nt, Homo sapiens
ccuauuucacaacugug

SEQ ID NO: 5603 - RNA, 17 nt, Homo sapiens
uauuucacaacugugua

SEQ ID NO: 5604 - RNA, 17 nt, Homo sapiens
uucacaacuguguaaau

SEQ ID NO: 5605 - RNA, 17 nt, Homo sapiens
uaaauugccaauaauuc

SEQ ID NO: 5606 - RNA, 17 nt, Homo sapiens
aaauugccaauaauucc

SEQ ID NO: 5607 - RNA, 17 nt, Homo sapiens
aauaauuccuguccaug

SEQ ID NO: 5608 - RNA, 17 nt, Homo sapiens
auaauuccuguccauga

SEQ ID NO: 5609 - RNA, 17 nt, Homo sapiens
uuccuguccaugaaaau

SEQ ID NO: 5610 - RNA, 17 nt, Homo sapiens
uccuguccaugaaaaug

SEQ ID NO: 5611 - RNA, 17 nt, Homo sapiens
gaaaaugcaaauuaucc

SEQ ID NO: 5612 - RNA, 17 nt, Homo sapiens
aaauuauccaguguaga

SEQ ID NO: 5613 - RNA, 17 nt, Homo sapiens
aauuauccaguguagau

SEQ ID NO: 5614 - RNA, 17 nt, Homo sapiens
uauuugaccaucacccu

SEQ ID NO: 5615 - RNA, 17 nt, Homo sapiens
auuugaccaucacccua

SEQ ID NO: 5616 - RNA, 17 nt, Homo sapiens
ugaccaucacccuaugg

SEQ ID NO: 5617 - RNA, 17 nt, Homo sapiens
accaucacccuauggau

SEQ ID NO: 5618 - RNA, 17 nt, Homo sapiens
ccaucacccuauggaua

SEQ ID NO: 5619 - RNA, 17 nt, Homo sapiens
caucacccuauggauau

SEQ ID NO: 5620 - RNA, 17 nt, Homo sapiens
auauuggcuaguuuugc

SEQ ID NO: 5621 - RNA, 17 nt, Homo sapiens
aguuuugccuuuauuaa

SEQ ID NO: 5622 - RNA, 17 nt, Homo sapiens
guuuugccuuuauuaag

SEQ ID NO: 5623 - RNA, 17 nt, Homo sapiens
uauuaagcaaauucauu

SEQ ID NO: 5624 - RNA, 17 nt, Homo sapiens
gcaaauucauuucagcc

SEQ ID NO: 5625 - RNA, 17 nt, Homo sapiens
uucauuucagccugaau

SEQ ID NO: 5626 - RNA, 17 nt, Homo sapiens
auuucagccugaauguc

SEQ ID NO: 5627 - RNA, 17 nt, Homo sapiens
uuucagccugaaugucu

SEQ ID NO: 5628 - RNA, 17 nt, Homo sapiens
ugaaugucugccuauau

SEQ ID NO: 5629 - RNA, 17 nt, Homo sapiens
augucugccuauauauu

SEQ ID NO: 5630 - RNA, 17 nt, Homo sapiens
ugucugccuauauauuc

SEQ ID NO: 5631 - RNA, 17 nt, Homo sapiens
auauauucucugcucuu

SEQ ID NO: 5632 - RNA, 17 nt, Homo sapiens
auauucucugcucuuug

SEQ ID NO: 5633 - RNA, 17 nt, Homo sapiens
uucucugcucuuuguau

SEQ ID NO: 5634 - RNA, 17 nt, Homo sapiens
cucugcucuuuguauuc

SEQ ID NO: 5635 - RNA, 17 nt, Homo sapiens
uuguauucuccuuugaa

SEQ ID NO: 5636 - RNA, 17 nt, Homo sapiens
guauucuccuuugaacc

SEQ ID NO: 5637 - RNA, 17 nt, Homo sapiens
uauucuccuuugaaccc

SEQ ID NO: 5638 - RNA, 17 nt, Homo sapiens
cuuugaacccguuaaaa

SEQ ID NO: 5639 - RNA, 17 nt, Homo sapiens
uuugaacccguuaaaac

SEQ ID NO: 5640 - RNA, 17 nt, Homo sapiens
guuaaaacauccugugg

SEQ ID NO: 5641 - RNA, 17 nt, Homo sapiens
aaaacauccuguggcac

SEQ ID NO: 5642 - RNA, 17 nt, Homo sapiens
aaacauccuguggcacu

SEQ ID NO: 5643 - RNA, 16 nt, Homo sapiens
gggcucgggugcagcg

SEQ ID NO: 5644 - RNA, 16 nt, Homo sapiens
gccuggcggcgaggau

SEQ ID NO: 5645 - RNA, 16 nt, Homo sapiens
ggaagugguugucucc

SEQ ID NO: 5646 - RNA, 16 nt, Homo sapiens
ggcuggagccgcgaga

SEQ ID NO: 5647 - RNA, 16 nt, Homo sapiens
cuggagccgcgagacg

SEQ ID NO: 5648 - RNA, 16 nt, Homo sapiens
cgagacgggcgcucag

SEQ ID NO: 5649 - RNA, 16 nt, Homo sapiens
cgcucagggcgcgggg

SEQ ID NO: 5650 - RNA, 16 nt, Homo sapiens
cggcggcggcgaacga

SEQ ID NO: 5651 - RNA, 16 nt, Homo sapiens
ggcggcgaacgagagg

SEQ ID NO: 5652 - RNA, 16 nt, Homo sapiens
ccgggggagcgcgggc

SEQ ID NO: 5653 - RNA, 16 nt, Homo sapiens
ggcaccgggcgagcag

SEQ ID NO: 5654 - RNA, 16 nt, Homo sapiens
cgagcaggccgcgucg

SEQ ID NO: 5655 - RNA, 16 nt, Homo sapiens
aggccgcgucgcgcuc

SEQ ID NO: 5656 - RNA, 16 nt, Homo sapiens
gccgcgucgcgcucac

SEQ ID NO: 5657 - RNA, 16 nt, Homo sapiens
ccgggguccugcugug

SEQ ID NO: 5658 - RNA, 16 nt, Homo sapiens
ggguccugcugugcgc

SEQ ID NO: 5659 - RNA, 16 nt, Homo sapiens
guccugcugugcgcgc

SEQ ID NO: 5660 - RNA, 16 nt, Homo sapiens
ccugcugugcgcgcug

SEQ ID NO: 5661 - RNA, 16 nt, Homo sapiens
ugcugugcgcgcugcu

SEQ ID NO: 5662 - RNA, 16 nt, Homo sapiens
ugugcgcgcugcucag

SEQ ID NO: 5663 - RNA, 16 nt, Homo sapiens
cugcucagcugucugc

SEQ ID NO: 5664 - RNA, 16 nt, Homo sapiens
ucagcugucugcuucu

SEQ ID NO: 5665 - RNA, 16 nt, Homo sapiens
aaaagauccugaacug

SEQ ID NO: 5666 - RNA, 16 nt, Homo sapiens
auccugaacugaguuu

SEQ ID NO: 5667 - RNA, 16 nt, Homo sapiens
agcacaucaugcaagc

SEQ ID NO: 5668 - RNA, 16 nt, Homo sapiens
gccagacacugcaucu

SEQ ID NO: 5669 - RNA, 16 nt, Homo sapiens
caucuccaaugcaggg

SEQ ID NO: 5670 - RNA, 16 nt, Homo sapiens
aauggucuuugccuga

SEQ ID NO: 5671 - RNA, 16 nt, Homo sapiens
gucuuugccugaaaug

SEQ ID NO: 5672 - RNA, 16 nt, Homo sapiens
cugaaauggugaguaa

SEQ ID NO: 5673 - RNA, 16 nt, Homo sapiens
uaaggaaagcgaaagg

SEQ ID NO: 5674 - RNA, 16 nt, Homo sapiens
gcgaaaggcugagcau

SEQ ID NO: 5675 - RNA, 16 nt, Homo sapiens
aacuaaaucugccugu

SEQ ID NO: 5676 - RNA, 16 nt, Homo sapiens
aaaucugccuguggaa

SEQ ID NO: 5677 - RNA, 16 nt, Homo sapiens
aaacaauucugcagua

SEQ ID NO: 5678 - RNA, 16 nt, Homo sapiens
cuuuaaccuugaacac

SEQ ID NO: 5679 - RNA, 16 nt, Homo sapiens
uucuacagcugcaaau

SEQ ID NO: 5680 - RNA, 16 nt, Homo sapiens
auaucuagcuguaccu

SEQ ID NO: 5681 - RNA, 16 nt, Homo sapiens
aacagaaucugcaauc

SEQ ID NO: 5682 - RNA, 16 nt, Homo sapiens
auuuauuagugauaca

SEQ ID NO: 5683 - RNA, 16 nt, Homo sapiens
ucguagagauguacag

SEQ ID NO: 5684 - RNA, 16 nt, Homo sapiens
gauguacagugaaauc

SEQ ID NO: 5685 - RNA, 16 nt, Homo sapiens
ugaaauccccgaaauu

SEQ ID NO: 5686 - RNA, 16 nt, Homo sapiens
uuauacacaugacuga

SEQ ID NO: 5687 - RNA, 16 nt, Homo sapiens
acacaugacugaagga

SEQ ID NO: 5688 - RNA, 16 nt, Homo sapiens
gucauucccugccggg

SEQ ID NO: 5689 - RNA, 16 nt, Homo sapiens
uaacaucacuguuacu

SEQ ID NO: 5690 - RNA, 16 nt, Homo sapiens
guuuccacuugacacu

SEQ ID NO: 5691 - RNA, 16 nt, Homo sapiens
uugacacuuugauccc

SEQ ID NO: 5692 - RNA, 16 nt, Homo sapiens
uuugaucccugaugga

SEQ ID NO: 5693 - RNA, 16 nt, Homo sapiens
gauggaaaacgcauaa

SEQ ID NO: 5694 - RNA, 16 nt, Homo sapiens
cauaucaaaugcaacg

SEQ ID NO: 5695 - RNA, 16 nt, Homo sapiens
uagggcuucugaccug

SEQ ID NO: 5696 - RNA, 16 nt, Homo sapiens
cuucugaccugugaag

SEQ ID NO: 5697 - RNA, 16 nt, Homo sapiens
ucugaccugugaagca

SEQ ID NO: 5698 - RNA, 16 nt, Homo sapiens
augggcauuuguauaa

SEQ ID NO: 5699 - RNA, 16 nt, Homo sapiens
cucacacaucgacaaa

SEQ ID NO: 5700 - RNA, 16 nt, Homo sapiens
aaucauagauguccaa

SEQ ID NO: 5701 - RNA, 16 nt, Homo sapiens
agcacaccacgcccag

SEQ ID NO: 5702 - RNA, 16 nt, Homo sapiens
ccauacucuuguccuc

SEQ ID NO: 5703 - RNA, 16 nt, Homo sapiens
guccucaauuguacug

SEQ ID NO: 5704 - RNA, 16 nt, Homo sapiens
caauuguacugcuacc

SEQ ID NO: 5705 - RNA, 16 nt, Homo sapiens
ccacucccuugaacac

SEQ ID NO: 5706 - RNA, 16 nt, Homo sapiens
ccuugaacacgagagu

SEQ ID NO: 5707 - RNA, 16 nt, Homo sapiens
gaguucaaaugaccug

SEQ ID NO: 5708 - RNA, 16 nt, Homo sapiens
gaguuacccugaugaa

SEQ ID NO: 5709 - RNA, 16 nt, Homo sapiens
uuacccugaugaaaaa

SEQ ID NO: 5710 - RNA, 16 nt, Homo sapiens
uccguaaggcgacgaa

SEQ ID NO: 5711 - RNA, 16 nt, Homo sapiens
guaaggcgacgaauug

SEQ ID NO: 5712 - RNA, 16 nt, Homo sapiens
gcgacgaauugaccaa

SEQ ID NO: 5713 - RNA, 16 nt, Homo sapiens
caauucccaugccaac

SEQ ID NO: 5714 - RNA, 16 nt, Homo sapiens
auucuacaguguucuu

SEQ ID NO: 5715 - RNA, 16 nt, Homo sapiens
ucuuacuauugacaaa

SEQ ID NO: 5716 - RNA, 16 nt, Homo sapiens
uugacaaaaugcagaa

SEQ ID NO: 5717 - RNA, 16 nt, Homo sapiens
cuuuauacuugucgug

SEQ ID NO: 5718 - RNA, 16 nt, Homo sapiens
uacuugucguguaagg

SEQ ID NO: 5719 - RNA, 16 nt, Homo sapiens
auucaaaucuguuaac

SEQ ID NO: 5720 - RNA, 16 nt, Homo sapiens
acaccucagugcauau

SEQ ID NO: 5721 - RNA, 16 nt, Homo sapiens
gcauauauaugauaaa

SEQ ID NO: 5722 - RNA, 16 nt, Homo sapiens
auucaucacugugaaa

SEQ ID NO: 5723 - RNA, 16 nt, Homo sapiens
ucaucacugugaaaca

SEQ ID NO: 5724 - RNA, 16 nt, Homo sapiens
gugaaacaucgaaaac

SEQ ID NO: 5725 - RNA, 16 nt, Homo sapiens
aacagcaggugcuuga

SEQ ID NO: 5726 - RNA, 16 nt, Homo sapiens
gcaggugcuugaaacc

SEQ ID NO: 5727 - RNA, 16 nt, Homo sapiens
ggcucucuaugaaagu

SEQ ID NO: 5728 - RNA, 16 nt, Homo sapiens
cuaugaaagugaaggc

SEQ ID NO: 5729 - RNA, 16 nt, Homo sapiens
cauuucccucgccgga

SEQ ID NO: 5730 - RNA, 16 nt, Homo sapiens
gccggaaguuguaugg

SEQ ID NO: 5731 - RNA, 16 nt, Homo sapiens
uggguuaccugcgacu

SEQ ID NO: 5732 - RNA, 16 nt, Homo sapiens
gguuaccugcgacuga

SEQ ID NO: 5733 - RNA, 16 nt, Homo sapiens
accugcgacugagaaa

SEQ ID NO: 5734 - RNA, 16 nt, Homo sapiens
ugagaaaucugcucgc

SEQ ID NO: 5735 - RNA, 16 nt, Homo sapiens
aaaucugcucgcuauu

SEQ ID NO: 5736 - RNA, 16 nt, Homo sapiens
cucgcuauuugacucg

SEQ ID NO: 5737 - RNA, 16 nt, Homo sapiens
ggacguaacugaagag

SEQ ID NO: 5738 - RNA, 16 nt, Homo sapiens
ugaagaggaugcaggg

SEQ ID NO: 5739 - RNA, 16 nt, Homo sapiens
auacaaucuugcugag

SEQ ID NO: 5740 - RNA, 16 nt, Homo sapiens
caaucuugcugagcau

SEQ ID NO: 5741 - RNA, 16 nt, Homo sapiens
acagucaaauguguuu

SEQ ID NO: 5742 - RNA, 16 nt, Homo sapiens
agucaaauguguuuaa

SEQ ID NO: 5743 - RNA, 16 nt, Homo sapiens
aaaccucacugccacu

SEQ ID NO: 5744 - RNA, 16 nt, Homo sapiens
cacucuaauugucaau

SEQ ID NO: 5745 - RNA, 16 nt, Homo sapiens
aauugucaaugugaaa

SEQ ID NO: 5746 - RNA, 16 nt, Homo sapiens
uugucaaugugaaacc

SEQ ID NO: 5747 - RNA, 16 nt, Homo sapiens
ccagauuuacgaaaag

SEQ ID NO: 5748 - RNA, 16 nt, Homo sapiens
aaaaggccgugucauc

SEQ ID NO: 5749 - RNA, 16 nt, Homo sapiens
gacaaauccugacuug

SEQ ID NO: 5750 - RNA, 16 nt, Homo sapiens
auccugacuuguaccg

SEQ ID NO: 5751 - RNA, 16 nt, Homo sapiens
gacuuguaccgcauau

SEQ ID NO: 5752 - RNA, 16 nt, Homo sapiens
uggcaccccuguaacc

SEQ ID NO: 5753 - RNA, 16 nt, Homo sapiens
uaaucauuccgaagca

SEQ ID NO: 5754 - RNA, 16 nt, Homo sapiens
gaagcaaggugugacu

SEQ ID NO: 5755 - RNA, 16 nt, Homo sapiens
agcaaggugugacuuu

SEQ ID NO: 5756 - RNA, 16 nt, Homo sapiens
ugugacuuuuguucca

SEQ ID NO: 5757 - RNA, 16 nt, Homo sapiens
uuccaauaaugaagag

SEQ ID NO: 5758 - RNA, 16 nt, Homo sapiens
uauccuggaugcugac

SEQ ID NO: 5759 - RNA, 16 nt, Homo sapiens
ccuggaugcugacagc

SEQ ID NO: 5760 - RNA, 16 nt, Homo sapiens
aaacagaauugagagc

SEQ ID NO: 5761 - RNA, 16 nt, Homo sapiens
aucacucagcgcaugg

SEQ ID NO: 5762 - RNA, 16 nt, Homo sapiens
caccuugguuguggcu

SEQ ID NO: 5763 - RNA, 16 nt, Homo sapiens
gguuguggcugacucu

SEQ ID NO: 5764 - RNA, 16 nt, Homo sapiens
aucuacauuugcauag

SEQ ID NO: 5765 - RNA, 16 nt, Homo sapiens
aguugggacuguggga

SEQ ID NO: 5766 - RNA, 16 nt, Homo sapiens
uaucacagaugugcca

SEQ ID NO: 5767 - RNA, 16 nt, Homo sapiens
ucacagaugugccaaa

SEQ ID NO: 5768 - RNA, 16 nt, Homo sapiens
uggguuucauguuaac

SEQ ID NO: 5769 - RNA, 16 nt, Homo sapiens
uggaaaaaaugccgac

SEQ ID NO: 5770 - RNA, 16 nt, Homo sapiens
aaaaaaugccgacgga

SEQ ID NO: 5771 - RNA, 16 nt, Homo sapiens
gagaggaccugaaacu

SEQ ID NO: 5772 - RNA, 16 nt, Homo sapiens
accugaaacugucuug

SEQ ID NO: 5773 - RNA, 16 nt, Homo sapiens
aaacugucuugcacag

SEQ ID NO: 5774 - RNA, 16 nt, Homo sapiens
ggauuuuacugcggac

SEQ ID NO: 5775 - RNA, 16 nt, Homo sapiens
acagaacaaugcacua

SEQ ID NO: 5776 - RNA, 16 nt, Homo sapiens
uuaccaucaugaaugu

SEQ ID NO: 5777 - RNA, 16 nt, Homo sapiens
caucaugaauguuucc

SEQ ID NO: 5778 - RNA, 16 nt, Homo sapiens
auguuucccugcaaga

SEQ ID NO: 5779 - RNA, 16 nt, Homo sapiens
aggcaccuaugccugc

SEQ ID NO: 5780 - RNA, 16 nt, Homo sapiens
accuaugccugcagag

SEQ ID NO: 5781 - RNA, 16 nt, Homo sapiens
agccaggaauguauac

SEQ ID NO: 5782 - RNA, 16 nt, Homo sapiens
cauaccuccugcgaaa

SEQ ID NO: 5783 - RNA, 16 nt, Homo sapiens
uaccuccugcgaaacc

SEQ ID NO: 5784 - RNA, 16 nt, Homo sapiens
aaaccucagugaucac

SEQ ID NO: 5785 - RNA, 16 nt, Homo sapiens
acuuuagacugucaug

SEQ ID NO: 5786 - RNA, 16 nt, Homo sapiens
agacugucaugcuaau

SEQ ID NO: 5787 - RNA, 16 nt, Homo sapiens
ugcuaauggugucccc

SEQ ID NO: 5788 - RNA, 16 nt, Homo sapiens
ugguguccccgagccu

SEQ ID NO: 5789 - RNA, 16 nt, Homo sapiens
gaagcagcacgcuguu

SEQ ID NO: 5790 - RNA, 16 nt, Homo sapiens
gcagcacgcuguuuau

SEQ ID NO: 5791 - RNA, 16 nt, Homo sapiens
gcuguuuauugaaaga

SEQ ID NO: 5792 - RNA, 16 nt, Homo sapiens
agaagaggaugaaggu

SEQ ID NO: 5793 - RNA, 16 nt, Homo sapiens
ggaugaaggugucuau

SEQ ID NO: 5794 - RNA, 16 nt, Homo sapiens
gucuaucacugcaaag

SEQ ID NO: 5795 - RNA, 16 nt, Homo sapiens
gaagggcucuguggaa

SEQ ID NO: 5796 - RNA, 16 nt, Homo sapiens
auaccucacuguucaa

SEQ ID NO: 5797 - RNA, 16 nt, Homo sapiens
aucuggagcugaucac

SEQ ID NO: 5798 - RNA, 16 nt, Homo sapiens
acucuaacaugcaccu

SEQ ID NO: 5799 - RNA, 16 nt, Homo sapiens
acaugcaccugugugg

SEQ ID NO: 5800 - RNA, 16 nt, Homo sapiens
augcaccuguguggcu

SEQ ID NO: 5801 - RNA, 16 nt, Homo sapiens
cuguguggcugcgacu

SEQ ID NO: 5802 - RNA, 16 nt, Homo sapiens
guguggcugcgacucu

SEQ ID NO: 5803 - RNA, 16 nt, Homo sapiens
cuccuuauccgaaaaa

SEQ ID NO: 5804 - RNA, 16 nt, Homo sapiens
uccgaaaaaugaaaag

SEQ ID NO: 5805 - RNA, 16 nt, Homo sapiens
gucuucuucugaaaua

SEQ ID NO: 5806 - RNA, 16 nt, Homo sapiens
aauaaagacugacuac

SEQ ID NO: 5807 - RNA, 16 nt, Homo sapiens
ggacccagaugaaguu

SEQ ID NO: 5808 - RNA, 16 nt, Homo sapiens
uccuuuggaugagcag

SEQ ID NO: 5809 - RNA, 16 nt, Homo sapiens
gaugagcagugugagc

SEQ ID NO: 5810 - RNA, 16 nt, Homo sapiens
ugagcagugugagcgg

SEQ ID NO: 5811 - RNA, 16 nt, Homo sapiens
gcucccuuaugaugcc

SEQ ID NO: 5812 - RNA, 16 nt, Homo sapiens
cccuuaugaugccagc

SEQ ID NO: 5813 - RNA, 16 nt, Homo sapiens
gugggaguuugcccgg

SEQ ID NO: 5814 - RNA, 16 nt, Homo sapiens
ucaccuacgugccgga

SEQ ID NO: 5815 - RNA, 16 nt, Homo sapiens
gugccggacuguggcu

SEQ ID NO: 5816 - RNA, 16 nt, Homo sapiens
gacuguggcugugaaa

SEQ ID NO: 5817 - RNA, 16 nt, Homo sapiens
cuguggcugugaaaau

SEQ ID NO: 5818 - RNA, 16 nt, Homo sapiens
cugugaaaaugcugaa

SEQ ID NO: 5819 - RNA, 16 nt, Homo sapiens
ugaaaaugcugaaaga

SEQ ID NO: 5820 - RNA, 16 nt, Homo sapiens
cacggccagcgaguac

SEQ ID NO: 5821 - RNA, 16 nt, Homo sapiens
acaaagcucugaugac

SEQ ID NO: 5822 - RNA, 16 nt, Homo sapiens
aagcucugaugacuga

SEQ ID NO: 5823 - RNA, 16 nt, Homo sapiens
ucugaugacugagcua

SEQ ID NO: 5824 - RNA, 16 nt, Homo sapiens
uaaaaaucuugaccca

SEQ ID NO: 5825 - RNA, 16 nt, Homo sapiens
gccaccaucugaacgu

SEQ ID NO: 5826 - RNA, 16 nt, Homo sapiens
ugguuaaccugcuggg

SEQ ID NO: 5827 - RNA, 16 nt, Homo sapiens
cugggagccugcacca

SEQ ID NO: 5828 - RNA, 16 nt, Homo sapiens
gagggccucugauggu

SEQ ID NO: 5829 - RNA, 16 nt, Homo sapiens
cucugauggugauugu

SEQ ID NO: 5830 - RNA, 16 nt, Homo sapiens
gauggugauuguugaa

SEQ ID NO: 5831 - RNA, 16 nt, Homo sapiens
ggugauuguugaauac

SEQ ID NO: 5832 - RNA, 16 nt, Homo sapiens
guugaauacugcaaau

SEQ ID NO: 5833 - RNA, 16 nt, Homo sapiens
gagcaaacgugacuua

SEQ ID NO: 5834 - RNA, 16 nt, Homo sapiens
caacaaggaugcagca

SEQ ID NO: 5835 - RNA, 16 nt, Homo sapiens
caccagcagcgaaagc

SEQ ID NO: 5836 - RNA, 16 nt, Homo sapiens
cgaaagcuuugcgagc

SEQ ID NO: 5837 - RNA, 16 nt, Homo sapiens
aaagcuuugcgagcuc

SEQ ID NO: 5838 - RNA, 16 nt, Homo sapiens
auaaaagucugaguga

SEQ ID NO: 5839 - RNA, 16 nt, Homo sapiens
aagucugagugauguu

SEQ ID NO: 5840 - RNA, 16 nt, Homo sapiens
ucugagugauguugag

SEQ ID NO: 5841 - RNA, 16 nt, Homo sapiens
gagugauguugaggaa

SEQ ID NO: 5842 - RNA, 16 nt, Homo sapiens
ggaggauucugacggu

SEQ ID NO: 5843 - RNA, 16 nt, Homo sapiens
uggaagaucugauuuc

SEQ ID NO: 5844 - RNA, 16 nt, Homo sapiens
uggaguuccugucuuc

SEQ ID NO: 5845 - RNA, 16 nt, Homo sapiens
uccagaaagugcauuc

SEQ ID NO: 5846 - RNA, 16 nt, Homo sapiens
accuggcagcgagaaa

SEQ ID NO: 5847 - RNA, 16 nt, Homo sapiens
ucuuuuaucugagaac

SEQ ID NO: 5848 - RNA, 16 nt, Homo sapiens
acaacguggugaagau

SEQ ID NO: 5849 - RNA, 16 nt, Homo sapiens
gugaagauuugugauu

SEQ ID NO: 5850 - RNA, 16 nt, Homo sapiens
gaagauuugugauuuu

SEQ ID NO: 5851 - RNA, 16 nt, Homo sapiens
uuuuggccuugcccgg

SEQ ID NO: 5852 - RNA, 16 nt, Homo sapiens
uaagaaccccgauuau

SEQ ID NO: 5853 - RNA, 16 nt, Homo sapiens
ccccgauuaugugaga

SEQ ID NO: 5854 - RNA, 16 nt, Homo sapiens
ccgauuaugugagaaa

SEQ ID NO: 5855 - RNA, 16 nt, Homo sapiens
ggagauacucgacuuc

SEQ ID NO: 5856 - RNA, 16 nt, Homo sapiens
gacuuccucugaaaug

SEQ ID NO: 5857 - RNA, 16 nt, Homo sapiens
gauggcucccgaaucu

SEQ ID NO: 5858 - RNA, 16 nt, Homo sapiens
aucuaucuuugacaaa

SEQ ID NO: 5859 - RNA, 16 nt, Homo sapiens
caccaagagcgacgug

SEQ ID NO: 5860 - RNA, 16 nt, Homo sapiens
agagcgacgugugguc

SEQ ID NO: 5861 - RNA, 16 nt, Homo sapiens
acggaguauugcugug

SEQ ID NO: 5862 - RNA, 16 nt, Homo sapiens
gaguauugcuguggga

SEQ ID NO: 5863 - RNA, 16 nt, Homo sapiens
acaaauggaugaggac

SEQ ID NO: 5864 - RNA, 16 nt, Homo sapiens
gaggacuuuugcaguc

SEQ ID NO: 5865 - RNA, 16 nt, Homo sapiens
uuuugcagucgccuga

SEQ ID NO: 5866 - RNA, 16 nt, Homo sapiens
gcagucgccugaggga

SEQ ID NO: 5867 - RNA, 16 nt, Homo sapiens
gggaaggcaugaggau

SEQ ID NO: 5868 - RNA, 16 nt, Homo sapiens
gcaugaggaugagagc

SEQ ID NO: 5869 - RNA, 16 nt, Homo sapiens
gagagcuccugaguac

SEQ ID NO: 5870 - RNA, 16 nt, Homo sapiens
cucuacuccugaaauc

SEQ ID NO: 5871 - RNA, 16 nt, Homo sapiens
aucagaucaugcugga

SEQ ID NO: 5872 - RNA, 16 nt, Homo sapiens
augcuggacugcuggc

SEQ ID NO: 5873 - RNA, 16 nt, Homo sapiens
gccaagauuugcagaa

SEQ ID NO: 5874 - RNA, 16 nt, Homo sapiens
ugcagaacuuguggaa

SEQ ID NO: 5875 - RNA, 16 nt, Homo sapiens
aaaacuaggugauuug

SEQ ID NO: 5876 - RNA, 16 nt, Homo sapiens
uaggugauuugcuuca

SEQ ID NO: 5877 - RNA, 16 nt, Homo sapiens
ucaagcaaauguacaa

SEQ ID NO: 5878 - RNA, 16 nt, Homo sapiens
cccaaucaaugccaua

SEQ ID NO: 5879 - RNA, 16 nt, Homo sapiens
augccauacugacagg

SEQ ID NO: 5880 - RNA, 16 nt, Homo sapiens
cucaacuccugccuuc

SEQ ID NO: 5881 - RNA, 16 nt, Homo sapiens
ugccuucucugaggac

SEQ ID NO: 5882 - RNA, 16 nt, Homo sapiens
uuucagcuccgaaguu

SEQ ID NO: 5883 - RNA, 16 nt, Homo sapiens
aggaagcucugaugau

SEQ ID NO: 5884 - RNA, 16 nt, Homo sapiens
aagcucugaugauguc

SEQ ID NO: 5885 - RNA, 16 nt, Homo sapiens
cucugaugaugucaga

SEQ ID NO: 5886 - RNA, 16 nt, Homo sapiens
ugucagauauguaaau

SEQ ID NO: 5887 - RNA, 16 nt, Homo sapiens
auauguaaaugcuuuc

SEQ ID NO: 5888 - RNA, 16 nt, Homo sapiens
ucaaguucaugagccu

SEQ ID NO: 5889 - RNA, 16 nt, Homo sapiens
caaaaccuuugaagaa

SEQ ID NO: 5890 - RNA, 16 nt, Homo sapiens
aacuuuuaccgaaugc

SEQ ID NO: 5891 - RNA, 16 nt, Homo sapiens
uuuaccgaaugccacc

SEQ ID NO: 5892 - RNA, 16 nt, Homo sapiens
ccaccuccauguuuga

SEQ ID NO: 5893 - RNA, 16 nt, Homo sapiens
cuccauguuugaugac

SEQ ID NO: 5894 - RNA, 16 nt, Homo sapiens
cauguuugaugacuac

SEQ ID NO: 5895 - RNA, 16 nt, Homo sapiens
cuaccagggcgacagc

SEQ ID NO: 5896 - RNA, 16 nt, Homo sapiens
gcagcacucuguuggc

SEQ ID NO: 5897 - RNA, 16 nt, Homo sapiens
ccucucccaugcugaa

SEQ ID NO: 5898 - RNA, 16 nt, Homo sapiens
cucccaugcugaagcg

SEQ ID NO: 5899 - RNA, 16 nt, Homo sapiens
augcugaagcgcuuca

SEQ ID NO: 5900 - RNA, 16 nt, Homo sapiens
caccuggacugacagc

SEQ ID NO: 5901 - RNA, 16 nt, Homo sapiens
ccaaggccucgcucaa

SEQ ID NO: 5902 - RNA, 16 nt, Homo sapiens
gcucaagauugacuug

SEQ ID NO: 5903 - RNA, 16 nt, Homo sapiens
agauugacuugagagu

SEQ ID NO: 5904 - RNA, 16 nt, Homo sapiens
agucggggcugucuga

SEQ ID NO: 5905 - RNA, 16 nt, Homo sapiens
ggggcugucugauguc

SEQ ID NO: 5906 - RNA, 16 nt, Homo sapiens
gcugucugaugucagc

SEQ ID NO: 5907 - RNA, 16 nt, Homo sapiens
cccaguuucugccauu

SEQ ID NO: 5908 - RNA, 16 nt, Homo sapiens
cauuccagcugugggc

SEQ ID NO: 5909 - RNA, 16 nt, Homo sapiens
gcacgucagcgaaggc

SEQ ID NO: 5910 - RNA, 16 nt, Homo sapiens
gaaggcaagcgcaggu

SEQ ID NO: 5911 - RNA, 16 nt, Homo sapiens
guucaccuacgaccac

SEQ ID NO: 5912 - RNA, 16 nt, Homo sapiens
cuacgaccacgcugag

SEQ ID NO: 5913 - RNA, 16 nt, Homo sapiens
cgaccacgcugagcug

SEQ ID NO: 5914 - RNA, 16 nt, Homo sapiens
aaggaaaaucgcgugc

SEQ ID NO: 5915 - RNA, 16 nt, Homo sapiens
aaaaucgcgugcugcu

SEQ ID NO: 5916 - RNA, 16 nt, Homo sapiens
aucgcgugcugcuccc

SEQ ID NO: 5917 - RNA, 16 nt, Homo sapiens
gcugcuccccgccccc

SEQ ID NO: 5918 - RNA, 16 nt, Homo sapiens
cggugguccuguacuc

SEQ ID NO: 5919 - RNA, 16 nt, Homo sapiens
ucuagaguuugacacg

SEQ ID NO: 5920 - RNA, 16 nt, Homo sapiens
aguuugacacgaagcc

SEQ ID NO: 5921 - RNA, 16 nt, Homo sapiens
agaagcacauguguau

SEQ ID NO: 5922 - RNA, 16 nt, Homo sapiens
aagcacauguguauuu

SEQ ID NO: 5923 - RNA, 16 nt, Homo sapiens
acuagcuuuugccagu

SEQ ID NO: 5924 - RNA, 16 nt, Homo sapiens
ccaguauuaugcauau

SEQ ID NO: 5925 - RNA, 16 nt, Homo sapiens
ggagccagcugcuuuu

SEQ ID NO: 5926 - RNA, 16 nt, Homo sapiens
gcugcuuuuugugauu

SEQ ID NO: 5927 - RNA, 16 nt, Homo sapiens
ugcuuuuugugauuuu

SEQ ID NO: 5928 - RNA, 16 nt, Homo sapiens
uuuuaauagugcuuuu

SEQ ID NO: 5929 - RNA, 16 nt, Homo sapiens
uuuuuuuuuugacuaa

SEQ ID NO: 5930 - RNA, 16 nt, Homo sapiens
uaacaagaauguaacu

SEQ ID NO: 5931 - RNA, 16 nt, Homo sapiens
gagaaauagugacaag

SEQ ID NO: 5932 - RNA, 16 nt, Homo sapiens
agugacaagugaagaa

SEQ ID NO: 5933 - RNA, 16 nt, Homo sapiens
gaacacuacugcuaaa

SEQ ID NO: 5934 - RNA, 16 nt, Homo sapiens
aaauccucauguuacu

SEQ ID NO: 5935 - RNA, 16 nt, Homo sapiens
guuacucaguguuaga

SEQ ID NO: 5936 - RNA, 16 nt, Homo sapiens
uaaacccaaugacuuc

SEQ ID NO: 5937 - RNA, 16 nt, Homo sapiens
ugacuucccugcucca

SEQ ID NO: 5938 - RNA, 16 nt, Homo sapiens
uccaacccccgccacc

SEQ ID NO: 5939 - RNA, 16 nt, Homo sapiens
cucagggcacgcagga

SEQ ID NO: 5940 - RNA, 16 nt, Homo sapiens
ggaccaguuugauuga

SEQ ID NO: 5941 - RNA, 16 nt, Homo sapiens
caguuugauugaggag

SEQ ID NO: 5942 - RNA, 16 nt, Homo sapiens
uugaggagcugcacug

SEQ ID NO: 5943 - RNA, 16 nt, Homo sapiens
gagcugcacugaucac

SEQ ID NO: 5944 - RNA, 16 nt, Homo sapiens
aucacccaaugcauca

SEQ ID NO: 5945 - RNA, 16 nt, Homo sapiens
ggccagcccugcagcc

SEQ ID NO: 5946 - RNA, 16 nt, Homo sapiens
uggcuggccugagcaa

SEQ ID NO: 5947 - RNA, 16 nt, Homo sapiens
ccuaagacaugugagg

SEQ ID NO: 5948 - RNA, 16 nt, Homo sapiens
uaagacaugugaggag

SEQ ID NO: 5949 - RNA, 16 nt, Homo sapiens
gagaaggcaugagaaa

SEQ ID NO: 5950 - RNA, 16 nt, Homo sapiens
gaaagaauuugagacg

SEQ ID NO: 5951 - RNA, 16 nt, Homo sapiens
aauuugagacgcacca

SEQ ID NO: 5952 - RNA, 16 nt, Homo sapiens
gacgcaccaugugggc

SEQ ID NO: 5953 - RNA, 16 nt, Homo sapiens
gcucagcaaugccauu

SEQ ID NO: 5954 - RNA, 16 nt, Homo sapiens
ucccagcucugacccu

SEQ ID NO: 5955 - RNA, 16 nt, Homo sapiens
uucuacauuugagggc

SEQ ID NO: 5956 - RNA, 16 nt, Homo sapiens
gauggacagcgaugag

SEQ ID NO: 5957 - RNA, 16 nt, Homo sapiens
ggacagcgaugagggg

SEQ ID NO: 5958 - RNA, 16 nt, Homo sapiens
gugguucuauguccau

SEQ ID NO: 5959 - RNA, 16 nt, Homo sapiens
uucguggcauguuuug

SEQ ID NO: 5960 - RNA, 16 nt, Homo sapiens
ggcauguuuugauuug

SEQ ID NO: 5961 - RNA, 16 nt, Homo sapiens
guuuugauuuguagca

SEQ ID NO: 5962 - RNA, 16 nt, Homo sapiens
uuguagcacugagggu

SEQ ID NO: 5963 - RNA, 16 nt, Homo sapiens
acucaacucugagccc

SEQ ID NO: 5964 - RNA, 16 nt, Homo sapiens
cuaguaagaugcacug

SEQ ID NO: 5965 - RNA, 16 nt, Homo sapiens
aagaugcacugaaaac

SEQ ID NO: 5966 - RNA, 16 nt, Homo sapiens
gaguuagguugucucc

SEQ ID NO: 5967 - RNA, 16 nt, Homo sapiens
uccaggccaugauggc

SEQ ID NO: 5968 - RNA, 16 nt, Homo sapiens
gccuuacacugaaaau

SEQ ID NO: 5969 - RNA, 16 nt, Homo sapiens
cacugaaaaugucaca

SEQ ID NO: 5970 - RNA, 16 nt, Homo sapiens
guauuauucuguuuug

SEQ ID NO: 5971 - RNA, 16 nt, Homo sapiens
auucuguuuugcacag

SEQ ID NO: 5972 - RNA, 16 nt, Homo sapiens
acaguuaguugugaaa

SEQ ID NO: 5973 - RNA, 16 nt, Homo sapiens
aguuaguugugaaaga

SEQ ID NO: 5974 - RNA, 16 nt, Homo sapiens
aaagaaagcugagaag

SEQ ID NO: 5975 - RNA, 16 nt, Homo sapiens
ugagaagaaugaaaau

SEQ ID NO: 5976 - RNA, 16 nt, Homo sapiens
gaaugaaaaugcaguc

SEQ ID NO: 5977 - RNA, 16 nt, Homo sapiens
augcaguccugaggag

SEQ ID NO: 5978 - RNA, 16 nt, Homo sapiens
auaucaaaacgagggc

SEQ ID NO: 5979 - RNA, 16 nt, Homo sapiens
aacgagggcugaugga

SEQ ID NO: 5980 - RNA, 16 nt, Homo sapiens
acacuaaucugaaagg

SEQ ID NO: 5981 - RNA, 16 nt, Homo sapiens
cugaaaggauguggaa

SEQ ID NO: 5982 - RNA, 16 nt, Homo sapiens
auuagcuggcgcauau

SEQ ID NO: 5983 - RNA, 16 nt, Homo sapiens
uaagcuccuugaguaa

SEQ ID NO: 5984 - RNA, 16 nt, Homo sapiens
aaggugguauguaauu

SEQ ID NO: 5985 - RNA, 16 nt, Homo sapiens
uguaauuuaugcaagg

SEQ ID NO: 5986 - RNA, 16 nt, Homo sapiens
auuaguuaaugagcca

SEQ ID NO: 5987 - RNA, 16 nt, Homo sapiens
auuuucaacugcuuug

SEQ ID NO: 5988 - RNA, 16 nt, Homo sapiens
caacugcuuugaaacu

SEQ ID NO: 5989 - RNA, 16 nt, Homo sapiens
uuugaaacuugccugg

SEQ ID NO: 5990 - RNA, 16 nt, Homo sapiens
ccuggggucugagcau

SEQ ID NO: 5991 - RNA, 16 nt, Homo sapiens
gucugagcaugauggg

SEQ ID NO: 5992 - RNA, 16 nt, Homo sapiens
aggaaagggcgccuac

SEQ ID NO: 5993 - RNA, 16 nt, Homo sapiens
gccuuggaucgcuaag

SEQ ID NO: 5994 - RNA, 16 nt, Homo sapiens
agcuggcucuguuuga

SEQ ID NO: 5995 - RNA, 16 nt, Homo sapiens
ggcucuguuugaugcu

SEQ ID NO: 5996 - RNA, 16 nt, Homo sapiens
ucuguuugaugcuauu

SEQ ID NO: 5997 - RNA, 16 nt, Homo sapiens
ugcuauuuaugcaagu

SEQ ID NO: 5998 - RNA, 16 nt, Homo sapiens
uagggucuauguauuu

SEQ ID NO: 5999 - RNA, 16 nt, Homo sapiens
uauuuaggaugcgccu

SEQ ID NO: 6000 - RNA, 16 nt, Homo sapiens
uuuaggaugcgccuac

SEQ ID NO: 6001 - RNA, 16 nt, Homo sapiens
uauuuaggaugucugc

SEQ ID NO: 6002 - RNA, 16 nt, Homo sapiens
uaggaugucugcaccu

SEQ ID NO: 6003 - RNA, 16 nt, Homo sapiens
ugcaccuucugcagcc

SEQ ID NO: 6004 - RNA, 16 nt, Homo sapiens
acaguggauugcugcu

SEQ ID NO: 6005 - RNA, 16 nt, Homo sapiens
guggauugcugcuucu

SEQ ID NO: 6006 - RNA, 16 nt, Homo sapiens
agaagaguaugcuucc

SEQ ID NO: 6007 - RNA, 16 nt, Homo sapiens
uuuuauccauguaauu

SEQ ID NO: 6008 - RNA, 16 nt, Homo sapiens
uaauuuaacuguagaa

SEQ ID NO: 6009 - RNA, 16 nt, Homo sapiens
uguagaaccugagcuc

SEQ ID NO: 6010 - RNA, 16 nt, Homo sapiens
cuaaguaaccgaagaa

SEQ ID NO: 6011 - RNA, 16 nt, Homo sapiens
accgaagaauguaugc

SEQ ID NO: 6012 - RNA, 16 nt, Homo sapiens
aagaauguaugccucu

SEQ ID NO: 6013 - RNA, 16 nt, Homo sapiens
guaugccucuguucuu

SEQ ID NO: 6014 - RNA, 16 nt, Homo sapiens
cuguucuuaugugcca

SEQ ID NO: 6015 - RNA, 16 nt, Homo sapiens
guucuuaugugccaca

SEQ ID NO: 6016 - RNA, 16 nt, Homo sapiens
ccacauccuuguuuaa

SEQ ID NO: 6017 - RNA, 16 nt, Homo sapiens
aaggcucucuguauga

SEQ ID NO: 6018 - RNA, 16 nt, Homo sapiens
cucucuguaugaagag

SEQ ID NO: 6019 - RNA, 16 nt, Homo sapiens
auucccuagugagccu

SEQ ID NO: 6020 - RNA, 16 nt, Homo sapiens
agcggcuuuuguggaa

SEQ ID NO: 6021 - RNA, 16 nt, Homo sapiens
acaaaucuuuguuguu

SEQ ID NO: 6022 - RNA, 16 nt, Homo sapiens
aaucuuuguuguuccu

SEQ ID NO: 6023 - RNA, 16 nt, Homo sapiens
uuacacauacgcaaac

SEQ ID NO: 6024 - RNA, 16 nt, Homo sapiens
caaaccaccugugaca

SEQ ID NO: 6025 - RNA, 16 nt, Homo sapiens
aaccaccugugacagc

SEQ ID NO: 6026 - RNA, 16 nt, Homo sapiens
agcaaauagugauaac

SEQ ID NO: 6027 - RNA, 16 nt, Homo sapiens
aaccuuagcuguucau

SEQ ID NO: 6028 - RNA, 16 nt, Homo sapiens
agcuguucaugucuug

SEQ ID NO: 6029 - RNA, 16 nt, Homo sapiens
uucaugucuugauuuc

SEQ ID NO: 6030 - RNA, 16 nt, Homo sapiens
cauuagaauuguuacu

SEQ ID NO: 6031 - RNA, 16 nt, Homo sapiens
acucagguuuguagca

SEQ ID NO: 6032 - RNA, 16 nt, Homo sapiens
uagcauacaugagucc

SEQ ID NO: 6033 - RNA, 16 nt, Homo sapiens
gagucuuaauguagaa

SEQ ID NO: 6034 - RNA, 16 nt, Homo sapiens
auggagacuuguaaua

SEQ ID NO: 6035 - RNA, 16 nt, Homo sapiens
uuguaauaaugagcua

SEQ ID NO: 6036 - RNA, 16 nt, Homo sapiens
guuacaaagugcuugu

SEQ ID NO: 6037 - RNA, 16 nt, Homo sapiens
caaagugcuuguucau

SEQ ID NO: 6038 - RNA, 16 nt, Homo sapiens
aaauagcacugaaaau

SEQ ID NO: 6039 - RNA, 16 nt, Homo sapiens
acugaaaauugaaaca

SEQ ID NO: 6040 - RNA, 16 nt, Homo sapiens
auugaaacaugaauua

SEQ ID NO: 6041 - RNA, 16 nt, Homo sapiens
ugaauuaacugauaau

SEQ ID NO: 6042 - RNA, 16 nt, Homo sapiens
ccaaucauuugccauu

SEQ ID NO: 6043 - RNA, 16 nt, Homo sapiens
ugccauuuaugacaaa

SEQ ID NO: 6044 - RNA, 16 nt, Homo sapiens
aacaaagaacgagcac

SEQ ID NO: 6045 - RNA, 16 nt, Homo sapiens
cagaguuucugagaua

SEQ ID NO: 6046 - RNA, 16 nt, Homo sapiens
cugagauaauguacgu

SEQ ID NO: 6047 - RNA, 16 nt, Homo sapiens
gaauggggcugaaacc

SEQ ID NO: 6048 - RNA, 16 nt, Homo sapiens
cugaaaccaugugcaa

SEQ ID NO: 6049 - RNA, 16 nt, Homo sapiens
gaaaccaugugcaagu

SEQ ID NO: 6050 - RNA, 16 nt, Homo sapiens
gugcaagucugugucu

SEQ ID NO: 6051 - RNA, 16 nt, Homo sapiens
gcaagucugugucuug

SEQ ID NO: 6052 - RNA, 16 nt, Homo sapiens
ucugugucuugucagu

SEQ ID NO: 6053 - RNA, 16 nt, Homo sapiens
uccaagaagugacacc

SEQ ID NO: 6054 - RNA, 16 nt, Homo sapiens
aagugacaccgagaug

SEQ ID NO: 6055 - RNA, 16 nt, Homo sapiens
acaccgagauguuaau

SEQ ID NO: 6056 - RNA, 16 nt, Homo sapiens
agggacccgugccuug

SEQ ID NO: 6057 - RNA, 16 nt, Homo sapiens
cccgugccuuguuucc

SEQ ID NO: 6058 - RNA, 16 nt, Homo sapiens
ccacaagaaugcaaac

SEQ ID NO: 6059 - RNA, 16 nt, Homo sapiens
acagauacucgcuagc

SEQ ID NO: 6060 - RNA, 16 nt, Homo sapiens
cauuuaaauugauuaa

SEQ ID NO: 6061 - RNA, 16 nt, Homo sapiens
aaggaggagugcaucu

SEQ ID NO: 6062 - RNA, 16 nt, Homo sapiens
aucuuuggccgacagu

SEQ ID NO: 6063 - RNA, 16 nt, Homo sapiens
cgacagugguguaacu

SEQ ID NO: 6064 - RNA, 16 nt, Homo sapiens
ugguguaacugugugu

SEQ ID NO: 6065 - RNA, 16 nt, Homo sapiens
guguaacugugugugu

SEQ ID NO: 6066 - RNA, 16 nt, Homo sapiens
guaacugugugugugu

SEQ ID NO: 6067 - RNA, 16 nt, Homo sapiens
aacugugugugugugu

SEQ ID NO: 6068 - RNA, 16 nt, Homo sapiens
cugugugugugugugu

SEQ ID NO: 6069 - RNA, 16 nt, Homo sapiens
gugugugugugugugu

SEQ ID NO: 6070 - RNA, 16 nt, Homo sapiens
gugugugugugugugg

SEQ ID NO: 6071 - RNA, 16 nt, Homo sapiens
gugugugugugugggu

SEQ ID NO: 6072 - RNA, 16 nt, Homo sapiens
gugugugggugugggu

SEQ ID NO: 6073 - RNA, 16 nt, Homo sapiens
ggguguggguguaugu

SEQ ID NO: 6074 - RNA, 16 nt, Homo sapiens
guggguguaugugugu

SEQ ID NO: 6075 - RNA, 16 nt, Homo sapiens
ggguguauguguguuu

SEQ ID NO: 6076 - RNA, 16 nt, Homo sapiens
guguauguguguuuug

SEQ ID NO: 6077 - RNA, 16 nt, Homo sapiens
uguguguuuugugcau

SEQ ID NO: 6078 - RNA, 16 nt, Homo sapiens
uguguuuugugcauaa

SEQ ID NO: 6079 - RNA, 16 nt, Homo sapiens
aagaauauaugcuaca

SEQ ID NO: 6080 - RNA, 16 nt, Homo sapiens
uucuagucaugaugaa

SEQ ID NO: 6081 - RNA, 16 nt, Homo sapiens
uagucaugaugaaugu

SEQ ID NO: 6082 - RNA, 16 nt, Homo sapiens
caugaugaauguauuu

SEQ ID NO: 6083 - RNA, 16 nt, Homo sapiens
aauguauuuuguauac

SEQ ID NO: 6084 - RNA, 16 nt, Homo sapiens
auugggauuuguaauc

SEQ ID NO: 6085 - RNA, 16 nt, Homo sapiens
caacuuaauugauaaa

SEQ ID NO: 6086 - RNA, 16 nt, Homo sapiens
cuuggcaacugcuuuu

SEQ ID NO: 6087 - RNA, 16 nt, Homo sapiens
cugcuuuuauguucug

SEQ ID NO: 6088 - RNA, 16 nt, Homo sapiens
uuuauguucugucucc

SEQ ID NO: 6089 - RNA, 16 nt, Homo sapiens
auuuauccuuguuuag

SEQ ID NO: 6090 - RNA, 16 nt, Homo sapiens
gaaaaacuuugaaaug

SEQ ID NO: 6091 - RNA, 16 nt, Homo sapiens
ucaaaaaauugcuaaa

SEQ ID NO: 6092 - RNA, 16 nt, Homo sapiens
aaaacuaaauguuagu

SEQ ID NO: 6093 - RNA, 16 nt, Homo sapiens
uaguuuagcugauugu

SEQ ID NO: 6094 - RNA, 16 nt, Homo sapiens
uuagcugauuguaugg

SEQ ID NO: 6095 - RNA, 16 nt, Homo sapiens
ugggguuuucgaaccu

SEQ ID NO: 6096 - RNA, 16 nt, Homo sapiens
uucacuuuuuguuugu

SEQ ID NO: 6097 - RNA, 16 nt, Homo sapiens
cuuuuuguuuguuuua

SEQ ID NO: 6098 - RNA, 16 nt, Homo sapiens
uuucacaacuguguaa

SEQ ID NO: 6099 - RNA, 16 nt, Homo sapiens
ucacaacuguguaaau

SEQ ID NO: 6100 - RNA, 16 nt, Homo sapiens
uguguaaauugccaau

SEQ ID NO: 6101 - RNA, 16 nt, Homo sapiens
aauaauuccuguccau

SEQ ID NO: 6102 - RNA, 16 nt, Homo sapiens
uccuguccaugaaaau

SEQ ID NO: 6103 - RNA, 16 nt, Homo sapiens
ccaugaaaaugcaaau

SEQ ID NO: 6104 - RNA, 16 nt, Homo sapiens
auuauccaguguagau

SEQ ID NO: 6105 - RNA, 16 nt, Homo sapiens
agauauauuugaccau

SEQ ID NO: 6106 - RNA, 16 nt, Homo sapiens
ggcuaguuuugccuuu

SEQ ID NO: 6107 - RNA, 16 nt, Homo sapiens
auuucagccugaaugu

SEQ ID NO: 6108 - RNA, 16 nt, Homo sapiens
cagccugaaugucugc

SEQ ID NO: 6109 - RNA, 16 nt, Homo sapiens
cugaaugucugccuau

SEQ ID NO: 6110 - RNA, 16 nt, Homo sapiens
uauauucucugcucuu

SEQ ID NO: 6111 - RNA, 16 nt, Homo sapiens
ucugcucuuuguauuc

SEQ ID NO: 6112 - RNA, 16 nt, Homo sapiens
auucuccuuugaaccc

SEQ ID NO: 6113 - RNA, 16 nt, Homo sapiens
aaaacauccuguggca

SEQ ID NO: 6114 - RNA, 17 nt, Homo sapiens
caaggugcugcuggccg

SEQ ID NO: 6115 - RNA, 17 nt, Homo sapiens
ggugcugcuggccgucg

SEQ ID NO: 6116 - RNA, 17 nt, Homo sapiens
cugcuggccgucgcccu

SEQ ID NO: 6117 - RNA, 17 nt, Homo sapiens
gccgucgcccuguggcu

SEQ ID NO: 6118 - RNA, 17 nt, Homo sapiens
ccgucgcccuguggcuc

SEQ ID NO: 6119 - RNA, 17 nt, Homo sapiens
cgucgcccuguggcucu

SEQ ID NO: 6120 - RNA, 17 nt, Homo sapiens
ccuguggcucugcgugg

SEQ ID NO: 6121 - RNA, 17 nt, Homo sapiens
uguggcucugcguggag

SEQ ID NO: 6122 - RNA, 17 nt, Homo sapiens
guggagacccgggccgc

SEQ ID NO: 6123 - RNA, 17 nt, Homo sapiens
uggagacccgggccgcc

SEQ ID NO: 6124 - RNA, 17 nt, Homo sapiens
acccgggccgccucugu

SEQ ID NO: 6125 - RNA, 17 nt, Homo sapiens
cgggccgccucuguggg

SEQ ID NO: 6126 - RNA, 17 nt, Homo sapiens
gggccgccucugugggu

SEQ ID NO: 6127 - RNA, 17 nt, Homo sapiens
gccgccucuguggguuu

SEQ ID NO: 6128 - RNA, 17 nt, Homo sapiens
ggguuugccuaguguuu

SEQ ID NO: 6129 - RNA, 17 nt, Homo sapiens
gguuugccuaguguuuc

SEQ ID NO: 6130 - RNA, 17 nt, Homo sapiens
aguguuucucuugaucu

SEQ ID NO: 6131 - RNA, 17 nt, Homo sapiens
uguuucucuugaucugc

SEQ ID NO: 6132 - RNA, 17 nt, Homo sapiens
ucuugaucugcccaggc

SEQ ID NO: 6133 - RNA, 17 nt, Homo sapiens
ugaucugcccaggcuca

SEQ ID NO: 6134 - RNA, 17 nt, Homo sapiens
gaucugcccaggcucag

SEQ ID NO: 6135 - RNA, 17 nt, Homo sapiens
aucugcccaggcucagc

SEQ ID NO: 6136 - RNA, 17 nt, Homo sapiens
gcccaggcucagcauac

SEQ ID NO: 6137 - RNA, 17 nt, Homo sapiens
ccaggcucagcauacaa

SEQ ID NO: 6138 - RNA, 17 nt, Homo sapiens
ggcucagcauacaaaaa

SEQ ID NO: 6139 - RNA, 17 nt, Homo sapiens
cagcauacaaaaagaca

SEQ ID NO: 6140 - RNA, 17 nt, Homo sapiens
aaaaagacauacuuaca

SEQ ID NO: 6141 - RNA, 17 nt, Homo sapiens
agacauacuuacaauua

SEQ ID NO: 6142 - RNA, 17 nt, Homo sapiens
auacuuacaauuaaggc

SEQ ID NO: 6143 - RNA, 17 nt, Homo sapiens
auuaaggcuaauacaac

SEQ ID NO: 6144 - RNA, 17 nt, Homo sapiens
gcuaauacaacucuuca

SEQ ID NO: 6145 - RNA, 17 nt, Homo sapiens
aauacaacucuucaaau

SEQ ID NO: 6146 - RNA, 17 nt, Homo sapiens
uacaacucuucaaauua

SEQ ID NO: 6147 - RNA, 17 nt, Homo sapiens
aacucuucaaauuacuu

SEQ ID NO: 6148 - RNA, 17 nt, Homo sapiens
caaauuacuugcagggg

SEQ ID NO: 6149 - RNA, 17 nt, Homo sapiens
uuacuugcaggggacag

SEQ ID NO: 6150 - RNA, 17 nt, Homo sapiens
caggggacagagggacu

SEQ ID NO: 6151 - RNA, 17 nt, Homo sapiens
agagggacuuggacugg

SEQ ID NO: 6152 - RNA, 17 nt, Homo sapiens
acuuggacuggcuuugg

SEQ ID NO: 6153 - RNA, 17 nt, Homo sapiens
ggacuggcuuuggccca

SEQ ID NO: 6154 - RNA, 17 nt, Homo sapiens
gcuuuggcccaauaauc

SEQ ID NO: 6155 - RNA, 17 nt, Homo sapiens
cuuuggcccaauaauca

SEQ ID NO: 6156 - RNA, 17 nt, Homo sapiens
uuuggcccaauaaucag

SEQ ID NO: 6157 - RNA, 17 nt, Homo sapiens
caauaaucagaguggca

SEQ ID NO: 6158 - RNA, 17 nt, Homo sapiens
agaguggcagugagcaa

SEQ ID NO: 6159 - RNA, 17 nt, Homo sapiens
cagugagcaaagggugg

SEQ ID NO: 6160 - RNA, 17 nt, Homo sapiens
gaggugacugagugcag

SEQ ID NO: 6161 - RNA, 17 nt, Homo sapiens
cugagugcagcgauggc

SEQ ID NO: 6162 - RNA, 17 nt, Homo sapiens
gcgauggccucuucugu

SEQ ID NO: 6163 - RNA, 17 nt, Homo sapiens
cgauggccucuucugua

SEQ ID NO: 6164 - RNA, 17 nt, Homo sapiens
auggccucuucuguaag

SEQ ID NO: 6165 - RNA, 17 nt, Homo sapiens
gccucuucuguaagaca

SEQ ID NO: 6166 - RNA, 17 nt, Homo sapiens
uguaagacacucacaau

SEQ ID NO: 6167 - RNA, 17 nt, Homo sapiens
uaagacacucacaauuc

SEQ ID NO: 6168 - RNA, 17 nt, Homo sapiens
agacacucacaauucca

SEQ ID NO: 6169 - RNA, 17 nt, Homo sapiens
acacucacaauuccaaa

SEQ ID NO: 6170 - RNA, 17 nt, Homo sapiens
cacaauuccaaaaguga

SEQ ID NO: 6171 - RNA, 17 nt, Homo sapiens
acaauuccaaaagugau

SEQ ID NO: 6172 - RNA, 17 nt, Homo sapiens
gaaaugacacuggagcc

SEQ ID NO: 6173 - RNA, 17 nt, Homo sapiens
aaugacacuggagccua

SEQ ID NO: 6174 - RNA, 17 nt, Homo sapiens
acuggagccuacaagug

SEQ ID NO: 6175 - RNA, 17 nt, Homo sapiens
cuggagccuacaagugc

SEQ ID NO: 6176 - RNA, 17 nt, Homo sapiens
gagccuacaagugcuuc

SEQ ID NO: 6177 - RNA, 17 nt, Homo sapiens
acaagugcuucuaccgg

SEQ ID NO: 6178 - RNA, 17 nt, Homo sapiens
agugcuucuaccgggaa

SEQ ID NO: 6179 - RNA, 17 nt, Homo sapiens
gcuucuaccgggaaacu

SEQ ID NO: 6180 - RNA, 17 nt, Homo sapiens
cgggaaacugacuuggc

SEQ ID NO: 6181 - RNA, 17 nt, Homo sapiens
aaacugacuuggccucg

SEQ ID NO: 6182 - RNA, 17 nt, Homo sapiens
gacuuggccucggucau

SEQ ID NO: 6183 - RNA, 17 nt, Homo sapiens
acuuggccucggucauu

SEQ ID NO: 6184 - RNA, 17 nt, Homo sapiens
ccucggucauuuauguc

SEQ ID NO: 6185 - RNA, 17 nt, Homo sapiens
uuuaugucuauguucaa

SEQ ID NO: 6186 - RNA, 17 nt, Homo sapiens
cuauguucaagauuaca

SEQ ID NO: 6187 - RNA, 17 nt, Homo sapiens
aagauuacagaucucca

SEQ ID NO: 6188 - RNA, 17 nt, Homo sapiens
uacagaucuccauuuau

SEQ ID NO: 6189 - RNA, 17 nt, Homo sapiens
cagaucuccauuuauug

SEQ ID NO: 6190 - RNA, 17 nt, Homo sapiens
agaucuccauuuauugc

SEQ ID NO: 6191 - RNA, 17 nt, Homo sapiens
uuuauugcuucuguuag

SEQ ID NO: 6192 - RNA, 17 nt, Homo sapiens
auugcuucuguuaguga

SEQ ID NO: 6193 - RNA, 17 nt, Homo sapiens
uuagugaccaacaugga

SEQ ID NO: 6194 - RNA, 17 nt, Homo sapiens
uagugaccaacauggag

SEQ ID NO: 6195 - RNA, 17 nt, Homo sapiens
ugaccaacauggagucg

SEQ ID NO: 6196 - RNA, 17 nt, Homo sapiens
ucguguacauuacugag

SEQ ID NO: 6197 - RNA, 17 nt, Homo sapiens
uacauuacugagaacaa

SEQ ID NO: 6198 - RNA, 17 nt, Homo sapiens
cugagaacaaaaacaaa

SEQ ID NO: 6199 - RNA, 17 nt, Homo sapiens
acaaaaacaaaacugug

SEQ ID NO: 6200 - RNA, 17 nt, Homo sapiens
aacaaaacuguggugau

SEQ ID NO: 6201 - RNA, 17 nt, Homo sapiens
ggugauuccaugucucg

SEQ ID NO: 6202 - RNA, 17 nt, Homo sapiens
gugauuccaugucucgg

SEQ ID NO: 6203 - RNA, 17 nt, Homo sapiens
uccaugucucgggucca

SEQ ID NO: 6204 - RNA, 17 nt, Homo sapiens
cucggguccauuucaaa

SEQ ID NO: 6205 - RNA, 17 nt, Homo sapiens
ucggguccauuucaaau

SEQ ID NO: 6206 - RNA, 17 nt, Homo sapiens
uccauuucaaaucucaa

SEQ ID NO: 6207 - RNA, 17 nt, Homo sapiens
uucaaaucucaacgugu

SEQ ID NO: 6208 - RNA, 17 nt, Homo sapiens
caaaucucaacguguca

SEQ ID NO: 6209 - RNA, 17 nt, Homo sapiens
aacgugucacuuugugc

SEQ ID NO: 6210 - RNA, 17 nt, Homo sapiens
cgugucacuuugugcaa

SEQ ID NO: 6211 - RNA, 17 nt, Homo sapiens
cuuugugcaagauaccc

SEQ ID NO: 6212 - RNA, 17 nt, Homo sapiens
caagauacccagaaaag

SEQ ID NO: 6213 - RNA, 17 nt, Homo sapiens
aagauacccagaaaaga

SEQ ID NO: 6214 - RNA, 17 nt, Homo sapiens
agauacccagaaaagag

SEQ ID NO: 6215 - RNA, 17 nt, Homo sapiens
auuuguuccugauggua

SEQ ID NO: 6216 - RNA, 17 nt, Homo sapiens
uuuguuccugaugguaa

SEQ ID NO: 6217 - RNA, 17 nt, Homo sapiens
augguaacagaauuucc

SEQ ID NO: 6218 - RNA, 17 nt, Homo sapiens
agaauuuccugggacag

SEQ ID NO: 6219 - RNA, 17 nt, Homo sapiens
gaauuuccugggacagc

SEQ ID NO: 6220 - RNA, 17 nt, Homo sapiens
ccugggacagcaagaag

SEQ ID NO: 6221 - RNA, 17 nt, Homo sapiens
gggacagcaagaagggc

SEQ ID NO: 6222 - RNA, 17 nt, Homo sapiens
agaagggcuuuacuauu

SEQ ID NO: 6223 - RNA, 17 nt, Homo sapiens
ggcuuuacuauucccag

SEQ ID NO: 6224 - RNA, 17 nt, Homo sapiens
uacuauucccagcuaca

SEQ ID NO: 6225 - RNA, 17 nt, Homo sapiens
acuauucccagcuacau

SEQ ID NO: 6226 - RNA, 17 nt, Homo sapiens
cuauucccagcuacaug

SEQ ID NO: 6227 - RNA, 17 nt, Homo sapiens
uucccagcuacaugauc

SEQ ID NO: 6228 - RNA, 17 nt, Homo sapiens
ccagcuacaugaucagc

SEQ ID NO: 6229 - RNA, 17 nt, Homo sapiens
acaugaucagcuaugcu

SEQ ID NO: 6230 - RNA, 17 nt, Homo sapiens
ugaucagcuaugcuggc

SEQ ID NO: 6231 - RNA, 17 nt, Homo sapiens
agcuaugcuggcauggu

SEQ ID NO: 6232 - RNA, 17 nt, Homo sapiens
augcuggcauggucuuc

SEQ ID NO: 6233 - RNA, 17 nt, Homo sapiens
gcauggucuucugugaa

SEQ ID NO: 6234 - RNA, 17 nt, Homo sapiens
uggucuucugugaagca

SEQ ID NO: 6235 - RNA, 17 nt, Homo sapiens
ugugaagcaaaaauuaa

SEQ ID NO: 6236 - RNA, 17 nt, Homo sapiens
aaaguuaccagucuauu

SEQ ID NO: 6237 - RNA, 17 nt, Homo sapiens
aaguuaccagucuauua

SEQ ID NO: 6238 - RNA, 17 nt, Homo sapiens
uaccagucuauuaugua

SEQ ID NO: 6239 - RNA, 17 nt, Homo sapiens
uuauguacauaguuguc

SEQ ID NO: 6240 - RNA, 17 nt, Homo sapiens
ugugguucugaguccgu

SEQ ID NO: 6241 - RNA, 17 nt, Homo sapiens
ucugaguccgucucaug

SEQ ID NO: 6242 - RNA, 17 nt, Homo sapiens
aguccgucucauggaau

SEQ ID NO: 6243 - RNA, 17 nt, Homo sapiens
uccgucucauggaauug

SEQ ID NO: 6244 - RNA, 17 nt, Homo sapiens
aauugaacuaucuguug

SEQ ID NO: 6245 - RNA, 17 nt, Homo sapiens
gaacuaucuguuggaga

SEQ ID NO: 6246 - RNA, 17 nt, Homo sapiens
agaaaagcuugucuuaa

SEQ ID NO: 6247 - RNA, 17 nt, Homo sapiens
agcuugucuuaaauugu

SEQ ID NO: 6248 - RNA, 17 nt, Homo sapiens
aauuguacagcaagaac

SEQ ID NO: 6249 - RNA, 17 nt, Homo sapiens
uguacagcaagaacuga

SEQ ID NO: 6250 - RNA, 17 nt, Homo sapiens
gcaagaacugaacuaaa

SEQ ID NO: 6251 - RNA, 17 nt, Homo sapiens
aacugaacuaaaugugg

SEQ ID NO: 6252 - RNA, 17 nt, Homo sapiens
ggauugacuucaacugg

SEQ ID NO: 6253 - RNA, 17 nt, Homo sapiens
uugacuucaacugggaa

SEQ ID NO: 6254 - RNA, 17 nt, Homo sapiens
acuucaacugggaauac

SEQ ID NO: 6255 - RNA, 17 nt, Homo sapiens
gggaauacccuucuucg

SEQ ID NO: 6256 - RNA, 17 nt, Homo sapiens
ggaauacccuucuucga

SEQ ID NO: 6257 - RNA, 17 nt, Homo sapiens
gaauacccuucuucgaa

SEQ ID NO: 6258 - RNA, 17 nt, Homo sapiens
uacccuucuucgaagca

SEQ ID NO: 6259 - RNA, 17 nt, Homo sapiens
uucgaagcaucagcaua

SEQ ID NO: 6260 - RNA, 17 nt, Homo sapiens
gaagcaucagcauaaga

SEQ ID NO: 6261 - RNA, 17 nt, Homo sapiens
gcaucagcauaagaaac

SEQ ID NO: 6262 - RNA, 17 nt, Homo sapiens
uaagaaacuuguaaacc

SEQ ID NO: 6263 - RNA, 17 nt, Homo sapiens
uuguaaaccgagaccua

SEQ ID NO: 6264 - RNA, 17 nt, Homo sapiens
accgagaccuaaaaacc

SEQ ID NO: 6265 - RNA, 17 nt, Homo sapiens
ccgagaccuaaaaaccc

SEQ ID NO: 6266 - RNA, 17 nt, Homo sapiens
cuaaaaacccagucugg

SEQ ID NO: 6267 - RNA, 17 nt, Homo sapiens
uaaaaacccagucuggg

SEQ ID NO: 6268 - RNA, 17 nt, Homo sapiens
aaaaacccagucuggga

SEQ ID NO: 6269 - RNA, 17 nt, Homo sapiens
acccagucugggaguga

SEQ ID NO: 6270 - RNA, 17 nt, Homo sapiens
uuuugagcaccuuaacu

SEQ ID NO: 6271 - RNA, 17 nt, Homo sapiens
uugagcaccuuaacuau

SEQ ID NO: 6272 - RNA, 17 nt, Homo sapiens
ugagcaccuuaacuaua

SEQ ID NO: 6273 - RNA, 17 nt, Homo sapiens
accuuaacuauagaugg

SEQ ID NO: 6274 - RNA, 17 nt, Homo sapiens
gguguaacccggaguga

SEQ ID NO: 6275 - RNA, 17 nt, Homo sapiens
guguaacccggagugac

SEQ ID NO: 6276 - RNA, 17 nt, Homo sapiens
ggagugaccaaggauug

SEQ ID NO: 6277 - RNA, 17 nt, Homo sapiens
gagugaccaaggauugu

SEQ ID NO: 6278 - RNA, 17 nt, Homo sapiens
gauuguacaccugugca

SEQ ID NO: 6279 - RNA, 17 nt, Homo sapiens
uuguacaccugugcagc

SEQ ID NO: 6280 - RNA, 17 nt, Homo sapiens
uguacaccugugcagca

SEQ ID NO: 6281 - RNA, 17 nt, Homo sapiens
accugugcagcauccag

SEQ ID NO: 6282 - RNA, 17 nt, Homo sapiens
ugugcagcauccagugg

SEQ ID NO: 6283 - RNA, 17 nt, Homo sapiens
gcagcauccagugggcu

SEQ ID NO: 6284 - RNA, 17 nt, Homo sapiens
cagcauccagugggcug

SEQ ID NO: 6285 - RNA, 17 nt, Homo sapiens
cagugggcugaugacca

SEQ ID NO: 6286 - RNA, 17 nt, Homo sapiens
cugaugaccaagaagaa

SEQ ID NO: 6287 - RNA, 17 nt, Homo sapiens
ugaugaccaagaagaac

SEQ ID NO: 6288 - RNA, 17 nt, Homo sapiens
agaagaacagcacauuu

SEQ ID NO: 6289 - RNA, 17 nt, Homo sapiens
agaacagcacauuuguc

SEQ ID NO: 6290 - RNA, 17 nt, Homo sapiens
aacagcacauuugucag

SEQ ID NO: 6291 - RNA, 17 nt, Homo sapiens
cauuugucaggguccau

SEQ ID NO: 6292 - RNA, 17 nt, Homo sapiens
ucaggguccaugaaaaa

SEQ ID NO: 6293 - RNA, 17 nt, Homo sapiens
caggguccaugaaaaac

SEQ ID NO: 6294 - RNA, 17 nt, Homo sapiens
ugaaaaaccuuuuguug

SEQ ID NO: 6295 - RNA, 17 nt, Homo sapiens
gaaaaaccuuuuguugc

SEQ ID NO: 6296 - RNA, 17 nt, Homo sapiens
uuuguugcuuuuggaag

SEQ ID NO: 6297 - RNA, 17 nt, Homo sapiens
gaaguggcauggaaucu

SEQ ID NO: 6298 - RNA, 17 nt, Homo sapiens
auggaaucucuggugga

SEQ ID NO: 6299 - RNA, 17 nt, Homo sapiens
ggaaucucugguggaag

SEQ ID NO: 6300 - RNA, 17 nt, Homo sapiens
guggaagccacgguggg

SEQ ID NO: 6301 - RNA, 17 nt, Homo sapiens
uggaagccacggugggg

SEQ ID NO: 6302 - RNA, 17 nt, Homo sapiens
agcgugucagaaucccu

SEQ ID NO: 6303 - RNA, 17 nt, Homo sapiens
ucagaaucccugcgaag

SEQ ID NO: 6304 - RNA, 17 nt, Homo sapiens
cagaaucccugcgaagu

SEQ ID NO: 6305 - RNA, 17 nt, Homo sapiens
agaaucccugcgaagua

SEQ ID NO: 6306 - RNA, 17 nt, Homo sapiens
cgaaguaccuugguuac

SEQ ID NO: 6307 - RNA, 17 nt, Homo sapiens
gaaguaccuugguuacc

SEQ ID NO: 6308 - RNA, 17 nt, Homo sapiens
uugguuacccaccccca

SEQ ID NO: 6309 - RNA, 17 nt, Homo sapiens
ugguuacccacccccag

SEQ ID NO: 6310 - RNA, 17 nt, Homo sapiens
gguuacccacccccaga

SEQ ID NO: 6311 - RNA, 17 nt, Homo sapiens
uuacccacccccagaaa

SEQ ID NO: 6312 - RNA, 17 nt, Homo sapiens
uacccacccccagaaau

SEQ ID NO: 6313 - RNA, 17 nt, Homo sapiens
acccacccccagaaaua

SEQ ID NO: 6314 - RNA, 17 nt, Homo sapiens
cccacccccagaaauaa

SEQ ID NO: 6315 - RNA, 17 nt, Homo sapiens
ccacccccagaaauaaa

SEQ ID NO: 6316 - RNA, 17 nt, Homo sapiens
uggaauaccccuugagu

SEQ ID NO: 6317 - RNA, 17 nt, Homo sapiens
ggaauaccccuugaguc

SEQ ID NO: 6318 - RNA, 17 nt, Homo sapiens
gaauaccccuugagucc

SEQ ID NO: 6319 - RNA, 17 nt, Homo sapiens
aauaccccuugagucca

SEQ ID NO: 6320 - RNA, 17 nt, Homo sapiens
cuugaguccaaucacac

SEQ ID NO: 6321 - RNA, 17 nt, Homo sapiens
uugaguccaaucacaca

SEQ ID NO: 6322 - RNA, 17 nt, Homo sapiens
guccaaucacacaauua

SEQ ID NO: 6323 - RNA, 17 nt, Homo sapiens
ccaaucacacaauuaaa

SEQ ID NO: 6324 - RNA, 17 nt, Homo sapiens
aaucacacaauuaaagc

SEQ ID NO: 6325 - RNA, 17 nt, Homo sapiens
agcggggcauguacuga

SEQ ID NO: 6326 - RNA, 17 nt, Homo sapiens
gcauguacugacgauua

SEQ ID NO: 6327 - RNA, 17 nt, Homo sapiens
aaagagacacaggaaau

SEQ ID NO: 6328 - RNA, 17 nt, Homo sapiens
agagacacaggaaauua

SEQ ID NO: 6329 - RNA, 17 nt, Homo sapiens
gaaauuacacugucauc

SEQ ID NO: 6330 - RNA, 17 nt, Homo sapiens
aauuacacugucauccu

SEQ ID NO: 6331 - RNA, 17 nt, Homo sapiens
acacugucauccuuacc

SEQ ID NO: 6332 - RNA, 17 nt, Homo sapiens
cugucauccuuaccaau

SEQ ID NO: 6333 - RNA, 17 nt, Homo sapiens
ugucauccuuaccaauc

SEQ ID NO: 6334 - RNA, 17 nt, Homo sapiens
auccuuaccaaucccau

SEQ ID NO: 6335 - RNA, 17 nt, Homo sapiens
uccuuaccaaucccauu

SEQ ID NO: 6336 - RNA, 17 nt, Homo sapiens
uaccaaucccauuucaa

SEQ ID NO: 6337 - RNA, 17 nt, Homo sapiens
accaaucccauuucaaa

SEQ ID NO: 6338 - RNA, 17 nt, Homo sapiens
ccaaucccauuucaaag

SEQ ID NO: 6339 - RNA, 17 nt, Homo sapiens
cccauuucaaaggagaa

SEQ ID NO: 6340 - RNA, 17 nt, Homo sapiens
ggagaagcagagccaug

SEQ ID NO: 6341 - RNA, 17 nt, Homo sapiens
agcagagccaugugguc

SEQ ID NO: 6342 - RNA, 17 nt, Homo sapiens
gcagagccauguggucu

SEQ ID NO: 6343 - RNA, 17 nt, Homo sapiens
auguggucucucugguu

SEQ ID NO: 6344 - RNA, 17 nt, Homo sapiens
guggucucucugguugu

SEQ ID NO: 6345 - RNA, 17 nt, Homo sapiens
ggucucucugguugugu

SEQ ID NO: 6346 - RNA, 17 nt, Homo sapiens
uguaugucccaccccag

SEQ ID NO: 6347 - RNA, 17 nt, Homo sapiens
guaugucccaccccaga

SEQ ID NO: 6348 - RNA, 17 nt, Homo sapiens
uaugucccaccccagau

SEQ ID NO: 6349 - RNA, 17 nt, Homo sapiens
ugucccaccccagauug

SEQ ID NO: 6350 - RNA, 17 nt, Homo sapiens
gucccaccccagauugg

SEQ ID NO: 6351 - RNA, 17 nt, Homo sapiens
ucccaccccagauuggu

SEQ ID NO: 6352 - RNA, 17 nt, Homo sapiens
cccaccccagauuggug

SEQ ID NO: 6353 - RNA, 17 nt, Homo sapiens
gagaaaucucuaaucuc

SEQ ID NO: 6354 - RNA, 17 nt, Homo sapiens
gaaaucucuaaucucuc

SEQ ID NO: 6355 - RNA, 17 nt, Homo sapiens
cucuaaucucuccugug

SEQ ID NO: 6356 - RNA, 17 nt, Homo sapiens
cuaaucucuccugugga

SEQ ID NO: 6357 - RNA, 17 nt, Homo sapiens
aaucucuccuguggauu

SEQ ID NO: 6358 - RNA, 17 nt, Homo sapiens
aucucuccuguggauuc

SEQ ID NO: 6359 - RNA, 17 nt, Homo sapiens
guggauuccuaccagua

SEQ ID NO: 6360 - RNA, 17 nt, Homo sapiens
uggauuccuaccaguac

SEQ ID NO: 6361 - RNA, 17 nt, Homo sapiens
auuccuaccaguacggc

SEQ ID NO: 6362 - RNA, 17 nt, Homo sapiens
uuccuaccaguacggca

SEQ ID NO: 6363 - RNA, 17 nt, Homo sapiens
aguacggcaccacucaa

SEQ ID NO: 6364 - RNA, 17 nt, Homo sapiens
uacggcaccacucaaac

SEQ ID NO: 6365 - RNA, 17 nt, Homo sapiens
acggcaccacucaaacg

SEQ ID NO: 6366 - RNA, 17 nt, Homo sapiens
ggcaccacucaaacgcu

SEQ ID NO: 6367 - RNA, 17 nt, Homo sapiens
caccacucaaacgcuga

SEQ ID NO: 6368 - RNA, 17 nt, Homo sapiens
ucaaacgcugacaugua

SEQ ID NO: 6369 - RNA, 17 nt, Homo sapiens
acgcugacauguacggu

SEQ ID NO: 6370 - RNA, 17 nt, Homo sapiens
guacggucuaugccauu

SEQ ID NO: 6371 - RNA, 17 nt, Homo sapiens
gucuaugccauuccucc

SEQ ID NO: 6372 - RNA, 17 nt, Homo sapiens
ucuaugccauuccuccc

SEQ ID NO: 6373 - RNA, 17 nt, Homo sapiens
ugccauuccucccccgc

SEQ ID NO: 6374 - RNA, 17 nt, Homo sapiens
gccauuccucccccgca

SEQ ID NO: 6375 - RNA, 17 nt, Homo sapiens
cauuccucccccgcauc

SEQ ID NO: 6376 - RNA, 17 nt, Homo sapiens
auuccucccccgcauca

SEQ ID NO: 6377 - RNA, 17 nt, Homo sapiens
uuccucccccgcaucac

SEQ ID NO: 6378 - RNA, 17 nt, Homo sapiens
uccucccccgcaucaca

SEQ ID NO: 6379 - RNA, 17 nt, Homo sapiens
ucccccgcaucacaucc

SEQ ID NO: 6380 - RNA, 17 nt, Homo sapiens
cccgcaucacauccacu

SEQ ID NO: 6381 - RNA, 17 nt, Homo sapiens
cgcaucacauccacugg

SEQ ID NO: 6382 - RNA, 17 nt, Homo sapiens
aucacauccacugguau

SEQ ID NO: 6383 - RNA, 17 nt, Homo sapiens
ucacauccacugguauu

SEQ ID NO: 6384 - RNA, 17 nt, Homo sapiens
acauccacugguauugg

SEQ ID NO: 6385 - RNA, 17 nt, Homo sapiens
guauuggcaguuggagg

SEQ ID NO: 6386 - RNA, 17 nt, Homo sapiens
gagugcgccaacgagcc

SEQ ID NO: 6387 - RNA, 17 nt, Homo sapiens
agugcgccaacgagccc

SEQ ID NO: 6388 - RNA, 17 nt, Homo sapiens
caacgagcccagccaag

SEQ ID NO: 6389 - RNA, 17 nt, Homo sapiens
aacgagcccagccaagc

SEQ ID NO: 6390 - RNA, 17 nt, Homo sapiens
acgagcccagccaagcu

SEQ ID NO: 6391 - RNA, 17 nt, Homo sapiens
agcccagccaagcuguc

SEQ ID NO: 6392 - RNA, 17 nt, Homo sapiens
gcccagccaagcugucu

SEQ ID NO: 6393 - RNA, 17 nt, Homo sapiens
agccaagcugucucagu

SEQ ID NO: 6394 - RNA, 17 nt, Homo sapiens
aagcugucucagugaca

SEQ ID NO: 6395 - RNA, 17 nt, Homo sapiens
gcugucucagugacaaa

SEQ ID NO: 6396 - RNA, 17 nt, Homo sapiens
ucagugacaaacccaua

SEQ ID NO: 6397 - RNA, 17 nt, Homo sapiens
ugacaaacccauacccu

SEQ ID NO: 6398 - RNA, 17 nt, Homo sapiens
gacaaacccauacccuu

SEQ ID NO: 6399 - RNA, 17 nt, Homo sapiens
acaaacccauacccuug

SEQ ID NO: 6400 - RNA, 17 nt, Homo sapiens
acccauacccuugugaa

SEQ ID NO: 6401 - RNA, 17 nt, Homo sapiens
cccauacccuugugaag

SEQ ID NO: 6402 - RNA, 17 nt, Homo sapiens
ccauacccuugugaaga

SEQ ID NO: 6403 - RNA, 17 nt, Homo sapiens
uggaggacuuccaggga

SEQ ID NO: 6404 - RNA, 17 nt, Homo sapiens
aggacuuccagggagga

SEQ ID NO: 6405 - RNA, 17 nt, Homo sapiens
ggacuuccagggaggaa

SEQ ID NO: 6406 - RNA, 17 nt, Homo sapiens
uaaaaaucaauuugcuc

SEQ ID NO: 6407 - RNA, 17 nt, Homo sapiens
caauuugcucuaauuga

SEQ ID NO: 6408 - RNA, 17 nt, Homo sapiens
auuugcucuaauugaag

SEQ ID NO: 6409 - RNA, 17 nt, Homo sapiens
gaaaaaacaaaacugua

SEQ ID NO: 6410 - RNA, 17 nt, Homo sapiens
aacaaaacuguaaguac

SEQ ID NO: 6411 - RNA, 17 nt, Homo sapiens
guaaguacccuuguuau

SEQ ID NO: 6412 - RNA, 17 nt, Homo sapiens
uaaguacccuuguuauc

SEQ ID NO: 6413 - RNA, 17 nt, Homo sapiens
aaguacccuuguuaucc

SEQ ID NO: 6414 - RNA, 17 nt, Homo sapiens
uuguuauccaagcggca

SEQ ID NO: 6415 - RNA, 17 nt, Homo sapiens
uguuauccaagcggcaa

SEQ ID NO: 6416 - RNA, 17 nt, Homo sapiens
caagcggcaaauguguc

SEQ ID NO: 6417 - RNA, 17 nt, Homo sapiens
aaugugucagcuuugua

SEQ ID NO: 6418 - RNA, 17 nt, Homo sapiens
gugucagcuuuguacaa

SEQ ID NO: 6419 - RNA, 17 nt, Homo sapiens
cuuuguacaaaugugaa

SEQ ID NO: 6420 - RNA, 17 nt, Homo sapiens
aagcggucaacaaaguc

SEQ ID NO: 6421 - RNA, 17 nt, Homo sapiens
cggucaacaaagucggg

SEQ ID NO: 6422 - RNA, 17 nt, Homo sapiens
gggugaucuccuuccac

SEQ ID NO: 6423 - RNA, 17 nt, Homo sapiens
gugaucuccuuccacgu

SEQ ID NO: 6424 - RNA, 17 nt, Homo sapiens
ugaucuccuuccacgug

SEQ ID NO: 6425 - RNA, 17 nt, Homo sapiens
ucuccuuccacgugacc

SEQ ID NO: 6426 - RNA, 17 nt, Homo sapiens
cuccuuccacgugacca

SEQ ID NO: 6427 - RNA, 17 nt, Homo sapiens
cacgugaccaggggucc

SEQ ID NO: 6428 - RNA, 17 nt, Homo sapiens
acgugaccagggguccu

SEQ ID NO: 6429 - RNA, 17 nt, Homo sapiens
cagggguccugaaauua

SEQ ID NO: 6430 - RNA, 17 nt, Homo sapiens
agggguccugaaauuac

SEQ ID NO: 6431 - RNA, 17 nt, Homo sapiens
gaaauuacuuugcaacc

SEQ ID NO: 6432 - RNA, 17 nt, Homo sapiens
uacuuugcaaccugaca

SEQ ID NO: 6433 - RNA, 17 nt, Homo sapiens
uuugcaaccugacaugc

SEQ ID NO: 6434 - RNA, 17 nt, Homo sapiens
uugcaaccugacaugca

SEQ ID NO: 6435 - RNA, 17 nt, Homo sapiens
aaccugacaugcagccc

SEQ ID NO: 6436 - RNA, 17 nt, Homo sapiens
ugacaugcagcccacug

SEQ ID NO: 6437 - RNA, 17 nt, Homo sapiens
caugcagcccacugagc

SEQ ID NO: 6438 - RNA, 17 nt, Homo sapiens
augcagcccacugagca

SEQ ID NO: 6439 - RNA, 17 nt, Homo sapiens
ugcagcccacugagcag

SEQ ID NO: 6440 - RNA, 17 nt, Homo sapiens
cagcccacugagcagga

SEQ ID NO: 6441 - RNA, 17 nt, Homo sapiens
cacugagcaggagagcg

SEQ ID NO: 6442 - RNA, 17 nt, Homo sapiens
agcgugucuuuguggug

SEQ ID NO: 6443 - RNA, 17 nt, Homo sapiens
uguggugcacugcagac

SEQ ID NO: 6444 - RNA, 17 nt, Homo sapiens
uggugcacugcagacag

SEQ ID NO: 6445 - RNA, 17 nt, Homo sapiens
ugcacugcagacagauc

SEQ ID NO: 6446 - RNA, 17 nt, Homo sapiens
cugcagacagaucuacg

SEQ ID NO: 6447 - RNA, 17 nt, Homo sapiens
gacagaucuacguuuga

SEQ ID NO: 6448 - RNA, 17 nt, Homo sapiens
uugagaaccucacaugg

SEQ ID NO: 6449 - RNA, 17 nt, Homo sapiens
ugagaaccucacauggu

SEQ ID NO: 6450 - RNA, 17 nt, Homo sapiens
agaaccucacaugguac

SEQ ID NO: 6451 - RNA, 17 nt, Homo sapiens
aaccucacaugguacaa

SEQ ID NO: 6452 - RNA, 17 nt, Homo sapiens
caugguacaagcuuggc

SEQ ID NO: 6453 - RNA, 17 nt, Homo sapiens
guacaagcuuggcccac

SEQ ID NO: 6454 - RNA, 17 nt, Homo sapiens
agcuuggcccacagccu

SEQ ID NO: 6455 - RNA, 17 nt, Homo sapiens
gcuuggcccacagccuc

SEQ ID NO: 6456 - RNA, 17 nt, Homo sapiens
cuuggcccacagccucu

SEQ ID NO: 6457 - RNA, 17 nt, Homo sapiens
uggcccacagccucugc

SEQ ID NO: 6458 - RNA, 17 nt, Homo sapiens
cccacagccucugccaa

SEQ ID NO: 6459 - RNA, 17 nt, Homo sapiens
ccacagccucugccaau

SEQ ID NO: 6460 - RNA, 17 nt, Homo sapiens
acagccucugccaaucc

SEQ ID NO: 6461 - RNA, 17 nt, Homo sapiens
gccucugccaauccaug

SEQ ID NO: 6462 - RNA, 17 nt, Homo sapiens
ccucugccaauccaugu

SEQ ID NO: 6463 - RNA, 17 nt, Homo sapiens
ugccaauccauguggga

SEQ ID NO: 6464 - RNA, 17 nt, Homo sapiens
gccaauccaugugggag

SEQ ID NO: 6465 - RNA, 17 nt, Homo sapiens
agaguugcccacaccug

SEQ ID NO: 6466 - RNA, 17 nt, Homo sapiens
gaguugcccacaccugu

SEQ ID NO: 6467 - RNA, 17 nt, Homo sapiens
aguugcccacaccuguu

SEQ ID NO: 6468 - RNA, 17 nt, Homo sapiens
uugcccacaccuguuug

SEQ ID NO: 6469 - RNA, 17 nt, Homo sapiens
gcccacaccuguuugca

SEQ ID NO: 6470 - RNA, 17 nt, Homo sapiens
cccacaccuguuugcaa

SEQ ID NO: 6471 - RNA, 17 nt, Homo sapiens
cuguuugcaagaacuug

SEQ ID NO: 6472 - RNA, 17 nt, Homo sapiens
gcaagaacuuggauacu

SEQ ID NO: 6473 - RNA, 17 nt, Homo sapiens
uuggauacucuuuggaa

SEQ ID NO: 6474 - RNA, 17 nt, Homo sapiens
ggauacucuuuggaaau

SEQ ID NO: 6475 - RNA, 17 nt, Homo sapiens
uugaaugccaccauguu

SEQ ID NO: 6476 - RNA, 17 nt, Homo sapiens
ugaaugccaccauguuc

SEQ ID NO: 6477 - RNA, 17 nt, Homo sapiens
aaugccaccauguucuc

SEQ ID NO: 6478 - RNA, 17 nt, Homo sapiens
augccaccauguucucu

SEQ ID NO: 6479 - RNA, 17 nt, Homo sapiens
ccauguucucuaauagc

SEQ ID NO: 6480 - RNA, 17 nt, Homo sapiens
auguucucuaauagcac

SEQ ID NO: 6481 - RNA, 17 nt, Homo sapiens
cuaauagcacaaaugac

SEQ ID NO: 6482 - RNA, 17 nt, Homo sapiens
aauagcacaaaugacau

SEQ ID NO: 6483 - RNA, 17 nt, Homo sapiens
caaaugacauuuugauc

SEQ ID NO: 6484 - RNA, 17 nt, Homo sapiens
uuuugaucauggagcuu

SEQ ID NO: 6485 - RNA, 17 nt, Homo sapiens
cauggagcuuaagaaug

SEQ ID NO: 6486 - RNA, 17 nt, Homo sapiens
aagaaugcauccuugca

SEQ ID NO: 6487 - RNA, 17 nt, Homo sapiens
aaugcauccuugcagga

SEQ ID NO: 6488 - RNA, 17 nt, Homo sapiens
augcauccuugcaggac

SEQ ID NO: 6489 - RNA, 17 nt, Homo sapiens
auccuugcaggaccaag

SEQ ID NO: 6490 - RNA, 17 nt, Homo sapiens
ugcaggaccaaggagac

SEQ ID NO: 6491 - RNA, 17 nt, Homo sapiens
gcaggaccaaggagacu

SEQ ID NO: 6492 - RNA, 17 nt, Homo sapiens
aaggagacuaugucugc

SEQ ID NO: 6493 - RNA, 17 nt, Homo sapiens
acuaugucugccuugcu

SEQ ID NO: 6494 - RNA, 17 nt, Homo sapiens
augucugccuugcucaa

SEQ ID NO: 6495 - RNA, 17 nt, Homo sapiens
ugucugccuugcucaag

SEQ ID NO: 6496 - RNA, 17 nt, Homo sapiens
ugccuugcucaagacag

SEQ ID NO: 6497 - RNA, 17 nt, Homo sapiens
ccuugcucaagacagga

SEQ ID NO: 6498 - RNA, 17 nt, Homo sapiens
cucaagacaggaagacc

SEQ ID NO: 6499 - RNA, 17 nt, Homo sapiens
aggaagaccaagaaaag

SEQ ID NO: 6500 - RNA, 17 nt, Homo sapiens
ggaagaccaagaaaaga

SEQ ID NO: 6501 - RNA, 17 nt, Homo sapiens
gaaaagacauugcgugg

SEQ ID NO: 6502 - RNA, 17 nt, Homo sapiens
gcguggucaggcagcuc

SEQ ID NO: 6503 - RNA, 17 nt, Homo sapiens
ggucaggcagcucacag

SEQ ID NO: 6504 - RNA, 17 nt, Homo sapiens
caggcagcucacagucc

SEQ ID NO: 6505 - RNA, 17 nt, Homo sapiens
ggcagcucacaguccua

SEQ ID NO: 6506 - RNA, 17 nt, Homo sapiens
cagcucacaguccuaga

SEQ ID NO: 6507 - RNA, 17 nt, Homo sapiens
ucacaguccuagagcgu

SEQ ID NO: 6508 - RNA, 17 nt, Homo sapiens
cacaguccuagagcgug

SEQ ID NO: 6509 - RNA, 17 nt, Homo sapiens
cguguggcacccacgau

SEQ ID NO: 6510 - RNA, 17 nt, Homo sapiens
uguggcacccacgauca

SEQ ID NO: 6511 - RNA, 17 nt, Homo sapiens
guggcacccacgaucac

SEQ ID NO: 6512 - RNA, 17 nt, Homo sapiens
uggcacccacgaucaca

SEQ ID NO: 6513 - RNA, 17 nt, Homo sapiens
ccacgaucacaggaaac

SEQ ID NO: 6514 - RNA, 17 nt, Homo sapiens
acgaucacaggaaaccu

SEQ ID NO: 6515 - RNA, 17 nt, Homo sapiens
caggaaaccuggagaau

SEQ ID NO: 6516 - RNA, 17 nt, Homo sapiens
aggaaaccuggagaauc

SEQ ID NO: 6517 - RNA, 17 nt, Homo sapiens
ggagaaucagacgacaa

SEQ ID NO: 6518 - RNA, 17 nt, Homo sapiens
cagacgacaaguauugg

SEQ ID NO: 6519 - RNA, 17 nt, Homo sapiens
gggaaagcaucgaaguc

SEQ ID NO: 6520 - RNA, 17 nt, Homo sapiens
ucgaagucucaugcacg

SEQ ID NO: 6521 - RNA, 17 nt, Homo sapiens
gaagucucaugcacggc

SEQ ID NO: 6522 - RNA, 17 nt, Homo sapiens
ucucaugcacggcaucu

SEQ ID NO: 6523 - RNA, 17 nt, Homo sapiens
ugcacggcaucugggaa

SEQ ID NO: 6524 - RNA, 17 nt, Homo sapiens
acggcaucugggaaucc

SEQ ID NO: 6525 - RNA, 17 nt, Homo sapiens
ugggaaucccccuccac

SEQ ID NO: 6526 - RNA, 17 nt, Homo sapiens
gggaaucccccuccaca

SEQ ID NO: 6527 - RNA, 17 nt, Homo sapiens
ggaaucccccuccacag

SEQ ID NO: 6528 - RNA, 17 nt, Homo sapiens
gaaucccccuccacaga

SEQ ID NO: 6529 - RNA, 17 nt, Homo sapiens
aaucccccuccacagau

SEQ ID NO: 6530 - RNA, 17 nt, Homo sapiens
ucccccuccacagauca

SEQ ID NO: 6531 - RNA, 17 nt, Homo sapiens
cccccuccacagaucau

SEQ ID NO: 6532 - RNA, 17 nt, Homo sapiens
cccuccacagaucaugu

SEQ ID NO: 6533 - RNA, 17 nt, Homo sapiens
cacagaucaugugguuu

SEQ ID NO: 6534 - RNA, 17 nt, Homo sapiens
aaugagacccuuguaga

SEQ ID NO: 6535 - RNA, 17 nt, Homo sapiens
augagacccuuguagaa

SEQ ID NO: 6536 - RNA, 17 nt, Homo sapiens
ugagacccuuguagaag

SEQ ID NO: 6537 - RNA, 17 nt, Homo sapiens
uagaagacucaggcauu

SEQ ID NO: 6538 - RNA, 17 nt, Homo sapiens
gaagacucaggcauugu

SEQ ID NO: 6539 - RNA, 17 nt, Homo sapiens
acucaggcauuguauug

SEQ ID NO: 6540 - RNA, 17 nt, Homo sapiens
augggaaccggaaccuc

SEQ ID NO: 6541 - RNA, 17 nt, Homo sapiens
accggaaccucacuauc

SEQ ID NO: 6542 - RNA, 17 nt, Homo sapiens
ccggaaccucacuaucc

SEQ ID NO: 6543 - RNA, 17 nt, Homo sapiens
ggaaccucacuauccgc

SEQ ID NO: 6544 - RNA, 17 nt, Homo sapiens
aaccucacuauccgcag

SEQ ID NO: 6545 - RNA, 17 nt, Homo sapiens
ucacuauccgcagagug

SEQ ID NO: 6546 - RNA, 17 nt, Homo sapiens
cuauccgcagagugagg

SEQ ID NO: 6547 - RNA, 17 nt, Homo sapiens
acgaaggccucuacacc

SEQ ID NO: 6548 - RNA, 17 nt, Homo sapiens
cgaaggccucuacaccu

SEQ ID NO: 6549 - RNA, 17 nt, Homo sapiens
aaggccucuacaccugc

SEQ ID NO: 6550 - RNA, 17 nt, Homo sapiens
gccucuacaccugccag

SEQ ID NO: 6551 - RNA, 17 nt, Homo sapiens
cucuacaccugccaggc

SEQ ID NO: 6552 - RNA, 17 nt, Homo sapiens
ucuacaccugccaggca

SEQ ID NO: 6553 - RNA, 17 nt, Homo sapiens
acaccugccaggcaugc

SEQ ID NO: 6554 - RNA, 17 nt, Homo sapiens
caccugccaggcaugca

SEQ ID NO: 6555 - RNA, 17 nt, Homo sapiens
ugccaggcaugcagugu

SEQ ID NO: 6556 - RNA, 17 nt, Homo sapiens
aggcaugcaguguucuu

SEQ ID NO: 6557 - RNA, 17 nt, Homo sapiens
caguguucuuggcugug

SEQ ID NO: 6558 - RNA, 17 nt, Homo sapiens
uucuuggcugugcaaaa

SEQ ID NO: 6559 - RNA, 17 nt, Homo sapiens
ggcugugcaaaagugga

SEQ ID NO: 6560 - RNA, 17 nt, Homo sapiens
guggaggcauuuuucau

SEQ ID NO: 6561 - RNA, 17 nt, Homo sapiens
cauuuuucauaauagaa

SEQ ID NO: 6562 - RNA, 17 nt, Homo sapiens
gaaggugcccaggaaaa

SEQ ID NO: 6563 - RNA, 17 nt, Homo sapiens
aaggugcccaggaaaag

SEQ ID NO: 6564 - RNA, 17 nt, Homo sapiens
aggugcccaggaaaaga

SEQ ID NO: 6565 - RNA, 17 nt, Homo sapiens
agacgaacuuggaaauc

SEQ ID NO: 6566 - RNA, 17 nt, Homo sapiens
uggaaaucauuauucua

SEQ ID NO: 6567 - RNA, 17 nt, Homo sapiens
cauuauucuaguaggca

SEQ ID NO: 6568 - RNA, 17 nt, Homo sapiens
uaguaggcacgacggug

SEQ ID NO: 6569 - RNA, 17 nt, Homo sapiens
gugauugccauguucuu

SEQ ID NO: 6570 - RNA, 17 nt, Homo sapiens
ugauugccauguucuuc

SEQ ID NO: 6571 - RNA, 17 nt, Homo sapiens
ccauguucuucuggcua

SEQ ID NO: 6572 - RNA, 17 nt, Homo sapiens
uguucuucuggcuacuu

SEQ ID NO: 6573 - RNA, 17 nt, Homo sapiens
cuucuggcuacuucuug

SEQ ID NO: 6574 - RNA, 17 nt, Homo sapiens
cuggcuacuucuuguca

SEQ ID NO: 6575 - RNA, 17 nt, Homo sapiens
gcuacuucuugucauca

SEQ ID NO: 6576 - RNA, 17 nt, Homo sapiens
uucuugucaucauccua

SEQ ID NO: 6577 - RNA, 17 nt, Homo sapiens
uugucaucauccuaggg

SEQ ID NO: 6578 - RNA, 17 nt, Homo sapiens
ucaucauccuagggacc

SEQ ID NO: 6579 - RNA, 17 nt, Homo sapiens
caucauccuagggaccg

SEQ ID NO: 6580 - RNA, 17 nt, Homo sapiens
cuagggaccguuaagcg

SEQ ID NO: 6581 - RNA, 17 nt, Homo sapiens
aagcgggccaauggagg

SEQ ID NO: 6582 - RNA, 17 nt, Homo sapiens
agcgggccaauggaggg

SEQ ID NO: 6583 - RNA, 17 nt, Homo sapiens
aggggaacugaagacag

SEQ ID NO: 6584 - RNA, 17 nt, Homo sapiens
cugaagacaggcuacuu

SEQ ID NO: 6585 - RNA, 17 nt, Homo sapiens
agacaggcuacuugucc

SEQ ID NO: 6586 - RNA, 17 nt, Homo sapiens
caggcuacuuguccauc

SEQ ID NO: 6587 - RNA, 17 nt, Homo sapiens
uacuuguccaucgucau

SEQ ID NO: 6588 - RNA, 17 nt, Homo sapiens
acuuguccaucgucaug

SEQ ID NO: 6589 - RNA, 17 nt, Homo sapiens
ccaucgucauggaucca

SEQ ID NO: 6590 - RNA, 17 nt, Homo sapiens
cauggauccagaugaac

SEQ ID NO: 6591 - RNA, 17 nt, Homo sapiens
auggauccagaugaacu

SEQ ID NO: 6592 - RNA, 17 nt, Homo sapiens
agaugaacucccauugg

SEQ ID NO: 6593 - RNA, 17 nt, Homo sapiens
augaacucccauuggau

SEQ ID NO: 6594 - RNA, 17 nt, Homo sapiens
ugaacucccauuggaug

SEQ ID NO: 6595 - RNA, 17 nt, Homo sapiens
gaacucccauuggauga

SEQ ID NO: 6596 - RNA, 17 nt, Homo sapiens
ggaugaacauugugaac

SEQ ID NO: 6597 - RNA, 17 nt, Homo sapiens
ugaacgacugccuuaug

SEQ ID NO: 6598 - RNA, 17 nt, Homo sapiens
acgacugccuuaugaug

SEQ ID NO: 6599 - RNA, 17 nt, Homo sapiens
cgacugccuuaugaugc

SEQ ID NO: 6600 - RNA, 17 nt, Homo sapiens
uaugaugccagcaaaug

SEQ ID NO: 6601 - RNA, 17 nt, Homo sapiens
augaugccagcaaaugg

SEQ ID NO: 6602 - RNA, 17 nt, Homo sapiens
augccagcaaaugggaa

SEQ ID NO: 6603 - RNA, 17 nt, Homo sapiens
gggaauuccccagagac

SEQ ID NO: 6604 - RNA, 17 nt, Homo sapiens
ggaauuccccagagacc

SEQ ID NO: 6605 - RNA, 17 nt, Homo sapiens
gaauuccccagagaccg

SEQ ID NO: 6606 - RNA, 17 nt, Homo sapiens
aauuccccagagaccgg

SEQ ID NO: 6607 - RNA, 17 nt, Homo sapiens
ccagagaccggcugaac

SEQ ID NO: 6608 - RNA, 17 nt, Homo sapiens
agaccggcugaaccuag

SEQ ID NO: 6609 - RNA, 17 nt, Homo sapiens
ggcugaaccuagguaag

SEQ ID NO: 6610 - RNA, 17 nt, Homo sapiens
gcugaaccuagguaagc

SEQ ID NO: 6611 - RNA, 17 nt, Homo sapiens
agguaagccucuuggcc

SEQ ID NO: 6612 - RNA, 17 nt, Homo sapiens
gguaagccucuuggccg

SEQ ID NO: 6613 - RNA, 17 nt, Homo sapiens
uaagccucuuggccgug

SEQ ID NO: 6614 - RNA, 17 nt, Homo sapiens
cucuuggccguggugcc

SEQ ID NO: 6615 - RNA, 17 nt, Homo sapiens
cguggugccuuuggcca

SEQ ID NO: 6616 - RNA, 17 nt, Homo sapiens
guggugccuuuggccaa

SEQ ID NO: 6617 - RNA, 17 nt, Homo sapiens
ccuuuggccaagagauu

SEQ ID NO: 6618 - RNA, 17 nt, Homo sapiens
cuuuggccaagagauug

SEQ ID NO: 6619 - RNA, 17 nt, Homo sapiens
auugaagcagaugccuu

SEQ ID NO: 6620 - RNA, 17 nt, Homo sapiens
gcagaugccuuuggaau

SEQ ID NO: 6621 - RNA, 17 nt, Homo sapiens
cagaugccuuuggaauu

SEQ ID NO: 6622 - RNA, 17 nt, Homo sapiens
gaauugacaagacagca

SEQ ID NO: 6623 - RNA, 17 nt, Homo sapiens
gacaagacagcaacuug

SEQ ID NO: 6624 - RNA, 17 nt, Homo sapiens
aagacagcaacuugcag

SEQ ID NO: 6625 - RNA, 17 nt, Homo sapiens
acagcaacuugcaggac

SEQ ID NO: 6626 - RNA, 17 nt, Homo sapiens
caacuugcaggacagua

SEQ ID NO: 6627 - RNA, 17 nt, Homo sapiens
ugcaggacaguagcagu

SEQ ID NO: 6628 - RNA, 17 nt, Homo sapiens
acaguagcagucaaaau

SEQ ID NO: 6629 - RNA, 17 nt, Homo sapiens
uagcagucaaaauguug

SEQ ID NO: 6630 - RNA, 17 nt, Homo sapiens
gaaggagcaacacacag

SEQ ID NO: 6631 - RNA, 17 nt, Homo sapiens
ggagcaacacacaguga

SEQ ID NO: 6632 - RNA, 17 nt, Homo sapiens
agcaacacacagugagc

SEQ ID NO: 6633 - RNA, 17 nt, Homo sapiens
caacacacagugagcau

SEQ ID NO: 6634 - RNA, 17 nt, Homo sapiens
cagugagcaucgagcuc

SEQ ID NO: 6635 - RNA, 17 nt, Homo sapiens
caucgagcucucauguc

SEQ ID NO: 6636 - RNA, 17 nt, Homo sapiens
ucgagcucucaugucug

SEQ ID NO: 6637 - RNA, 17 nt, Homo sapiens
gagcucucaugucugaa

SEQ ID NO: 6638 - RNA, 17 nt, Homo sapiens
cucaugucugaacucaa

SEQ ID NO: 6639 - RNA, 17 nt, Homo sapiens
gucugaacucaagaucc

SEQ ID NO: 6640 - RNA, 17 nt, Homo sapiens
cugaacucaagauccuc

SEQ ID NO: 6641 - RNA, 17 nt, Homo sapiens
ucaagauccucauucau

SEQ ID NO: 6642 - RNA, 17 nt, Homo sapiens
caagauccucauucaua

SEQ ID NO: 6643 - RNA, 17 nt, Homo sapiens
agauccucauucauauu

SEQ ID NO: 6644 - RNA, 17 nt, Homo sapiens
ccucauucauauugguc

SEQ ID NO: 6645 - RNA, 17 nt, Homo sapiens
uauuggucaccaucuca

SEQ ID NO: 6646 - RNA, 17 nt, Homo sapiens
uuggucaccaucucaau

SEQ ID NO: 6647 - RNA, 17 nt, Homo sapiens
uggucaccaucucaaug

SEQ ID NO: 6648 - RNA, 17 nt, Homo sapiens
ucaccaucucaaugugg

SEQ ID NO: 6649 - RNA, 17 nt, Homo sapiens
accaucucaaugugguc

SEQ ID NO: 6650 - RNA, 17 nt, Homo sapiens
auguggucaaccuucua

SEQ ID NO: 6651 - RNA, 17 nt, Homo sapiens
uggucaaccuucuaggu

SEQ ID NO: 6652 - RNA, 17 nt, Homo sapiens
ggucaaccuucuaggug

SEQ ID NO: 6653 - RNA, 17 nt, Homo sapiens
caaccuucuaggugccu

SEQ ID NO: 6654 - RNA, 17 nt, Homo sapiens
cuaggugccuguaccaa

SEQ ID NO: 6655 - RNA, 17 nt, Homo sapiens
uaggugccuguaccaag

SEQ ID NO: 6656 - RNA, 17 nt, Homo sapiens
gccuguaccaagccagg

SEQ ID NO: 6657 - RNA, 17 nt, Homo sapiens
ccuguaccaagccagga

SEQ ID NO: 6658 - RNA, 17 nt, Homo sapiens
uaccaagccaggagggc

SEQ ID NO: 6659 - RNA, 17 nt, Homo sapiens
accaagccaggagggcc

SEQ ID NO: 6660 - RNA, 17 nt, Homo sapiens
aggagggccacucaugg

SEQ ID NO: 6661 - RNA, 17 nt, Homo sapiens
ggagggccacucauggu

SEQ ID NO: 6662 - RNA, 17 nt, Homo sapiens
agggccacucaugguga

SEQ ID NO: 6663 - RNA, 17 nt, Homo sapiens
ggccacucauggugauu

SEQ ID NO: 6664 - RNA, 17 nt, Homo sapiens
uggaauucugcaaauuu

SEQ ID NO: 6665 - RNA, 17 nt, Homo sapiens
aauucugcaaauuugga

SEQ ID NO: 6666 - RNA, 17 nt, Homo sapiens
uuggaaaccuguccacu

SEQ ID NO: 6667 - RNA, 17 nt, Homo sapiens
uggaaaccuguccacuu

SEQ ID NO: 6668 - RNA, 17 nt, Homo sapiens
aaccuguccacuuaccu

SEQ ID NO: 6669 - RNA, 17 nt, Homo sapiens
accuguccacuuaccug

SEQ ID NO: 6670 - RNA, 17 nt, Homo sapiens
cuguccacuuaccugag

SEQ ID NO: 6671 - RNA, 17 nt, Homo sapiens
ccacuuaccugaggagc

SEQ ID NO: 6672 - RNA, 17 nt, Homo sapiens
cacuuaccugaggagca

SEQ ID NO: 6673 - RNA, 17 nt, Homo sapiens
ugaggagcaagagaaau

SEQ ID NO: 6674 - RNA, 17 nt, Homo sapiens
aauuuguccccuacaag

SEQ ID NO: 6675 - RNA, 17 nt, Homo sapiens
auuuguccccuacaaga

SEQ ID NO: 6676 - RNA, 17 nt, Homo sapiens
uuuguccccuacaagac

SEQ ID NO: 6677 - RNA, 17 nt, Homo sapiens
uuguccccuacaagacc

SEQ ID NO: 6678 - RNA, 17 nt, Homo sapiens
uccccuacaagaccaaa

SEQ ID NO: 6679 - RNA, 17 nt, Homo sapiens
uacaagaccaaaggggc

SEQ ID NO: 6680 - RNA, 17 nt, Homo sapiens
acaagaccaaaggggca

SEQ ID NO: 6681 - RNA, 17 nt, Homo sapiens
aaaggggcacgauuccg

SEQ ID NO: 6682 - RNA, 17 nt, Homo sapiens
cacgauuccgucaaggg

SEQ ID NO: 6683 - RNA, 17 nt, Homo sapiens
auuccgucaagggaaag

SEQ ID NO: 6684 - RNA, 17 nt, Homo sapiens
ggaaagacuacguugga

SEQ ID NO: 6685 - RNA, 17 nt, Homo sapiens
guuggagcaaucccugu

SEQ ID NO: 6686 - RNA, 17 nt, Homo sapiens
gagcaaucccuguggau

SEQ ID NO: 6687 - RNA, 17 nt, Homo sapiens
agcaaucccuguggauc

SEQ ID NO: 6688 - RNA, 17 nt, Homo sapiens
gcaaucccuguggaucu

SEQ ID NO: 6689 - RNA, 17 nt, Homo sapiens
uguggaucugaaacggc

SEQ ID NO: 6690 - RNA, 17 nt, Homo sapiens
aacggcgcuuggacagc

SEQ ID NO: 6691 - RNA, 17 nt, Homo sapiens
gcuuggacagcaucacc

SEQ ID NO: 6692 - RNA, 17 nt, Homo sapiens
uggacagcaucaccagu

SEQ ID NO: 6693 - RNA, 17 nt, Homo sapiens
acagcaucaccaguagc

SEQ ID NO: 6694 - RNA, 17 nt, Homo sapiens
agcaucaccaguagcca

SEQ ID NO: 6695 - RNA, 17 nt, Homo sapiens
gcaucaccaguagccag

SEQ ID NO: 6696 - RNA, 17 nt, Homo sapiens
ccaguagccagagcuca

SEQ ID NO: 6697 - RNA, 17 nt, Homo sapiens
caguagccagagcucag

SEQ ID NO: 6698 - RNA, 17 nt, Homo sapiens
gccagagcucagccagc

SEQ ID NO: 6699 - RNA, 17 nt, Homo sapiens
cagagcucagccagcuc

SEQ ID NO: 6700 - RNA, 17 nt, Homo sapiens
agcucagccagcucugg

SEQ ID NO: 6701 - RNA, 17 nt, Homo sapiens
gcucagccagcucugga

SEQ ID NO: 6702 - RNA, 17 nt, Homo sapiens
cagccagcucuggauuu

SEQ ID NO: 6703 - RNA, 17 nt, Homo sapiens
gccagcucuggauuugu

SEQ ID NO: 6704 - RNA, 17 nt, Homo sapiens
gagaagucccucaguga

SEQ ID NO: 6705 - RNA, 17 nt, Homo sapiens
agaagucccucagugau

SEQ ID NO: 6706 - RNA, 17 nt, Homo sapiens
gaagucccucagugaug

SEQ ID NO: 6707 - RNA, 17 nt, Homo sapiens
agucccucagugaugua

SEQ ID NO: 6708 - RNA, 17 nt, Homo sapiens
gaggaagcuccugaaga

SEQ ID NO: 6709 - RNA, 17 nt, Homo sapiens
ggaagcuccugaagauc

SEQ ID NO: 6710 - RNA, 17 nt, Homo sapiens
gaagcuccugaagaucu

SEQ ID NO: 6711 - RNA, 17 nt, Homo sapiens
ugaagaucuguauaagg

SEQ ID NO: 6712 - RNA, 17 nt, Homo sapiens
auaaggacuuccugacc

SEQ ID NO: 6713 - RNA, 17 nt, Homo sapiens
aggacuuccugaccuug

SEQ ID NO: 6714 - RNA, 17 nt, Homo sapiens
ggacuuccugaccuugg

SEQ ID NO: 6715 - RNA, 17 nt, Homo sapiens
uuccugaccuuggagca

SEQ ID NO: 6716 - RNA, 17 nt, Homo sapiens
uccugaccuuggagcau

SEQ ID NO: 6717 - RNA, 17 nt, Homo sapiens
cuuggagcaucucaucu

SEQ ID NO: 6718 - RNA, 17 nt, Homo sapiens
ggagcaucucaucuguu

SEQ ID NO: 6719 - RNA, 17 nt, Homo sapiens
agcaucucaucuguuac

SEQ ID NO: 6720 - RNA, 17 nt, Homo sapiens
aucucaucuguuacagc

SEQ ID NO: 6721 - RNA, 17 nt, Homo sapiens
ucuguuacagcuuccaa

SEQ ID NO: 6722 - RNA, 17 nt, Homo sapiens
guuacagcuuccaagug

SEQ ID NO: 6723 - RNA, 17 nt, Homo sapiens
acagcuuccaaguggcu

SEQ ID NO: 6724 - RNA, 17 nt, Homo sapiens
cagcuuccaaguggcua

SEQ ID NO: 6725 - RNA, 17 nt, Homo sapiens
caaguggcuaagggcau

SEQ ID NO: 6726 - RNA, 17 nt, Homo sapiens
cuaagggcauggaguuc

SEQ ID NO: 6727 - RNA, 17 nt, Homo sapiens
uggaguucuuggcaucg

SEQ ID NO: 6728 - RNA, 17 nt, Homo sapiens
uucuuggcaucgcgaaa

SEQ ID NO: 6729 - RNA, 17 nt, Homo sapiens
aguguauccacagggac

SEQ ID NO: 6730 - RNA, 17 nt, Homo sapiens
guguauccacagggacc

SEQ ID NO: 6731 - RNA, 17 nt, Homo sapiens
guauccacagggaccug

SEQ ID NO: 6732 - RNA, 17 nt, Homo sapiens
acagggaccuggcggca

SEQ ID NO: 6733 - RNA, 17 nt, Homo sapiens
cagggaccuggcggcac

SEQ ID NO: 6734 - RNA, 17 nt, Homo sapiens
cuggcggcacgaaauau

SEQ ID NO: 6735 - RNA, 17 nt, Homo sapiens
gaaauauccucuuaucg

SEQ ID NO: 6736 - RNA, 17 nt, Homo sapiens
aaauauccucuuaucgg

SEQ ID NO: 6737 - RNA, 17 nt, Homo sapiens
auauccucuuaucggag

SEQ ID NO: 6738 - RNA, 17 nt, Homo sapiens
uuaaaaucugugacuuu

SEQ ID NO: 6739 - RNA, 17 nt, Homo sapiens
ucugugacuuuggcuug

SEQ ID NO: 6740 - RNA, 17 nt, Homo sapiens
acuuuggcuuggcccgg

SEQ ID NO: 6741 - RNA, 17 nt, Homo sapiens
ggcuuggcccgggauau

SEQ ID NO: 6742 - RNA, 17 nt, Homo sapiens
gcuuggcccgggauauu

SEQ ID NO: 6743 - RNA, 17 nt, Homo sapiens
uaaagauccagauuaug

SEQ ID NO: 6744 - RNA, 17 nt, Homo sapiens
aaagauccagauuaugu

SEQ ID NO: 6745 - RNA, 17 nt, Homo sapiens
auuaugucagaaaagga

SEQ ID NO: 6746 - RNA, 17 nt, Homo sapiens
ggagaugcucgccuccc

SEQ ID NO: 6747 - RNA, 17 nt, Homo sapiens
augcucgccucccuuug

SEQ ID NO: 6748 - RNA, 17 nt, Homo sapiens
ugcucgccucccuuuga

SEQ ID NO: 6749 - RNA, 17 nt, Homo sapiens
cucgccucccuuugaaa

SEQ ID NO: 6750 - RNA, 17 nt, Homo sapiens
ucgccucccuuugaaau

SEQ ID NO: 6751 - RNA, 17 nt, Homo sapiens
cgccucccuuugaaaug

SEQ ID NO: 6752 - RNA, 17 nt, Homo sapiens
uggauggccccagaaac

SEQ ID NO: 6753 - RNA, 17 nt, Homo sapiens
ggauggccccagaaaca

SEQ ID NO: 6754 - RNA, 17 nt, Homo sapiens
gauggccccagaaacaa

SEQ ID NO: 6755 - RNA, 17 nt, Homo sapiens
auggccccagaaacaau

SEQ ID NO: 6756 - RNA, 17 nt, Homo sapiens
ccagaaacaauuuuuga

SEQ ID NO: 6757 - RNA, 17 nt, Homo sapiens
uuuuugacagaguguac

SEQ ID NO: 6758 - RNA, 17 nt, Homo sapiens
gaguguacacaauccag

SEQ ID NO: 6759 - RNA, 17 nt, Homo sapiens
guguacacaauccagag

SEQ ID NO: 6760 - RNA, 17 nt, Homo sapiens
acacaauccagagugac

SEQ ID NO: 6761 - RNA, 17 nt, Homo sapiens
cacaauccagagugacg

SEQ ID NO: 6762 - RNA, 17 nt, Homo sapiens
gugacgucuggucuuuu

SEQ ID NO: 6763 - RNA, 17 nt, Homo sapiens
gucuggucuuuuggugu

SEQ ID NO: 6764 - RNA, 17 nt, Homo sapiens
uguuuugcugugggaaa

SEQ ID NO: 6765 - RNA, 17 nt, Homo sapiens
auauuuuccuuaggugc

SEQ ID NO: 6766 - RNA, 17 nt, Homo sapiens
uauuuuccuuaggugcu

SEQ ID NO: 6767 - RNA, 17 nt, Homo sapiens
uuaggugcuucuccaua

SEQ ID NO: 6768 - RNA, 17 nt, Homo sapiens
ggugcuucuccauaucc

SEQ ID NO: 6769 - RNA, 17 nt, Homo sapiens
ugcuucuccauauccug

SEQ ID NO: 6770 - RNA, 17 nt, Homo sapiens
gcuucuccauauccugg

SEQ ID NO: 6771 - RNA, 17 nt, Homo sapiens
uccauauccugggguaa

SEQ ID NO: 6772 - RNA, 17 nt, Homo sapiens
ccauauccugggguaaa

SEQ ID NO: 6773 - RNA, 17 nt, Homo sapiens
gaaggaacuagaaugag

SEQ ID NO: 6774 - RNA, 17 nt, Homo sapiens
augagggccccugauua

SEQ ID NO: 6775 - RNA, 17 nt, Homo sapiens
ugagggccccugauuau

SEQ ID NO: 6776 - RNA, 17 nt, Homo sapiens
gagggccccugauuaua

SEQ ID NO: 6777 - RNA, 17 nt, Homo sapiens
agggccccugauuauac

SEQ ID NO: 6778 - RNA, 17 nt, Homo sapiens
gauuauacuacaccaga

SEQ ID NO: 6779 - RNA, 17 nt, Homo sapiens
uauacuacaccagaaau

SEQ ID NO: 6780 - RNA, 17 nt, Homo sapiens
uacuacaccagaaaugu

SEQ ID NO: 6781 - RNA, 17 nt, Homo sapiens
acuacaccagaaaugua

SEQ ID NO: 6782 - RNA, 17 nt, Homo sapiens
aaauguaccagaccaug

SEQ ID NO: 6783 - RNA, 17 nt, Homo sapiens
aauguaccagaccaugc

SEQ ID NO: 6784 - RNA, 17 nt, Homo sapiens
uaccagaccaugcugga

SEQ ID NO: 6785 - RNA, 17 nt, Homo sapiens
accagaccaugcuggac

SEQ ID NO: 6786 - RNA, 17 nt, Homo sapiens
gaccaugcuggacugcu

SEQ ID NO: 6787 - RNA, 17 nt, Homo sapiens
uggacugcuggcacggg

SEQ ID NO: 6788 - RNA, 17 nt, Homo sapiens
cugcuggcacggggagc

SEQ ID NO: 6789 - RNA, 17 nt, Homo sapiens
cggggagcccagucaga

SEQ ID NO: 6790 - RNA, 17 nt, Homo sapiens
ggggagcccagucagag

SEQ ID NO: 6791 - RNA, 17 nt, Homo sapiens
gggagcccagucagaga

SEQ ID NO: 6792 - RNA, 17 nt, Homo sapiens
gcccagucagagaccca

SEQ ID NO: 6793 - RNA, 17 nt, Homo sapiens
ucagagacccacguuuu

SEQ ID NO: 6794 - RNA, 17 nt, Homo sapiens
cagagacccacguuuuc

SEQ ID NO: 6795 - RNA, 17 nt, Homo sapiens
agagacccacguuuuca

SEQ ID NO: 6796 - RNA, 17 nt, Homo sapiens
acguuuucagaguuggu

SEQ ID NO: 6797 - RNA, 17 nt, Homo sapiens
gguggaacauuugggaa

SEQ ID NO: 6798 - RNA, 17 nt, Homo sapiens
gggaaaucucuugcaag

SEQ ID NO: 6799 - RNA, 17 nt, Homo sapiens
gaaaucucuugcaagcu

SEQ ID NO: 6800 - RNA, 17 nt, Homo sapiens
ucucuugcaagcuaaug

SEQ ID NO: 6801 - RNA, 17 nt, Homo sapiens
uugcaagcuaaugcuca

SEQ ID NO: 6802 - RNA, 17 nt, Homo sapiens
gcuaaugcucagcagga

SEQ ID NO: 6803 - RNA, 17 nt, Homo sapiens
uaaugcucagcaggaug

SEQ ID NO: 6804 - RNA, 17 nt, Homo sapiens
ugcucagcaggauggca

SEQ ID NO: 6805 - RNA, 17 nt, Homo sapiens
aggauggcaaagacuac

SEQ ID NO: 6806 - RNA, 17 nt, Homo sapiens
gcaaagacuacauuguu

SEQ ID NO: 6807 - RNA, 17 nt, Homo sapiens
aagacuacauuguucuu

SEQ ID NO: 6808 - RNA, 17 nt, Homo sapiens
cauuguucuuccgauau

SEQ ID NO: 6809 - RNA, 17 nt, Homo sapiens
uguucuuccgauaucag

SEQ ID NO: 6810 - RNA, 17 nt, Homo sapiens
ccgauaucagagacuuu

SEQ ID NO: 6811 - RNA, 17 nt, Homo sapiens
ucagagacuuugagcau

SEQ ID NO: 6812 - RNA, 17 nt, Homo sapiens
cuuugagcauggaagag

SEQ ID NO: 6813 - RNA, 17 nt, Homo sapiens
gaggauucuggacucuc

SEQ ID NO: 6814 - RNA, 17 nt, Homo sapiens
uucuggacucucucugc

SEQ ID NO: 6815 - RNA, 17 nt, Homo sapiens
cuggacucucucugccu

SEQ ID NO: 6816 - RNA, 17 nt, Homo sapiens
ggacucucucugccuac

SEQ ID NO: 6817 - RNA, 17 nt, Homo sapiens
acucucucugccuaccu

SEQ ID NO: 6818 - RNA, 17 nt, Homo sapiens
cucucugccuaccucac

SEQ ID NO: 6819 - RNA, 17 nt, Homo sapiens
ucucugccuaccucacc

SEQ ID NO: 6820 - RNA, 17 nt, Homo sapiens
cugccuaccucaccugu

SEQ ID NO: 6821 - RNA, 17 nt, Homo sapiens
ugccuaccucaccuguu

SEQ ID NO: 6822 - RNA, 17 nt, Homo sapiens
ccuaccucaccuguuuc

SEQ ID NO: 6823 - RNA, 17 nt, Homo sapiens
uaccucaccuguuuccu

SEQ ID NO: 6824 - RNA, 17 nt, Homo sapiens
accucaccuguuuccug

SEQ ID NO: 6825 - RNA, 17 nt, Homo sapiens
ccuguuuccuguaugga

SEQ ID NO: 6826 - RNA, 17 nt, Homo sapiens
cuguuuccuguauggag

SEQ ID NO: 6827 - RNA, 17 nt, Homo sapiens
uaugugaccccaaauuc

SEQ ID NO: 6828 - RNA, 17 nt, Homo sapiens
augugaccccaaauucc

SEQ ID NO: 6829 - RNA, 17 nt, Homo sapiens
ugugaccccaaauucca

SEQ ID NO: 6830 - RNA, 17 nt, Homo sapiens
gugaccccaaauuccau

SEQ ID NO: 6831 - RNA, 17 nt, Homo sapiens
ccaaauuccauuaugac

SEQ ID NO: 6832 - RNA, 17 nt, Homo sapiens
caaauuccauuaugaca

SEQ ID NO: 6833 - RNA, 17 nt, Homo sapiens
auuaugacaacacagca

SEQ ID NO: 6834 - RNA, 17 nt, Homo sapiens
augacaacacagcagga

SEQ ID NO: 6835 - RNA, 17 nt, Homo sapiens
gacaacacagcaggaau

SEQ ID NO: 6836 - RNA, 17 nt, Homo sapiens
aacacagcaggaaucag

SEQ ID NO: 6837 - RNA, 17 nt, Homo sapiens
caggaaucagucaguau

SEQ ID NO: 6838 - RNA, 17 nt, Homo sapiens
aaucagucaguaucugc

SEQ ID NO: 6839 - RNA, 17 nt, Homo sapiens
ucaguaucugcagaaca

SEQ ID NO: 6840 - RNA, 17 nt, Homo sapiens
guaucugcagaacagua

SEQ ID NO: 6841 - RNA, 17 nt, Homo sapiens
ugcagaacaguaagcga

SEQ ID NO: 6842 - RNA, 17 nt, Homo sapiens
gaaagagccggccugug

SEQ ID NO: 6843 - RNA, 17 nt, Homo sapiens
gagccggccugugagug

SEQ ID NO: 6844 - RNA, 17 nt, Homo sapiens
agccggccugugagugu

SEQ ID NO: 6845 - RNA, 17 nt, Homo sapiens
guaaaaacauuugaaga

SEQ ID NO: 6846 - RNA, 17 nt, Homo sapiens
aagauaucccguuagaa

SEQ ID NO: 6847 - RNA, 17 nt, Homo sapiens
agauaucccguuagaag

SEQ ID NO: 6848 - RNA, 17 nt, Homo sapiens
agaagaaccagaaguaa

SEQ ID NO: 6849 - RNA, 17 nt, Homo sapiens
gaagaaccagaaguaaa

SEQ ID NO: 6850 - RNA, 17 nt, Homo sapiens
aaguaaucccagaugac

SEQ ID NO: 6851 - RNA, 17 nt, Homo sapiens
aguaaucccagaugaca

SEQ ID NO: 6852 - RNA, 17 nt, Homo sapiens
guaaucccagaugacaa

SEQ ID NO: 6853 - RNA, 17 nt, Homo sapiens
cagaugacaaccagacg

SEQ ID NO: 6854 - RNA, 17 nt, Homo sapiens
augacaaccagacggac

SEQ ID NO: 6855 - RNA, 17 nt, Homo sapiens
ugacaaccagacggaca

SEQ ID NO: 6856 - RNA, 17 nt, Homo sapiens
agacggacagugguaug

SEQ ID NO: 6857 - RNA, 17 nt, Homo sapiens
uaugguucuugccucag

SEQ ID NO: 6858 - RNA, 17 nt, Homo sapiens
guucuugccucagaaga

SEQ ID NO: 6859 - RNA, 17 nt, Homo sapiens
uucuugccucagaagag

SEQ ID NO: 6860 - RNA, 17 nt, Homo sapiens
cuugccucagaagagcu

SEQ ID NO: 6861 - RNA, 17 nt, Homo sapiens
agaagagcugaaaacuu

SEQ ID NO: 6862 - RNA, 17 nt, Homo sapiens
cugaaaacuuuggaaga

SEQ ID NO: 6863 - RNA, 17 nt, Homo sapiens
uggaagacagaaccaaa

SEQ ID NO: 6864 - RNA, 17 nt, Homo sapiens
gacagaaccaaauuauc

SEQ ID NO: 6865 - RNA, 17 nt, Homo sapiens
acagaaccaaauuaucu

SEQ ID NO: 6866 - RNA, 17 nt, Homo sapiens
aaauuaucuccaucuuu

SEQ ID NO: 6867 - RNA, 17 nt, Homo sapiens
auuaucuccaucuuuug

SEQ ID NO: 6868 - RNA, 17 nt, Homo sapiens
uuaucuccaucuuuugg

SEQ ID NO: 6869 - RNA, 17 nt, Homo sapiens
ucuccaucuuuuggugg

SEQ ID NO: 6870 - RNA, 17 nt, Homo sapiens
aauggugcccagcaaaa

SEQ ID NO: 6871 - RNA, 17 nt, Homo sapiens
auggugcccagcaaaag

SEQ ID NO: 6872 - RNA, 17 nt, Homo sapiens
uggugcccagcaaaagc

SEQ ID NO: 6873 - RNA, 17 nt, Homo sapiens
ugcccagcaaaagcagg

SEQ ID NO: 6874 - RNA, 17 nt, Homo sapiens
gcaaaagcagggagucu

SEQ ID NO: 6875 - RNA, 17 nt, Homo sapiens
agggagucuguggcauc

SEQ ID NO: 6876 - RNA, 17 nt, Homo sapiens
ucuguggcaucugaagg

SEQ ID NO: 6877 - RNA, 17 nt, Homo sapiens
guggcaucugaaggcuc

SEQ ID NO: 6878 - RNA, 17 nt, Homo sapiens
cugaaggcucaaaccag

SEQ ID NO: 6879 - RNA, 17 nt, Homo sapiens
gaaggcucaaaccagac

SEQ ID NO: 6880 - RNA, 17 nt, Homo sapiens
gcucaaaccagacaagc

SEQ ID NO: 6881 - RNA, 17 nt, Homo sapiens
cucaaaccagacaagcg

SEQ ID NO: 6882 - RNA, 17 nt, Homo sapiens
aaccagacaagcggcua

SEQ ID NO: 6883 - RNA, 17 nt, Homo sapiens
caagcggcuaccagucc

SEQ ID NO: 6884 - RNA, 17 nt, Homo sapiens
gcggcuaccaguccgga

SEQ ID NO: 6885 - RNA, 17 nt, Homo sapiens
cggcuaccaguccggau

SEQ ID NO: 6886 - RNA, 17 nt, Homo sapiens
uaccaguccggauauca

SEQ ID NO: 6887 - RNA, 17 nt, Homo sapiens
cggauaucacuccgaug

SEQ ID NO: 6888 - RNA, 17 nt, Homo sapiens
gauaucacuccgaugac

SEQ ID NO: 6889 - RNA, 17 nt, Homo sapiens
uaucacuccgaugacac

SEQ ID NO: 6890 - RNA, 17 nt, Homo sapiens
ccgaugacacagacacc

SEQ ID NO: 6891 - RNA, 17 nt, Homo sapiens
gaugacacagacaccac

SEQ ID NO: 6892 - RNA, 17 nt, Homo sapiens
acacagacaccaccgug

SEQ ID NO: 6893 - RNA, 17 nt, Homo sapiens
acagacaccaccgugua

SEQ ID NO: 6894 - RNA, 17 nt, Homo sapiens
cagacaccaccguguac

SEQ ID NO: 6895 - RNA, 17 nt, Homo sapiens
gacaccaccguguacuc

SEQ ID NO: 6896 - RNA, 17 nt, Homo sapiens
ccguguacuccagugag

SEQ ID NO: 6897 - RNA, 17 nt, Homo sapiens
guguacuccagugagga

SEQ ID NO: 6898 - RNA, 17 nt, Homo sapiens
uguacuccagugaggaa

SEQ ID NO: 6899 - RNA, 17 nt, Homo sapiens
gaggaagcagaacuuuu

SEQ ID NO: 6900 - RNA, 17 nt, Homo sapiens
agcagaacuuuuaaagc

SEQ ID NO: 6901 - RNA, 17 nt, Homo sapiens
uuuaaagcugauagaga

SEQ ID NO: 6902 - RNA, 17 nt, Homo sapiens
uggagugcaaaccggua

SEQ ID NO: 6903 - RNA, 17 nt, Homo sapiens
gugcaaaccgguagcac

SEQ ID NO: 6904 - RNA, 17 nt, Homo sapiens
ccgguagcacagcccag

SEQ ID NO: 6905 - RNA, 17 nt, Homo sapiens
gguagcacagcccagau

SEQ ID NO: 6906 - RNA, 17 nt, Homo sapiens
agcacagcccagauucu

SEQ ID NO: 6907 - RNA, 17 nt, Homo sapiens
gcacagcccagauucuc

SEQ ID NO: 6908 - RNA, 17 nt, Homo sapiens
cacagcccagauucucc

SEQ ID NO: 6909 - RNA, 17 nt, Homo sapiens
ccagauucuccagccug

SEQ ID NO: 6910 - RNA, 17 nt, Homo sapiens
agauucuccagccugac

SEQ ID NO: 6911 - RNA, 17 nt, Homo sapiens
gauucuccagccugaca

SEQ ID NO: 6912 - RNA, 17 nt, Homo sapiens
ucuccagccugacacgg

SEQ ID NO: 6913 - RNA, 17 nt, Homo sapiens
cuccagccugacacggg

SEQ ID NO: 6914 - RNA, 17 nt, Homo sapiens
agccugacacggggacc

SEQ ID NO: 6915 - RNA, 17 nt, Homo sapiens
acggggaccacacugag

SEQ ID NO: 6916 - RNA, 17 nt, Homo sapiens
cggggaccacacugagc

SEQ ID NO: 6917 - RNA, 17 nt, Homo sapiens
gggaccacacugagcuc

SEQ ID NO: 6918 - RNA, 17 nt, Homo sapiens
gaccacacugagcucuc

SEQ ID NO: 6919 - RNA, 17 nt, Homo sapiens
cacugagcucuccuccu

SEQ ID NO: 6920 - RNA, 17 nt, Homo sapiens
cugagcucuccuccugu

SEQ ID NO: 6921 - RNA, 17 nt, Homo sapiens
gagcucuccuccuguuu

SEQ ID NO: 6922 - RNA, 17 nt, Homo sapiens
agcucuccuccuguuua

SEQ ID NO: 6923 - RNA, 17 nt, Homo sapiens
cucuccuccuguuuaaa

SEQ ID NO: 6924 - RNA, 17 nt, Homo sapiens
ucuccuccuguuuaaaa

SEQ ID NO: 6925 - RNA, 17 nt, Homo sapiens
aaggaagcauccacacc

SEQ ID NO: 6926 - RNA, 17 nt, Homo sapiens
gaagcauccacacccca

SEQ ID NO: 6927 - RNA, 17 nt, Homo sapiens
aagcauccacaccccaa

SEQ ID NO: 6928 - RNA, 17 nt, Homo sapiens
gcauccacaccccaacu

SEQ ID NO: 6929 - RNA, 17 nt, Homo sapiens
auccacaccccaacucc

SEQ ID NO: 6930 - RNA, 17 nt, Homo sapiens
uccacaccccaacuccc

SEQ ID NO: 6931 - RNA, 17 nt, Homo sapiens
ccacaccccaacucccg

SEQ ID NO: 6932 - RNA, 17 nt, Homo sapiens
cacaccccaacucccgg

SEQ ID NO: 6933 - RNA, 17 nt, Homo sapiens
accccaacucccggaca

SEQ ID NO: 6934 - RNA, 17 nt, Homo sapiens
cccaacucccggacauc

SEQ ID NO: 6935 - RNA, 17 nt, Homo sapiens
ccaacucccggacauca

SEQ ID NO: 6936 - RNA, 17 nt, Homo sapiens
ucccggacaucacauga

SEQ ID NO: 6937 - RNA, 17 nt, Homo sapiens
cggacaucacaugagag

SEQ ID NO: 6938 - RNA, 17 nt, Homo sapiens
gacaucacaugagaggu

SEQ ID NO: 6939 - RNA, 17 nt, Homo sapiens
gagaggucugcucagau

SEQ ID NO: 6940 - RNA, 17 nt, Homo sapiens
aggucugcucagauuuu

SEQ ID NO: 6941 - RNA, 17 nt, Homo sapiens
gucugcucagauuuuga

SEQ ID NO: 6942 - RNA, 17 nt, Homo sapiens
uguuguucuuuccacca

SEQ ID NO: 6943 - RNA, 17 nt, Homo sapiens
guucuuuccaccagcag

SEQ ID NO: 6944 - RNA, 17 nt, Homo sapiens
uucuuuccaccagcagg

SEQ ID NO: 6945 - RNA, 17 nt, Homo sapiens
cuuuccaccagcaggaa

SEQ ID NO: 6946 - RNA, 17 nt, Homo sapiens
uuuccaccagcaggaag

SEQ ID NO: 6947 - RNA, 17 nt, Homo sapiens
ccaccagcaggaaguag

SEQ ID NO: 6948 - RNA, 17 nt, Homo sapiens
gaaguagccgcauuuga

SEQ ID NO: 6949 - RNA, 17 nt, Homo sapiens
guagccgcauuugauuu

SEQ ID NO: 6950 - RNA, 17 nt, Homo sapiens
ugauuuucauuucgaca

SEQ ID NO: 6951 - RNA, 17 nt, Homo sapiens
auuucgacaacagaaaa

SEQ ID NO: 6952 - RNA, 17 nt, Homo sapiens
ucgacaacagaaaaagg

SEQ ID NO: 6953 - RNA, 17 nt, Homo sapiens
aaaaggaccucggacug

SEQ ID NO: 6954 - RNA, 17 nt, Homo sapiens
aaaggaccucggacugc

SEQ ID NO: 6955 - RNA, 17 nt, Homo sapiens
ccucggacugcagggag

SEQ ID NO: 6956 - RNA, 17 nt, Homo sapiens
cggacugcagggagcca

SEQ ID NO: 6957 - RNA, 17 nt, Homo sapiens
cagggagccagcucuuc

SEQ ID NO: 6958 - RNA, 17 nt, Homo sapiens
agggagccagcucuucu

SEQ ID NO: 6959 - RNA, 17 nt, Homo sapiens
gagccagcucuucuagg

SEQ ID NO: 6960 - RNA, 17 nt, Homo sapiens
gccagcucuucuaggcu

SEQ ID NO: 6961 - RNA, 17 nt, Homo sapiens
agcucuucuaggcuugu

SEQ ID NO: 6962 - RNA, 16 nt, Homo sapiens
gcaaggugcugcuggc

SEQ ID NO: 6963 - RNA, 16 nt, Homo sapiens
gcuggccgucgcccug

SEQ ID NO: 6964 - RNA, 16 nt, Homo sapiens
cuguggcucugcgugg

SEQ ID NO: 6965 - RNA, 16 nt, Homo sapiens
gacccgggccgccucu

SEQ ID NO: 6966 - RNA, 16 nt, Homo sapiens
cuguggguuugccuag

SEQ ID NO: 6967 - RNA, 16 nt, Homo sapiens
uguuucucuugaucug

SEQ ID NO: 6968 - RNA, 16 nt, Homo sapiens
cucuugaucugcccag

SEQ ID NO: 6969 - RNA, 16 nt, Homo sapiens
caaauuacuugcaggg

SEQ ID NO: 6970 - RNA, 16 nt, Homo sapiens
gaguggcagugagcaa

SEQ ID NO: 6971 - RNA, 16 nt, Homo sapiens
ggguggaggugacuga

SEQ ID NO: 6972 - RNA, 16 nt, Homo sapiens
ggaggugacugagugc

SEQ ID NO: 6973 - RNA, 16 nt, Homo sapiens
gugacugagugcagcg

SEQ ID NO: 6974 - RNA, 16 nt, Homo sapiens
ugagugcagcgauggc

SEQ ID NO: 6975 - RNA, 16 nt, Homo sapiens
uuccaaaagugaucgg

SEQ ID NO: 6976 - RNA, 16 nt, Homo sapiens
gaucggaaaugacacu

SEQ ID NO: 6977 - RNA, 16 nt, Homo sapiens
gccuacaagugcuucu

SEQ ID NO: 6978 - RNA, 16 nt, Homo sapiens
ccgggaaacugacuug

SEQ ID NO: 6979 - RNA, 16 nt, Homo sapiens
uccauuuauugcuucu

SEQ ID NO: 6980 - RNA, 16 nt, Homo sapiens
uucuguuagugaccaa

SEQ ID NO: 6981 - RNA, 16 nt, Homo sapiens
guacauuacugagaac

SEQ ID NO: 6982 - RNA, 16 nt, Homo sapiens
aaacuguggugauucc

SEQ ID NO: 6983 - RNA, 16 nt, Homo sapiens
gucacuuugugcaaga

SEQ ID NO: 6984 - RNA, 16 nt, Homo sapiens
auuuguuccugauggu

SEQ ID NO: 6985 - RNA, 16 nt, Homo sapiens
ccagcuacaugaucag

SEQ ID NO: 6986 - RNA, 16 nt, Homo sapiens
gaucagcuaugcuggc

SEQ ID NO: 6987 - RNA, 16 nt, Homo sapiens
ggucuucugugaagca

SEQ ID NO: 6988 - RNA, 16 nt, Homo sapiens
aaaaauuaaugaugaa

SEQ ID NO: 6989 - RNA, 16 nt, Homo sapiens
aauuaaugaugaaagu

SEQ ID NO: 6990 - RNA, 16 nt, Homo sapiens
uaggauuuaugaugug

SEQ ID NO: 6991 - RNA, 16 nt, Homo sapiens
augugguucugagucc

SEQ ID NO: 6992 - RNA, 16 nt, Homo sapiens
ucauggaauugaacua

SEQ ID NO: 6993 - RNA, 16 nt, Homo sapiens
agcaagaacugaacua

SEQ ID NO: 6994 - RNA, 16 nt, Homo sapiens
uguggggauugacuuc

SEQ ID NO: 6995 - RNA, 16 nt, Homo sapiens
acccuucuucgaagca

SEQ ID NO: 6996 - RNA, 16 nt, Homo sapiens
cuuguaaaccgagacc

SEQ ID NO: 6997 - RNA, 16 nt, Homo sapiens
gucugggagugagaug

SEQ ID NO: 6998 - RNA, 16 nt, Homo sapiens
ggagugagaugaagaa

SEQ ID NO: 6999 - RNA, 16 nt, Homo sapiens
agaaauuuuugagcac

SEQ ID NO: 7000 - RNA, 16 nt, Homo sapiens
aacccggagugaccaa

SEQ ID NO: 7001 - RNA, 16 nt, Homo sapiens
guacaccugugcagca

SEQ ID NO: 7002 - RNA, 16 nt, Homo sapiens
ccagugggcugaugac

SEQ ID NO: 7003 - RNA, 16 nt, Homo sapiens
gugggcugaugaccaa

SEQ ID NO: 7004 - RNA, 16 nt, Homo sapiens
caggguccaugaaaaa

SEQ ID NO: 7005 - RNA, 16 nt, Homo sapiens
accuuuuguugcuuuu

SEQ ID NO: 7006 - RNA, 16 nt, Homo sapiens
cagaaucccugcgaag

SEQ ID NO: 7007 - RNA, 16 nt, Homo sapiens
gaaucccugcgaagua

SEQ ID NO: 7008 - RNA, 16 nt, Homo sapiens
aauaccccuugagucc

SEQ ID NO: 7009 - RNA, 16 nt, Homo sapiens
ggcauguacugacgau

SEQ ID NO: 7010 - RNA, 16 nt, Homo sapiens
auguacugacgauuau

SEQ ID NO: 7011 - RNA, 16 nt, Homo sapiens
uuauggaagugaguga

SEQ ID NO: 7012 - RNA, 16 nt, Homo sapiens
ggaagugagugaaaga

SEQ ID NO: 7013 - RNA, 16 nt, Homo sapiens
ccagauuggugagaaa

SEQ ID NO: 7014 - RNA, 16 nt, Homo sapiens
ccacucaaacgcugac

SEQ ID NO: 7015 - RNA, 16 nt, Homo sapiens
cucaaacgcugacaug

SEQ ID NO: 7016 - RNA, 16 nt, Homo sapiens
uacggucuaugccauu

SEQ ID NO: 7017 - RNA, 16 nt, Homo sapiens
uuccucccccgcauca

SEQ ID NO: 7018 - RNA, 16 nt, Homo sapiens
gaggaagagugcgcca

SEQ ID NO: 7019 - RNA, 16 nt, Homo sapiens
ggaagagugcgccaac

SEQ ID NO: 7020 - RNA, 16 nt, Homo sapiens
gugcgccaacgagccc

SEQ ID NO: 7021 - RNA, 16 nt, Homo sapiens
cugucucagugacaaa

SEQ ID NO: 7022 - RNA, 16 nt, Homo sapiens
auacccuugugaagaa

SEQ ID NO: 7023 - RNA, 16 nt, Homo sapiens
aaauaaaauugaaguu

SEQ ID NO: 7024 - RNA, 16 nt, Homo sapiens
aaaucaauuugcucua

SEQ ID NO: 7025 - RNA, 16 nt, Homo sapiens
ugcucuaauugaagga

SEQ ID NO: 7026 - RNA, 16 nt, Homo sapiens
guacaaaugugaagcg

SEQ ID NO: 7027 - RNA, 16 nt, Homo sapiens
gagagagggugaucuc

SEQ ID NO: 7028 - RNA, 16 nt, Homo sapiens
ccuuccacgugaccag

SEQ ID NO: 7029 - RNA, 16 nt, Homo sapiens
cagggguccugaaauu

SEQ ID NO: 7030 - RNA, 16 nt, Homo sapiens
aaauuacuuugcaacc

SEQ ID NO: 7031 - RNA, 16 nt, Homo sapiens
uuugcaaccugacaug

SEQ ID NO: 7032 - RNA, 16 nt, Homo sapiens
aaccugacaugcagcc

SEQ ID NO: 7033 - RNA, 16 nt, Homo sapiens
gcagcccacugagcag

SEQ ID NO: 7034 - RNA, 16 nt, Homo sapiens
ucuuuguggugcacug

SEQ ID NO: 7035 - RNA, 16 nt, Homo sapiens
guggugcacugcagac

SEQ ID NO: 7036 - RNA, 16 nt, Homo sapiens
aucuacguuugagaac

SEQ ID NO: 7037 - RNA, 16 nt, Homo sapiens
cacagccucugccaau

SEQ ID NO: 7038 - RNA, 16 nt, Homo sapiens
ugggagaguugcccac

SEQ ID NO: 7039 - RNA, 16 nt, Homo sapiens
acaccuguuugcaaga

SEQ ID NO: 7040 - RNA, 16 nt, Homo sapiens
uuuggaaauugaaugc

SEQ ID NO: 7041 - RNA, 16 nt, Homo sapiens
gaaauugaaugccacc

SEQ ID NO: 7042 - RNA, 16 nt, Homo sapiens
uagcacaaaugacauu

SEQ ID NO: 7043 - RNA, 16 nt, Homo sapiens
augacauuuugaucau

SEQ ID NO: 7044 - RNA, 16 nt, Homo sapiens
gcuuaagaaugcaucc

SEQ ID NO: 7045 - RNA, 16 nt, Homo sapiens
augcauccuugcagga

SEQ ID NO: 7046 - RNA, 16 nt, Homo sapiens
gacuaugucugccuug

SEQ ID NO: 7047 - RNA, 16 nt, Homo sapiens
ugucugccuugcucaa

SEQ ID NO: 7048 - RNA, 16 nt, Homo sapiens
aaaagacauugcgugg

SEQ ID NO: 7049 - RNA, 16 nt, Homo sapiens
uggcacccacgaucac

SEQ ID NO: 7050 - RNA, 16 nt, Homo sapiens
agaaucagacgacaag

SEQ ID NO: 7051 - RNA, 16 nt, Homo sapiens
ggaaagcaucgaaguc

SEQ ID NO: 7052 - RNA, 16 nt, Homo sapiens
gaagucucaugcacgg

SEQ ID NO: 7053 - RNA, 16 nt, Homo sapiens
uaaagauaaugagacc

SEQ ID NO: 7054 - RNA, 16 nt, Homo sapiens
gcauuguauugaagga

SEQ ID NO: 7055 - RNA, 16 nt, Homo sapiens
cucacuauccgcagag

SEQ ID NO: 7056 - RNA, 16 nt, Homo sapiens
uccgcagagugaggaa

SEQ ID NO: 7057 - RNA, 16 nt, Homo sapiens
gaaggaggacgaaggc

SEQ ID NO: 7058 - RNA, 16 nt, Homo sapiens
cucuacaccugccagg

SEQ ID NO: 7059 - RNA, 16 nt, Homo sapiens
ugccaggcaugcagug

SEQ ID NO: 7060 - RNA, 16 nt, Homo sapiens
ucuuggcugugcaaaa

SEQ ID NO: 7061 - RNA, 16 nt, Homo sapiens
aauagaaggugcccag

SEQ ID NO: 7062 - RNA, 16 nt, Homo sapiens
aggaaaagacgaacuu

SEQ ID NO: 7063 - RNA, 16 nt, Homo sapiens
uaguaggcacgacggu

SEQ ID NO: 7064 - RNA, 16 nt, Homo sapiens
gcacgacggugauugc

SEQ ID NO: 7065 - RNA, 16 nt, Homo sapiens
gacggugauugccaug

SEQ ID NO: 7066 - RNA, 16 nt, Homo sapiens
gaggggaacugaagac

SEQ ID NO: 7067 - RNA, 16 nt, Homo sapiens
ggauccagaugaacuc

SEQ ID NO: 7068 - RNA, 16 nt, Homo sapiens
cccauuggaugaacau

SEQ ID NO: 7069 - RNA, 16 nt, Homo sapiens
ugaacauugugaacga

SEQ ID NO: 7070 - RNA, 16 nt, Homo sapiens
cauugugaacgacugc

SEQ ID NO: 7071 - RNA, 16 nt, Homo sapiens
gugaacgacugccuua

SEQ ID NO: 7072 - RNA, 16 nt, Homo sapiens
acugccuuaugaugcc

SEQ ID NO: 7073 - RNA, 16 nt, Homo sapiens
gccuuaugaugccagc

SEQ ID NO: 7074 - RNA, 16 nt, Homo sapiens
gagaccggcugaaccu

SEQ ID NO: 7075 - RNA, 16 nt, Homo sapiens
uggccguggugccuuu

SEQ ID NO: 7076 - RNA, 16 nt, Homo sapiens
ccaagagauugaagca

SEQ ID NO: 7077 - RNA, 16 nt, Homo sapiens
ugaagcagaugccuuu

SEQ ID NO: 7078 - RNA, 16 nt, Homo sapiens
cuuuggaauugacaag

SEQ ID NO: 7079 - RNA, 16 nt, Homo sapiens
acagcaacuugcagga

SEQ ID NO: 7080 - RNA, 16 nt, Homo sapiens
ucaaaauguugaaaga

SEQ ID NO: 7081 - RNA, 16 nt, Homo sapiens
aacacacagugagcau

SEQ ID NO: 7082 - RNA, 16 nt, Homo sapiens
agugagcaucgagcuc

SEQ ID NO: 7083 - RNA, 16 nt, Homo sapiens
ucucaugucugaacuc

SEQ ID NO: 7084 - RNA, 16 nt, Homo sapiens
ccuucuaggugccugu

SEQ ID NO: 7085 - RNA, 16 nt, Homo sapiens
cacucauggugauugu

SEQ ID NO: 7086 - RNA, 16 nt, Homo sapiens
guggaauucugcaaau

SEQ ID NO: 7087 - RNA, 16 nt, Homo sapiens
ccacuuaccugaggag

SEQ ID NO: 7088 - RNA, 16 nt, Homo sapiens
caagagaaaugaauuu

SEQ ID NO: 7089 - RNA, 16 nt, Homo sapiens
aaaggggcacgauucc

SEQ ID NO: 7090 - RNA, 16 nt, Homo sapiens
cuguggaucugaaacg

SEQ ID NO: 7091 - RNA, 16 nt, Homo sapiens
cugaaacggcgcuugg

SEQ ID NO: 7092 - RNA, 16 nt, Homo sapiens
gucccucagugaugua

SEQ ID NO: 7093 - RNA, 16 nt, Homo sapiens
ggaagcuccugaagau

SEQ ID NO: 7094 - RNA, 16 nt, Homo sapiens
aggacuuccugaccuu

SEQ ID NO: 7095 - RNA, 16 nt, Homo sapiens
ucuuggcaucgcgaaa

SEQ ID NO: 7096 - RNA, 16 nt, Homo sapiens
uuggcaucgcgaaagu

SEQ ID NO: 7097 - RNA, 16 nt, Homo sapiens
cuggcggcacgaaaua

SEQ ID NO: 7098 - RNA, 16 nt, Homo sapiens
uaaaaucugugacuuu

SEQ ID NO: 7099 - RNA, 16 nt, Homo sapiens
aaaaggagaugcucgc

SEQ ID NO: 7100 - RNA, 16 nt, Homo sapiens
ggagaugcucgccucc

SEQ ID NO: 7101 - RNA, 16 nt, Homo sapiens
gccucccuuugaaaug

SEQ ID NO: 7102 - RNA, 16 nt, Homo sapiens
aacaauuuuugacaga

SEQ ID NO: 7103 - RNA, 16 nt, Homo sapiens
aauccagagugacguc

SEQ ID NO: 7104 - RNA, 16 nt, Homo sapiens
uugguguuuugcugug

SEQ ID NO: 7105 - RNA, 16 nt, Homo sapiens
uuccuuaggugcuucu

SEQ ID NO: 7106 - RNA, 16 nt, Homo sapiens
gguaaagauugaugaa

SEQ ID NO: 7107 - RNA, 16 nt, Homo sapiens
aaagauugaugaagaa

SEQ ID NO: 7108 - RNA, 16 nt, Homo sapiens
uuuuguaggcgauuga

SEQ ID NO: 7109 - RNA, 16 nt, Homo sapiens
guaggcgauugaaaga

SEQ ID NO: 7110 - RNA, 16 nt, Homo sapiens
gaacuagaaugagggc

SEQ ID NO: 7111 - RNA, 16 nt, Homo sapiens
gagggccccugauuau

SEQ ID NO: 7112 - RNA, 16 nt, Homo sapiens
accagaccaugcugga

SEQ ID NO: 7113 - RNA, 16 nt, Homo sapiens
gaaaucucuugcaagc

SEQ ID NO: 7114 - RNA, 16 nt, Homo sapiens
gcaagcuaaugcucag

SEQ ID NO: 7115 - RNA, 16 nt, Homo sapiens
uuguucuuccgauauc

SEQ ID NO: 7116 - RNA, 16 nt, Homo sapiens
cagagacuuugagcau

SEQ ID NO: 7117 - RNA, 16 nt, Homo sapiens
gacucucucugccuac

SEQ ID NO: 7118 - RNA, 16 nt, Homo sapiens
ggaaguaugugacccc

SEQ ID NO: 7119 - RNA, 16 nt, Homo sapiens
auuccauuaugacaac

SEQ ID NO: 7120 - RNA, 16 nt, Homo sapiens
gucaguaucugcagaa

SEQ ID NO: 7121 - RNA, 16 nt, Homo sapiens
aacaguaagcgaaaga

SEQ ID NO: 7122 - RNA, 16 nt, Homo sapiens
gccggccugugagugu

SEQ ID NO: 7123 - RNA, 16 nt, Homo sapiens
aaaaacauuugaagau

SEQ ID NO: 7124 - RNA, 16 nt, Homo sapiens
aaucccagaugacaac

SEQ ID NO: 7125 - RNA, 16 nt, Homo sapiens
uaugguucuugccuca

SEQ ID NO: 7126 - RNA, 16 nt, Homo sapiens
cagaagagcugaaaac

SEQ ID NO: 7127 - RNA, 16 nt, Homo sapiens
guggaauggugcccag

SEQ ID NO: 7128 - RNA, 16 nt, Homo sapiens
uguggcaucugaaggc

SEQ ID NO: 7129 - RNA, 16 nt, Homo sapiens
auaucacuccgaugac

SEQ ID NO: 7130 - RNA, 16 nt, Homo sapiens
ucacuccgaugacaca

SEQ ID NO: 7131 - RNA, 16 nt, Homo sapiens
guacuccagugaggaa

SEQ ID NO: 7132 - RNA, 16 nt, Homo sapiens
uuuuaaagcugauaga

SEQ ID NO: 7133 - RNA, 16 nt, Homo sapiens
agauuggagugcaaac

SEQ ID NO: 7134 - RNA, 16 nt, Homo sapiens
ucuccagccugacacg

SEQ ID NO: 7135 - RNA, 16 nt, Homo sapiens
ggaccacacugagcuc

SEQ ID NO: 7136 - RNA, 16 nt, Homo sapiens
gacaucacaugagagg

SEQ ID NO: 7137 - RNA, 16 nt, Homo sapiens
ugagaggucugcucag

SEQ ID NO: 7138 - RNA, 16 nt, Homo sapiens
cucagauuuugaagug

SEQ ID NO: 7139 - RNA, 16 nt, Homo sapiens
ggaaguagccgcauuu

SEQ ID NO: 7140 - RNA, 16 nt, Homo sapiens
agccgcauuugauuuu

SEQ ID NO: 7141 - RNA, 16 nt, Homo sapiens
uuuucauuucgacaac

SEQ ID NO: 7142 - RNA, 16 nt, Homo sapiens
accucggacugcaggg

SEQ ID NO: 7143 - RNA, 17 nt, Homo sapiens
uccucucggcuccuccc

SEQ ID NO: 7144 - RNA, 17 nt, Homo sapiens
ccuccccggcagcggcg

SEQ ID NO: 7145 - RNA, 17 nt, Homo sapiens
ccccggcagcggcggcg

SEQ ID NO: 7146 - RNA, 17 nt, Homo sapiens
cggcagcggcggcggcu

SEQ ID NO: 7147 - RNA, 17 nt, Homo sapiens
cagcggcggcggcucgg

SEQ ID NO: 7148 - RNA, 17 nt, Homo sapiens
cggcggcggcucggagc

SEQ ID NO: 7149 - RNA, 17 nt, Homo sapiens
ggcucggagcgggcucc

SEQ ID NO: 7150 - RNA, 17 nt, Homo sapiens
cggagcgggcuccgggg

SEQ ID NO: 7151 - RNA, 17 nt, Homo sapiens
gcuccggggcucgggug

SEQ ID NO: 7152 - RNA, 17 nt, Homo sapiens
gggcucgggugcagcgg

SEQ ID NO: 7153 - RNA, 17 nt, Homo sapiens
gcucgggugcagcggcc

SEQ ID NO: 7154 - RNA, 17 nt, Homo sapiens
cgggugcagcggccagc

SEQ ID NO: 7155 - RNA, 17 nt, Homo sapiens
gugcagcggccagcggg

SEQ ID NO: 7156 - RNA, 17 nt, Homo sapiens
agcggccagcgggccug

SEQ ID NO: 7157 - RNA, 17 nt, Homo sapiens
gccagcgggccuggcgg

SEQ ID NO: 7158 - RNA, 17 nt, Homo sapiens
cgggccuggcggcgagg

SEQ ID NO: 7159 - RNA, 17 nt, Homo sapiens
gccuggcggcgaggauu

SEQ ID NO: 7160 - RNA, 17 nt, Homo sapiens
cggcgaggauuacccgg

SEQ ID NO: 7161 - RNA, 17 nt, Homo sapiens
ccggggaagugguuguc

SEQ ID NO: 7162 - RNA, 17 nt, Homo sapiens
gggaagugguugucucc

SEQ ID NO: 7163 - RNA, 17 nt, Homo sapiens
aagugguugucuccugg

SEQ ID NO: 7164 - RNA, 17 nt, Homo sapiens
gucuccuggcuggagcc

SEQ ID NO: 7165 - RNA, 17 nt, Homo sapiens
uggcuggagccgcgaga

SEQ ID NO: 7166 - RNA, 17 nt, Homo sapiens
cuggagccgcgagacgg

SEQ ID NO: 7167 - RNA, 17 nt, Homo sapiens
gccgcgagacgggcgcu

SEQ ID NO: 7168 - RNA, 17 nt, Homo sapiens
cgagacgggcgcucagg

SEQ ID NO: 7169 - RNA, 17 nt, Homo sapiens
agacgggcgcucagggc

SEQ ID NO: 7170 - RNA, 17 nt, Homo sapiens
cgcucagggcgcggggc

SEQ ID NO: 7171 - RNA, 17 nt, Homo sapiens
cucagggcgcggggccg

SEQ ID NO: 7172 - RNA, 17 nt, Homo sapiens
ggcgcggggccggcggc

SEQ ID NO: 7173 - RNA, 17 nt, Homo sapiens
cggggccggcggcggcg

SEQ ID NO: 7174 - RNA, 17 nt, Homo sapiens
ggccggcggcggcgaac

SEQ ID NO: 7175 - RNA, 17 nt, Homo sapiens
cggcggcggcgaacgag

SEQ ID NO: 7176 - RNA, 17 nt, Homo sapiens
ggcggcgaacgagagga

SEQ ID NO: 7177 - RNA, 17 nt, Homo sapiens
acgagaggacggacucu

SEQ ID NO: 7178 - RNA, 17 nt, Homo sapiens
gaggacggacucuggcg

SEQ ID NO: 7179 - RNA, 17 nt, Homo sapiens
ggacucuggcggccggg

SEQ ID NO: 7180 - RNA, 17 nt, Homo sapiens
cucuggcggccgggucg

SEQ ID NO: 7181 - RNA, 17 nt, Homo sapiens
gcggccgggucguuggc

SEQ ID NO: 7182 - RNA, 17 nt, Homo sapiens
gccgggucguuggccgg

SEQ ID NO: 7183 - RNA, 17 nt, Homo sapiens
ggucguuggccggggga

SEQ ID NO: 7184 - RNA, 17 nt, Homo sapiens
ccgggggagcgcgggca

SEQ ID NO: 7185 - RNA, 17 nt, Homo sapiens
gggggagcgcgggcacc

SEQ ID NO: 7186 - RNA, 17 nt, Homo sapiens
gagcgcgggcaccgggc

SEQ ID NO: 7187 - RNA, 17 nt, Homo sapiens
ggcaccgggcgagcagg

SEQ ID NO: 7188 - RNA, 17 nt, Homo sapiens
ccgggcgagcaggccgc

SEQ ID NO: 7189 - RNA, 17 nt, Homo sapiens
gcgagcaggccgcgucg

SEQ ID NO: 7190 - RNA, 17 nt, Homo sapiens
agcaggccgcgucgcgc

SEQ ID NO: 7191 - RNA, 17 nt, Homo sapiens
caggccgcgucgcgcuc

SEQ ID NO: 7192 - RNA, 17 nt, Homo sapiens
gccgcgucgcgcucacc

SEQ ID NO: 7193 - RNA, 17 nt, Homo sapiens
cgcgucgcgcucaccau

SEQ ID NO: 7194 - RNA, 17 nt, Homo sapiens
ucaccauggucagcuac

SEQ ID NO: 7195 - RNA, 17 nt, Homo sapiens
cauggucagcuacuggg

SEQ ID NO: 7196 - RNA, 17 nt, Homo sapiens
cuacugggacaccgggg

SEQ ID NO: 7197 - RNA, 17 nt, Homo sapiens
acaccgggguccugcug

SEQ ID NO: 7198 - RNA, 17 nt, Homo sapiens
gggguccugcugugcgc

SEQ ID NO: 7199 - RNA, 17 nt, Homo sapiens
guccugcugugcgcgcu

SEQ ID NO: 7200 - RNA, 17 nt, Homo sapiens
ccugcugugcgcgcugc

SEQ ID NO: 7201 - RNA, 17 nt, Homo sapiens
ugcugugcgcgcugcuc

SEQ ID NO: 7202 - RNA, 17 nt, Homo sapiens
cugugcgcgcugcucag

SEQ ID NO: 7203 - RNA, 17 nt, Homo sapiens
ugcgcgcugcucagcug

SEQ ID NO: 7204 - RNA, 17 nt, Homo sapiens
gcugcucagcugucugc

SEQ ID NO: 7205 - RNA, 17 nt, Homo sapiens
gcucagcugucugcuuc

SEQ ID NO: 7206 - RNA, 17 nt, Homo sapiens
agcugucugcuucucac

SEQ ID NO: 7207 - RNA, 17 nt, Homo sapiens
cucacaggaucuaguuc

SEQ ID NO: 7208 - RNA, 17 nt, Homo sapiens
aggaucuaguucagguu

SEQ ID NO: 7209 - RNA, 17 nt, Homo sapiens
uaguucagguucaaaau

SEQ ID NO: 7210 - RNA, 17 nt, Homo sapiens
gguucaaaauuaaaaga

SEQ ID NO: 7211 - RNA, 17 nt, Homo sapiens
auuaaaagauccugaac

SEQ ID NO: 7212 - RNA, 17 nt, Homo sapiens
gauccugaacugaguuu

SEQ ID NO: 7213 - RNA, 17 nt, Homo sapiens
ugaacugaguuuaaaag

SEQ ID NO: 7214 - RNA, 17 nt, Homo sapiens
uuuaaaaggcacccagc

SEQ ID NO: 7215 - RNA, 17 nt, Homo sapiens
ggcacccagcacaucau

SEQ ID NO: 7216 - RNA, 17 nt, Homo sapiens
cacaucaugcaagcagg

SEQ ID NO: 7217 - RNA, 17 nt, Homo sapiens
ucaugcaagcaggccag

SEQ ID NO: 7218 - RNA, 17 nt, Homo sapiens
gcaagcaggccagacac

SEQ ID NO: 7219 - RNA, 17 nt, Homo sapiens
caggccagacacugcau

SEQ ID NO: 7220 - RNA, 17 nt, Homo sapiens
cagacacugcaucucca

SEQ ID NO: 7221 - RNA, 17 nt, Homo sapiens
caucuccaaugcagggg

SEQ ID NO: 7222 - RNA, 17 nt, Homo sapiens
ucuccaaugcagggggg

SEQ ID NO: 7223 - RNA, 17 nt, Homo sapiens
ggggggaagcagcccau

SEQ ID NO: 7224 - RNA, 17 nt, Homo sapiens
gggaagcagcccauaaa

SEQ ID NO: 7225 - RNA, 17 nt, Homo sapiens
gcccauaaauggucuuu

SEQ ID NO: 7226 - RNA, 17 nt, Homo sapiens
cauaaauggucuuugcc

SEQ ID NO: 7227 - RNA, 17 nt, Homo sapiens
uggucuuugccugaaau

SEQ ID NO: 7228 - RNA, 17 nt, Homo sapiens
ugccugaaauggugagu

SEQ ID NO: 7229 - RNA, 17 nt, Homo sapiens
cugaaauggugaguaag

SEQ ID NO: 7230 - RNA, 17 nt, Homo sapiens
aauggugaguaaggaaa

SEQ ID NO: 7231 - RNA, 17 nt, Homo sapiens
uaaggaaagcgaaaggc

SEQ ID NO: 7232 - RNA, 17 nt, Homo sapiens
agcgaaaggcugagcau

SEQ ID NO: 7233 - RNA, 17 nt, Homo sapiens
aaggcugagcauaacua

SEQ ID NO: 7234 - RNA, 17 nt, Homo sapiens
ugagcauaacuaaaucu

SEQ ID NO: 7235 - RNA, 17 nt, Homo sapiens
auaacuaaaucugccug

SEQ ID NO: 7236 - RNA, 17 nt, Homo sapiens
cuaaaucugccugugga

SEQ ID NO: 7237 - RNA, 17 nt, Homo sapiens
aucugccuguggaagaa

SEQ ID NO: 7238 - RNA, 17 nt, Homo sapiens
uggaagaaauggcaaac

SEQ ID NO: 7239 - RNA, 17 nt, Homo sapiens
aagaaauggcaaacaau

SEQ ID NO: 7240 - RNA, 17 nt, Homo sapiens
aauggcaaacaauucug

SEQ ID NO: 7241 - RNA, 17 nt, Homo sapiens
ggcaaacaauucugcag

SEQ ID NO: 7242 - RNA, 17 nt, Homo sapiens
acaauucugcaguacuu

SEQ ID NO: 7243 - RNA, 17 nt, Homo sapiens
auucugcaguacuuuaa

SEQ ID NO: 7244 - RNA, 17 nt, Homo sapiens
guacuuuaaccuugaac

SEQ ID NO: 7245 - RNA, 17 nt, Homo sapiens
aaccuugaacacagcuc

SEQ ID NO: 7246 - RNA, 17 nt, Homo sapiens
ugaacacagcucaagca

SEQ ID NO: 7247 - RNA, 17 nt, Homo sapiens
cagcucaagcaaaccac

SEQ ID NO: 7248 - RNA, 17 nt, Homo sapiens
ucaagcaaaccacacug

SEQ ID NO: 7249 - RNA, 17 nt, Homo sapiens
ccacacuggcuucuaca

SEQ ID NO: 7250 - RNA, 17 nt, Homo sapiens
cuucuacagcugcaaau

SEQ ID NO: 7251 - RNA, 17 nt, Homo sapiens
cuacagcugcaaauauc

SEQ ID NO: 7252 - RNA, 17 nt, Homo sapiens
agcugcaaauaucuagc

SEQ ID NO: 7253 - RNA, 17 nt, Homo sapiens
aauaucuagcuguaccu

SEQ ID NO: 7254 - RNA, 17 nt, Homo sapiens
aucuagcuguaccuacu

SEQ ID NO: 7255 - RNA, 17 nt, Homo sapiens
agaaggaaacagaaucu

SEQ ID NO: 7256 - RNA, 17 nt, Homo sapiens
gaaacagaaucugcaau

SEQ ID NO: 7257 - RNA, 17 nt, Homo sapiens
cagaaucugcaaucuau

SEQ ID NO: 7258 - RNA, 17 nt, Homo sapiens
aaucugcaaucuauaua

SEQ ID NO: 7259 - RNA, 17 nt, Homo sapiens
auuuauuagugauacag

SEQ ID NO: 7260 - RNA, 17 nt, Homo sapiens
uauuagugauacaggua

SEQ ID NO: 7261 - RNA, 17 nt, Homo sapiens
ugauacagguagaccuu

SEQ ID NO: 7262 - RNA, 17 nt, Homo sapiens
acagguagaccuuucgu

SEQ ID NO: 7263 - RNA, 17 nt, Homo sapiens
gaccuuucguagagaug

SEQ ID NO: 7264 - RNA, 17 nt, Homo sapiens
ucguagagauguacagu

SEQ ID NO: 7265 - RNA, 17 nt, Homo sapiens
guagagauguacaguga

SEQ ID NO: 7266 - RNA, 17 nt, Homo sapiens
gauguacagugaaaucc

SEQ ID NO: 7267 - RNA, 17 nt, Homo sapiens
acagugaaauccccgaa

SEQ ID NO: 7268 - RNA, 17 nt, Homo sapiens
uccccgaaauuauacac

SEQ ID NO: 7269 - RNA, 17 nt, Homo sapiens
uacacaugacugaagga

SEQ ID NO: 7270 - RNA, 17 nt, Homo sapiens
ggaagggagcucgucau

SEQ ID NO: 7271 - RNA, 17 nt, Homo sapiens
gggagcucgucauuccc

SEQ ID NO: 7272 - RNA, 17 nt, Homo sapiens
cauucccugccggguua

SEQ ID NO: 7273 - RNA, 17 nt, Homo sapiens
ccugccggguuacguca

SEQ ID NO: 7274 - RNA, 17 nt, Homo sapiens
cggguuacgucaccuaa

SEQ ID NO: 7275 - RNA, 17 nt, Homo sapiens
gucaccuaacaucacug

SEQ ID NO: 7276 - RNA, 17 nt, Homo sapiens
acaucacuguuacuuua

SEQ ID NO: 7277 - RNA, 17 nt, Homo sapiens
uuaaaaaaguuuccacu

SEQ ID NO: 7278 - RNA, 17 nt, Homo sapiens
uccacuugacacuuuga

SEQ ID NO: 7279 - RNA, 17 nt, Homo sapiens
acacuuugaucccugau

SEQ ID NO: 7280 - RNA, 17 nt, Homo sapiens
gaucccugauggaaaac

SEQ ID NO: 7281 - RNA, 17 nt, Homo sapiens
gauggaaaacgcauaau

SEQ ID NO: 7282 - RNA, 17 nt, Homo sapiens
uggaaaacgcauaaucu

SEQ ID NO: 7283 - RNA, 17 nt, Homo sapiens
aacgcauaaucugggac

SEQ ID NO: 7284 - RNA, 17 nt, Homo sapiens
aaucugggacaguagaa

SEQ ID NO: 7285 - RNA, 17 nt, Homo sapiens
cugggacaguagaaagg

SEQ ID NO: 7286 - RNA, 17 nt, Homo sapiens
uagaaagggcuucauca

SEQ ID NO: 7287 - RNA, 17 nt, Homo sapiens
cauaucaaaugcaacgu

SEQ ID NO: 7288 - RNA, 17 nt, Homo sapiens
uaucaaaugcaacguac

SEQ ID NO: 7289 - RNA, 17 nt, Homo sapiens
caaaugcaacguacaaa

SEQ ID NO: 7290 - RNA, 17 nt, Homo sapiens
aaugcaacguacaaaga

SEQ ID NO: 7291 - RNA, 17 nt, Homo sapiens
acaaagaaauagggcuu

SEQ ID NO: 7292 - RNA, 17 nt, Homo sapiens
gaaauagggcuucugac

SEQ ID NO: 7293 - RNA, 17 nt, Homo sapiens
ggcuucugaccugugaa

SEQ ID NO: 7294 - RNA, 17 nt, Homo sapiens
ucugaccugugaagcaa

SEQ ID NO: 7295 - RNA, 17 nt, Homo sapiens
ccugugaagcaacaguc

SEQ ID NO: 7296 - RNA, 17 nt, Homo sapiens
gugaagcaacagucaau

SEQ ID NO: 7297 - RNA, 17 nt, Homo sapiens
aagcaacagucaauggg

SEQ ID NO: 7298 - RNA, 17 nt, Homo sapiens
aacagucaaugggcauu

SEQ ID NO: 7299 - RNA, 17 nt, Homo sapiens
gucaaugggcauuugua

SEQ ID NO: 7300 - RNA, 17 nt, Homo sapiens
gggcauuuguauaagac

SEQ ID NO: 7301 - RNA, 17 nt, Homo sapiens
uguauaagacaaacuau

SEQ ID NO: 7302 - RNA, 17 nt, Homo sapiens
uaagacaaacuaucuca

SEQ ID NO: 7303 - RNA, 17 nt, Homo sapiens
acacaucgacaaaccaa

SEQ ID NO: 7304 - RNA, 17 nt, Homo sapiens
aucgacaaaccaauaca

SEQ ID NO: 7305 - RNA, 17 nt, Homo sapiens
acaaaccaauacaauca

SEQ ID NO: 7306 - RNA, 17 nt, Homo sapiens
ccaauacaaucauagau

SEQ ID NO: 7307 - RNA, 17 nt, Homo sapiens
aaucauagauguccaaa

SEQ ID NO: 7308 - RNA, 17 nt, Homo sapiens
ucauagauguccaaaua

SEQ ID NO: 7309 - RNA, 17 nt, Homo sapiens
auguccaaauaagcaca

SEQ ID NO: 7310 - RNA, 17 nt, Homo sapiens
ccaaauaagcacaccac

SEQ ID NO: 7311 - RNA, 17 nt, Homo sapiens
cacaccacgcccaguca

SEQ ID NO: 7312 - RNA, 17 nt, Homo sapiens
cacgcccagucaaauua

SEQ ID NO: 7313 - RNA, 17 nt, Homo sapiens
ccagucaaauuacuuag

SEQ ID NO: 7314 - RNA, 17 nt, Homo sapiens
acuuagaggccauacuc

SEQ ID NO: 7315 - RNA, 17 nt, Homo sapiens
auacucuuguccucaau

SEQ ID NO: 7316 - RNA, 17 nt, Homo sapiens
uguccucaauuguacug

SEQ ID NO: 7317 - RNA, 17 nt, Homo sapiens
ccucaauuguacugcua

SEQ ID NO: 7318 - RNA, 17 nt, Homo sapiens
auuguacugcuaccacu

SEQ ID NO: 7319 - RNA, 17 nt, Homo sapiens
ucccuugaacacgagag

SEQ ID NO: 7320 - RNA, 17 nt, Homo sapiens
acacgagaguucaaaug

SEQ ID NO: 7321 - RNA, 17 nt, Homo sapiens
gaguucaaaugaccugg

SEQ ID NO: 7322 - RNA, 17 nt, Homo sapiens
uucaaaugaccuggagu

SEQ ID NO: 7323 - RNA, 17 nt, Homo sapiens
gaccuggaguuacccug

SEQ ID NO: 7324 - RNA, 17 nt, Homo sapiens
uuacccugaugaaaaaa

SEQ ID NO: 7325 - RNA, 17 nt, Homo sapiens
ugaaaaaaauaagagag

SEQ ID NO: 7326 - RNA, 17 nt, Homo sapiens
auaagagagcuuccgua

SEQ ID NO: 7327 - RNA, 17 nt, Homo sapiens
gagcuuccguaaggcga

SEQ ID NO: 7328 - RNA, 17 nt, Homo sapiens
uccguaaggcgacgaau

SEQ ID NO: 7329 - RNA, 17 nt, Homo sapiens
guaaggcgacgaauuga

SEQ ID NO: 7330 - RNA, 17 nt, Homo sapiens
ggcgacgaauugaccaa

SEQ ID NO: 7331 - RNA, 17 nt, Homo sapiens
acgaauugaccaaagca

SEQ ID NO: 7332 - RNA, 17 nt, Homo sapiens
ugaccaaagcaauuccc

SEQ ID NO: 7333 - RNA, 17 nt, Homo sapiens
ccaaagcaauucccaug

SEQ ID NO: 7334 - RNA, 17 nt, Homo sapiens
auucccaugccaacaua

SEQ ID NO: 7335 - RNA, 17 nt, Homo sapiens
ccaugccaacauauucu

SEQ ID NO: 7336 - RNA, 17 nt, Homo sapiens
auucuacaguguucuua

SEQ ID NO: 7337 - RNA, 17 nt, Homo sapiens
ucuacaguguucuuacu

SEQ ID NO: 7338 - RNA, 17 nt, Homo sapiens
uacuauugacaaaaugc

SEQ ID NO: 7339 - RNA, 17 nt, Homo sapiens
uugacaaaaugcagaac

SEQ ID NO: 7340 - RNA, 17 nt, Homo sapiens
gacaaaaugcagaacaa

SEQ ID NO: 7341 - RNA, 17 nt, Homo sapiens
aaugcagaacaaagaca

SEQ ID NO: 7342 - RNA, 17 nt, Homo sapiens
gaacaaagacaaaggac

SEQ ID NO: 7343 - RNA, 17 nt, Homo sapiens
gacaaaggacuuuauac

SEQ ID NO: 7344 - RNA, 17 nt, Homo sapiens
uuauacuugucguguaa

SEQ ID NO: 7345 - RNA, 17 nt, Homo sapiens
uacuugucguguaagga

SEQ ID NO: 7346 - RNA, 17 nt, Homo sapiens
cuugucguguaaggagu

SEQ ID NO: 7347 - RNA, 17 nt, Homo sapiens
uguaaggaguggaccau

SEQ ID NO: 7348 - RNA, 17 nt, Homo sapiens
aggaguggaccaucauu

SEQ ID NO: 7349 - RNA, 17 nt, Homo sapiens
ucauucaaaucuguuaa

SEQ ID NO: 7350 - RNA, 17 nt, Homo sapiens
ucaaaucuguuaacacc

SEQ ID NO: 7351 - RNA, 17 nt, Homo sapiens
aucuguuaacaccucag

SEQ ID NO: 7352 - RNA, 17 nt, Homo sapiens
acaccucagugcauaua

SEQ ID NO: 7353 - RNA, 17 nt, Homo sapiens
accucagugcauauaua

SEQ ID NO: 7354 - RNA, 17 nt, Homo sapiens
uauauaugauaaagcau

SEQ ID NO: 7355 - RNA, 17 nt, Homo sapiens
augauaaagcauucauc

SEQ ID NO: 7356 - RNA, 17 nt, Homo sapiens
ucaucacugugaaacau

SEQ ID NO: 7357 - RNA, 17 nt, Homo sapiens
acugugaaacaucgaaa

SEQ ID NO: 7358 - RNA, 17 nt, Homo sapiens
caucgaaaacagcaggu

SEQ ID NO: 7359 - RNA, 17 nt, Homo sapiens
cgaaaacagcaggugcu

SEQ ID NO: 7360 - RNA, 17 nt, Homo sapiens
aacagcaggugcuugaa

SEQ ID NO: 7361 - RNA, 17 nt, Homo sapiens
cagcaggugcuugaaac

SEQ ID NO: 7362 - RNA, 17 nt, Homo sapiens
ugcuugaaaccguagcu

SEQ ID NO: 7363 - RNA, 17 nt, Homo sapiens
uugaaaccguagcuggc

SEQ ID NO: 7364 - RNA, 17 nt, Homo sapiens
aaaccguagcuggcaag

SEQ ID NO: 7365 - RNA, 17 nt, Homo sapiens
cguagcuggcaagcggu

SEQ ID NO: 7366 - RNA, 17 nt, Homo sapiens
gcuggcaagcggucuua

SEQ ID NO: 7367 - RNA, 17 nt, Homo sapiens
ggcaagcggucuuaccg

SEQ ID NO: 7368 - RNA, 17 nt, Homo sapiens
ucuuaccggcucucuau

SEQ ID NO: 7369 - RNA, 17 nt, Homo sapiens
cuaugaaagugaaggca

SEQ ID NO: 7370 - RNA, 17 nt, Homo sapiens
aagugaaggcauuuccc

SEQ ID NO: 7371 - RNA, 17 nt, Homo sapiens
uuucccucgccggaagu

SEQ ID NO: 7372 - RNA, 17 nt, Homo sapiens
cgccggaaguuguaugg

SEQ ID NO: 7373 - RNA, 17 nt, Homo sapiens
cggaaguuguaugguua

SEQ ID NO: 7374 - RNA, 17 nt, Homo sapiens
guuguaugguuaaaaga

SEQ ID NO: 7375 - RNA, 17 nt, Homo sapiens
guuaaaagauggguuac

SEQ ID NO: 7376 - RNA, 17 nt, Homo sapiens
aaagauggguuaccugc

SEQ ID NO: 7377 - RNA, 17 nt, Homo sapiens
gguuaccugcgacugag

SEQ ID NO: 7378 - RNA, 17 nt, Homo sapiens
uaccugcgacugagaaa

SEQ ID NO: 7379 - RNA, 17 nt, Homo sapiens
acugagaaaucugcucg

SEQ ID NO: 7380 - RNA, 17 nt, Homo sapiens
agaaaucugcucgcuau

SEQ ID NO: 7381 - RNA, 17 nt, Homo sapiens
aucugcucgcuauuuga

SEQ ID NO: 7382 - RNA, 17 nt, Homo sapiens
gcuauuugacucguggc

SEQ ID NO: 7383 - RNA, 17 nt, Homo sapiens
uuugacucguggcuacu

SEQ ID NO: 7384 - RNA, 17 nt, Homo sapiens
gacucguggcuacucgu

SEQ ID NO: 7385 - RNA, 17 nt, Homo sapiens
ggcuacucguuaauuau

SEQ ID NO: 7386 - RNA, 17 nt, Homo sapiens
acucguuaauuaucaag

SEQ ID NO: 7387 - RNA, 17 nt, Homo sapiens
uaucaaggacguaacug

SEQ ID NO: 7388 - RNA, 17 nt, Homo sapiens
ucaaggacguaacugaa

SEQ ID NO: 7389 - RNA, 17 nt, Homo sapiens
aggacguaacugaagag

SEQ ID NO: 7390 - RNA, 17 nt, Homo sapiens
ugaagaggaugcaggga

SEQ ID NO: 7391 - RNA, 17 nt, Homo sapiens
aagaggaugcagggaau

SEQ ID NO: 7392 - RNA, 17 nt, Homo sapiens
ugcagggaauuauacaa

SEQ ID NO: 7393 - RNA, 17 nt, Homo sapiens
auuauacaaucuugcug

SEQ ID NO: 7394 - RNA, 17 nt, Homo sapiens
acaaucuugcugagcau

SEQ ID NO: 7395 - RNA, 17 nt, Homo sapiens
cuugcugagcauaaaac

SEQ ID NO: 7396 - RNA, 17 nt, Homo sapiens
agcauaaaacagucaaa

SEQ ID NO: 7397 - RNA, 17 nt, Homo sapiens
auaaaacagucaaaugu

SEQ ID NO: 7398 - RNA, 17 nt, Homo sapiens
acagucaaauguguuua

SEQ ID NO: 7399 - RNA, 17 nt, Homo sapiens
agucaaauguguuuaaa

SEQ ID NO: 7400 - RNA, 17 nt, Homo sapiens
ucaaauguguuuaaaaa

SEQ ID NO: 7401 - RNA, 17 nt, Homo sapiens
guuuaaaaaccucacug

SEQ ID NO: 7402 - RNA, 17 nt, Homo sapiens
accucacugccacucua

SEQ ID NO: 7403 - RNA, 17 nt, Homo sapiens
ccacucuaauugucaau

SEQ ID NO: 7404 - RNA, 17 nt, Homo sapiens
cucuaauugucaaugug

SEQ ID NO: 7405 - RNA, 17 nt, Homo sapiens
aauugucaaugugaaac

SEQ ID NO: 7406 - RNA, 17 nt, Homo sapiens
uugucaaugugaaaccc

SEQ ID NO: 7407 - RNA, 17 nt, Homo sapiens
aaugugaaaccccagau

SEQ ID NO: 7408 - RNA, 17 nt, Homo sapiens
aaccccagauuuacgaa

SEQ ID NO: 7409 - RNA, 17 nt, Homo sapiens
acgaaaaggccguguca

SEQ ID NO: 7410 - RNA, 17 nt, Homo sapiens
aaaaggccgugucaucg

SEQ ID NO: 7411 - RNA, 17 nt, Homo sapiens
aaggccgugucaucguu

SEQ ID NO: 7412 - RNA, 17 nt, Homo sapiens
gugucaucguuuccaga

SEQ ID NO: 7413 - RNA, 17 nt, Homo sapiens
guuuccagacccggcuc

SEQ ID NO: 7414 - RNA, 17 nt, Homo sapiens
cagacccggcucucuac

SEQ ID NO: 7415 - RNA, 17 nt, Homo sapiens
cccacugggcagcagac

SEQ ID NO: 7416 - RNA, 17 nt, Homo sapiens
acugggcagcagacaaa

SEQ ID NO: 7417 - RNA, 17 nt, Homo sapiens
ggcagcagacaaauccu

SEQ ID NO: 7418 - RNA, 17 nt, Homo sapiens
gcagacaaauccugacu

SEQ ID NO: 7419 - RNA, 17 nt, Homo sapiens
aaauccugacuuguacc

SEQ ID NO: 7420 - RNA, 17 nt, Homo sapiens
ccugacuuguaccgcau

SEQ ID NO: 7421 - RNA, 17 nt, Homo sapiens
cuuguaccgcauauggu

SEQ ID NO: 7422 - RNA, 17 nt, Homo sapiens
cgcauaugguaucccuc

SEQ ID NO: 7423 - RNA, 17 nt, Homo sapiens
aucccucaaccuacaau

SEQ ID NO: 7424 - RNA, 17 nt, Homo sapiens
aaccuacaaucaagugg

SEQ ID NO: 7425 - RNA, 17 nt, Homo sapiens
acaaucaagugguucug

SEQ ID NO: 7426 - RNA, 17 nt, Homo sapiens
aucaagugguucuggca

SEQ ID NO: 7427 - RNA, 17 nt, Homo sapiens
ugguucuggcaccccug

SEQ ID NO: 7428 - RNA, 17 nt, Homo sapiens
gcaccccuguaaccaua

SEQ ID NO: 7429 - RNA, 17 nt, Homo sapiens
ccccuguaaccauaauc

SEQ ID NO: 7430 - RNA, 17 nt, Homo sapiens
uaaccauaaucauuccg

SEQ ID NO: 7431 - RNA, 17 nt, Homo sapiens
auuccgaagcaaggugu

SEQ ID NO: 7432 - RNA, 17 nt, Homo sapiens
gaagcaaggugugacuu

SEQ ID NO: 7433 - RNA, 17 nt, Homo sapiens
agcaaggugugacuuuu

SEQ ID NO: 7434 - RNA, 17 nt, Homo sapiens
aaggugugacuuuuguu

SEQ ID NO: 7435 - RNA, 17 nt, Homo sapiens
ugacuuuuguuccaaua

SEQ ID NO: 7436 - RNA, 17 nt, Homo sapiens
uuguuccaauaaugaag

SEQ ID NO: 7437 - RNA, 17 nt, Homo sapiens
uuccaauaaugaagagu

SEQ ID NO: 7438 - RNA, 17 nt, Homo sapiens
aaugaagaguccuuuau

SEQ ID NO: 7439 - RNA, 17 nt, Homo sapiens
uauccuggaugcugaca

SEQ ID NO: 7440 - RNA, 17 nt, Homo sapiens
uccuggaugcugacagc

SEQ ID NO: 7441 - RNA, 17 nt, Homo sapiens
ggaugcugacagcaaca

SEQ ID NO: 7442 - RNA, 17 nt, Homo sapiens
ugcugacagcaacaugg

SEQ ID NO: 7443 - RNA, 17 nt, Homo sapiens
ugacagcaacaugggaa

SEQ ID NO: 7444 - RNA, 17 nt, Homo sapiens
caugggaaacagaauug

SEQ ID NO: 7445 - RNA, 17 nt, Homo sapiens
gaaacagaauugagagc

SEQ ID NO: 7446 - RNA, 17 nt, Homo sapiens
aauugagagcaucacuc

SEQ ID NO: 7447 - RNA, 17 nt, Homo sapiens
aucacucagcgcauggc

SEQ ID NO: 7448 - RNA, 17 nt, Homo sapiens
cacucagcgcauggcaa

SEQ ID NO: 7449 - RNA, 17 nt, Homo sapiens
agcgcauggcaauaaua

SEQ ID NO: 7450 - RNA, 17 nt, Homo sapiens
gcauggcaauaauagaa

SEQ ID NO: 7451 - RNA, 17 nt, Homo sapiens
uggcaauaauagaagga

SEQ ID NO: 7452 - RNA, 17 nt, Homo sapiens
aggaaagaauaagaugg

SEQ ID NO: 7453 - RNA, 17 nt, Homo sapiens
agaauaagauggcuagc

SEQ ID NO: 7454 - RNA, 17 nt, Homo sapiens
auaagauggcuagcacc

SEQ ID NO: 7455 - RNA, 17 nt, Homo sapiens
gauggcuagcaccuugg

SEQ ID NO: 7456 - RNA, 17 nt, Homo sapiens
gcaccuugguuguggcu

SEQ ID NO: 7457 - RNA, 17 nt, Homo sapiens
ccuugguuguggcugac

SEQ ID NO: 7458 - RNA, 17 nt, Homo sapiens
ugguuguggcugacucu

SEQ ID NO: 7459 - RNA, 17 nt, Homo sapiens
uguggcugacucuagaa

SEQ ID NO: 7460 - RNA, 17 nt, Homo sapiens
acucuagaauuucugga

SEQ ID NO: 7461 - RNA, 17 nt, Homo sapiens
uuucuggaaucuacauu

SEQ ID NO: 7462 - RNA, 17 nt, Homo sapiens
cuacauuugcauagcuu

SEQ ID NO: 7463 - RNA, 17 nt, Homo sapiens
uuugcauagcuuccaau

SEQ ID NO: 7464 - RNA, 17 nt, Homo sapiens
agcuuccaauaaaguug

SEQ ID NO: 7465 - RNA, 17 nt, Homo sapiens
ccaauaaaguugggacu

SEQ ID NO: 7466 - RNA, 17 nt, Homo sapiens
aaguugggacuguggga

SEQ ID NO: 7467 - RNA, 17 nt, Homo sapiens
uugggacugugggaaga

SEQ ID NO: 7468 - RNA, 17 nt, Homo sapiens
gggaagaaacauaagcu

SEQ ID NO: 7469 - RNA, 17 nt, Homo sapiens
aaacauaagcuuuuaua

SEQ ID NO: 7470 - RNA, 17 nt, Homo sapiens
uaucacagaugugccaa

SEQ ID NO: 7471 - RNA, 17 nt, Homo sapiens
ucacagaugugccaaau

SEQ ID NO: 7472 - RNA, 17 nt, Homo sapiens
acagaugugccaaaugg

SEQ ID NO: 7473 - RNA, 17 nt, Homo sapiens
ugugccaaauggguuuc

SEQ ID NO: 7474 - RNA, 17 nt, Homo sapiens
ccaaauggguuucaugu

SEQ ID NO: 7475 - RNA, 17 nt, Homo sapiens
gguuucauguuaacuug

SEQ ID NO: 7476 - RNA, 17 nt, Homo sapiens
ucauguuaacuuggaaa

SEQ ID NO: 7477 - RNA, 17 nt, Homo sapiens
uggaaaaaaugccgacg

SEQ ID NO: 7478 - RNA, 17 nt, Homo sapiens
gaaaaaaugccgacgga

SEQ ID NO: 7479 - RNA, 17 nt, Homo sapiens
aaaugccgacggaagga

SEQ ID NO: 7480 - RNA, 17 nt, Homo sapiens
aggagaggaccugaaac

SEQ ID NO: 7481 - RNA, 17 nt, Homo sapiens
gaccugaaacugucuug

SEQ ID NO: 7482 - RNA, 17 nt, Homo sapiens
cugaaacugucuugcac

SEQ ID NO: 7483 - RNA, 17 nt, Homo sapiens
acugucuugcacaguua

SEQ ID NO: 7484 - RNA, 17 nt, Homo sapiens
cuugcacaguuaacaag

SEQ ID NO: 7485 - RNA, 17 nt, Homo sapiens
cacaguuaacaaguucu

SEQ ID NO: 7486 - RNA, 17 nt, Homo sapiens
guuaacaaguucuuaua

SEQ ID NO: 7487 - RNA, 17 nt, Homo sapiens
auacagagacguuacuu

SEQ ID NO: 7488 - RNA, 17 nt, Homo sapiens
acagagacguuacuugg

SEQ ID NO: 7489 - RNA, 17 nt, Homo sapiens
uuacuuggauuuuacug

SEQ ID NO: 7490 - RNA, 17 nt, Homo sapiens
auuuuacugcggacagu

SEQ ID NO: 7491 - RNA, 17 nt, Homo sapiens
uacugcggacaguuaau

SEQ ID NO: 7492 - RNA, 17 nt, Homo sapiens
ugcggacaguuaauaac

SEQ ID NO: 7493 - RNA, 17 nt, Homo sapiens
gacaguuaauaacagaa

SEQ ID NO: 7494 - RNA, 17 nt, Homo sapiens
aguuaauaacagaacaa

SEQ ID NO: 7495 - RNA, 17 nt, Homo sapiens
auaacagaacaaugcac

SEQ ID NO: 7496 - RNA, 17 nt, Homo sapiens
acagaacaaugcacuac

SEQ ID NO: 7497 - RNA, 17 nt, Homo sapiens
agaacaaugcacuacag

SEQ ID NO: 7498 - RNA, 17 nt, Homo sapiens
gcacuacaguauuagca

SEQ ID NO: 7499 - RNA, 17 nt, Homo sapiens
caguauuagcaagcaaa

SEQ ID NO: 7500 - RNA, 17 nt, Homo sapiens
auuagcaagcaaaaaau

SEQ ID NO: 7501 - RNA, 17 nt, Homo sapiens
agcaaaaaauggccauc

SEQ ID NO: 7502 - RNA, 17 nt, Homo sapiens
aaaaaauggccaucacu

SEQ ID NO: 7503 - RNA, 17 nt, Homo sapiens
acuaaggagcacuccau

SEQ ID NO: 7504 - RNA, 17 nt, Homo sapiens
cacucuuaaucuuacca

SEQ ID NO: 7505 - RNA, 17 nt, Homo sapiens
caucaugaauguuuccc

SEQ ID NO: 7506 - RNA, 17 nt, Homo sapiens
ucaugaauguuucccug

SEQ ID NO: 7507 - RNA, 17 nt, Homo sapiens
guuucccugcaagauuc

SEQ ID NO: 7508 - RNA, 17 nt, Homo sapiens
ccugcaagauucaggca

SEQ ID NO: 7509 - RNA, 17 nt, Homo sapiens
agauucaggcaccuaug

SEQ ID NO: 7510 - RNA, 17 nt, Homo sapiens
gcaccuaugccugcaga

SEQ ID NO: 7511 - RNA, 17 nt, Homo sapiens
cuaugccugcagagcca

SEQ ID NO: 7512 - RNA, 17 nt, Homo sapiens
ccugcagagccaggaau

SEQ ID NO: 7513 - RNA, 17 nt, Homo sapiens
agccaggaauguauaca

SEQ ID NO: 7514 - RNA, 17 nt, Homo sapiens
ccaggaauguauacaca

SEQ ID NO: 7515 - RNA, 17 nt, Homo sapiens
gggaagaaauccuccag

SEQ ID NO: 7516 - RNA, 17 nt, Homo sapiens
agaaagaaauuacaauc

SEQ ID NO: 7517 - RNA, 17 nt, Homo sapiens
aaauuacaaucagagau

SEQ ID NO: 7518 - RNA, 17 nt, Homo sapiens
aaucagagaucaggaag

SEQ ID NO: 7519 - RNA, 17 nt, Homo sapiens
aucaggaagcaccauac

SEQ ID NO: 7520 - RNA, 17 nt, Homo sapiens
uaccuccugcgaaaccu

SEQ ID NO: 7521 - RNA, 17 nt, Homo sapiens
ccugcgaaaccucagug

SEQ ID NO: 7522 - RNA, 17 nt, Homo sapiens
aaaccucagugaucaca

SEQ ID NO: 7523 - RNA, 17 nt, Homo sapiens
ccucagugaucacacag

SEQ ID NO: 7524 - RNA, 17 nt, Homo sapiens
aucacacaguggccauc

SEQ ID NO: 7525 - RNA, 17 nt, Homo sapiens
acacaguggccaucagc

SEQ ID NO: 7526 - RNA, 17 nt, Homo sapiens
ggccaucagcaguucca

SEQ ID NO: 7527 - RNA, 17 nt, Homo sapiens
caucagcaguuccacca

SEQ ID NO: 7528 - RNA, 17 nt, Homo sapiens
cacuuuagacugucaug

SEQ ID NO: 7529 - RNA, 17 nt, Homo sapiens
uuuagacugucaugcua

SEQ ID NO: 7530 - RNA, 17 nt, Homo sapiens
acugucaugcuaauggu

SEQ ID NO: 7531 - RNA, 17 nt, Homo sapiens
ucaugcuaauggugucc

SEQ ID NO: 7532 - RNA, 17 nt, Homo sapiens
ugcuaaugguguccccg

SEQ ID NO: 7533 - RNA, 17 nt, Homo sapiens
cuaaugguguccccgag

SEQ ID NO: 7534 - RNA, 17 nt, Homo sapiens
guccccgagccucagau

SEQ ID NO: 7535 - RNA, 17 nt, Homo sapiens
agccucagaucacuugg

SEQ ID NO: 7536 - RNA, 17 nt, Homo sapiens
aucacuugguuuaaaaa

SEQ ID NO: 7537 - RNA, 17 nt, Homo sapiens
guuuaaaaacaaccaca

SEQ ID NO: 7538 - RNA, 17 nt, Homo sapiens
uaaaaacaaccacaaaa

SEQ ID NO: 7539 - RNA, 17 nt, Homo sapiens
accacaaaauacaacaa

SEQ ID NO: 7540 - RNA, 17 nt, Homo sapiens
aaaauacaacaagagcc

SEQ ID NO: 7541 - RNA, 17 nt, Homo sapiens
caacaagagccuggaau

SEQ ID NO: 7542 - RNA, 17 nt, Homo sapiens
agccuggaauuauuuua

SEQ ID NO: 7543 - RNA, 17 nt, Homo sapiens
auuuuaggaccaggaag

SEQ ID NO: 7544 - RNA, 17 nt, Homo sapiens
accaggaagcagcacgc

SEQ ID NO: 7545 - RNA, 17 nt, Homo sapiens
aggaagcagcacgcugu

SEQ ID NO: 7546 - RNA, 17 nt, Homo sapiens
agcagcacgcuguuuau

SEQ ID NO: 7547 - RNA, 17 nt, Homo sapiens
agcacgcuguuuauuga

SEQ ID NO: 7548 - RNA, 17 nt, Homo sapiens
uugaaagagucacagaa

SEQ ID NO: 7549 - RNA, 17 nt, Homo sapiens
agaagaggaugaaggug

SEQ ID NO: 7550 - RNA, 17 nt, Homo sapiens
ggaugaaggugucuauc

SEQ ID NO: 7551 - RNA, 17 nt, Homo sapiens
augaaggugucuaucac

SEQ ID NO: 7552 - RNA, 17 nt, Homo sapiens
cuaucacugcaaagcca

SEQ ID NO: 7553 - RNA, 17 nt, Homo sapiens
acugcaaagccaccaac

SEQ ID NO: 7554 - RNA, 17 nt, Homo sapiens
agccaccaaccagaagg

SEQ ID NO: 7555 - RNA, 17 nt, Homo sapiens
ccagaagggcucugugg

SEQ ID NO: 7556 - RNA, 17 nt, Homo sapiens
agggcucuguggaaagu

SEQ ID NO: 7557 - RNA, 17 nt, Homo sapiens
uguggaaaguucagcau

SEQ ID NO: 7558 - RNA, 17 nt, Homo sapiens
aaaguucagcauaccuc

SEQ ID NO: 7559 - RNA, 17 nt, Homo sapiens
accucacuguucaagga

SEQ ID NO: 7560 - RNA, 17 nt, Homo sapiens
uucaaggaaccucggac

SEQ ID NO: 7561 - RNA, 17 nt, Homo sapiens
aaccucggacaagucua

SEQ ID NO: 7562 - RNA, 17 nt, Homo sapiens
ucggacaagucuaaucu

SEQ ID NO: 7563 - RNA, 17 nt, Homo sapiens
caagucuaaucuggagc

SEQ ID NO: 7564 - RNA, 17 nt, Homo sapiens
aaucuggagcugaucac

SEQ ID NO: 7565 - RNA, 17 nt, Homo sapiens
uggagcugaucacucua

SEQ ID NO: 7566 - RNA, 17 nt, Homo sapiens
ucacucuaacaugcacc

SEQ ID NO: 7567 - RNA, 17 nt, Homo sapiens
ucuaacaugcaccugug

SEQ ID NO: 7568 - RNA, 17 nt, Homo sapiens
augcaccuguguggcug

SEQ ID NO: 7569 - RNA, 17 nt, Homo sapiens
gcaccuguguggcugcg

SEQ ID NO: 7570 - RNA, 17 nt, Homo sapiens
ccuguguggcugcgacu

SEQ ID NO: 7571 - RNA, 17 nt, Homo sapiens
guguggcugcgacucuc

SEQ ID NO: 7572 - RNA, 17 nt, Homo sapiens
uggcugcgacucucuuc

SEQ ID NO: 7573 - RNA, 17 nt, Homo sapiens
cucuucuggcuccuauu

SEQ ID NO: 7574 - RNA, 17 nt, Homo sapiens
uccuauuaacccuccuu

SEQ ID NO: 7575 - RNA, 17 nt, Homo sapiens
uccgaaaaaugaaaagg

SEQ ID NO: 7576 - RNA, 17 nt, Homo sapiens
augaaaaggucuucuuc

SEQ ID NO: 7577 - RNA, 17 nt, Homo sapiens
cuucugaaauaaagacu

SEQ ID NO: 7578 - RNA, 17 nt, Homo sapiens
aaauaaagacugacuac

SEQ ID NO: 7579 - RNA, 17 nt, Homo sapiens
aaagacugacuaccuau

SEQ ID NO: 7580 - RNA, 17 nt, Homo sapiens
accuaucaauuauaaug

SEQ ID NO: 7581 - RNA, 17 nt, Homo sapiens
caauuauaauggaccca

SEQ ID NO: 7582 - RNA, 17 nt, Homo sapiens
uauaauggacccagaug

SEQ ID NO: 7583 - RNA, 17 nt, Homo sapiens
ggacccagaugaaguuc

SEQ ID NO: 7584 - RNA, 17 nt, Homo sapiens
cagaugaaguuccuuug

SEQ ID NO: 7585 - RNA, 17 nt, Homo sapiens
uccuuuggaugagcagu

SEQ ID NO: 7586 - RNA, 17 nt, Homo sapiens
uuggaugagcaguguga

SEQ ID NO: 7587 - RNA, 17 nt, Homo sapiens
gaugagcagugugagcg

SEQ ID NO: 7588 - RNA, 17 nt, Homo sapiens
ugagcagugugagcggc

SEQ ID NO: 7589 - RNA, 17 nt, Homo sapiens
cagugugagcggcuccc

SEQ ID NO: 7590 - RNA, 17 nt, Homo sapiens
ugugagcggcucccuua

SEQ ID NO: 7591 - RNA, 17 nt, Homo sapiens
cccuuaugaugccagca

SEQ ID NO: 7592 - RNA, 17 nt, Homo sapiens
cuuaugaugccagcaag

SEQ ID NO: 7593 - RNA, 17 nt, Homo sapiens
ugaugccagcaaguggg

SEQ ID NO: 7594 - RNA, 17 nt, Homo sapiens
gccagcaagugggaguu

SEQ ID NO: 7595 - RNA, 17 nt, Homo sapiens
aagugggaguuugcccg

SEQ ID NO: 7596 - RNA, 17 nt, Homo sapiens
gggaguuugcccgggag

SEQ ID NO: 7597 - RNA, 17 nt, Homo sapiens
cgggagagacuuaaacu

SEQ ID NO: 7598 - RNA, 17 nt, Homo sapiens
agacuuaaacugggcaa

SEQ ID NO: 7599 - RNA, 17 nt, Homo sapiens
uaaacugggcaaaucac

SEQ ID NO: 7600 - RNA, 17 nt, Homo sapiens
cugggcaaaucacuugg

SEQ ID NO: 7601 - RNA, 17 nt, Homo sapiens
gaagaggggcuuuugga

SEQ ID NO: 7602 - RNA, 17 nt, Homo sapiens
uuggaaaagugguucaa

SEQ ID NO: 7603 - RNA, 17 nt, Homo sapiens
gaaaagugguucaagca

SEQ ID NO: 7604 - RNA, 17 nt, Homo sapiens
ugguucaagcaucagca

SEQ ID NO: 7605 - RNA, 17 nt, Homo sapiens
aagcaucagcauuuggc

SEQ ID NO: 7606 - RNA, 17 nt, Homo sapiens
agcauuuggcauuaaga

SEQ ID NO: 7607 - RNA, 17 nt, Homo sapiens
auuaagaaaucaccuac

SEQ ID NO: 7608 - RNA, 17 nt, Homo sapiens
ucaccuacgugccggac

SEQ ID NO: 7609 - RNA, 17 nt, Homo sapiens
accuacgugccggacug

SEQ ID NO: 7610 - RNA, 17 nt, Homo sapiens
cgugccggacuguggcu

SEQ ID NO: 7611 - RNA, 17 nt, Homo sapiens
gccggacuguggcugug

SEQ ID NO: 7612 - RNA, 17 nt, Homo sapiens
ggacuguggcugugaaa

SEQ ID NO: 7613 - RNA, 17 nt, Homo sapiens
cuguggcugugaaaaug

SEQ ID NO: 7614 - RNA, 17 nt, Homo sapiens
cugugaaaaugcugaaa

SEQ ID NO: 7615 - RNA, 17 nt, Homo sapiens
gugaaaaugcugaaaga

SEQ ID NO: 7616 - RNA, 17 nt, Homo sapiens
aagagggggccacggcc

SEQ ID NO: 7617 - RNA, 17 nt, Homo sapiens
gggccacggccagcgag

SEQ ID NO: 7618 - RNA, 17 nt, Homo sapiens
cacggccagcgaguaca

SEQ ID NO: 7619 - RNA, 17 nt, Homo sapiens
gccagcgaguacaaagc

SEQ ID NO: 7620 - RNA, 17 nt, Homo sapiens
aguacaaagcucugaug

SEQ ID NO: 7621 - RNA, 17 nt, Homo sapiens
aagcucugaugacugag

SEQ ID NO: 7622 - RNA, 17 nt, Homo sapiens
cucugaugacugagcua

SEQ ID NO: 7623 - RNA, 17 nt, Homo sapiens
augacugagcuaaaaau

SEQ ID NO: 7624 - RNA, 17 nt, Homo sapiens
agcuaaaaaucuugacc

SEQ ID NO: 7625 - RNA, 17 nt, Homo sapiens
aaaucuugacccacauu

SEQ ID NO: 7626 - RNA, 17 nt, Homo sapiens
ccacauuggccaccauc

SEQ ID NO: 7627 - RNA, 17 nt, Homo sapiens
ccaucugaacgugguua

SEQ ID NO: 7628 - RNA, 17 nt, Homo sapiens
aucugaacgugguuaac

SEQ ID NO: 7629 - RNA, 17 nt, Homo sapiens
ugaacgugguuaaccug

SEQ ID NO: 7630 - RNA, 17 nt, Homo sapiens
cgugguuaaccugcugg

SEQ ID NO: 7631 - RNA, 17 nt, Homo sapiens
guuaaccugcugggagc

SEQ ID NO: 7632 - RNA, 17 nt, Homo sapiens
ugcugggagccugcacc

SEQ ID NO: 7633 - RNA, 17 nt, Homo sapiens
gggagccugcaccaagc

SEQ ID NO: 7634 - RNA, 17 nt, Homo sapiens
ugcaccaagcaaggagg

SEQ ID NO: 7635 - RNA, 17 nt, Homo sapiens
caaggagggccucugau

SEQ ID NO: 7636 - RNA, 17 nt, Homo sapiens
ggccucugauggugauu

SEQ ID NO: 7637 - RNA, 17 nt, Homo sapiens
cucugauggugauuguu

SEQ ID NO: 7638 - RNA, 17 nt, Homo sapiens
ugauggugauuguugaa

SEQ ID NO: 7639 - RNA, 17 nt, Homo sapiens
uggugauuguugaauac

SEQ ID NO: 7640 - RNA, 17 nt, Homo sapiens
auuguugaauacugcaa

SEQ ID NO: 7641 - RNA, 17 nt, Homo sapiens
ugaauacugcaaauaug

SEQ ID NO: 7642 - RNA, 17 nt, Homo sapiens
uacugcaaauauggaaa

SEQ ID NO: 7643 - RNA, 17 nt, Homo sapiens
auauggaaaucucucca

SEQ ID NO: 7644 - RNA, 17 nt, Homo sapiens
ucucuccaacuaccuca

SEQ ID NO: 7645 - RNA, 17 nt, Homo sapiens
ccucaagagcaaacgug

SEQ ID NO: 7646 - RNA, 17 nt, Homo sapiens
aagagcaaacgugacuu

SEQ ID NO: 7647 - RNA, 17 nt, Homo sapiens
gagcaaacgugacuuau

SEQ ID NO: 7648 - RNA, 17 nt, Homo sapiens
caaacgugacuuauuuu

SEQ ID NO: 7649 - RNA, 17 nt, Homo sapiens
uuuucucaacaaggaug

SEQ ID NO: 7650 - RNA, 17 nt, Homo sapiens
caacaaggaugcagcac

SEQ ID NO: 7651 - RNA, 17 nt, Homo sapiens
acaaggaugcagcacua

SEQ ID NO: 7652 - RNA, 17 nt, Homo sapiens
aggaugcagcacuacac

SEQ ID NO: 7653 - RNA, 17 nt, Homo sapiens
cacauggagccuaagaa

SEQ ID NO: 7654 - RNA, 17 nt, Homo sapiens
aagaaaaaauggagcca

SEQ ID NO: 7655 - RNA, 17 nt, Homo sapiens
aaaauggagccaggccu

SEQ ID NO: 7656 - RNA, 17 nt, Homo sapiens
ggagccaggccuggaac

SEQ ID NO: 7657 - RNA, 17 nt, Homo sapiens
ggccuggaacaaggcaa

SEQ ID NO: 7658 - RNA, 17 nt, Homo sapiens
ggaacaaggcaagaaac

SEQ ID NO: 7659 - RNA, 17 nt, Homo sapiens
ggcaagaaaccaagacu

SEQ ID NO: 7660 - RNA, 17 nt, Homo sapiens
aaaccaagacuagauag

SEQ ID NO: 7661 - RNA, 17 nt, Homo sapiens
aagacuagauagcguca

SEQ ID NO: 7662 - RNA, 17 nt, Homo sapiens
acuagauagcgucacca

SEQ ID NO: 7663 - RNA, 17 nt, Homo sapiens
uagauagcgucaccagc

SEQ ID NO: 7664 - RNA, 17 nt, Homo sapiens
cgucaccagcagcgaaa

SEQ ID NO: 7665 - RNA, 17 nt, Homo sapiens
caccagcagcgaaagcu

SEQ ID NO: 7666 - RNA, 17 nt, Homo sapiens
cagcgaaagcuuugcga

SEQ ID NO: 7667 - RNA, 17 nt, Homo sapiens
aaagcuuugcgagcucc

SEQ ID NO: 7668 - RNA, 17 nt, Homo sapiens
cuuugcgagcuccggcu

SEQ ID NO: 7669 - RNA, 17 nt, Homo sapiens
gagcuccggcuuucagg

SEQ ID NO: 7670 - RNA, 17 nt, Homo sapiens
ucaggaagauaaaaguc

SEQ ID NO: 7671 - RNA, 17 nt, Homo sapiens
agauaaaagucugagug

SEQ ID NO: 7672 - RNA, 17 nt, Homo sapiens
aagucugagugauguug

SEQ ID NO: 7673 - RNA, 17 nt, Homo sapiens
ucugagugauguugagg

SEQ ID NO: 7674 - RNA, 17 nt, Homo sapiens
ugagugauguugaggaa

SEQ ID NO: 7675 - RNA, 17 nt, Homo sapiens
agaggaggauucugacg

SEQ ID NO: 7676 - RNA, 17 nt, Homo sapiens
ggauucugacgguuucu

SEQ ID NO: 7677 - RNA, 17 nt, Homo sapiens
uucugacgguuucuaca

SEQ ID NO: 7678 - RNA, 17 nt, Homo sapiens
uacaaggagcccaucac

SEQ ID NO: 7679 - RNA, 17 nt, Homo sapiens
uauggaagaucugauuu

SEQ ID NO: 7680 - RNA, 17 nt, Homo sapiens
aagaucugauuucuuac

SEQ ID NO: 7681 - RNA, 17 nt, Homo sapiens
uucuuacaguuuucaag

SEQ ID NO: 7682 - RNA, 17 nt, Homo sapiens
guuuucaaguggccaga

SEQ ID NO: 7683 - RNA, 17 nt, Homo sapiens
uucaaguggccagaggc

SEQ ID NO: 7684 - RNA, 17 nt, Homo sapiens
ggccagaggcauggagu

SEQ ID NO: 7685 - RNA, 17 nt, Homo sapiens
ggcauggaguuccuguc

SEQ ID NO: 7686 - RNA, 17 nt, Homo sapiens
gaguuccugucuuccag

SEQ ID NO: 7687 - RNA, 17 nt, Homo sapiens
uccagaaagugcauuca

SEQ ID NO: 7688 - RNA, 17 nt, Homo sapiens
cagaaagugcauucauc

SEQ ID NO: 7689 - RNA, 17 nt, Homo sapiens
ucaucgggaccuggcag

SEQ ID NO: 7690 - RNA, 17 nt, Homo sapiens
gggaccuggcagcgaga

SEQ ID NO: 7691 - RNA, 17 nt, Homo sapiens
accuggcagcgagaaac

SEQ ID NO: 7692 - RNA, 17 nt, Homo sapiens
agcgagaaacauucuuu

SEQ ID NO: 7693 - RNA, 17 nt, Homo sapiens
aucugagaacaacgugg

SEQ ID NO: 7694 - RNA, 17 nt, Homo sapiens
ugagaacaacgugguga

SEQ ID NO: 7695 - RNA, 17 nt, Homo sapiens
agaacaacguggugaag

SEQ ID NO: 7696 - RNA, 17 nt, Homo sapiens
acaacguggugaagauu

SEQ ID NO: 7697 - RNA, 17 nt, Homo sapiens
uggugaagauuugugau

SEQ ID NO: 7698 - RNA, 17 nt, Homo sapiens
gaagauuugugauuuug

SEQ ID NO: 7699 - RNA, 17 nt, Homo sapiens
gauuugugauuuuggcc

SEQ ID NO: 7700 - RNA, 17 nt, Homo sapiens
ugauuuuggccuugccc

SEQ ID NO: 7701 - RNA, 17 nt, Homo sapiens
uuggccuugcccgggau

SEQ ID NO: 7702 - RNA, 17 nt, Homo sapiens
ugcccgggauauuuaua

SEQ ID NO: 7703 - RNA, 17 nt, Homo sapiens
uuauaagaaccccgauu

SEQ ID NO: 7704 - RNA, 17 nt, Homo sapiens
gaaccccgauuauguga

SEQ ID NO: 7705 - RNA, 17 nt, Homo sapiens
ccgauuaugugagaaaa

SEQ ID NO: 7706 - RNA, 17 nt, Homo sapiens
aaaaggagauacucgac

SEQ ID NO: 7707 - RNA, 17 nt, Homo sapiens
gauacucgacuuccucu

SEQ ID NO: 7708 - RNA, 17 nt, Homo sapiens
ccucugaaauggauggc

SEQ ID NO: 7709 - RNA, 17 nt, Homo sapiens
ugaaauggauggcuccc

SEQ ID NO: 7710 - RNA, 17 nt, Homo sapiens
aauggauggcucccgaa

SEQ ID NO: 7711 - RNA, 17 nt, Homo sapiens
gcucccgaaucuaucuu

SEQ ID NO: 7712 - RNA, 17 nt, Homo sapiens
uaucuuugacaaaaucu

SEQ ID NO: 7713 - RNA, 17 nt, Homo sapiens
uugacaaaaucuacagc

SEQ ID NO: 7714 - RNA, 17 nt, Homo sapiens
aaucuacagcaccaaga

SEQ ID NO: 7715 - RNA, 17 nt, Homo sapiens
caccaagagcgacgugu

SEQ ID NO: 7716 - RNA, 17 nt, Homo sapiens
caagagcgacguguggu

SEQ ID NO: 7717 - RNA, 17 nt, Homo sapiens
agagcgacguguggucu

SEQ ID NO: 7718 - RNA, 17 nt, Homo sapiens
agcgacguguggucuua

SEQ ID NO: 7719 - RNA, 17 nt, Homo sapiens
gacguguggucuuacgg

SEQ ID NO: 7720 - RNA, 17 nt, Homo sapiens
cuuacggaguauugcug

SEQ ID NO: 7721 - RNA, 17 nt, Homo sapiens
ggaguauugcuguggga

SEQ ID NO: 7722 - RNA, 17 nt, Homo sapiens
guauugcugugggaaau

SEQ ID NO: 7723 - RNA, 17 nt, Homo sapiens
ugugggaaaucuucucc

SEQ ID NO: 7724 - RNA, 17 nt, Homo sapiens
cuccuuaggugggucuc

SEQ ID NO: 7725 - RNA, 17 nt, Homo sapiens
uuaggugggucuccaua

SEQ ID NO: 7726 - RNA, 17 nt, Homo sapiens
acccaggaguacaaaug

SEQ ID NO: 7727 - RNA, 17 nt, Homo sapiens
gaguacaaauggaugag

SEQ ID NO: 7728 - RNA, 17 nt, Homo sapiens
acaaauggaugaggacu

SEQ ID NO: 7729 - RNA, 17 nt, Homo sapiens
ggaugaggacuuuugca

SEQ ID NO: 7730 - RNA, 17 nt, Homo sapiens
ggacuuuugcagucgcc

SEQ ID NO: 7731 - RNA, 17 nt, Homo sapiens
cuuuugcagucgccuga

SEQ ID NO: 7732 - RNA, 17 nt, Homo sapiens
uugcagucgccugaggg

SEQ ID NO: 7733 - RNA, 17 nt, Homo sapiens
gagggaaggcaugagga

SEQ ID NO: 7734 - RNA, 17 nt, Homo sapiens
gcaugaggaugagagcu

SEQ ID NO: 7735 - RNA, 17 nt, Homo sapiens
ggaugagagcuccugag

SEQ ID NO: 7736 - RNA, 17 nt, Homo sapiens
gcuccugaguacucuac

SEQ ID NO: 7737 - RNA, 17 nt, Homo sapiens
cuccugaaaucuaucag

SEQ ID NO: 7738 - RNA, 17 nt, Homo sapiens
ucuaucagaucaugcug

SEQ ID NO: 7739 - RNA, 17 nt, Homo sapiens
cagaucaugcuggacug

SEQ ID NO: 7740 - RNA, 17 nt, Homo sapiens
caugcuggacugcuggc

SEQ ID NO: 7741 - RNA, 17 nt, Homo sapiens
gcuggacugcuggcaca

SEQ ID NO: 7742 - RNA, 17 nt, Homo sapiens
gacugcuggcacagaga

SEQ ID NO: 7743 - RNA, 17 nt, Homo sapiens
gcacagagacccaaaag

SEQ ID NO: 7744 - RNA, 17 nt, Homo sapiens
aaagaaaggccaagauu

SEQ ID NO: 7745 - RNA, 17 nt, Homo sapiens
aggccaagauuugcaga

SEQ ID NO: 7746 - RNA, 17 nt, Homo sapiens
caagauuugcagaacuu

SEQ ID NO: 7747 - RNA, 17 nt, Homo sapiens
uuugcagaacuugugga

SEQ ID NO: 7748 - RNA, 17 nt, Homo sapiens
cagaacuuguggaaaaa

SEQ ID NO: 7749 - RNA, 17 nt, Homo sapiens
guggaaaaacuagguga

SEQ ID NO: 7750 - RNA, 17 nt, Homo sapiens
aaaacuaggugauuugc

SEQ ID NO: 7751 - RNA, 17 nt, Homo sapiens
acuaggugauuugcuuc

SEQ ID NO: 7752 - RNA, 17 nt, Homo sapiens
ggugauuugcuucaagc

SEQ ID NO: 7753 - RNA, 17 nt, Homo sapiens
ugcuucaagcaaaugua

SEQ ID NO: 7754 - RNA, 17 nt, Homo sapiens
ucaagcaaauguacaac

SEQ ID NO: 7755 - RNA, 17 nt, Homo sapiens
aagcaaauguacaacag

SEQ ID NO: 7756 - RNA, 17 nt, Homo sapiens
aauguacaacaggaugg

SEQ ID NO: 7757 - RNA, 17 nt, Homo sapiens
acaacaggaugguaaag

SEQ ID NO: 7758 - RNA, 17 nt, Homo sapiens
acaggaugguaaagacu

SEQ ID NO: 7759 - RNA, 17 nt, Homo sapiens
ugguaaagacuacaucc

SEQ ID NO: 7760 - RNA, 17 nt, Homo sapiens
acaucccaaucaaugcc

SEQ ID NO: 7761 - RNA, 17 nt, Homo sapiens
cccaaucaaugccauac

SEQ ID NO: 7762 - RNA, 17 nt, Homo sapiens
caaucaaugccauacug

SEQ ID NO: 7763 - RNA, 17 nt, Homo sapiens
ccauacugacaggaaau

SEQ ID NO: 7764 - RNA, 17 nt, Homo sapiens
gacaggaaauagugggu

SEQ ID NO: 7765 - RNA, 17 nt, Homo sapiens
aggaaauaguggguuua

SEQ ID NO: 7766 - RNA, 17 nt, Homo sapiens
aauaguggguuuacaua

SEQ ID NO: 7767 - RNA, 17 nt, Homo sapiens
cauacucaacuccugcc

SEQ ID NO: 7768 - RNA, 17 nt, Homo sapiens
caacuccugccuucucu

SEQ ID NO: 7769 - RNA, 17 nt, Homo sapiens
cucugaggacuucuuca

SEQ ID NO: 7770 - RNA, 17 nt, Homo sapiens
caaggaaaguauuucag

SEQ ID NO: 7771 - RNA, 17 nt, Homo sapiens
guauuucagcuccgaag

SEQ ID NO: 7772 - RNA, 17 nt, Homo sapiens
gcuccgaaguuuaauuc

SEQ ID NO: 7773 - RNA, 17 nt, Homo sapiens
gaaguuuaauucaggaa

SEQ ID NO: 7774 - RNA, 17 nt, Homo sapiens
uucaggaagcucugaug

SEQ ID NO: 7775 - RNA, 17 nt, Homo sapiens
aagcucugaugauguca

SEQ ID NO: 7776 - RNA, 17 nt, Homo sapiens
cucugaugaugucagau

SEQ ID NO: 7777 - RNA, 17 nt, Homo sapiens
cugaugaugucagauau

SEQ ID NO: 7778 - RNA, 17 nt, Homo sapiens
gaugucagauauguaaa

SEQ ID NO: 7779 - RNA, 17 nt, Homo sapiens
ucagauauguaaaugcu

SEQ ID NO: 7780 - RNA, 17 nt, Homo sapiens
auauguaaaugcuuuca

SEQ ID NO: 7781 - RNA, 17 nt, Homo sapiens
auguaaaugcuuucaag

SEQ ID NO: 7782 - RNA, 17 nt, Homo sapiens
gcuuucaaguucaugag

SEQ ID NO: 7783 - RNA, 17 nt, Homo sapiens
guucaugagccuggaaa

SEQ ID NO: 7784 - RNA, 17 nt, Homo sapiens
uggaaagaaucaaaacc

SEQ ID NO: 7785 - RNA, 17 nt, Homo sapiens
gaaucaaaaccuuugaa

SEQ ID NO: 7786 - RNA, 17 nt, Homo sapiens
uuugaagaacuuuuacc

SEQ ID NO: 7787 - RNA, 17 nt, Homo sapiens
uuuaccgaaugccaccu

SEQ ID NO: 7788 - RNA, 17 nt, Homo sapiens
uaccgaaugccaccucc

SEQ ID NO: 7789 - RNA, 17 nt, Homo sapiens
accuccauguuugauga

SEQ ID NO: 7790 - RNA, 17 nt, Homo sapiens
cauguuugaugacuacc

SEQ ID NO: 7791 - RNA, 17 nt, Homo sapiens
guuugaugacuaccagg

SEQ ID NO: 7792 - RNA, 17 nt, Homo sapiens
cuaccagggcgacagca

SEQ ID NO: 7793 - RNA, 17 nt, Homo sapiens
ccagggcgacagcagca

SEQ ID NO: 7794 - RNA, 17 nt, Homo sapiens
gggcgacagcagcacuc

SEQ ID NO: 7795 - RNA, 17 nt, Homo sapiens
cgacagcagcacucugu

SEQ ID NO: 7796 - RNA, 17 nt, Homo sapiens
agcacucuguuggccuc

SEQ ID NO: 7797 - RNA, 17 nt, Homo sapiens
cucuguuggccucuccc

SEQ ID NO: 7798 - RNA, 17 nt, Homo sapiens
ucucccaugcugaagcg

SEQ ID NO: 7799 - RNA, 17 nt, Homo sapiens
augcugaagcgcuucac

SEQ ID NO: 7800 - RNA, 17 nt, Homo sapiens
gcugaagcgcuucaccu

SEQ ID NO: 7801 - RNA, 17 nt, Homo sapiens
ucaccuggacugacagc

SEQ ID NO: 7802 - RNA, 17 nt, Homo sapiens
cuggacugacagcaaac

SEQ ID NO: 7803 - RNA, 17 nt, Homo sapiens
gacugacagcaaaccca

SEQ ID NO: 7804 - RNA, 17 nt, Homo sapiens
gacagcaaacccaaggc

SEQ ID NO: 7805 - RNA, 17 nt, Homo sapiens
aacccaaggccucgcuc

SEQ ID NO: 7806 - RNA, 17 nt, Homo sapiens
aaggccucgcucaagau

SEQ ID NO: 7807 - RNA, 17 nt, Homo sapiens
cgcucaagauugacuug

SEQ ID NO: 7808 - RNA, 17 nt, Homo sapiens
caagauugacuugagag

SEQ ID NO: 7809 - RNA, 17 nt, Homo sapiens
acuugagaguaaccagu

SEQ ID NO: 7810 - RNA, 17 nt, Homo sapiens
ugagaguaaccaguaaa

SEQ ID NO: 7811 - RNA, 17 nt, Homo sapiens
aguaaccaguaaaagua

SEQ ID NO: 7812 - RNA, 17 nt, Homo sapiens
caguaaaaguaaggagu

SEQ ID NO: 7813 - RNA, 17 nt, Homo sapiens
aguaaggagucggggcu

SEQ ID NO: 7814 - RNA, 17 nt, Homo sapiens
gagucggggcugucuga

SEQ ID NO: 7815 - RNA, 17 nt, Homo sapiens
ucggggcugucugaugu

SEQ ID NO: 7816 - RNA, 17 nt, Homo sapiens
gcugucugaugucagca

SEQ ID NO: 7817 - RNA, 17 nt, Homo sapiens
ugucugaugucagcagg

SEQ ID NO: 7818 - RNA, 17 nt, Homo sapiens
ugaugucagcaggccca

SEQ ID NO: 7819 - RNA, 17 nt, Homo sapiens
gucagcaggcccaguuu

SEQ ID NO: 7820 - RNA, 17 nt, Homo sapiens
caggcccaguuucugcc

SEQ ID NO: 7821 - RNA, 17 nt, Homo sapiens
caguuucugccauucca

SEQ ID NO: 7822 - RNA, 17 nt, Homo sapiens
ccauuccagcugugggc

SEQ ID NO: 7823 - RNA, 17 nt, Homo sapiens
uuccagcugugggcacg

SEQ ID NO: 7824 - RNA, 17 nt, Homo sapiens
agcugugggcacgucag

SEQ ID NO: 7825 - RNA, 17 nt, Homo sapiens
gugggcacgucagcgaa

SEQ ID NO: 7826 - RNA, 17 nt, Homo sapiens
gcacgucagcgaaggca

SEQ ID NO: 7827 - RNA, 17 nt, Homo sapiens
cagcgaaggcaagcgca

SEQ ID NO: 7828 - RNA, 17 nt, Homo sapiens
gaaggcaagcgcagguu

SEQ ID NO: 7829 - RNA, 17 nt, Homo sapiens
aggcaagcgcagguuca

SEQ ID NO: 7830 - RNA, 17 nt, Homo sapiens
aagcgcagguucaccua

SEQ ID NO: 7831 - RNA, 17 nt, Homo sapiens
caccuacgaccacgcug

SEQ ID NO: 7832 - RNA, 17 nt, Homo sapiens
acgaccacgcugagcug

SEQ ID NO: 7833 - RNA, 17 nt, Homo sapiens
cacgcugagcuggaaag

SEQ ID NO: 7834 - RNA, 17 nt, Homo sapiens
aaaggaaaaucgcgugc

SEQ ID NO: 7835 - RNA, 17 nt, Homo sapiens
ggaaaaucgcgugcugc

SEQ ID NO: 7836 - RNA, 17 nt, Homo sapiens
aaaaucgcgugcugcuc

SEQ ID NO: 7837 - RNA, 17 nt, Homo sapiens
aaucgcgugcugcuccc

SEQ ID NO: 7838 - RNA, 17 nt, Homo sapiens
cgcgugcugcuccccgc

SEQ ID NO: 7839 - RNA, 17 nt, Homo sapiens
ugcuccccgcccccaga

SEQ ID NO: 7840 - RNA, 17 nt, Homo sapiens
gcccccagacuacaacu

SEQ ID NO: 7841 - RNA, 17 nt, Homo sapiens
agacuacaacucggugg

SEQ ID NO: 7842 - RNA, 17 nt, Homo sapiens
acaacucggugguccug

SEQ ID NO: 7843 - RNA, 17 nt, Homo sapiens
acucggugguccuguac

SEQ ID NO: 7844 - RNA, 17 nt, Homo sapiens
gugguccuguacuccac

SEQ ID NO: 7845 - RNA, 17 nt, Homo sapiens
caucuagaguuugacac

SEQ ID NO: 7846 - RNA, 17 nt, Homo sapiens
agaguuugacacgaagc

SEQ ID NO: 7847 - RNA, 17 nt, Homo sapiens
gacacgaagccuuauuu

SEQ ID NO: 7848 - RNA, 17 nt, Homo sapiens
uucuagaagcacaugug

SEQ ID NO: 7849 - RNA, 17 nt, Homo sapiens
aagcacauguguauuua

SEQ ID NO: 7850 - RNA, 17 nt, Homo sapiens
gcacauguguauuuaua

SEQ ID NO: 7851 - RNA, 17 nt, Homo sapiens
cccaggaaacuagcuuu

SEQ ID NO: 7852 - RNA, 17 nt, Homo sapiens
ggaaacuagcuuuugcc

SEQ ID NO: 7853 - RNA, 17 nt, Homo sapiens
uagcuuuugccaguauu

SEQ ID NO: 7854 - RNA, 17 nt, Homo sapiens
uuuugccaguauuaugc

SEQ ID NO: 7855 - RNA, 17 nt, Homo sapiens
aguauuaugcauauaua

SEQ ID NO: 7856 - RNA, 17 nt, Homo sapiens
auauauaaguuuacacc

SEQ ID NO: 7857 - RNA, 17 nt, Homo sapiens
ccaugggagccagcugc

SEQ ID NO: 7858 - RNA, 17 nt, Homo sapiens
gggagccagcugcuuuu

SEQ ID NO: 7859 - RNA, 17 nt, Homo sapiens
agccagcugcuuuuugu

SEQ ID NO: 7860 - RNA, 17 nt, Homo sapiens
ugcuuuuugugauuuuu

SEQ ID NO: 7861 - RNA, 17 nt, Homo sapiens
uuuuugugauuuuuuua

SEQ ID NO: 7862 - RNA, 17 nt, Homo sapiens
uuuuuuuaauagugcuu

SEQ ID NO: 7863 - RNA, 17 nt, Homo sapiens
uuuuaauagugcuuuuu

SEQ ID NO: 7864 - RNA, 17 nt, Homo sapiens
uuaauagugcuuuuuuu

SEQ ID NO: 7865 - RNA, 17 nt, Homo sapiens
uuuuuuugacuaacaag

SEQ ID NO: 7866 - RNA, 17 nt, Homo sapiens
uuugacuaacaagaaug

SEQ ID NO: 7867 - RNA, 17 nt, Homo sapiens
uaacaagaauguaacuc

SEQ ID NO: 7868 - RNA, 17 nt, Homo sapiens
acaagaauguaacucca

SEQ ID NO: 7869 - RNA, 17 nt, Homo sapiens
agaauguaacuccagau

SEQ ID NO: 7870 - RNA, 17 nt, Homo sapiens
aacuccagauagagaaa

SEQ ID NO: 7871 - RNA, 17 nt, Homo sapiens
auagagaaauagugaca

SEQ ID NO: 7872 - RNA, 17 nt, Homo sapiens
gagaaauagugacaagu

SEQ ID NO: 7873 - RNA, 17 nt, Homo sapiens
aaauagugacaagugaa

SEQ ID NO: 7874 - RNA, 17 nt, Homo sapiens
agugacaagugaagaac

SEQ ID NO: 7875 - RNA, 17 nt, Homo sapiens
agugaagaacacuacug

SEQ ID NO: 7876 - RNA, 17 nt, Homo sapiens
acacuacugcuaaaucc

SEQ ID NO: 7877 - RNA, 17 nt, Homo sapiens
acugcuaaauccucaug

SEQ ID NO: 7878 - RNA, 17 nt, Homo sapiens
auccucauguuacucag

SEQ ID NO: 7879 - RNA, 17 nt, Homo sapiens
guuacucaguguuagag

SEQ ID NO: 7880 - RNA, 17 nt, Homo sapiens
uacucaguguuagagaa

SEQ ID NO: 7881 - RNA, 17 nt, Homo sapiens
uuagagaaauccuuccu

SEQ ID NO: 7882 - RNA, 17 nt, Homo sapiens
cuuccuaaacccaauga

SEQ ID NO: 7883 - RNA, 17 nt, Homo sapiens
uaaacccaaugacuucc

SEQ ID NO: 7884 - RNA, 17 nt, Homo sapiens
acccaaugacuucccug

SEQ ID NO: 7885 - RNA, 17 nt, Homo sapiens
acuucccugcuccaacc

SEQ ID NO: 7886 - RNA, 17 nt, Homo sapiens
cugcuccaacccccgcc

SEQ ID NO: 7887 - RNA, 17 nt, Homo sapiens
caacccccgccaccuca

SEQ ID NO: 7888 - RNA, 17 nt, Homo sapiens
accucagggcacgcagg

SEQ ID NO: 7889 - RNA, 17 nt, Homo sapiens
cagggcacgcaggacca

SEQ ID NO: 7890 - RNA, 17 nt, Homo sapiens
cacgcaggaccaguuug

SEQ ID NO: 7891 - RNA, 17 nt, Homo sapiens
caggaccaguuugauug

SEQ ID NO: 7892 - RNA, 17 nt, Homo sapiens
ccaguuugauugaggag

SEQ ID NO: 7893 - RNA, 17 nt, Homo sapiens
auugaggagcugcacug

SEQ ID NO: 7894 - RNA, 17 nt, Homo sapiens
gaggagcugcacugauc

SEQ ID NO: 7895 - RNA, 17 nt, Homo sapiens
cugcacugaucacccaa

SEQ ID NO: 7896 - RNA, 17 nt, Homo sapiens
aucacccaaugcaucac

SEQ ID NO: 7897 - RNA, 17 nt, Homo sapiens
cacccaaugcaucacgu

SEQ ID NO: 7898 - RNA, 17 nt, Homo sapiens
ugcaucacguaccccac

SEQ ID NO: 7899 - RNA, 17 nt, Homo sapiens
cccacugggccagcccu

SEQ ID NO: 7900 - RNA, 17 nt, Homo sapiens
cugggccagcccugcag

SEQ ID NO: 7901 - RNA, 17 nt, Homo sapiens
ccagcccugcagcccaa

SEQ ID NO: 7902 - RNA, 17 nt, Homo sapiens
gcccugcagcccaaaac

SEQ ID NO: 7903 - RNA, 17 nt, Homo sapiens
agcccaaaacccagggc

SEQ ID NO: 7904 - RNA, 17 nt, Homo sapiens
aacccagggcaacaagc

SEQ ID NO: 7905 - RNA, 17 nt, Homo sapiens
ccagggcaacaagcccg

SEQ ID NO: 7906 - RNA, 17 nt, Homo sapiens
ggcaacaagcccguuag

SEQ ID NO: 7907 - RNA, 17 nt, Homo sapiens
acaagcccguuagcccc

SEQ ID NO: 7908 - RNA, 17 nt, Homo sapiens
gcccguuagccccaggg

SEQ ID NO: 7909 - RNA, 17 nt, Homo sapiens
cccaggggaucacuggc

SEQ ID NO: 7910 - RNA, 17 nt, Homo sapiens
gaucacuggcuggccug

SEQ ID NO: 7911 - RNA, 17 nt, Homo sapiens
acuggcuggccugagca

SEQ ID NO: 7912 - RNA, 17 nt, Homo sapiens
uggccugagcaacaucu

SEQ ID NO: 7913 - RNA, 17 nt, Homo sapiens
ccugagcaacaucucgg

SEQ ID NO: 7914 - RNA, 17 nt, Homo sapiens
ucucgggaguccucuag

SEQ ID NO: 7915 - RNA, 17 nt, Homo sapiens
guccucuagcaggccua

SEQ ID NO: 7916 - RNA, 17 nt, Homo sapiens
ucuagcaggccuaagac

SEQ ID NO: 7917 - RNA, 17 nt, Homo sapiens
ggccuaagacaugugag

SEQ ID NO: 7918 - RNA, 17 nt, Homo sapiens
uaagacaugugaggagg

SEQ ID NO: 7919 - RNA, 17 nt, Homo sapiens
gaaaaaaagcaaaaagc

SEQ ID NO: 7920 - RNA, 17 nt, Homo sapiens
agcaaaaagcaagggag

SEQ ID NO: 7921 - RNA, 17 nt, Homo sapiens
aaagagaaaccgggaga

SEQ ID NO: 7922 - RNA, 17 nt, Homo sapiens
gggagaaggcaugagaa

SEQ ID NO: 7923 - RNA, 17 nt, Homo sapiens
gagaaagaauuugagac

SEQ ID NO: 7924 - RNA, 17 nt, Homo sapiens
aauuugagacgcaccau

SEQ ID NO: 7925 - RNA, 17 nt, Homo sapiens
uuugagacgcaccaugu

SEQ ID NO: 7926 - RNA, 17 nt, Homo sapiens
cgcaccaugugggcacg

SEQ ID NO: 7927 - RNA, 17 nt, Homo sapiens
ccaugugggcacggagg

SEQ ID NO: 7928 - RNA, 17 nt, Homo sapiens
ggagggggacggggcuc

SEQ ID NO: 7929 - RNA, 17 nt, Homo sapiens
gggacggggcucagcaa

SEQ ID NO: 7930 - RNA, 17 nt, Homo sapiens
ggggcucagcaaugcca

SEQ ID NO: 7931 - RNA, 17 nt, Homo sapiens
gcucagcaaugccauuu

SEQ ID NO: 7932 - RNA, 17 nt, Homo sapiens
ucagcaaugccauuuca

SEQ ID NO: 7933 - RNA, 17 nt, Homo sapiens
ccauuucaguggcuucc

SEQ ID NO: 7934 - RNA, 17 nt, Homo sapiens
uuucaguggcuucccag

SEQ ID NO: 7935 - RNA, 17 nt, Homo sapiens
gcuucccagcucugacc

SEQ ID NO: 7936 - RNA, 17 nt, Homo sapiens
cagcucugacccuucua

SEQ ID NO: 7937 - RNA, 17 nt, Homo sapiens
auuugagggcccagcca

SEQ ID NO: 7938 - RNA, 17 nt, Homo sapiens
agggcccagccaggagc

SEQ ID NO: 7939 - RNA, 17 nt, Homo sapiens
agccaggagcagaugga

SEQ ID NO: 7940 - RNA, 17 nt, Homo sapiens
aggagcagauggacagc

SEQ ID NO: 7941 - RNA, 17 nt, Homo sapiens
gcagauggacagcgaug

SEQ ID NO: 7942 - RNA, 17 nt, Homo sapiens
gauggacagcgaugagg

SEQ ID NO: 7943 - RNA, 17 nt, Homo sapiens
ggacagcgaugagggga

SEQ ID NO: 7944 - RNA, 17 nt, Homo sapiens
augaggggacauuuucu

SEQ ID NO: 7945 - RNA, 17 nt, Homo sapiens
uuuucuggauucuggga

SEQ ID NO: 7946 - RNA, 17 nt, Homo sapiens
ucugggaggcaagaaaa

SEQ ID NO: 7947 - RNA, 17 nt, Homo sapiens
agaaaaggacaaauauc

SEQ ID NO: 7948 - RNA, 17 nt, Homo sapiens
aaggacaaauaucuuuu

SEQ ID NO: 7949 - RNA, 17 nt, Homo sapiens
uuuuuggaacuaaagca

SEQ ID NO: 7950 - RNA, 17 nt, Homo sapiens
gaacuaaagcaaauuuu

SEQ ID NO: 7951 - RNA, 17 nt, Homo sapiens
uaaagcaaauuuuagac

SEQ ID NO: 7952 - RNA, 17 nt, Homo sapiens
aauuuuagaccuuuacc

SEQ ID NO: 7953 - RNA, 17 nt, Homo sapiens
cuauggaagugguucua

SEQ ID NO: 7954 - RNA, 17 nt, Homo sapiens
uggaagugguucuaugu

SEQ ID NO: 7955 - RNA, 17 nt, Homo sapiens
gguucuauguccauucu

SEQ ID NO: 7956 - RNA, 17 nt, Homo sapiens
ucucauucguggcaugu

SEQ ID NO: 7957 - RNA, 17 nt, Homo sapiens
cauucguggcauguuuu

SEQ ID NO: 7958 - RNA, 17 nt, Homo sapiens
cguggcauguuuugauu

SEQ ID NO: 7959 - RNA, 17 nt, Homo sapiens
auguuuugauuuguagc

SEQ ID NO: 7960 - RNA, 17 nt, Homo sapiens
uuugauuuguagcacug

SEQ ID NO: 7961 - RNA, 17 nt, Homo sapiens
gauuuguagcacugagg

SEQ ID NO: 7962 - RNA, 17 nt, Homo sapiens
cacugaggguggcacuc

SEQ ID NO: 7963 - RNA, 17 nt, Homo sapiens
ugaggguggcacucaac

SEQ ID NO: 7964 - RNA, 17 nt, Homo sapiens
ggcacucaacucugagc

SEQ ID NO: 7965 - RNA, 17 nt, Homo sapiens
aacucugagcccauacu

SEQ ID NO: 7966 - RNA, 17 nt, Homo sapiens
uacuuuuggcuccucua

SEQ ID NO: 7967 - RNA, 17 nt, Homo sapiens
cuccucuaguaagaugc

SEQ ID NO: 7968 - RNA, 17 nt, Homo sapiens
cuaguaagaugcacuga

SEQ ID NO: 7969 - RNA, 17 nt, Homo sapiens
aguaagaugcacugaaa

SEQ ID NO: 7970 - RNA, 17 nt, Homo sapiens
cacugaaaacuuagcca

SEQ ID NO: 7971 - RNA, 17 nt, Homo sapiens
aaaacuuagccagaguu

SEQ ID NO: 7972 - RNA, 17 nt, Homo sapiens
uagccagaguuagguug

SEQ ID NO: 7973 - RNA, 17 nt, Homo sapiens
agaguuagguugucucc

SEQ ID NO: 7974 - RNA, 17 nt, Homo sapiens
guuagguugucuccagg

SEQ ID NO: 7975 - RNA, 17 nt, Homo sapiens
gucuccaggccaugaug

SEQ ID NO: 7976 - RNA, 17 nt, Homo sapiens
aggccaugauggccuua

SEQ ID NO: 7977 - RNA, 17 nt, Homo sapiens
ccaugauggccuuacac

SEQ ID NO: 7978 - RNA, 17 nt, Homo sapiens
cacugaaaaugucacau

SEQ ID NO: 7979 - RNA, 17 nt, Homo sapiens
cugaaaaugucacauuc

SEQ ID NO: 7980 - RNA, 17 nt, Homo sapiens
uauuuuggguauuaaua

SEQ ID NO: 7981 - RNA, 17 nt, Homo sapiens
ggguauuaauauauagu

SEQ ID NO: 7982 - RNA, 17 nt, Homo sapiens
aauauauaguccagaca

SEQ ID NO: 7983 - RNA, 17 nt, Homo sapiens
uaguccagacacuuaac

SEQ ID NO: 7984 - RNA, 17 nt, Homo sapiens
gacacuuaacucaauuu

SEQ ID NO: 7985 - RNA, 17 nt, Homo sapiens
uuaacucaauuucuugg

SEQ ID NO: 7986 - RNA, 17 nt, Homo sapiens
auuucuugguauuauuc

SEQ ID NO: 7987 - RNA, 17 nt, Homo sapiens
auuauucuguuuugcac

SEQ ID NO: 7988 - RNA, 17 nt, Homo sapiens
ucuguuuugcacaguua

SEQ ID NO: 7989 - RNA, 17 nt, Homo sapiens
uuugcacaguuaguugu

SEQ ID NO: 7990 - RNA, 17 nt, Homo sapiens
cacaguuaguugugaaa

SEQ ID NO: 7991 - RNA, 17 nt, Homo sapiens
aguuaguugugaaagaa

SEQ ID NO: 7992 - RNA, 17 nt, Homo sapiens
gaaagaaagcugagaag

SEQ ID NO: 7993 - RNA, 17 nt, Homo sapiens
ugagaagaaugaaaaug

SEQ ID NO: 7994 - RNA, 17 nt, Homo sapiens
gaaugaaaaugcagucc

SEQ ID NO: 7995 - RNA, 17 nt, Homo sapiens
augaaaaugcaguccug

SEQ ID NO: 7996 - RNA, 17 nt, Homo sapiens
aaaaugcaguccugagg

SEQ ID NO: 7997 - RNA, 17 nt, Homo sapiens
ugaggagaguuuucucc

SEQ ID NO: 7998 - RNA, 17 nt, Homo sapiens
auaucaaaacgagggcu

SEQ ID NO: 7999 - RNA, 17 nt, Homo sapiens
aaacgagggcugaugga

SEQ ID NO: 8000 - RNA, 17 nt, Homo sapiens
gagggcugauggaggaa

SEQ ID NO: 8001 - RNA, 17 nt, Homo sapiens
ggaaaaaggucaauaag

SEQ ID NO: 8002 - RNA, 17 nt, Homo sapiens
aaaggucaauaagguca

SEQ ID NO: 8003 - RNA, 17 nt, Homo sapiens
ucaauaaggucaaggga

SEQ ID NO: 8004 - RNA, 17 nt, Homo sapiens
aagggaagaccccgucu

SEQ ID NO: 8005 - RNA, 17 nt, Homo sapiens
aagaccccgucucuaua

SEQ ID NO: 8006 - RNA, 17 nt, Homo sapiens
cuauaccaaccaaacca

SEQ ID NO: 8007 - RNA, 17 nt, Homo sapiens
ccaaccaaaccaauuca

SEQ ID NO: 8008 - RNA, 17 nt, Homo sapiens
ccaaaccaauucaccaa

SEQ ID NO: 8009 - RNA, 17 nt, Homo sapiens
auucaccaacacaguug

SEQ ID NO: 8010 - RNA, 17 nt, Homo sapiens
ccaacacaguugggacc

SEQ ID NO: 8011 - RNA, 17 nt, Homo sapiens
caguugggacccaaaac

SEQ ID NO: 8012 - RNA, 17 nt, Homo sapiens
gacccaaaacacaggaa

SEQ ID NO: 8013 - RNA, 17 nt, Homo sapiens
cacaggaagucagucac

SEQ ID NO: 8014 - RNA, 17 nt, Homo sapiens
ggaagucagucacguuu

SEQ ID NO: 8015 - RNA, 17 nt, Homo sapiens
ucagucacguuuccuuu

SEQ ID NO: 8016 - RNA, 17 nt, Homo sapiens
uucauuuaauggggauu

SEQ ID NO: 8017 - RNA, 17 nt, Homo sapiens
uaauggggauuccacua

SEQ ID NO: 8018 - RNA, 17 nt, Homo sapiens
ucacacuaaucugaaag

SEQ ID NO: 8019 - RNA, 17 nt, Homo sapiens
cugaaaggauguggaag

SEQ ID NO: 8020 - RNA, 17 nt, Homo sapiens
gaaaggauguggaagag

SEQ ID NO: 8021 - RNA, 17 nt, Homo sapiens
guggaagagcauuagcu

SEQ ID NO: 8022 - RNA, 17 nt, Homo sapiens
gagcauuagcuggcgca

SEQ ID NO: 8023 - RNA, 17 nt, Homo sapiens
auuagcuggcgcauauu

SEQ ID NO: 8024 - RNA, 17 nt, Homo sapiens
uagcuggcgcauauuaa

SEQ ID NO: 8025 - RNA, 17 nt, Homo sapiens
cauauuaagcacuuuaa

SEQ ID NO: 8026 - RNA, 17 nt, Homo sapiens
cacuuuaagcuccuuga

SEQ ID NO: 8027 - RNA, 17 nt, Homo sapiens
cuccuugaguaaaaagg

SEQ ID NO: 8028 - RNA, 17 nt, Homo sapiens
guaaaaaggugguaugu

SEQ ID NO: 8029 - RNA, 17 nt, Homo sapiens
aaaaggugguauguaau

SEQ ID NO: 8030 - RNA, 17 nt, Homo sapiens
ggugguauguaauuuau

SEQ ID NO: 8031 - RNA, 17 nt, Homo sapiens
gguauguaauuuaugca

SEQ ID NO: 8032 - RNA, 17 nt, Homo sapiens
uaauuuaugcaagguau

SEQ ID NO: 8033 - RNA, 17 nt, Homo sapiens
uaugcaagguauuucuc

SEQ ID NO: 8034 - RNA, 17 nt, Homo sapiens
uuucuccaguugggacu

SEQ ID NO: 8035 - RNA, 17 nt, Homo sapiens
caguugggacucaggau

SEQ ID NO: 8036 - RNA, 17 nt, Homo sapiens
gacucaggauauuaguu

SEQ ID NO: 8037 - RNA, 17 nt, Homo sapiens
ggauauuaguuaaugag

SEQ ID NO: 8038 - RNA, 17 nt, Homo sapiens
auuaguuaaugagccau

SEQ ID NO: 8039 - RNA, 17 nt, Homo sapiens
guuaaugagccaucacu

SEQ ID NO: 8040 - RNA, 17 nt, Homo sapiens
gaagaaaagcccauuuu

SEQ ID NO: 8041 - RNA, 17 nt, Homo sapiens
cauuuucaacugcuuug

SEQ ID NO: 8042 - RNA, 17 nt, Homo sapiens
uuucaacugcuuugaaa

SEQ ID NO: 8043 - RNA, 17 nt, Homo sapiens
gcuuugaaacuugccug

SEQ ID NO: 8044 - RNA, 17 nt, Homo sapiens
ugaaacuugccuggggu

SEQ ID NO: 8045 - RNA, 17 nt, Homo sapiens
ugccuggggucugagca

SEQ ID NO: 8046 - RNA, 17 nt, Homo sapiens
gggucugagcaugaugg

SEQ ID NO: 8047 - RNA, 17 nt, Homo sapiens
ugagcaugaugggaaua

SEQ ID NO: 8048 - RNA, 17 nt, Homo sapiens
ugaugggaauagggaga

SEQ ID NO: 8049 - RNA, 17 nt, Homo sapiens
auagggagacaggguag

SEQ ID NO: 8050 - RNA, 17 nt, Homo sapiens
gagacaggguaggaaag

SEQ ID NO: 8051 - RNA, 17 nt, Homo sapiens
aggaaagggcgccuacu

SEQ ID NO: 8052 - RNA, 17 nt, Homo sapiens
gaaagggcgccuacucu

SEQ ID NO: 8053 - RNA, 17 nt, Homo sapiens
ucuucagggucuaaaga

SEQ ID NO: 8054 - RNA, 17 nt, Homo sapiens
gucuaaagaucaagugg

SEQ ID NO: 8055 - RNA, 17 nt, Homo sapiens
aagaucaagugggccuu

SEQ ID NO: 8056 - RNA, 17 nt, Homo sapiens
ucaagugggccuuggau

SEQ ID NO: 8057 - RNA, 17 nt, Homo sapiens
ggccuuggaucgcuaag

SEQ ID NO: 8058 - RNA, 17 nt, Homo sapiens
cuuggaucgcuaagcug

SEQ ID NO: 8059 - RNA, 17 nt, Homo sapiens
aucgcuaagcuggcucu

SEQ ID NO: 8060 - RNA, 17 nt, Homo sapiens
cuaagcuggcucuguuu

SEQ ID NO: 8061 - RNA, 17 nt, Artificial Sequence
  Description of Artificial Sequence:  Enzymatic Nucleic Acid
cuggcucuguuugaugc

SEQ ID NO: 8062 - RNA, 17 nt, Homo sapiens
ucuguuugaugcuauuu

SEQ ID NO: 8063 - RNA, 17 nt, Homo sapiens
uguuugaugcuauuuau

SEQ ID NO: 8064 - RNA, 17 nt, Homo sapiens
cuauuuaugcaaguuag

SEQ ID NO: 8065 - RNA, 17 nt, Homo sapiens
uuaugcaaguuaggguc

SEQ ID NO: 8066 - RNA, 17 nt, Homo sapiens
aaguuagggucuaugua

SEQ ID NO: 8067 - RNA, 17 nt, Homo sapiens
gggucuauguauuuagg

SEQ ID NO: 8068 - RNA, 17 nt, Homo sapiens
uauuuaggaugcgccua

SEQ ID NO: 8069 - RNA, 17 nt, Homo sapiens
uuuaggaugcgccuacu

SEQ ID NO: 8070 - RNA, 17 nt, Homo sapiens
uaggaugcgccuacucu

SEQ ID NO: 8071 - RNA, 17 nt, Homo sapiens
uauuuaggaugucugca

SEQ ID NO: 8072 - RNA, 17 nt, Homo sapiens
uuuaggaugucugcacc

SEQ ID NO: 8073 - RNA, 17 nt, Homo sapiens
ggaugucugcaccuucu

SEQ ID NO: 8074 - RNA, 17 nt, Homo sapiens
caccuucugcagccagu

SEQ ID NO: 8075 - RNA, 17 nt, Homo sapiens
cuucugcagccagucag

SEQ ID NO: 8076 - RNA, 17 nt, Homo sapiens
ugcagccagucagaagc

SEQ ID NO: 8077 - RNA, 17 nt, Homo sapiens
agucagaagcuggagag

SEQ ID NO: 8078 - RNA, 17 nt, Homo sapiens
cuggagaggcaacagug

SEQ ID NO: 8079 - RNA, 17 nt, Homo sapiens
gagaggcaacaguggau

SEQ ID NO: 8080 - RNA, 17 nt, Homo sapiens
aggcaacaguggauugc

SEQ ID NO: 8081 - RNA, 17 nt, Homo sapiens
aacaguggauugcugcu

SEQ ID NO: 8082 - RNA, 17 nt, Homo sapiens
aguggauugcugcuucu

SEQ ID NO: 8083 - RNA, 17 nt, Homo sapiens
ggauugcugcuucuugg

SEQ ID NO: 8084 - RNA, 17 nt, Homo sapiens
ggagaagaguaugcuuc

SEQ ID NO: 8085 - RNA, 17 nt, Homo sapiens
aagaguaugcuuccuuu

SEQ ID NO: 8086 - RNA, 17 nt, Homo sapiens
uuauccauguaauuuaa

SEQ ID NO: 8087 - RNA, 17 nt, Homo sapiens
uccauguaauuuaacug

SEQ ID NO: 8088 - RNA, 17 nt, Homo sapiens
guaauuuaacuguagaa

SEQ ID NO: 8089 - RNA, 17 nt, Homo sapiens
auuuaacuguagaaccu

SEQ ID NO: 8090 - RNA, 17 nt, Homo sapiens
acuguagaaccugagcu

SEQ ID NO: 8091 - RNA, 17 nt, Homo sapiens
gaaccugagcucuaagu

SEQ ID NO: 8092 - RNA, 17 nt, Homo sapiens
agcucuaaguaaccgaa

SEQ ID NO: 8093 - RNA, 17 nt, Homo sapiens
ucuaaguaaccgaagaa

SEQ ID NO: 8094 - RNA, 17 nt, Homo sapiens
accgaagaauguaugcc

SEQ ID NO: 8095 - RNA, 17 nt, Homo sapiens
cgaagaauguaugccuc

SEQ ID NO: 8096 - RNA, 17 nt, Homo sapiens
gaauguaugccucuguu

SEQ ID NO: 8097 - RNA, 17 nt, Homo sapiens
augccucuguucuuaug

SEQ ID NO: 8098 - RNA, 17 nt, Homo sapiens
guucuuaugugccacau

SEQ ID NO: 8099 - RNA, 17 nt, Homo sapiens
ucuuaugugccacaucc

SEQ ID NO: 8100 - RNA, 17 nt, Homo sapiens
acauccuuguuuaaagg

SEQ ID NO: 8101 - RNA, 17 nt, Homo sapiens
guuuaaaggcucucugu

SEQ ID NO: 8102 - RNA, 17 nt, Homo sapiens
ggcucucuguaugaaga

SEQ ID NO: 8103 - RNA, 17 nt, Homo sapiens
augaagagaugggaccg

SEQ ID NO: 8104 - RNA, 17 nt, Homo sapiens
gagaugggaccgucauc

SEQ ID NO: 8105 - RNA, 17 nt, Homo sapiens
augggaccgucaucagc

SEQ ID NO: 8106 - RNA, 17 nt, Homo sapiens
cgucaucagcacauucc

SEQ ID NO: 8107 - RNA, 17 nt, Homo sapiens
auucccuagugagccua

SEQ ID NO: 8108 - RNA, 17 nt, Homo sapiens
ccuagugagccuacugg

SEQ ID NO: 8109 - RNA, 17 nt, Homo sapiens
gccuacuggcuccuggc

SEQ ID NO: 8110 - RNA, 17 nt, Homo sapiens
ggcuccuggcagcggcu

SEQ ID NO: 8111 - RNA, 17 nt, Homo sapiens
uccuggcagcggcuuuu

SEQ ID NO: 8112 - RNA, 17 nt, Homo sapiens
uggcagcggcuuuugug

SEQ ID NO: 8113 - RNA, 17 nt, Homo sapiens
cggcuuuuguggaagac

SEQ ID NO: 8114 - RNA, 17 nt, Homo sapiens
uguggaagacucacuag

SEQ ID NO: 8115 - RNA, 17 nt, Homo sapiens
acucacuagccagaaga

SEQ ID NO: 8116 - RNA, 17 nt, Homo sapiens
agagaggagugggacag

SEQ ID NO: 8117 - RNA, 17 nt, Homo sapiens
ggagugggacaguccuc

SEQ ID NO: 8118 - RNA, 17 nt, Homo sapiens
gugggacaguccucucc

SEQ ID NO: 8119 - RNA, 17 nt, Homo sapiens
ccaccaagaucuaaauc

SEQ ID NO: 8120 - RNA, 17 nt, Homo sapiens
agaucuaaauccaaaca

SEQ ID NO: 8121 - RNA, 17 nt, Homo sapiens
aaauccaaacaaaagca

SEQ ID NO: 8122 - RNA, 17 nt, Homo sapiens
aaacaaaagcaggcuag

SEQ ID NO: 8123 - RNA, 17 nt, Homo sapiens
aaaagcaggcuagagcc

SEQ ID NO: 8124 - RNA, 17 nt, Homo sapiens
aggcuagagccagaaga

SEQ ID NO: 8125 - RNA, 17 nt, Homo sapiens
aagagaggacaaaucuu

SEQ ID NO: 8126 - RNA, 17 nt, Homo sapiens
gaggacaaaucuuuguu

SEQ ID NO: 8127 - RNA, 17 nt, Homo sapiens
aaaucuuuguuguuccu

SEQ ID NO: 8128 - RNA, 17 nt, Homo sapiens
ucuuuguuguuccucuu

SEQ ID NO: 8129 - RNA, 17 nt, Homo sapiens
acacauacgcaaaccac

SEQ ID NO: 8130 - RNA, 17 nt, Homo sapiens
auacgcaaaccaccugu

SEQ ID NO: 8131 - RNA, 17 nt, Homo sapiens
aaccaccugugacagcu

SEQ ID NO: 8132 - RNA, 17 nt, Homo sapiens
caccugugacagcuggc

SEQ ID NO: 8133 - RNA, 17 nt, Homo sapiens
cugugacagcuggcaau

SEQ ID NO: 8134 - RNA, 17 nt, Homo sapiens
gacagcuggcaauuuua

SEQ ID NO: 8135 - RNA, 17 nt, Homo sapiens
agcuggcaauuuuauaa

SEQ ID NO: 8136 - RNA, 17 nt, Homo sapiens
uuuuauaaaucagguaa

SEQ ID NO: 8137 - RNA, 17 nt, Homo sapiens
uaaaucagguaacugga

SEQ ID NO: 8138 - RNA, 17 nt, Homo sapiens
aucagguaacuggaagg

SEQ ID NO: 8139 - RNA, 17 nt, Homo sapiens
ggaaggagguuaaacuc

SEQ ID NO: 8140 - RNA, 17 nt, Homo sapiens
gagguuaaacucagaaa

SEQ ID NO: 8141 - RNA, 17 nt, Homo sapiens
aaaagaagaccucaguc

SEQ ID NO: 8142 - RNA, 17 nt, Homo sapiens
agaccucagucaauucu

SEQ ID NO: 8143 - RNA, 17 nt, Homo sapiens
cucagucaauucucuac

SEQ ID NO: 8144 - RNA, 17 nt, Homo sapiens
uuuuccaaaucagauaa

SEQ ID NO: 8145 - RNA, 17 nt, Homo sapiens
caaaucagauaauagcc

SEQ ID NO: 8146 - RNA, 17 nt, Homo sapiens
aucagauaauagcccag

SEQ ID NO: 8147 - RNA, 17 nt, Homo sapiens
agauaauagcccagcaa

SEQ ID NO: 8148 - RNA, 17 nt, Homo sapiens
auagcccagcaaauagu

SEQ ID NO: 8149 - RNA, 17 nt, Homo sapiens
cccagcaaauagugaua

SEQ ID NO: 8150 - RNA, 17 nt, Homo sapiens
agcaaauagugauaaca

SEQ ID NO: 8151 - RNA, 17 nt, Homo sapiens
aaauagugauaacaaau

SEQ ID NO: 8152 - RNA, 17 nt, Homo sapiens
uagugauaacaaauaaa

SEQ ID NO: 8153 - RNA, 17 nt, Homo sapiens
gauaacaaauaaaaccu

SEQ ID NO: 8154 - RNA, 17 nt, Homo sapiens
caaauaaaaccuuagcu

SEQ ID NO: 8155 - RNA, 17 nt, Homo sapiens
aaaccuuagcuguucau

SEQ ID NO: 8156 - RNA, 17 nt, Homo sapiens
ccuuagcuguucauguc

SEQ ID NO: 8157 - RNA, 17 nt, Homo sapiens
cuguucaugucuugauu

SEQ ID NO: 8158 - RNA, 17 nt, Homo sapiens
augucuugauuucaaua

SEQ ID NO: 8159 - RNA, 17 nt, Homo sapiens
ugauuucaauaauuaau

SEQ ID NO: 8160 - RNA, 17 nt, Homo sapiens
uuucaauaauuaauucu

SEQ ID NO: 8161 - RNA, 17 nt, Homo sapiens
aauaauuaauucuuaau

SEQ ID NO: 8162 - RNA, 17 nt, Homo sapiens
aauucuuaaucauuaag

SEQ ID NO: 8163 - RNA, 17 nt, Homo sapiens
auuaagagaccauaaua

SEQ ID NO: 8164 - RNA, 17 nt, Homo sapiens
agaccauaauaaauacu

SEQ ID NO: 8165 - RNA, 17 nt, Homo sapiens
cauaauaaauacuccuu

SEQ ID NO: 8166 - RNA, 17 nt, Homo sapiens
agagaaaagcaaaacca

SEQ ID NO: 8167 - RNA, 17 nt, Homo sapiens
aaagcaaaaccauuaga

SEQ ID NO: 8168 - RNA, 17 nt, Homo sapiens
ccauuagaauuguuacu

SEQ ID NO: 8169 - RNA, 17 nt, Homo sapiens
uuagaauuguuacucag

SEQ ID NO: 8170 - RNA, 17 nt, Homo sapiens
guuacucagcuccuuca

SEQ ID NO: 8171 - RNA, 17 nt, Homo sapiens
uccuucaaacucagguu

SEQ ID NO: 8172 - RNA, 17 nt, Homo sapiens
aaacucagguuuguagc

SEQ ID NO: 8173 - RNA, 17 nt, Homo sapiens
ucagguuuguagcauac

SEQ ID NO: 8174 - RNA, 17 nt, Homo sapiens
gguuuguagcauacaug

SEQ ID NO: 8175 - RNA, 17 nt, Homo sapiens
auacaugaguccaucca

SEQ ID NO: 8176 - RNA, 17 nt, Homo sapiens
auccaucagucaaagaa

SEQ ID NO: 8177 - RNA, 17 nt, Homo sapiens
gucaaagaaugguucca

SEQ ID NO: 8178 - RNA, 17 nt, Homo sapiens
aaagaaugguuccaucu

SEQ ID NO: 8179 - RNA, 17 nt, Homo sapiens
caucuggagucuuaaug

SEQ ID NO: 8180 - RNA, 17 nt, Homo sapiens
gagucuuaauguagaaa

SEQ ID NO: 8181 - RNA, 17 nt, Homo sapiens
gucuuaauguagaaaga

SEQ ID NO: 8182 - RNA, 17 nt, Homo sapiens
aaagaaaaauggagacu

SEQ ID NO: 8183 - RNA, 17 nt, Homo sapiens
aaauggagacuuguaau

SEQ ID NO: 8184 - RNA, 17 nt, Homo sapiens
ggagacuuguaauaaug

SEQ ID NO: 8185 - RNA, 17 nt, Homo sapiens
gacuuguaauaaugagc

SEQ ID NO: 8186 - RNA, 17 nt, Homo sapiens
uuguaauaaugagcuag

SEQ ID NO: 8187 - RNA, 17 nt, Homo sapiens
aauaaugagcuaguuac

SEQ ID NO: 8188 - RNA, 17 nt, Homo sapiens
augagcuaguuacaaag

SEQ ID NO: 8189 - RNA, 17 nt, Homo sapiens
guuacaaagugcuuguu

SEQ ID NO: 8190 - RNA, 17 nt, Homo sapiens
uacaaagugcuuguuca

SEQ ID NO: 8191 - RNA, 17 nt, Homo sapiens
aagugcuuguucauuaa

SEQ ID NO: 8192 - RNA, 17 nt, Homo sapiens
ucauuaaaauagcacug

SEQ ID NO: 8193 - RNA, 17 nt, Homo sapiens
uuaaaauagcacugaaa

SEQ ID NO: 8194 - RNA, 17 nt, Homo sapiens
cacugaaaauugaaaca

SEQ ID NO: 8195 - RNA, 17 nt, Homo sapiens
aaauugaaacaugaauu

SEQ ID NO: 8196 - RNA, 17 nt, Homo sapiens
aaacaugaauuaacuga

SEQ ID NO: 8197 - RNA, 17 nt, Homo sapiens
augaauuaacugauaau

SEQ ID NO: 8198 - RNA, 17 nt, Homo sapiens
auuaacugauaauauuc

SEQ ID NO: 8199 - RNA, 17 nt, Homo sapiens
aacugauaauauuccaa

SEQ ID NO: 8200 - RNA, 17 nt, Homo sapiens
auauuccaaucauuugc

SEQ ID NO: 8201 - RNA, 17 nt, Homo sapiens
aaucauuugccauuuau

SEQ ID NO: 8202 - RNA, 17 nt, Homo sapiens
cauuuaugacaaaaaug

SEQ ID NO: 8203 - RNA, 17 nt, Homo sapiens
ugacaaaaaugguuggc

SEQ ID NO: 8204 - RNA, 17 nt, Homo sapiens
caaaaaugguuggcacu

SEQ ID NO: 8205 - RNA, 17 nt, Homo sapiens
aaugguuggcacuaaca

SEQ ID NO: 8206 - RNA, 17 nt, Homo sapiens
uggcacuaacaaagaac

SEQ ID NO: 8207 - RNA, 17 nt, Homo sapiens
aacaaagaacgagcacu

SEQ ID NO: 8208 - RNA, 17 nt, Homo sapiens
aagaacgagcacuuccu

SEQ ID NO: 8209 - RNA, 17 nt, Homo sapiens
cuuucagaguuucugag

SEQ ID NO: 8210 - RNA, 17 nt, Homo sapiens
uuucugagauaauguac

SEQ ID NO: 8211 - RNA, 17 nt, Homo sapiens
cugagauaauguacgug

SEQ ID NO: 8212 - RNA, 17 nt, Homo sapiens
gagauaauguacgugga

SEQ ID NO: 8213 - RNA, 17 nt, Homo sapiens
uaauguacguggaacag

SEQ ID NO: 8214 - RNA, 17 nt, Homo sapiens
uacguggaacagucugg

SEQ ID NO: 8215 - RNA, 17 nt, Homo sapiens
guggaacagucugggug

SEQ ID NO: 8216 - RNA, 17 nt, Homo sapiens
cagucuggguggaaugg

SEQ ID NO: 8217 - RNA, 17 nt, Homo sapiens
uggguggaauggggcug

SEQ ID NO: 8218 - RNA, 17 nt, Homo sapiens
ggaauggggcugaaacc

SEQ ID NO: 8219 - RNA, 17 nt, Homo sapiens
gggcugaaaccaugugc

SEQ ID NO: 8220 - RNA, 17 nt, Homo sapiens
gaaaccaugugcaaguc

SEQ ID NO: 8221 - RNA, 17 nt, Homo sapiens
aaccaugugcaagucug

SEQ ID NO: 8222 - RNA, 17 nt, Homo sapiens
augugcaagucuguguc

SEQ ID NO: 8223 - RNA, 17 nt, Homo sapiens
gcaagucugugucuugu

SEQ ID NO: 8224 - RNA, 17 nt, Homo sapiens
aagucugugucuuguca

SEQ ID NO: 8225 - RNA, 17 nt, Homo sapiens
ugugucuugucagucca

SEQ ID NO: 8226 - RNA, 17 nt, Homo sapiens
ucuugucaguccaagaa

SEQ ID NO: 8227 - RNA, 17 nt, Homo sapiens
uccaagaagugacaccg

SEQ ID NO: 8228 - RNA, 17 nt, Homo sapiens
aagaagugacaccgaga

SEQ ID NO: 8229 - RNA, 17 nt, Homo sapiens
acaccgagauguuaauu

SEQ ID NO: 8230 - RNA, 17 nt, Homo sapiens
accgagauguuaauuuu

SEQ ID NO: 8231 - RNA, 17 nt, Homo sapiens
agauguuaauuuuaggg

SEQ ID NO: 8232 - RNA, 17 nt, Homo sapiens
uuuuagggacccgugcc

SEQ ID NO: 8233 - RNA, 17 nt, Homo sapiens
agggacccgugccuugu

SEQ ID NO: 8234 - RNA, 17 nt, Homo sapiens
ggacccgugccuuguuu

SEQ ID NO: 8235 - RNA, 17 nt, Homo sapiens
cgugccuuguuuccuag

SEQ ID NO: 8236 - RNA, 17 nt, Homo sapiens
guuuccuagcccacaag

SEQ ID NO: 8237 - RNA, 17 nt, Homo sapiens
ccacaagaaugcaaaca

SEQ ID NO: 8238 - RNA, 17 nt, Homo sapiens
acaagaaugcaaacauc

SEQ ID NO: 8239 - RNA, 17 nt, Homo sapiens
gaaugcaaacaucaaac

SEQ ID NO: 8240 - RNA, 17 nt, Homo sapiens
aacaucaaacagauacu

SEQ ID NO: 8241 - RNA, 17 nt, Homo sapiens
ucaaacagauacucgcu

SEQ ID NO: 8242 - RNA, 17 nt, Homo sapiens
agauacucgcuagccuc

SEQ ID NO: 8243 - RNA, 17 nt, Homo sapiens
acucgcuagccucauuu

SEQ ID NO: 8244 - RNA, 17 nt, Homo sapiens
ucauuuaaauugauuaa

SEQ ID NO: 8245 - RNA, 17 nt, Homo sapiens
uuaaauugauuaaagga

SEQ ID NO: 8246 - RNA, 17 nt, Homo sapiens
aaggaggagugcaucuu

SEQ ID NO: 8247 - RNA, 17 nt, Homo sapiens
ggaggagugcaucuuug

SEQ ID NO: 8248 - RNA, 17 nt, Homo sapiens
caucuuuggccgacagu

SEQ ID NO: 8249 - RNA, 17 nt, Homo sapiens
uuuggccgacaguggug

SEQ ID NO: 8250 - RNA, 17 nt, Homo sapiens
ggccgacagugguguaa

SEQ ID NO: 8251 - RNA, 17 nt, Homo sapiens
cgacagugguguaacug

SEQ ID NO: 8252 - RNA, 17 nt, Homo sapiens
acagugguguaacugug

SEQ ID NO: 8253 - RNA, 17 nt, Homo sapiens
gugguguaacugugugu

SEQ ID NO: 8254 - RNA, 17 nt, Homo sapiens
guguaacugugugugug

SEQ ID NO: 8255 - RNA, 17 nt, Homo sapiens
guaacugugugugugug

SEQ ID NO: 8256 - RNA, 17 nt, Homo sapiens
aacugugugugugugug

SEQ ID NO: 8257 - RNA, 17 nt, Homo sapiens
cugugugugugugugug

SEQ ID NO: 8258 - RNA, 17 nt, Homo sapiens
gugugugugugugugug

SEQ ID NO: 8259 - RNA, 17 nt, Homo sapiens
guguguguguguguggg

SEQ ID NO: 8260 - RNA, 17 nt, Homo sapiens
gugugugugugugggug

SEQ ID NO: 8261 - RNA, 17 nt, Homo sapiens
gugugugugugggugug

SEQ ID NO: 8262 - RNA, 17 nt, Homo sapiens
gugugugggugugggug

SEQ ID NO: 8263 - RNA, 17 nt, Homo sapiens
gugugggugugggugua

SEQ ID NO: 8264 - RNA, 17 nt, Homo sapiens
ggguguggguguaugug

SEQ ID NO: 8265 - RNA, 17 nt, Homo sapiens
guguggguguaugugug

SEQ ID NO: 8266 - RNA, 17 nt, Homo sapiens
ggguguauguguguuuu

SEQ ID NO: 8267 - RNA, 17 nt, Homo sapiens
guguauguguguuuugu

SEQ ID NO: 8268 - RNA, 17 nt, Homo sapiens
guauguguguuuugugc

SEQ ID NO: 8269 - RNA, 17 nt, Homo sapiens
uguguuuugugcauaac

SEQ ID NO: 8270 - RNA, 17 nt, Homo sapiens
uguuuugugcauaacua

SEQ ID NO: 8271 - RNA, 17 nt, Homo sapiens
ugugcauaacuauuuaa

SEQ ID NO: 8272 - RNA, 17 nt, Homo sapiens
uuaaggaaacuggaauu

SEQ ID NO: 8273 - RNA, 17 nt, Homo sapiens
aaacuggaauuuuaaag

SEQ ID NO: 8274 - RNA, 17 nt, Homo sapiens
auuuuaaaguuacuuuu

SEQ ID NO: 8275 - RNA, 17 nt, Homo sapiens
uuauacaaaccaagaau

SEQ ID NO: 8276 - RNA, 17 nt, Homo sapiens
aaccaagaauauaugcu

SEQ ID NO: 8277 - RNA, 17 nt, Homo sapiens
gaauauaugcuacagau

SEQ ID NO: 8278 - RNA, 17 nt, Homo sapiens
ugcuacagauauaagac

SEQ ID NO: 8279 - RNA, 17 nt, Homo sapiens
gauauaagacagacaug

SEQ ID NO: 8280 - RNA, 17 nt, Homo sapiens
uaagacagacaugguuu

SEQ ID NO: 8281 - RNA, 17 nt, Homo sapiens
cagacaugguuuggucc

SEQ ID NO: 8282 - RNA, 17 nt, Homo sapiens
augguuugguccuauau

SEQ ID NO: 8283 - RNA, 17 nt, Homo sapiens
uauuucuagucaugaug

SEQ ID NO: 8284 - RNA, 17 nt, Homo sapiens
uagucaugaugaaugua

SEQ ID NO: 8285 - RNA, 17 nt, Homo sapiens
caugaugaauguauuuu

SEQ ID NO: 8286 - RNA, 17 nt, Homo sapiens
ugaugaauguauuuugu

SEQ ID NO: 8287 - RNA, 17 nt, Homo sapiens
uguauuuuguauaccau

SEQ ID NO: 8288 - RNA, 17 nt, Homo sapiens
uucauauaauauacuua

SEQ ID NO: 8289 - RNA, 17 nt, Homo sapiens
acuuaaaaauauuucuu

SEQ ID NO: 8290 - RNA, 17 nt, Homo sapiens
auuucuuaauugggauu

SEQ ID NO: 8291 - RNA, 17 nt, Homo sapiens
uaauugggauuuguaau

SEQ ID NO: 8292 - RNA, 17 nt, Homo sapiens
ugggauuuguaaucgua

SEQ ID NO: 8293 - RNA, 17 nt, Homo sapiens
gauuuguaaucguacca

SEQ ID NO: 8294 - RNA, 17 nt, Homo sapiens
uuguaaucguaccaacu

SEQ ID NO: 8295 - RNA, 17 nt, Homo sapiens
ucguaccaacuuaauug

SEQ ID NO: 8296 - RNA, 17 nt, Homo sapiens
ccaacuuaauugauaaa

SEQ ID NO: 8297 - RNA, 17 nt, Homo sapiens
cuuaauugauaaacuug

SEQ ID NO: 8298 - RNA, 17 nt, Homo sapiens
auugauaaacuuggcaa

SEQ ID NO: 8299 - RNA, 17 nt, Homo sapiens
uaaacuuggcaacugcu

SEQ ID NO: 8300 - RNA, 17 nt, Homo sapiens
acuuggcaacugcuuuu

SEQ ID NO: 8301 - RNA, 17 nt, Homo sapiens
uggcaacugcuuuuaug

SEQ ID NO: 8302 - RNA, 17 nt, Homo sapiens
gcuuuuauguucugucu

SEQ ID NO: 8303 - RNA, 17 nt, Homo sapiens
uauguucugucuccuuc

SEQ ID NO: 8304 - RNA, 17 nt, Homo sapiens
uuccauaaauuuuucaa

SEQ ID NO: 8305 - RNA, 17 nt, Homo sapiens
uuuucaaaauacuaauu

SEQ ID NO: 8306 - RNA, 17 nt, Homo sapiens
aaauacuaauucaacaa

SEQ ID NO: 8307 - RNA, 17 nt, Homo sapiens
cuaauucaacaaagaaa

SEQ ID NO: 8308 - RNA, 17 nt, Homo sapiens
aagaaaaagcucuuuuu

SEQ ID NO: 8309 - RNA, 17 nt, Homo sapiens
uuccuaaaauaaacuca

SEQ ID NO: 8310 - RNA, 17 nt, Homo sapiens
uaaaauaaacucaaauu

SEQ ID NO: 8311 - RNA, 17 nt, Homo sapiens
aaacucaaauuuauccu

SEQ ID NO: 8312 - RNA, 17 nt, Homo sapiens
uuauccuuguuuagagc

SEQ ID NO: 8313 - RNA, 17 nt, Homo sapiens
uguuuagagcagagaaa

SEQ ID NO: 8314 - RNA, 17 nt, Homo sapiens
agagaaaaauuaagaaa

SEQ ID NO: 8315 - RNA, 17 nt, Homo sapiens
uaagaaaaacuuugaaa

SEQ ID NO: 8316 - RNA, 17 nt, Homo sapiens
acuuugaaauggucuca

SEQ ID NO: 8317 - RNA, 17 nt, Homo sapiens
uugaaauggucucaaaa

SEQ ID NO: 8318 - RNA, 17 nt, Homo sapiens
cucaaaaaauugcuaaa

SEQ ID NO: 8319 - RNA, 17 nt, Homo sapiens
aaaaaauugcuaaauau

SEQ ID NO: 8320 - RNA, 17 nt, Homo sapiens
auugcuaaauauuuuca

SEQ ID NO: 8321 - RNA, 17 nt, Homo sapiens
uauuuucaauggaaaac

SEQ ID NO: 8322 - RNA, 17 nt, Homo sapiens
aauggaaaacuaaaugu

SEQ ID NO: 8323 - RNA, 17 nt, Homo sapiens
aaaacuaaauguuaguu

SEQ ID NO: 8324 - RNA, 17 nt, Homo sapiens
aacuaaauguuaguuua

SEQ ID NO: 8325 - RNA, 17 nt, Homo sapiens
aaauguuaguuuagcug

SEQ ID NO: 8326 - RNA, 17 nt, Homo sapiens
uuaguuuagcugauugu

SEQ ID NO: 8327 - RNA, 17 nt, Homo sapiens
uuuagcugauuguaugg

SEQ ID NO: 8328 - RNA, 17 nt, Homo sapiens
agcugauuguauggggu

SEQ ID NO: 8329 - RNA, 17 nt, Homo sapiens
uguaugggguuuucgaa

SEQ ID NO: 8330 - RNA, 17 nt, Homo sapiens
guuuucgaaccuuucac

SEQ ID NO: 8331 - RNA, 17 nt, Homo sapiens
cacuuuuuguuuguuuu

SEQ ID NO: 8332 - RNA, 17 nt, Homo sapiens
uuuuguuuguuuuaccu

SEQ ID NO: 8333 - RNA, 17 nt, Homo sapiens
auuucacaacuguguaa

SEQ ID NO: 8334 - RNA, 17 nt, Homo sapiens
ucacaacuguguaaauu

SEQ ID NO: 8335 - RNA, 17 nt, Homo sapiens
acaacuguguaaauugc

SEQ ID NO: 8336 - RNA, 17 nt, Homo sapiens
cuguguaaauugccaau

SEQ ID NO: 8337 - RNA, 17 nt, Homo sapiens
uguaaauugccaauaau

SEQ ID NO: 8338 - RNA, 17 nt, Homo sapiens
aauugccaauaauuccu

SEQ ID NO: 8339 - RNA, 17 nt, Homo sapiens
ugccaauaauuccuguc

SEQ ID NO: 8340 - RNA, 17 nt, Homo sapiens
uaauuccuguccaugaa

SEQ ID NO: 8341 - RNA, 17 nt, Homo sapiens
ccaugaaaaugcaaauu

SEQ ID NO: 8342 - RNA, 17 nt, Homo sapiens
augaaaaugcaaauuau

SEQ ID NO: 8343 - RNA, 17 nt, Homo sapiens
aaaugcaaauuauccag

SEQ ID NO: 8344 - RNA, 17 nt, Homo sapiens
auuauccaguguagaua

SEQ ID NO: 8345 - RNA, 17 nt, Homo sapiens
uauccaguguagauaua

SEQ ID NO: 8346 - RNA, 17 nt, Homo sapiens
caguguagauauauuug

SEQ ID NO: 8347 - RNA, 17 nt, Homo sapiens
uauauuugaccaucacc

SEQ ID NO: 8348 - RNA, 17 nt, Homo sapiens
cccuauggauauuggcu

SEQ ID NO: 8349 - RNA, 17 nt, Homo sapiens
ggauauuggcuaguuuu

SEQ ID NO: 8350 - RNA, 17 nt, Homo sapiens
auuggcuaguuuugccu

SEQ ID NO: 8351 - RNA, 17 nt, Homo sapiens
cuaguuuugccuuuauu

SEQ ID NO: 8352 - RNA, 17 nt, Homo sapiens
uuuauuaagcaaauuca

SEQ ID NO: 8353 - RNA, 17 nt, Homo sapiens
uuaagcaaauucauuuc

SEQ ID NO: 8354 - RNA, 17 nt, Homo sapiens
ucauuucagccugaaug

SEQ ID NO: 8355 - RNA, 17 nt, Homo sapiens
cagccugaaugucugcc

SEQ ID NO: 8356 - RNA, 17 nt, Homo sapiens
gccugaaugucugccua

SEQ ID NO: 8357 - RNA, 17 nt, Homo sapiens
gaaugucugccuauaua

SEQ ID NO: 8358 - RNA, 17 nt, Homo sapiens
uauucucugcucuuugu

SEQ ID NO: 8359 - RNA, 17 nt, Homo sapiens
ugcucuuuguauucucc

SEQ ID NO: 8360 - RNA, 17 nt, Homo sapiens
uccuuugaacccguuaa

SEQ ID NO: 8361 - RNA, 17 nt, Homo sapiens
uugaacccguuaaaaca

SEQ ID NO: 8362 - RNA, 17 nt, Homo sapiens
ccguuaaaacauccugu

SEQ ID NO: 8363 - RNA, 17 nt, Homo sapiens
aacauccuguggcacuc

SEQ ID NO: 8364 - RNA, 17 nt, Homo sapiens
gucccgggaccccggga

SEQ ID NO: 8365 - RNA, 17 nt, Homo sapiens
ccgggagagcggucagu

SEQ ID NO: 8366 - RNA, 17 nt, Homo sapiens
ggagagcggucagugug

SEQ ID NO: 8367 - RNA, 17 nt, Homo sapiens
agcggucaguguguggu

SEQ ID NO: 8368 - RNA, 17 nt, Homo sapiens
cggucaguguguggucg

SEQ ID NO: 8369 - RNA, 17 nt, Homo sapiens
gucaguguguggucgcu

SEQ ID NO: 8370 - RNA, 17 nt, Homo sapiens
aguguguggucgcugcg

SEQ ID NO: 8371 - RNA, 17 nt, Homo sapiens
guguggucgcugcguuu

SEQ ID NO: 8372 - RNA, 17 nt, Homo sapiens
uggucgcugcguuuccu

SEQ ID NO: 8373 - RNA, 17 nt, Homo sapiens
gucgcugcguuuccucu

SEQ ID NO: 8374 - RNA, 17 nt, Homo sapiens
uuuccucugccugcgcc

SEQ ID NO: 8375 - RNA, 17 nt, Homo sapiens
cucugccugcgccgggc

SEQ ID NO: 8376 - RNA, 17 nt, Homo sapiens
cugccugcgccgggcau

SEQ ID NO: 8377 - RNA, 17 nt, Homo sapiens
ugcgccgggcaucacuu

SEQ ID NO: 8378 - RNA, 17 nt, Homo sapiens
cgccgggcaucacuugc

SEQ ID NO: 8379 - RNA, 17 nt, Homo sapiens
cgggcaucacuugcgcg

SEQ ID NO: 8380 - RNA, 17 nt, Homo sapiens
caucacuugcgcgccgc

SEQ ID NO: 8381 - RNA, 17 nt, Homo sapiens
ucacuugcgcgccgcag

SEQ ID NO: 8382 - RNA, 17 nt, Homo sapiens
acuugcgcgccgcagaa

SEQ ID NO: 8383 - RNA, 17 nt, Homo sapiens
ugcgcgccgcagaaagu

SEQ ID NO: 8384 - RNA, 17 nt, Homo sapiens
cgcagaaaguccgucug

SEQ ID NO: 8385 - RNA, 17 nt, Homo sapiens
gaaaguccgucuggcag

SEQ ID NO: 8386 - RNA, 17 nt, Homo sapiens
uccgucuggcagccugg

SEQ ID NO: 8387 - RNA, 17 nt, Homo sapiens
gucuggcagccuggaua

SEQ ID NO: 8388 - RNA, 17 nt, Homo sapiens
cagccuggauauccucu

SEQ ID NO: 8389 - RNA, 17 nt, Homo sapiens
gccuggauauccucucc

SEQ ID NO: 8390 - RNA, 17 nt, Homo sapiens
ccucuccuaccggcacc

SEQ ID NO: 8391 - RNA, 17 nt, Homo sapiens
uccuaccggcacccgca

SEQ ID NO: 8392 - RNA, 17 nt, Homo sapiens
cuaccggcacccgcaga

SEQ ID NO: 8393 - RNA, 17 nt, Homo sapiens
cggcacccgcagacgcc

SEQ ID NO: 8394 - RNA, 17 nt, Homo sapiens
acccgcagacgccccug

SEQ ID NO: 8395 - RNA, 17 nt, Homo sapiens
ccgcagacgccccugca

SEQ ID NO: 8396 - RNA, 17 nt, Homo sapiens
acgccccugcagccgcc

SEQ ID NO: 8397 - RNA, 17 nt, Homo sapiens
ccccugcagccgccggu

SEQ ID NO: 8398 - RNA, 17 nt, Homo sapiens
cugcagccgccggucgg

SEQ ID NO: 8399 - RNA, 17 nt, Homo sapiens
agccgccggucggcgcc

SEQ ID NO: 8400 - RNA, 17 nt, Homo sapiens
gccggucggcgcccggg

SEQ ID NO: 8401 - RNA, 17 nt, Homo sapiens
cggucggcgcccgggcu

SEQ ID NO: 8402 - RNA, 17 nt, Homo sapiens
gcgcccgggcucccuag

SEQ ID NO: 8403 - RNA, 17 nt, Homo sapiens
gcucccuagcccugugc

SEQ ID NO: 8404 - RNA, 17 nt, Homo sapiens
cuagcccugugcgcuca

SEQ ID NO: 8405 - RNA, 17 nt, Homo sapiens
agcccugugcgcucaac

SEQ ID NO: 8406 - RNA, 17 nt, Homo sapiens
cccugugcgcucaacug

SEQ ID NO: 8407 - RNA, 17 nt, Homo sapiens
ugcgcucaacuguccug

SEQ ID NO: 8408 - RNA, 17 nt, Homo sapiens
gcucaacuguccugcgc

SEQ ID NO: 8409 - RNA, 17 nt, Homo sapiens
acuguccugcgcugcgg

SEQ ID NO: 8410 - RNA, 17 nt, Homo sapiens
uguccugcgcugcgggg

SEQ ID NO: 8411 - RNA, 17 nt, Homo sapiens
ccugcgcugcggggugc

SEQ ID NO: 8412 - RNA, 17 nt, Homo sapiens
gcugcggggugccgcga

SEQ ID NO: 8413 - RNA, 17 nt, Homo sapiens
ugcggggugccgcgagu

SEQ ID NO: 8414 - RNA, 17 nt, Homo sapiens
ggggugccgcgaguucc

SEQ ID NO: 8415 - RNA, 17 nt, Homo sapiens
ugccgcgaguuccaccu

SEQ ID NO: 8416 - RNA, 17 nt, Homo sapiens
cgaguuccaccuccgcg

SEQ ID NO: 8417 - RNA, 17 nt, Homo sapiens
ccaccuccgcgccuccu

SEQ ID NO: 8418 - RNA, 17 nt, Homo sapiens
accuccgcgccuccuuc

SEQ ID NO: 8419 - RNA, 17 nt, Homo sapiens
uucucuagacaggcgcu

SEQ ID NO: 8420 - RNA, 17 nt, Homo sapiens
cuagacaggcgcuggga

SEQ ID NO: 8421 - RNA, 17 nt, Homo sapiens
agacaggcgcugggaga

SEQ ID NO: 8422 - RNA, 17 nt, Homo sapiens
gagaaagaaccggcucc

SEQ ID NO: 8423 - RNA, 17 nt, Homo sapiens
aagaaccggcucccgag

SEQ ID NO: 8424 - RNA, 17 nt, Homo sapiens
gcucccgaguucugggc

SEQ ID NO: 8425 - RNA, 17 nt, Homo sapiens
aguucugggcauuucgc

SEQ ID NO: 8426 - RNA, 17 nt, Homo sapiens
uucugggcauuucgccc

SEQ ID NO: 8427 - RNA, 17 nt, Homo sapiens
ggcauuucgcccggcuc

SEQ ID NO: 8428 - RNA, 17 nt, Homo sapiens
uucgcccggcucgaggu

SEQ ID NO: 8429 - RNA, 17 nt, Homo sapiens
ggcucgaggugcaggau

SEQ ID NO: 8430 - RNA, 17 nt, Homo sapiens
cucgaggugcaggaugc

SEQ ID NO: 8431 - RNA, 17 nt, Homo sapiens
ggugcaggaugcagagc

SEQ ID NO: 8432 - RNA, 17 nt, Homo sapiens
ugcaggaugcagagcaa

SEQ ID NO: 8433 - RNA, 17 nt, Homo sapiens
gaugcagagcaaggugc

SEQ ID NO: 8434 - RNA, 17 nt, Homo sapiens
agagcaaggugcugcug

SEQ ID NO: 8435 - RNA, 17 nt, Homo sapiens
agcaaggugcugcuggc

SEQ ID NO: 8436 - RNA, 17 nt, Homo sapiens
aaggugcugcuggccgu

SEQ ID NO: 8437 - RNA, 17 nt, Homo sapiens
ugcugcuggccgucgcc

SEQ ID NO: 8438 - RNA, 17 nt, Homo sapiens
ugcuggccgucgcccug

SEQ ID NO: 8439 - RNA, 17 nt, Homo sapiens
uggccgucgcccugugg

SEQ ID NO: 8440 - RNA, 17 nt, Homo sapiens
gucgcccuguggcucug

SEQ ID NO: 8441 - RNA, 17 nt, Homo sapiens
gcccuguggcucugcgu

SEQ ID NO: 8442 - RNA, 17 nt, Homo sapiens
guggcucugcguggaga

SEQ ID NO: 8443 - RNA, 17 nt, Homo sapiens
ggcucugcguggagacc

SEQ ID NO: 8444 - RNA, 17 nt, Homo sapiens
gcguggagacccgggcc

SEQ ID NO: 8445 - RNA, 17 nt, Homo sapiens
agacccgggccgccucu

SEQ ID NO: 8446 - RNA, 17 nt, Homo sapiens
cccgggccgccucugug

SEQ ID NO: 8447 - RNA, 17 nt, Homo sapiens
ccgccucuguggguuug

SEQ ID NO: 8448 - RNA, 17 nt, Homo sapiens
cucuguggguuugccua

SEQ ID NO: 8449 - RNA, 17 nt, Homo sapiens
guggguuugccuagugu

SEQ ID NO: 8450 - RNA, 17 nt, Homo sapiens
uuugccuaguguuucuc

SEQ ID NO: 8451 - RNA, 17 nt, Homo sapiens
ugccuaguguuucucuu

SEQ ID NO: 8452 - RNA, 17 nt, Homo sapiens
uucucuugaucugccca

SEQ ID NO: 8453 - RNA, 17 nt, Homo sapiens
cuugaucugcccaggcu

SEQ ID NO: 8454 - RNA, 17 nt, Homo sapiens
cugcccaggcucagcau

SEQ ID NO: 8455 - RNA, 17 nt, Homo sapiens
caggcucagcauacaaa

SEQ ID NO: 8456 - RNA, 17 nt, Homo sapiens
acaaaaagacauacuua

SEQ ID NO: 8457 - RNA, 17 nt, Homo sapiens
uacuuacaauuaaggcu

SEQ ID NO: 8458 - RNA, 17 nt, Homo sapiens
caauuaaggcuaauaca

SEQ ID NO: 8459 - RNA, 17 nt, Homo sapiens
uaaggcuaauacaacuc

SEQ ID NO: 8460 - RNA, 17 nt, Homo sapiens
cuaauacaacucuucaa

SEQ ID NO: 8461 - RNA, 17 nt, Homo sapiens
cucuucaaauuacuugc

SEQ ID NO: 8462 - RNA, 17 nt, Homo sapiens
aauuacuugcaggggac

SEQ ID NO: 8463 - RNA, 17 nt, Homo sapiens
ugcaggggacagaggga

SEQ ID NO: 8464 - RNA, 17 nt, Homo sapiens
acagagggacuuggacu

SEQ ID NO: 8465 - RNA, 17 nt, Homo sapiens
ggacuuggacuggcuuu

SEQ ID NO: 8466 - RNA, 17 nt, Homo sapiens
uuggacuggcuuuggcc

SEQ ID NO: 8467 - RNA, 17 nt, Homo sapiens
uggcuuuggcccaauaa

SEQ ID NO: 8468 - RNA, 17 nt, Homo sapiens
uuggcccaauaaucaga

SEQ ID NO: 8469 - RNA, 17 nt, Homo sapiens
gcccaauaaucagagug

SEQ ID NO: 8470 - RNA, 17 nt, Homo sapiens
uaaucagaguggcagug

SEQ ID NO: 8471 - RNA, 17 nt, Homo sapiens
ucagaguggcagugagc

SEQ ID NO: 8472 - RNA, 17 nt, Homo sapiens
gaguggcagugagcaaa

SEQ ID NO: 8473 - RNA, 17 nt, Homo sapiens
ggcagugagcaaagggu

SEQ ID NO: 8474 - RNA, 17 nt, Homo sapiens
agcaaaggguggaggug

SEQ ID NO: 8475 - RNA, 17 nt, Homo sapiens
ggguggaggugacugag

SEQ ID NO: 8476 - RNA, 17 nt, Homo sapiens
uggaggugacugagugc

SEQ ID NO: 8477 - RNA, 17 nt, Homo sapiens
gugacugagugcagcga

SEQ ID NO: 8478 - RNA, 17 nt, Homo sapiens
gacugagugcagcgaug

SEQ ID NO: 8479 - RNA, 17 nt, Homo sapiens
ugagugcagcgauggcc

SEQ ID NO: 8480 - RNA, 17 nt, Homo sapiens
gugcagcgauggccucu

SEQ ID NO: 8481 - RNA, 17 nt, Homo sapiens
cagcgauggccucuucu

SEQ ID NO: 8482 - RNA, 17 nt, Homo sapiens
ccucuucuguaagacac

SEQ ID NO: 8483 - RNA, 17 nt, Homo sapiens
ucuguaagacacucaca

SEQ ID NO: 8484 - RNA, 17 nt, Homo sapiens
cacucacaauuccaaaa

SEQ ID NO: 8485 - RNA, 17 nt, Homo sapiens
uuccaaaagugaucgga

SEQ ID NO: 8486 - RNA, 17 nt, Homo sapiens
caaaagugaucggaaau

SEQ ID NO: 8487 - RNA, 17 nt, Homo sapiens
gaucggaaaugacacug

SEQ ID NO: 8488 - RNA, 17 nt, Homo sapiens
cggaaaugacacuggag

SEQ ID NO: 8489 - RNA, 17 nt, Homo sapiens
acacuggagccuacaag

SEQ ID NO: 8490 - RNA, 17 nt, Homo sapiens
gccuacaagugcuucua

SEQ ID NO: 8491 - RNA, 17 nt, Homo sapiens
cuacaagugcuucuacc

SEQ ID NO: 8492 - RNA, 17 nt, Homo sapiens
accgggaaacugacuug

SEQ ID NO: 8493 - RNA, 17 nt, Homo sapiens
ggaaacugacuuggccu

SEQ ID NO: 8494 - RNA, 17 nt, Homo sapiens
cugacuuggccucgguc

SEQ ID NO: 8495 - RNA, 17 nt, Homo sapiens
uggccucggucauuuau

SEQ ID NO: 8496 - RNA, 17 nt, Homo sapiens
ucauuuaugucuauguu

SEQ ID NO: 8497 - RNA, 17 nt, Homo sapiens
augucuauguucaagau

SEQ ID NO: 8498 - RNA, 17 nt, Homo sapiens
uguucaagauuacagau

SEQ ID NO: 8499 - RNA, 17 nt, Homo sapiens
gauuacagaucuccauu

SEQ ID NO: 8500 - RNA, 17 nt, Homo sapiens
cauuuauugcuucuguu

SEQ ID NO: 8501 - RNA, 17 nt, Homo sapiens
uugcuucuguuagugac

SEQ ID NO: 8502 - RNA, 17 nt, Homo sapiens
uucuguuagugaccaac

SEQ ID NO: 8503 - RNA, 17 nt, Homo sapiens
uguuagugaccaacaug

SEQ ID NO: 8504 - RNA, 17 nt, Homo sapiens
agugaccaacauggagu

SEQ ID NO: 8505 - RNA, 17 nt, Homo sapiens
aacauggagucguguac

SEQ ID NO: 8506 - RNA, 17 nt, Homo sapiens
auggagucguguacauu

SEQ ID NO: 8507 - RNA, 17 nt, Homo sapiens
ggagucguguacauuac

SEQ ID NO: 8508 - RNA, 17 nt, Homo sapiens
uacugagaacaaaaaca

SEQ ID NO: 8509 - RNA, 17 nt, Homo sapiens
gaacaaaaacaaaacug

SEQ ID NO: 8510 - RNA, 17 nt, Homo sapiens
aaaacaaaacuguggug

SEQ ID NO: 8511 - RNA, 17 nt, Homo sapiens
acaaaacuguggugauu

SEQ ID NO: 8512 - RNA, 17 nt, Homo sapiens
aaacuguggugauucca

SEQ ID NO: 8513 - RNA, 17 nt, Homo sapiens
cuguggugauuccaugu

SEQ ID NO: 8514 - RNA, 17 nt, Homo sapiens
gauuccaugucucgggu

SEQ ID NO: 8515 - RNA, 17 nt, Homo sapiens
ugucucggguccauuuc

SEQ ID NO: 8516 - RNA, 17 nt, Homo sapiens
cauuucaaaucucaacg

SEQ ID NO: 8517 - RNA, 17 nt, Homo sapiens
aaaucucaacgugucac

SEQ ID NO: 8518 - RNA, 17 nt, Homo sapiens
aucucaacgugucacuu

SEQ ID NO: 8519 - RNA, 17 nt, Homo sapiens
cucaacgugucacuuug

SEQ ID NO: 8520 - RNA, 17 nt, Homo sapiens
gucacuuugugcaagau

SEQ ID NO: 8521 - RNA, 17 nt, Homo sapiens
cacuuugugcaagauac

SEQ ID NO: 8522 - RNA, 17 nt, Homo sapiens
ugugcaagauacccaga

SEQ ID NO: 8523 - RNA, 17 nt, Homo sapiens
gaaaagagauuuguucc

SEQ ID NO: 8524 - RNA, 17 nt, Homo sapiens
agagauuuguuccugau

SEQ ID NO: 8525 - RNA, 17 nt, Homo sapiens
uguuccugaugguaaca

SEQ ID NO: 8526 - RNA, 17 nt, Homo sapiens
uccugaugguaacagaa

SEQ ID NO: 8527 - RNA, 17 nt, Homo sapiens
ugaugguaacagaauuu

SEQ ID NO: 8528 - RNA, 17 nt, Homo sapiens
guaacagaauuuccugg

SEQ ID NO: 8529 - RNA, 17 nt, Homo sapiens
uuccugggacagcaaga

SEQ ID NO: 8530 - RNA, 17 nt, Homo sapiens
cugggacagcaagaagg

SEQ ID NO: 8531 - RNA, 17 nt, Homo sapiens
caagaagggcuuuacua

SEQ ID NO: 8532 - RNA, 17 nt, Homo sapiens
uauucccagcuacauga

SEQ ID NO: 8533 - RNA, 17 nt, Homo sapiens
gcuacaugaucagcuau

SEQ ID NO: 8534 - RNA, 17 nt, Homo sapiens
caugaucagcuaugcug

SEQ ID NO: 8535 - RNA, 17 nt, Homo sapiens
ucagcuaugcuggcaug

SEQ ID NO: 8536 - RNA, 17 nt, Homo sapiens
cuaugcuggcauggucu

SEQ ID NO: 8537 - RNA, 17 nt, Homo sapiens
cuggcauggucuucugu

SEQ ID NO: 8538 - RNA, 17 nt, Homo sapiens
ggucuucugugaagcaa

SEQ ID NO: 8539 - RNA, 17 nt, Homo sapiens
ucugugaagcaaaaauu

SEQ ID NO: 8540 - RNA, 17 nt, Homo sapiens
aagcaaaaauuaaugau

SEQ ID NO: 8541 - RNA, 17 nt, Homo sapiens
aaaaauuaaugaugaaa

SEQ ID NO: 8542 - RNA, 17 nt, Homo sapiens
aauuaaugaugaaaguu

SEQ ID NO: 8543 - RNA, 17 nt, Homo sapiens
ugaugaaaguuaccagu

SEQ ID NO: 8544 - RNA, 17 nt, Homo sapiens
aguuaccagucuauuau

SEQ ID NO: 8545 - RNA, 17 nt, Homo sapiens
ucuauuauguacauagu

SEQ ID NO: 8546 - RNA, 17 nt, Homo sapiens
uguacauaguugucguu

SEQ ID NO: 8547 - RNA, 17 nt, Homo sapiens
acauaguugucguugua

SEQ ID NO: 8548 - RNA, 17 nt, Homo sapiens
uaguugucguuguaggg

SEQ ID NO: 8549 - RNA, 17 nt, Homo sapiens
uugucguuguaggguau

SEQ ID NO: 8550 - RNA, 17 nt, Homo sapiens
guuguaggguauaggau

SEQ ID NO: 8551 - RNA, 17 nt, Homo sapiens
gguauaggauuuaugau

SEQ ID NO: 8552 - RNA, 17 nt, Homo sapiens
gauuuaugaugugguuc

SEQ ID NO: 8553 - RNA, 17 nt, Homo sapiens
uuuaugaugugguucug

SEQ ID NO: 8554 - RNA, 17 nt, Homo sapiens
augaugugguucugagu

SEQ ID NO: 8555 - RNA, 17 nt, Homo sapiens
gguucugaguccgucuc

SEQ ID NO: 8556 - RNA, 17 nt, Homo sapiens
cugaguccgucucaugg

SEQ ID NO: 8557 - RNA, 17 nt, Homo sapiens
cucauggaauugaacua

SEQ ID NO: 8558 - RNA, 17 nt, Homo sapiens
ggaauugaacuaucugu

SEQ ID NO: 8559 - RNA, 17 nt, Homo sapiens
aacuaucuguuggagaa

SEQ ID NO: 8560 - RNA, 17 nt, Homo sapiens
ggagaaaagcuugucuu

SEQ ID NO: 8561 - RNA, 17 nt, Homo sapiens
aaaagcuugucuuaaau

SEQ ID NO: 8562 - RNA, 17 nt, Homo sapiens
ugucuuaaauuguacag

SEQ ID NO: 8563 - RNA, 17 nt, Homo sapiens
cuuaaauuguacagcaa

SEQ ID NO: 8564 - RNA, 17 nt, Homo sapiens
auuguacagcaagaacu

SEQ ID NO: 8565 - RNA, 17 nt, Homo sapiens
cagcaagaacugaacua

SEQ ID NO: 8566 - RNA, 17 nt, Homo sapiens
agaacugaacuaaaugu

SEQ ID NO: 8567 - RNA, 17 nt, Homo sapiens
ugaacuaaaugugggga

SEQ ID NO: 8568 - RNA, 17 nt, Homo sapiens
aacuaaauguggggauu

SEQ ID NO: 8569 - RNA, 17 nt, Homo sapiens
auguggggauugacuuc

SEQ ID NO: 8570 - RNA, 17 nt, Homo sapiens
ggggauugacuucaacu

SEQ ID NO: 8571 - RNA, 17 nt, Homo sapiens
ugacuucaacugggaau

SEQ ID NO: 8572 - RNA, 17 nt, Homo sapiens
aacugggaauacccuuc

SEQ ID NO: 8573 - RNA, 17 nt, Homo sapiens
ucuucgaagcaucagca

SEQ ID NO: 8574 - RNA, 17 nt, Homo sapiens
aagcaucagcauaagaa

SEQ ID NO: 8575 - RNA, 17 nt, Homo sapiens
cauaagaaacuuguaaa

SEQ ID NO: 8576 - RNA, 17 nt, Homo sapiens
agaaacuuguaaaccga

SEQ ID NO: 8577 - RNA, 17 nt, Homo sapiens
acuuguaaaccgagacc

SEQ ID NO: 8578 - RNA, 17 nt, Homo sapiens
aaaccgagaccuaaaaa

SEQ ID NO: 8579 - RNA, 17 nt, Homo sapiens
accuaaaaacccagucu

SEQ ID NO: 8580 - RNA, 17 nt, Homo sapiens
aaaacccagucugggag

SEQ ID NO: 8581 - RNA, 17 nt, Homo sapiens
gucugggagugagauga

SEQ ID NO: 8582 - RNA, 17 nt, Homo sapiens
ggagugagaugaagaaa

SEQ ID NO: 8583 - RNA, 17 nt, Homo sapiens
augaagaaauuuuugag

SEQ ID NO: 8584 - RNA, 17 nt, Homo sapiens
auuuuugagcaccuuaa

SEQ ID NO: 8585 - RNA, 17 nt, Homo sapiens
gcaccuuaacuauagau

SEQ ID NO: 8586 - RNA, 17 nt, Homo sapiens
aacuauagaugguguaa

SEQ ID NO: 8587 - RNA, 17 nt, Homo sapiens
uauagaugguguaaccc

SEQ ID NO: 8588 - RNA, 17 nt, Homo sapiens
uagaugguguaacccgg

SEQ ID NO: 8589 - RNA, 17 nt, Homo sapiens
augguguaacccggagu

SEQ ID NO: 8590 - RNA, 17 nt, Homo sapiens
aacccggagugaccaag

SEQ ID NO: 8591 - RNA, 17 nt, Homo sapiens
ccggagugaccaaggau

SEQ ID NO: 8592 - RNA, 17 nt, Homo sapiens
gaccaaggauuguacac

SEQ ID NO: 8593 - RNA, 17 nt, Homo sapiens
caaggauuguacaccug

SEQ ID NO: 8594 - RNA, 17 nt, Homo sapiens
guacaccugugcagcau

SEQ ID NO: 8595 - RNA, 17 nt, Homo sapiens
acaccugugcagcaucc

SEQ ID NO: 8596 - RNA, 17 nt, Homo sapiens
ccugugcagcauccagu

SEQ ID NO: 8597 - RNA, 17 nt, Homo sapiens
agcauccagugggcuga

SEQ ID NO: 8598 - RNA, 17 nt, Homo sapiens
uccagugggcugaugac

SEQ ID NO: 8599 - RNA, 17 nt, Homo sapiens
gugggcugaugaccaag

SEQ ID NO: 8600 - RNA, 17 nt, Homo sapiens
ggcugaugaccaagaag

SEQ ID NO: 8601 - RNA, 17 nt, Homo sapiens
caagaagaacagcacau

SEQ ID NO: 8602 - RNA, 17 nt, Homo sapiens
gaagaacagcacauuug

SEQ ID NO: 8603 - RNA, 17 nt, Homo sapiens
gcacauuugucaggguc

SEQ ID NO: 8604 - RNA, 17 nt, Homo sapiens
uugucaggguccaugaa

SEQ ID NO: 8605 - RNA, 17 nt, Homo sapiens
caugaaaaaccuuuugu

SEQ ID NO: 8606 - RNA, 17 nt, Homo sapiens
aaccuuuuguugcuuuu

SEQ ID NO: 8607 - RNA, 17 nt, Homo sapiens
cuuuuguugcuuuugga

SEQ ID NO: 8608 - RNA, 17 nt, Homo sapiens
uuuuggaaguggcaugg

SEQ ID NO: 8609 - RNA, 17 nt, Homo sapiens
uggaaguggcauggaau

SEQ ID NO: 8610 - RNA, 17 nt, Homo sapiens
ggcauggaaucucuggu

SEQ ID NO: 8611 - RNA, 17 nt, Homo sapiens
aaucucugguggaagcc

SEQ ID NO: 8612 - RNA, 17 nt, Homo sapiens
ugguggaagccacggug

SEQ ID NO: 8613 - RNA, 17 nt, Homo sapiens
aagccacggugggggag

SEQ ID NO: 8614 - RNA, 17 nt, Homo sapiens
gugggggagcgugucag

SEQ ID NO: 8615 - RNA, 17 nt, Homo sapiens
gggggagcgugucagaa

SEQ ID NO: 8616 - RNA, 17 nt, Homo sapiens
gggagcgugucagaauc

SEQ ID NO: 8617 - RNA, 17 nt, Homo sapiens
gugucagaaucccugcg

SEQ ID NO: 8618 - RNA, 17 nt, Homo sapiens
gaaucccugcgaaguac

SEQ ID NO: 8619 - RNA, 17 nt, Homo sapiens
ccugcgaaguaccuugg

SEQ ID NO: 8620 - RNA, 17 nt, Homo sapiens
guaccuugguuacccac

SEQ ID NO: 8621 - RNA, 17 nt, Homo sapiens
ccccagaaauaaaaugg

SEQ ID NO: 8622 - RNA, 17 nt, Homo sapiens
gaaauaaaaugguauaa

SEQ ID NO: 8623 - RNA, 17 nt, Homo sapiens
auaaaaugguauaaaaa

SEQ ID NO: 8624 - RNA, 17 nt, Homo sapiens
guauaaaaauggaauac

SEQ ID NO: 8625 - RNA, 17 nt, Homo sapiens
aaaauggaauaccccuu

SEQ ID NO: 8626 - RNA, 17 nt, Homo sapiens
ccccuugaguccaauca

SEQ ID NO: 8627 - RNA, 17 nt, Homo sapiens
ugaguccaaucacacaa

SEQ ID NO: 8628 - RNA, 17 nt, Homo sapiens
aucacacaauuaaagcg

SEQ ID NO: 8629 - RNA, 17 nt, Homo sapiens
caauuaaagcggggcau

SEQ ID NO: 8630 - RNA, 17 nt, Homo sapiens
aaagcggggcauguacu

SEQ ID NO: 8631 - RNA, 17 nt, Homo sapiens
cggggcauguacugacg

SEQ ID NO: 8632 - RNA, 17 nt, Homo sapiens
auguacugacgauuaug

SEQ ID NO: 8633 - RNA, 17 nt, Homo sapiens
uacugacgauuauggaa

SEQ ID NO: 8634 - RNA, 17 nt, Homo sapiens
uuauggaagugagugaa

SEQ ID NO: 8635 - RNA, 17 nt, Homo sapiens
ggaagugagugaaagag

SEQ ID NO: 8636 - RNA, 17 nt, Homo sapiens
ugaaagagacacaggaa

SEQ ID NO: 8637 - RNA, 17 nt, Homo sapiens
cacaggaaauuacacug

SEQ ID NO: 8638 - RNA, 17 nt, Homo sapiens
auuacacugucauccuu

SEQ ID NO: 8639 - RNA, 17 nt, Homo sapiens
ccuuaccaaucccauuu

SEQ ID NO: 8640 - RNA, 17 nt, Homo sapiens
aaggagaagcagagcca

SEQ ID NO: 8641 - RNA, 17 nt, Homo sapiens
gaagcagagccaugugg

SEQ ID NO: 8642 - RNA, 17 nt, Homo sapiens
agagccauguggucucu

SEQ ID NO: 8643 - RNA, 17 nt, Homo sapiens
gccauguggucucucug

SEQ ID NO: 8644 - RNA, 17 nt, Homo sapiens
ucucucugguuguguau

SEQ ID NO: 8645 - RNA, 17 nt, Homo sapiens
cucugguuguguauguc

SEQ ID NO: 8646 - RNA, 17 nt, Homo sapiens
cugguuguguauguccc

SEQ ID NO: 8647 - RNA, 17 nt, Homo sapiens
uuguguaugucccaccc

SEQ ID NO: 8648 - RNA, 17 nt, Homo sapiens
caccccagauuggugag

SEQ ID NO: 8649 - RNA, 17 nt, Homo sapiens
ccagauuggugagaaau

SEQ ID NO: 8650 - RNA, 17 nt, Homo sapiens
ggugagaaaucucuaau

SEQ ID NO: 8651 - RNA, 17 nt, Homo sapiens
aaucucuaaucucuccu

SEQ ID NO: 8652 - RNA, 17 nt, Homo sapiens
ucucuccuguggauucc

SEQ ID NO: 8653 - RNA, 17 nt, Homo sapiens
uccuguggauuccuacc

SEQ ID NO: 8654 - RNA, 17 nt, Homo sapiens
uccuaccaguacggcac

SEQ ID NO: 8655 - RNA, 17 nt, Homo sapiens
ccaguacggcaccacuc

SEQ ID NO: 8656 - RNA, 17 nt, Homo sapiens
ccacucaaacgcugaca

SEQ ID NO: 8657 - RNA, 17 nt, Homo sapiens
acucaaacgcugacaug

SEQ ID NO: 8658 - RNA, 17 nt, Homo sapiens
aaacgcugacauguacg

SEQ ID NO: 8659 - RNA, 17 nt, Homo sapiens
gcugacauguacggucu

SEQ ID NO: 8660 - RNA, 17 nt, Homo sapiens
cauguacggucuaugcc

SEQ ID NO: 8661 - RNA, 17 nt, Homo sapiens
cggucuaugccauuccu

SEQ ID NO: 8662 - RNA, 17 nt, Homo sapiens
ccucccccgcaucacau

SEQ ID NO: 8663 - RNA, 17 nt, Homo sapiens
auccacugguauuggca

SEQ ID NO: 8664 - RNA, 17 nt, Homo sapiens
ugguauuggcaguugga

SEQ ID NO: 8665 - RNA, 17 nt, Homo sapiens
uauuggcaguuggagga

SEQ ID NO: 8666 - RNA, 17 nt, Homo sapiens
gaggaagagugcgccaa

SEQ ID NO: 8667 - RNA, 17 nt, Homo sapiens
ggaagagugcgccaacg

SEQ ID NO: 8668 - RNA, 17 nt, Homo sapiens
aagagugcgccaacgag

SEQ ID NO: 8669 - RNA, 17 nt, Homo sapiens
gugcgccaacgagccca

SEQ ID NO: 8670 - RNA, 17 nt, Homo sapiens
gccaacgagcccagcca

SEQ ID NO: 8671 - RNA, 17 nt, Homo sapiens
cgagcccagccaagcug

SEQ ID NO: 8672 - RNA, 17 nt, Homo sapiens
ccagccaagcugucuca

SEQ ID NO: 8673 - RNA, 17 nt, Homo sapiens
gccaagcugucucagug

SEQ ID NO: 8674 - RNA, 17 nt, Homo sapiens
cugucucagugacaaac

SEQ ID NO: 8675 - RNA, 17 nt, Homo sapiens
ucucagugacaaaccca

SEQ ID NO: 8676 - RNA, 17 nt, Homo sapiens
agugacaaacccauacc

SEQ ID NO: 8677 - RNA, 17 nt, Homo sapiens
auacccuugugaagaau

SEQ ID NO: 8678 - RNA, 17 nt, Homo sapiens
ugugaagaauggagaag

SEQ ID NO: 8679 - RNA, 17 nt, Homo sapiens
auggagaaguguggagg

SEQ ID NO: 8680 - RNA, 17 nt, Homo sapiens
ggagaaguguggaggac

SEQ ID NO: 8681 - RNA, 17 nt, Homo sapiens
uguggaggacuuccagg

SEQ ID NO: 8682 - RNA, 17 nt, Homo sapiens
gggaggaaauaaaauug

SEQ ID NO: 8683 - RNA, 17 nt, Homo sapiens
gaaauaaaauugaaguu

SEQ ID NO: 8684 - RNA, 17 nt, Homo sapiens
aaauugaaguuaauaaa

SEQ ID NO: 8685 - RNA, 17 nt, Homo sapiens
ugaaguuaauaaaaauc

SEQ ID NO: 8686 - RNA, 17 nt, Homo sapiens
uaauaaaaaucaauuug

SEQ ID NO: 8687 - RNA, 17 nt, Homo sapiens
aaaaaucaauuugcucu

SEQ ID NO: 8688 - RNA, 17 nt, Homo sapiens
aucaauuugcucuaauu

SEQ ID NO: 8689 - RNA, 17 nt, Homo sapiens
uugcucuaauugaagga

SEQ ID NO: 8690 - RNA, 17 nt, Homo sapiens
aggaaaaaacaaaacug

SEQ ID NO: 8691 - RNA, 17 nt, Homo sapiens
aaaacaaaacuguaagu

SEQ ID NO: 8692 - RNA, 17 nt, Homo sapiens
acaaaacuguaaguacc

SEQ ID NO: 8693 - RNA, 17 nt, Homo sapiens
aacuguaaguacccuug

SEQ ID NO: 8694 - RNA, 17 nt, Homo sapiens
guacccuuguuauccaa

SEQ ID NO: 8695 - RNA, 17 nt, Homo sapiens
uuauccaagcggcaaau

SEQ ID NO: 8696 - RNA, 17 nt, Homo sapiens
uccaagcggcaaaugug

SEQ ID NO: 8697 - RNA, 17 nt, Homo sapiens
agcggcaaaugugucag

SEQ ID NO: 8698 - RNA, 17 nt, Homo sapiens
cggcaaaugugucagcu

SEQ ID NO: 8699 - RNA, 17 nt, Homo sapiens
gcaaaugugucagcuuu

SEQ ID NO: 8700 - RNA, 17 nt, Homo sapiens
augugucagcuuuguac

SEQ ID NO: 8701 - RNA, 17 nt, Homo sapiens
ucagcuuuguacaaaug

SEQ ID NO: 8702 - RNA, 17 nt, Homo sapiens
uuguacaaaugugaagc

SEQ ID NO: 8703 - RNA, 17 nt, Homo sapiens
guacaaaugugaagcgg

SEQ ID NO: 8704 - RNA, 17 nt, Homo sapiens
aaugugaagcggucaac

SEQ ID NO: 8705 - RNA, 17 nt, Homo sapiens
gugaagcggucaacaaa

SEQ ID NO: 8706 - RNA, 17 nt, Homo sapiens
agcggucaacaaagucg

SEQ ID NO: 8707 - RNA, 17 nt, Homo sapiens
ucaacaaagucgggaga

SEQ ID NO: 8708 - RNA, 17 nt, Homo sapiens
gagagagggugaucucc

SEQ ID NO: 8709 - RNA, 17 nt, Homo sapiens
agagggugaucuccuuc

SEQ ID NO: 8710 - RNA, 17 nt, Homo sapiens
ccuuccacgugaccagg

SEQ ID NO: 8711 - RNA, 17 nt, Homo sapiens
uccacgugaccaggggu

SEQ ID NO: 8712 - RNA, 17 nt, Homo sapiens
gaccagggguccugaaa

SEQ ID NO: 8713 - RNA, 17 nt, Homo sapiens
guccugaaauuacuuug

SEQ ID NO: 8714 - RNA, 17 nt, Homo sapiens
auuacuuugcaaccuga

SEQ ID NO: 8715 - RNA, 17 nt, Homo sapiens
acuuugcaaccugacau

SEQ ID NO: 8716 - RNA, 17 nt, Homo sapiens
gcaaccugacaugcagc

SEQ ID NO: 8717 - RNA, 17 nt, Homo sapiens
ccugacaugcagcccac

SEQ ID NO: 8718 - RNA, 17 nt, Homo sapiens
gacaugcagcccacuga

SEQ ID NO: 8719 - RNA, 17 nt, Homo sapiens
cccacugagcaggagag

SEQ ID NO: 8720 - RNA, 17 nt, Homo sapiens
gcaggagagcgugucuu

SEQ ID NO: 8721 - RNA, 17 nt, Homo sapiens
aggagagcgugucuuug

SEQ ID NO: 8722 - RNA, 17 nt, Homo sapiens
gagagcgugucuuugug

SEQ ID NO: 8723 - RNA, 17 nt, Homo sapiens
gugucuuuguggugcac

SEQ ID NO: 8724 - RNA, 17 nt, Homo sapiens
ucuuuguggugcacugc

SEQ ID NO: 8725 - RNA, 17 nt, Homo sapiens
uuuguggugcacugcag

SEQ ID NO: 8726 - RNA, 17 nt, Homo sapiens
ggugcacugcagacaga

SEQ ID NO: 8727 - RNA, 17 nt, Homo sapiens
cacugcagacagaucua

SEQ ID NO: 8728 - RNA, 17 nt, Homo sapiens
gcagacagaucuacguu

SEQ ID NO: 8729 - RNA, 17 nt, Homo sapiens
agaucuacguuugagaa

SEQ ID NO: 8730 - RNA, 17 nt, Homo sapiens
guuugagaaccucacau

SEQ ID NO: 8731 - RNA, 17 nt, Homo sapiens
cucacaugguacaagcu

SEQ ID NO: 8732 - RNA, 17 nt, Homo sapiens
ugguacaagcuuggccc

SEQ ID NO: 8733 - RNA, 17 nt, Homo sapiens
caagcuuggcccacagc

SEQ ID NO: 8734 - RNA, 17 nt, Homo sapiens
ggcccacagccucugcc

SEQ ID NO: 8735 - RNA, 17 nt, Homo sapiens
cagccucugccaaucca

SEQ ID NO: 8736 - RNA, 17 nt, Homo sapiens
cucugccaauccaugug

SEQ ID NO: 8737 - RNA, 17 nt, Homo sapiens
caauccaugugggagag

SEQ ID NO: 8738 - RNA, 17 nt, Homo sapiens
gugggagaguugcccac

SEQ ID NO: 8739 - RNA, 17 nt, Homo sapiens
ggagaguugcccacacc

SEQ ID NO: 8740 - RNA, 17 nt, Homo sapiens
ccacaccuguuugcaag

SEQ ID NO: 8741 - RNA, 17 nt, Homo sapiens
accuguuugcaagaacu

SEQ ID NO: 8742 - RNA, 17 nt, Homo sapiens
uugcaagaacuuggaua

SEQ ID NO: 8743 - RNA, 17 nt, Homo sapiens
gaacuuggauacucuuu

SEQ ID NO: 8744 - RNA, 17 nt, Homo sapiens
cuuuggaaauugaaugc

SEQ ID NO: 8745 - RNA, 17 nt, Homo sapiens
gaaauugaaugccacca

SEQ ID NO: 8746 - RNA, 17 nt, Homo sapiens
aauugaaugccaccaug

SEQ ID NO: 8747 - RNA, 17 nt, Homo sapiens
gccaccauguucucuaa

SEQ ID NO: 8748 - RNA, 17 nt, Homo sapiens
guucucuaauagcacaa

SEQ ID NO: 8749 - RNA, 17 nt, Homo sapiens
cucuaauagcacaaaug

SEQ ID NO: 8750 - RNA, 17 nt, Homo sapiens
uagcacaaaugacauuu

SEQ ID NO: 8751 - RNA, 17 nt, Homo sapiens
cacaaaugacauuuuga

SEQ ID NO: 8752 - RNA, 17 nt, Homo sapiens
acauuuugaucauggag

SEQ ID NO: 8753 - RNA, 17 nt, Homo sapiens
aucauggagcuuaagaa

SEQ ID NO: 8754 - RNA, 17 nt, Homo sapiens
gcuuaagaaugcauccu

SEQ ID NO: 8755 - RNA, 17 nt, Homo sapiens
uuaagaaugcauccuug

SEQ ID NO: 8756 - RNA, 17 nt, Homo sapiens
gcauccuugcaggacca

SEQ ID NO: 8757 - RNA, 17 nt, Homo sapiens
cuugcaggaccaaggag

SEQ ID NO: 8758 - RNA, 17 nt, Homo sapiens
ccaaggagacuaugucu

SEQ ID NO: 8759 - RNA, 17 nt, Homo sapiens
gagacuaugucugccuu

SEQ ID NO: 8760 - RNA, 17 nt, Homo sapiens
cuaugucugccuugcuc

SEQ ID NO: 8761 - RNA, 17 nt, Homo sapiens
ucugccuugcucaagac

SEQ ID NO: 8762 - RNA, 17 nt, Homo sapiens
ugcucaagacaggaaga

SEQ ID NO: 8763 - RNA, 17 nt, Homo sapiens
acaggaagaccaagaaa

SEQ ID NO: 8764 - RNA, 17 nt, Homo sapiens
aagaaaagacauugcgu

SEQ ID NO: 8765 - RNA, 17 nt, Homo sapiens
aagacauugcgugguca

SEQ ID NO: 8766 - RNA, 17 nt, Homo sapiens
gacauugcguggucagg

SEQ ID NO: 8767 - RNA, 17 nt, Homo sapiens
auugcguggucaggcag

SEQ ID NO: 8768 - RNA, 17 nt, Homo sapiens
guggucaggcagcucac

SEQ ID NO: 8769 - RNA, 17 nt, Homo sapiens
gucaggcagcucacagu

SEQ ID NO: 8770 - RNA, 17 nt, Homo sapiens
agcucacaguccuagag

SEQ ID NO: 8771 - RNA, 17 nt, Homo sapiens
guccuagagcguguggc

SEQ ID NO: 8772 - RNA, 17 nt, Homo sapiens
ccuagagcguguggcac

SEQ ID NO: 8773 - RNA, 17 nt, Homo sapiens
uagagcguguggcaccc

SEQ ID NO: 8774 - RNA, 17 nt, Homo sapiens
agcguguggcacccacg

SEQ ID NO: 8775 - RNA, 17 nt, Homo sapiens
cacccacgaucacagga

SEQ ID NO: 8776 - RNA, 17 nt, Homo sapiens
cacaggaaaccuggaga

SEQ ID NO: 8777 - RNA, 17 nt, Homo sapiens
ccuggagaaucagacga

SEQ ID NO: 8778 - RNA, 17 nt, Homo sapiens
agaaucagacgacaagu

SEQ ID NO: 8779 - RNA, 17 nt, Homo sapiens
aucagacgacaaguauu

SEQ ID NO: 8780 - RNA, 17 nt, Homo sapiens
gacgacaaguauugggg

SEQ ID NO: 8781 - RNA, 17 nt, Homo sapiens
uggggaaagcaucgaag

SEQ ID NO: 8782 - RNA, 17 nt, Homo sapiens
gcaucgaagucucaugc

SEQ ID NO: 8783 - RNA, 17 nt, Homo sapiens
agucucaugcacggcau

SEQ ID NO: 8784 - RNA, 17 nt, Homo sapiens
caugcacggcaucuggg

SEQ ID NO: 8785 - RNA, 17 nt, Homo sapiens
aucugggaaucccccuc

SEQ ID NO: 8786 - RNA, 17 nt, Homo sapiens
cuccacagaucaugugg

SEQ ID NO: 8787 - RNA, 17 nt, Homo sapiens
cagaucaugugguuuaa

SEQ ID NO: 8788 - RNA, 17 nt, Homo sapiens
aucaugugguuuaaaga

SEQ ID NO: 8789 - RNA, 17 nt, Homo sapiens
guuuaaagauaaugaga

SEQ ID NO: 8790 - RNA, 17 nt, Homo sapiens
uaaagauaaugagaccc

SEQ ID NO: 8791 - RNA, 17 nt, Homo sapiens
auaaugagacccuugua

SEQ ID NO: 8792 - RNA, 17 nt, Homo sapiens
agacccuuguagaagac

SEQ ID NO: 8793 - RNA, 17 nt, Homo sapiens
uguagaagacucaggca

SEQ ID NO: 8794 - RNA, 17 nt, Homo sapiens
agacucaggcauuguau

SEQ ID NO: 8795 - RNA, 17 nt, Homo sapiens
caggcauuguauugaag

SEQ ID NO: 8796 - RNA, 17 nt, Homo sapiens
auugaaggaugggaacc

SEQ ID NO: 8797 - RNA, 17 nt, Homo sapiens
ggaugggaaccggaacc

SEQ ID NO: 8798 - RNA, 17 nt, Homo sapiens
gaaccggaaccucacua

SEQ ID NO: 8799 - RNA, 17 nt, Homo sapiens
cacuauccgcagaguga

SEQ ID NO: 8800 - RNA, 17 nt, Homo sapiens
uccgcagagugaggaag

SEQ ID NO: 8801 - RNA, 17 nt, Homo sapiens
gaaggaggacgaaggcc

SEQ ID NO: 8802 - RNA, 17 nt, Homo sapiens
ggacgaaggccucuaca

SEQ ID NO: 8803 - RNA, 17 nt, Homo sapiens
cuacaccugccaggcau

SEQ ID NO: 8804 - RNA, 17 nt, Homo sapiens
ccugccaggcaugcagu

SEQ ID NO: 8805 - RNA, 17 nt, Homo sapiens
ccaggcaugcaguguuc

SEQ ID NO: 8806 - RNA, 17 nt, Homo sapiens
ggcaugcaguguucuug

SEQ ID NO: 8807 - RNA, 17 nt, Homo sapiens
caugcaguguucuuggc

SEQ ID NO: 8808 - RNA, 17 nt, Homo sapiens
uguucuuggcugugcaa

SEQ ID NO: 8809 - RNA, 17 nt, Homo sapiens
ucuuggcugugcaaaag

SEQ ID NO: 8810 - RNA, 17 nt, Homo sapiens
uuggcugugcaaaagug

SEQ ID NO: 8811 - RNA, 17 nt, Homo sapiens
gugcaaaaguggaggca

SEQ ID NO: 8812 - RNA, 17 nt, Homo sapiens
aaguggaggcauuuuuc

SEQ ID NO: 8813 - RNA, 17 nt, Homo sapiens
uuuucauaauagaaggu

SEQ ID NO: 8814 - RNA, 17 nt, Homo sapiens
aauagaaggugcccagg

SEQ ID NO: 8815 - RNA, 17 nt, Homo sapiens
uagaaggugcccaggaa

SEQ ID NO: 8816 - RNA, 17 nt, Homo sapiens
aggaaaagacgaacuug

SEQ ID NO: 8817 - RNA, 17 nt, Homo sapiens
aaagacgaacuuggaaa

SEQ ID NO: 8818 - RNA, 17 nt, Homo sapiens
acuuggaaaucauuauu

SEQ ID NO: 8819 - RNA, 17 nt, Homo sapiens
uuauucuaguaggcacg

SEQ ID NO: 8820 - RNA, 17 nt, Homo sapiens
ucuaguaggcacggcgg

SEQ ID NO: 8821 - RNA, 17 nt, Homo sapiens
uaguaggcacggcggug

SEQ ID NO: 8822 - RNA, 17 nt, Homo sapiens
uaggcacggcggugauu

SEQ ID NO: 8823 - RNA, 17 nt, Homo sapiens
gcacggcggugauugcc

SEQ ID NO: 8824 - RNA, 17 nt, Homo sapiens
cggcggugauugccaug

SEQ ID NO: 8825 - RNA, 17 nt, Homo sapiens
cggugauugccauguuc

SEQ ID NO: 8826 - RNA, 17 nt, Homo sapiens
auugccauguucuucug

SEQ ID NO: 8827 - RNA, 17 nt, Homo sapiens
uucuucuggcuacuucu

SEQ ID NO: 8828 - RNA, 17 nt, Homo sapiens
uacuucuugucaucauc

SEQ ID NO: 8829 - RNA, 17 nt, Homo sapiens
uugucaucauccuacgg

SEQ ID NO: 8830 - RNA, 17 nt, Homo sapiens
aucauccuacggaccgu

SEQ ID NO: 8831 - RNA, 17 nt, Homo sapiens
uccuacggaccguuaag

SEQ ID NO: 8832 - RNA, 17 nt, Homo sapiens
uacggaccguuaagcgg

SEQ ID NO: 8833 - RNA, 17 nt, Homo sapiens
accguuaagcgggccaa

SEQ ID NO: 8834 - RNA, 17 nt, Homo sapiens
uuaagcgggccaaugga

SEQ ID NO: 8835 - RNA, 17 nt, Homo sapiens
gcgggccaauggagggg

SEQ ID NO: 8836 - RNA, 17 nt, Homo sapiens
ggaggggaacugaagac

SEQ ID NO: 8837 - RNA, 17 nt, Homo sapiens
aacugaagacaggcuac

SEQ ID NO: 8838 - RNA, 17 nt, Homo sapiens
gaagacaggcuacuugu

SEQ ID NO: 8839 - RNA, 17 nt, Homo sapiens
ggcuacuuguccaucgu

SEQ ID NO: 8840 - RNA, 17 nt, Homo sapiens
uguccaucgucauggau

SEQ ID NO: 8841 - RNA, 17 nt, Homo sapiens
cgucauggauccagaug

SEQ ID NO: 8842 - RNA, 17 nt, Homo sapiens
ggauccagaugaacucc

SEQ ID NO: 8843 - RNA, 17 nt, Homo sapiens
ccagaugaacucccauu

SEQ ID NO: 8844 - RNA, 17 nt, Homo sapiens
cccauuggaugaacauu

SEQ ID NO: 8845 - RNA, 17 nt, Homo sapiens
uuggaugaacauuguga

SEQ ID NO: 8846 - RNA, 17 nt, Homo sapiens
ugaacauugugaacgac

SEQ ID NO: 8847 - RNA, 17 nt, Homo sapiens
cauugugaacgacugcc

SEQ ID NO: 8848 - RNA, 17 nt, Homo sapiens
ugugaacgacugccuua

SEQ ID NO: 8849 - RNA, 17 nt, Homo sapiens
gaacgacugccuuauga

SEQ ID NO: 8850 - RNA, 17 nt, Homo sapiens
gccuuaugaugccagca

SEQ ID NO: 8851 - RNA, 17 nt, Homo sapiens
cuuaugaugccagcaaa

SEQ ID NO: 8852 - RNA, 17 nt, Homo sapiens
ugaugccagcaaauggg

SEQ ID NO: 8853 - RNA, 17 nt, Homo sapiens
gccagcaaaugggaauu

SEQ ID NO: 8854 - RNA, 17 nt, Homo sapiens
aaaugggaauuccccag

SEQ ID NO: 8855 - RNA, 17 nt, Homo sapiens
ccccagagaccggcuga

SEQ ID NO: 8856 - RNA, 17 nt, Homo sapiens
agagaccggcugaagcu

SEQ ID NO: 8857 - RNA, 17 nt, Homo sapiens
cggcugaagcuagguaa

SEQ ID NO: 8858 - RNA, 17 nt, Homo sapiens
gaagcuagguaagccuc

SEQ ID NO: 8859 - RNA, 17 nt, Homo sapiens
cuagguaagccucuugg

SEQ ID NO: 8860 - RNA, 17 nt, Homo sapiens
gccucuuggccguggug

SEQ ID NO: 8861 - RNA, 17 nt, Homo sapiens
ucuuggccguggugccu

SEQ ID NO: 8862 - RNA, 17 nt, Homo sapiens
uggccguggugccuuug

SEQ ID NO: 8863 - RNA, 17 nt, Homo sapiens
gccguggugccuuuggc

SEQ ID NO: 8864 - RNA, 17 nt, Homo sapiens
ugccuuuggccaaguga

SEQ ID NO: 8865 - RNA, 17 nt, Homo sapiens
uuggccaagugauugaa

SEQ ID NO: 8866 - RNA, 17 nt, Homo sapiens
gccaagugauugaagca

SEQ ID NO: 8867 - RNA, 17 nt, Homo sapiens
ugauugaagcagaugcc

SEQ ID NO: 8868 - RNA, 17 nt, Homo sapiens
ugaagcagaugccuuug

SEQ ID NO: 8869 - RNA, 17 nt, Homo sapiens
aagcagaugccuuugga

SEQ ID NO: 8870 - RNA, 17 nt, Homo sapiens
ccuuuggaauugacaag

SEQ ID NO: 8871 - RNA, 17 nt, Homo sapiens
uggaauugacaagacag

SEQ ID NO: 8872 - RNA, 17 nt, Homo sapiens
uugacaagacagcaacu

SEQ ID NO: 8873 - RNA, 17 nt, Homo sapiens
acaagacagcaacuugc

SEQ ID NO: 8874 - RNA, 17 nt, Homo sapiens
agacagcaacuugcagg

SEQ ID NO: 8875 - RNA, 17 nt, Homo sapiens
agcaacuugcaggacag

SEQ ID NO: 8876 - RNA, 17 nt, Homo sapiens
cuugcaggacaguagca

SEQ ID NO: 8877 - RNA, 17 nt, Homo sapiens
gcaggacaguagcaguc

SEQ ID NO: 8878 - RNA, 17 nt, Homo sapiens
ggacaguagcagucaaa

SEQ ID NO: 8879 - RNA, 17 nt, Homo sapiens
caguagcagucaaaaug

SEQ ID NO: 8880 - RNA, 17 nt, Homo sapiens
cagucaaaauguugaaa

SEQ ID NO: 8881 - RNA, 17 nt, Homo sapiens
gucaaaauguugaaaga

SEQ ID NO: 8882 - RNA, 17 nt, Homo sapiens
aagaaggagcaacacac

SEQ ID NO: 8883 - RNA, 17 nt, Homo sapiens
aaggagcaacacacagu

SEQ ID NO: 8884 - RNA, 17 nt, Homo sapiens
aacacacagugagcauc

SEQ ID NO: 8885 - RNA, 17 nt, Homo sapiens
cacagugagcaucgagc

SEQ ID NO: 8886 - RNA, 17 nt, Homo sapiens
agcaucgagcucucaug

SEQ ID NO: 8887 - RNA, 17 nt, Homo sapiens
gcucucaugucugaacu

SEQ ID NO: 8888 - RNA, 17 nt, Homo sapiens
augucugaacucaagau

SEQ ID NO: 8889 - RNA, 17 nt, Homo sapiens
aacucaagauccucauu

SEQ ID NO: 8890 - RNA, 17 nt, Homo sapiens
ucauauuggucaccauc

SEQ ID NO: 8891 - RNA, 17 nt, Homo sapiens
ccaucucaaugugguca

SEQ ID NO: 8892 - RNA, 17 nt, Homo sapiens
aucucaauguggucaac

SEQ ID NO: 8893 - RNA, 17 nt, Homo sapiens
ucaauguggucaaccuu

SEQ ID NO: 8894 - RNA, 17 nt, Homo sapiens
uguggucaaccuucuag

SEQ ID NO: 8895 - RNA, 17 nt, Homo sapiens
ccuucuaggugccugua

SEQ ID NO: 8896 - RNA, 17 nt, Homo sapiens
uucuaggugccuguacc

SEQ ID NO: 8897 - RNA, 17 nt, Homo sapiens
aggugccuguaccaagc

SEQ ID NO: 8898 - RNA, 17 nt, Homo sapiens
uguaccaagccaggagg

SEQ ID NO: 8899 - RNA, 17 nt, Homo sapiens
ccaggagggccacucau

SEQ ID NO: 8900 - RNA, 17 nt, Homo sapiens
cacucauggugauugug

SEQ ID NO: 8901 - RNA, 17 nt, Homo sapiens
ucauggugauuguggaa

SEQ ID NO: 8902 - RNA, 17 nt, Homo sapiens
uggugauuguggaauuc

SEQ ID NO: 8903 - RNA, 17 nt, Homo sapiens
auuguggaauucugcaa

SEQ ID NO: 8904 - RNA, 17 nt, Homo sapiens
ggaauucugcaaauuug

SEQ ID NO: 8905 - RNA, 17 nt, Homo sapiens
uucugcaaauuuggaaa

SEQ ID NO: 8906 - RNA, 17 nt, Homo sapiens
auuuggaaaccugucca

SEQ ID NO: 8907 - RNA, 17 nt, Homo sapiens
ggaaaccuguccacuua

SEQ ID NO: 8908 - RNA, 17 nt, Homo sapiens
ccugaggagcaagagaa

SEQ ID NO: 8909 - RNA, 17 nt, Homo sapiens
caagagaaaugaauuug

SEQ ID NO: 8910 - RNA, 17 nt, Homo sapiens
agaaaugaauuuguccc

SEQ ID NO: 8911 - RNA, 17 nt, Homo sapiens
augaauuuguccccuac

SEQ ID NO: 8912 - RNA, 17 nt, Homo sapiens
ccuacaagaccaaaggg

SEQ ID NO: 8913 - RNA, 17 nt, Homo sapiens
ccaaaggggcacgauuc

SEQ ID NO: 8914 - RNA, 17 nt, Homo sapiens
ggggcacgauuccguca

SEQ ID NO: 8915 - RNA, 17 nt, Homo sapiens
acgauuccgucaaggga

SEQ ID NO: 8916 - RNA, 17 nt, Homo sapiens
agggaaagacuacguug

SEQ ID NO: 8917 - RNA, 17 nt, Homo sapiens
aagacuacguuggagca

SEQ ID NO: 8918 - RNA, 17 nt, Homo sapiens
acguuggagcaaucccu

SEQ ID NO: 8919 - RNA, 17 nt, Homo sapiens
uuggagcaaucccugug

SEQ ID NO: 8920 - RNA, 17 nt, Homo sapiens
caaucccuguggaucug

SEQ ID NO: 8921 - RNA, 17 nt, Homo sapiens
cccuguggaucugaaac

SEQ ID NO: 8922 - RNA, 17 nt, Homo sapiens
gaucugaaacggcgcuu

SEQ ID NO: 8923 - RNA, 17 nt, Homo sapiens
cugaaacggcgcuugga

SEQ ID NO: 8924 - RNA, 17 nt, Homo sapiens
gaaacggcgcuuggaca

SEQ ID NO: 8925 - RNA, 17 nt, Homo sapiens
gcgcuuggacagcauca

SEQ ID NO: 8926 - RNA, 17 nt, Homo sapiens
cuuggacagcaucacca

SEQ ID NO: 8927 - RNA, 17 nt, Homo sapiens
caucaccaguagccaga

SEQ ID NO: 8928 - RNA, 17 nt, Homo sapiens
caccaguagccagagcu

SEQ ID NO: 8929 - RNA, 17 nt, Homo sapiens
uagccagagcucagcca

SEQ ID NO: 8930 - RNA, 17 nt, Homo sapiens
agagcucagccagcucu

SEQ ID NO: 8931 - RNA, 17 nt, Homo sapiens
cucagccagcucuggau

SEQ ID NO: 8932 - RNA, 17 nt, Homo sapiens
agcucuggauuugugga

SEQ ID NO: 8933 - RNA, 17 nt, Homo sapiens
cuggauuuguggaggag

SEQ ID NO: 8934 - RNA, 17 nt, Homo sapiens
gaggagaagucccucag

SEQ ID NO: 8935 - RNA, 17 nt, Homo sapiens
gucccucagugauguag

SEQ ID NO: 8936 - RNA, 17 nt, Homo sapiens
ccucagugauguagaag

SEQ ID NO: 8937 - RNA, 17 nt, Homo sapiens
ucagugauguagaagaa

SEQ ID NO: 8938 - RNA, 17 nt, Homo sapiens
aagaggaagcuccugaa

SEQ ID NO: 8939 - RNA, 17 nt, Homo sapiens
uccugaagaucuguaua

SEQ ID NO: 8940 - RNA, 17 nt, Homo sapiens
gaagaucuguauaagga

SEQ ID NO: 8941 - RNA, 17 nt, Homo sapiens
guauaaggacuuccuga

SEQ ID NO: 8942 - RNA, 17 nt, Homo sapiens
acuuccugaccuuggag

SEQ ID NO: 8943 - RNA, 17 nt, Homo sapiens
accuuggagcaucucau

SEQ ID NO: 8944 - RNA, 17 nt, Homo sapiens
ucucaucuguuacagcu

SEQ ID NO: 8945 - RNA, 17 nt, Homo sapiens
cuguuacagcuuccaag

SEQ ID NO: 8946 - RNA, 17 nt, Homo sapiens
gcuuccaaguggcuaag

SEQ ID NO: 8947 - RNA, 17 nt, Homo sapiens
uccaaguggcuaagggc

SEQ ID NO: 8948 - RNA, 17 nt, Homo sapiens
ggcuaagggcauggagu

SEQ ID NO: 8949 - RNA, 17 nt, Homo sapiens
ggcauggaguucuuggc

SEQ ID NO: 8950 - RNA, 17 nt, Homo sapiens
aguucuuggcaucgcga

SEQ ID NO: 8951 - RNA, 17 nt, Homo sapiens
uuggcaucgcgaaagug

SEQ ID NO: 8952 - RNA, 17 nt, Homo sapiens
ucgcgaaaguguaucca

SEQ ID NO: 8953 - RNA, 17 nt, Homo sapiens
gcgaaaguguauccaca

SEQ ID NO: 8954 - RNA, 17 nt, Homo sapiens
ccacagggaccuggcgg

SEQ ID NO: 8955 - RNA, 17 nt, Homo sapiens
gggaccuggcggcacga

SEQ ID NO: 8956 - RNA, 17 nt, Homo sapiens
accuggcggcacgaaau

SEQ ID NO: 8957 - RNA, 17 nt, Homo sapiens
ggcacgaaauauccucu

SEQ ID NO: 8958 - RNA, 17 nt, Homo sapiens
ggagaagaacgugguua

SEQ ID NO: 8959 - RNA, 17 nt, Homo sapiens
agaagaacgugguuaaa

SEQ ID NO: 8960 - RNA, 17 nt, Homo sapiens
agaacgugguuaaaauc

SEQ ID NO: 8961 - RNA, 17 nt, Homo sapiens
ugguuaaaaucugugac

SEQ ID NO: 8962 - RNA, 17 nt, Homo sapiens
uaaaaucugugacuuug

SEQ ID NO: 8963 - RNA, 17 nt, Homo sapiens
aaucugugacuuuggcu

SEQ ID NO: 8964 - RNA, 17 nt, Homo sapiens
ugacuuuggcuuggccc

SEQ ID NO: 8965 - RNA, 17 nt, Homo sapiens
uuggcuuggcccgggau

SEQ ID NO: 8966 - RNA, 17 nt, Homo sapiens
ggcccgggauauuuaua

SEQ ID NO: 8967 - RNA, 17 nt, Homo sapiens
uuauaaagauccagauu

SEQ ID NO: 8968 - RNA, 17 nt, Homo sapiens
agauccagauuauguca

SEQ ID NO: 8969 - RNA, 17 nt, Homo sapiens
cagauuaugucagaaaa

SEQ ID NO: 8970 - RNA, 17 nt, Homo sapiens
aaaaggagaugcucgcc

SEQ ID NO: 8971 - RNA, 17 nt, Homo sapiens
aaggagaugcucgccuc

SEQ ID NO: 8972 - RNA, 17 nt, Homo sapiens
agaugcucgccucccuu

SEQ ID NO: 8973 - RNA, 17 nt, Homo sapiens
ccuuugaaauggauggc

SEQ ID NO: 8974 - RNA, 17 nt, Homo sapiens
ugaaauggauggcccca

SEQ ID NO: 8975 - RNA, 17 nt, Homo sapiens
aauggauggccccagaa

SEQ ID NO: 8976 - RNA, 17 nt, Homo sapiens
ccccagaaacaauuuuu

SEQ ID NO: 8977 - RNA, 17 nt, Homo sapiens
cagaaacaauuuuugac

SEQ ID NO: 8978 - RNA, 17 nt, Homo sapiens
aauuuuugacagagugu

SEQ ID NO: 8979 - RNA, 17 nt, Homo sapiens
uugacagaguguacaca

SEQ ID NO: 8980 - RNA, 17 nt, Homo sapiens
gacagaguguacacaau

SEQ ID NO: 8981 - RNA, 17 nt, Homo sapiens
uguacacaauccagagu

SEQ ID NO: 8982 - RNA, 17 nt, Homo sapiens
aauccagagugacgucu

SEQ ID NO: 8983 - RNA, 17 nt, Homo sapiens
ccagagugacgucuggu

SEQ ID NO: 8984 - RNA, 17 nt, Homo sapiens
agagugacgucuggucu

SEQ ID NO: 8985 - RNA, 17 nt, Homo sapiens
gacgucuggucuuuugg

SEQ ID NO: 8986 - RNA, 17 nt, Homo sapiens
gucuuuugguguuuugc

SEQ ID NO: 8987 - RNA, 17 nt, Homo sapiens
cuuuugguguuuugcug

SEQ ID NO: 8988 - RNA, 17 nt, Homo sapiens
gguguuuugcuguggga

SEQ ID NO: 8989 - RNA, 17 nt, Homo sapiens
guuuugcugugggaaau

SEQ ID NO: 8990 - RNA, 17 nt, Homo sapiens
ugugggaaauauuuucc

SEQ ID NO: 8991 - RNA, 17 nt, Homo sapiens
uuccuuaggugcuucuc

SEQ ID NO: 8992 - RNA, 17 nt, Homo sapiens
ccuuaggugcuucucca

SEQ ID NO: 8993 - RNA, 17 nt, Homo sapiens
auccugggguaaagauu

SEQ ID NO: 8994 - RNA, 17 nt, Homo sapiens
ggguaaagauugaugaa

SEQ ID NO: 8995 - RNA, 17 nt, Homo sapiens
aaagauugaugaagaau

SEQ ID NO: 8996 - RNA, 17 nt, Homo sapiens
gaugaagaauuuuguag

SEQ ID NO: 8997 - RNA, 17 nt, Homo sapiens
agaauuuuguaggcgau

SEQ ID NO: 8998 - RNA, 17 nt, Homo sapiens
uuuuguaggcgauugaa

SEQ ID NO: 8999 - RNA, 17 nt, Homo sapiens
uguaggcgauugaaaga

SEQ ID NO: 9000 - RNA, 17 nt, Homo sapiens
aagaaggaacuagaaug

SEQ ID NO: 9001 - RNA, 17 nt, Homo sapiens
gaacuagaaugagggcc

SEQ ID NO: 9002 - RNA, 17 nt, Homo sapiens
gaaugagggccccugau

SEQ ID NO: 9003 - RNA, 17 nt, Homo sapiens
ggccccugauuauacua

SEQ ID NO: 9004 - RNA, 17 nt, Homo sapiens
caccagaaauguaccag

SEQ ID NO: 9005 - RNA, 17 nt, Homo sapiens
ccagaaauguaccagac

SEQ ID NO: 9006 - RNA, 17 nt, Homo sapiens
uguaccagaccaugcug

SEQ ID NO: 9007 - RNA, 17 nt, Homo sapiens
cagaccaugcuggacug

SEQ ID NO: 9008 - RNA, 17 nt, Homo sapiens
gcuggacugcuggcacg

SEQ ID NO: 9009 - RNA, 17 nt, Homo sapiens
gacugcuggcacgggga

SEQ ID NO: 9010 - RNA, 17 nt, Homo sapiens
cacggggagcccaguca

SEQ ID NO: 9011 - RNA, 17 nt, Homo sapiens
ggagcccagucagagac

SEQ ID NO: 9012 - RNA, 17 nt, Homo sapiens
agucagagacccacguu

SEQ ID NO: 9013 - RNA, 17 nt, Homo sapiens
agacccacguuuucaga

SEQ ID NO: 9014 - RNA, 17 nt, Homo sapiens
uuuucagaguuggugga

SEQ ID NO: 9015 - RNA, 17 nt, Homo sapiens
cagaguugguggaacau

SEQ ID NO: 9016 - RNA, 17 nt, Homo sapiens
uugguggaacauuuggg

SEQ ID NO: 9017 - RNA, 17 nt, Homo sapiens
uuugggaaaucucuugc

SEQ ID NO: 9018 - RNA, 17 nt, Homo sapiens
aaucucuugcaagcuaa

SEQ ID NO: 9019 - RNA, 17 nt, Homo sapiens
ucuugcaagcuaaugcu

SEQ ID NO: 9020 - RNA, 17 nt, Homo sapiens
gcaagcuaaugcucagc

SEQ ID NO: 9021 - RNA, 17 nt, Homo sapiens
aagcuaaugcucagcag

SEQ ID NO: 9022 - RNA, 17 nt, Homo sapiens
aaugcucagcaggaugg

SEQ ID NO: 9023 - RNA, 17 nt, Homo sapiens
ucagcaggauggcaaag

SEQ ID NO: 9024 - RNA, 17 nt, Homo sapiens
gcaggauggcaaagacu

SEQ ID NO: 9025 - RNA, 17 nt, Homo sapiens
uggcaaagacuacauug

SEQ ID NO: 9026 - RNA, 17 nt, Homo sapiens
acuacauuguucuuccg

SEQ ID NO: 9027 - RNA, 17 nt, Homo sapiens
uucuuccgauaucagag

SEQ ID NO: 9028 - RNA, 17 nt, Homo sapiens
uaucagagacuuugagc

SEQ ID NO: 9029 - RNA, 17 nt, Homo sapiens
gacuuugagcauggaag

SEQ ID NO: 9030 - RNA, 17 nt, Homo sapiens
ggaagaggauucuggac

SEQ ID NO: 9031 - RNA, 17 nt, Homo sapiens
gauucuggacucucucu

SEQ ID NO: 9032 - RNA, 17 nt, Homo sapiens
cucucucugccuaccuc

SEQ ID NO: 9033 - RNA, 17 nt, Homo sapiens
ccucaccuguuuccugu

SEQ ID NO: 9034 - RNA, 17 nt, Homo sapiens
uguuuccuguauggagg

SEQ ID NO: 9035 - RNA, 17 nt, Homo sapiens
aggaggaaguaugugac

SEQ ID NO: 9036 - RNA, 17 nt, Homo sapiens
ggaaguaugugacccca

SEQ ID NO: 9037 - RNA, 17 nt, Homo sapiens
aguaugugaccccaaau

SEQ ID NO: 9038 - RNA, 17 nt, Homo sapiens
gaccccaaauuccauua

SEQ ID NO: 9039 - RNA, 17 nt, Homo sapiens
ccauuaugacaacacag

SEQ ID NO: 9040 - RNA, 17 nt, Homo sapiens
uuaugacaacacagcag

SEQ ID NO: 9041 - RNA, 17 nt, Homo sapiens
acaacacagcaggaauc

SEQ ID NO: 9042 - RNA, 17 nt, Homo sapiens
cagcaggaaucagucag

SEQ ID NO: 9043 - RNA, 17 nt, Homo sapiens
aggaaucagucaguauc

SEQ ID NO: 9044 - RNA, 17 nt, Homo sapiens
aucagucaguaucugca

SEQ ID NO: 9045 - RNA, 17 nt, Homo sapiens
caguaucugcagaacag

SEQ ID NO: 9046 - RNA, 17 nt, Homo sapiens
ucugcagaacaguaagc

SEQ ID NO: 9047 - RNA, 17 nt, Homo sapiens
gcagaacaguaagcgaa

SEQ ID NO: 9048 - RNA, 17 nt, Homo sapiens
aacaguaagcgaaagag

SEQ ID NO: 9049 - RNA, 17 nt, Homo sapiens
gcgaaagagccggccug

SEQ ID NO: 9050 - RNA, 17 nt, Homo sapiens
aagagccggccugugag

SEQ ID NO: 9051 - RNA, 17 nt, Homo sapiens
gccggccugugagugua

SEQ ID NO: 9052 - RNA, 17 nt, Homo sapiens
gccugugaguguaaaaa

SEQ ID NO: 9053 - RNA, 17 nt, Homo sapiens
cugugaguguaaaaaca

SEQ ID NO: 9054 - RNA, 17 nt, Homo sapiens
guguaaaaacauuugaa

SEQ ID NO: 9055 - RNA, 17 nt, Homo sapiens
auuugaagauaucccgu

SEQ ID NO: 9056 - RNA, 17 nt, Homo sapiens
gauaucccguuagaaga

SEQ ID NO: 9057 - RNA, 17 nt, Homo sapiens
uuagaagaaccagaagu

SEQ ID NO: 9058 - RNA, 17 nt, Homo sapiens
aaccagaaguaaaagua

SEQ ID NO: 9059 - RNA, 17 nt, Homo sapiens
aaguaaaaguaauccca

SEQ ID NO: 9060 - RNA, 17 nt, Homo sapiens
uaaaaguaaucccagau

SEQ ID NO: 9061 - RNA, 17 nt, Homo sapiens
aaucccagaugacaacc

SEQ ID NO: 9062 - RNA, 17 nt, Homo sapiens
cccagaugacaaccaga

SEQ ID NO: 9063 - RNA, 17 nt, Homo sapiens
agaugacaaccagacgg

SEQ ID NO: 9064 - RNA, 17 nt, Homo sapiens
acaaccagacggacagu

SEQ ID NO: 9065 - RNA, 17 nt, Homo sapiens
ccagacggacaguggua

SEQ ID NO: 9066 - RNA, 17 nt, Homo sapiens
gacggacagugguaugg

SEQ ID NO: 9067 - RNA, 17 nt, Homo sapiens
ggacagugguaugguuc

SEQ ID NO: 9068 - RNA, 17 nt, Homo sapiens
gugguaugguucuugcc

SEQ ID NO: 9069 - RNA, 17 nt, Homo sapiens
ugguucuugccucagaa

SEQ ID NO: 9070 - RNA, 17 nt, Homo sapiens
ucagaagagcugaaaac

SEQ ID NO: 9071 - RNA, 17 nt, Homo sapiens
agcugaaaacuuuggaa

SEQ ID NO: 9072 - RNA, 17 nt, Homo sapiens
uuuggaagacagaacca

SEQ ID NO: 9073 - RNA, 17 nt, Homo sapiens
aagacagaaccaaauua

SEQ ID NO: 9074 - RNA, 17 nt, Homo sapiens
agaaccaaauuaucucc

SEQ ID NO: 9075 - RNA, 17 nt, Homo sapiens
aucuuuugguggaaugg

SEQ ID NO: 9076 - RNA, 17 nt, Homo sapiens
uugguggaauggugccc

SEQ ID NO: 9077 - RNA, 17 nt, Homo sapiens
guggaauggugcccagc

SEQ ID NO: 9078 - RNA, 17 nt, Homo sapiens
ggaauggugcccagcaa

SEQ ID NO: 9079 - RNA, 17 nt, Homo sapiens
ggugcccagcaaaagca

SEQ ID NO: 9080 - RNA, 17 nt, Homo sapiens
cagcaaaagcagggagu

SEQ ID NO: 9081 - RNA, 17 nt, Homo sapiens
agcagggagucuguggc

SEQ ID NO: 9082 - RNA, 17 nt, Homo sapiens
gggagucuguggcaucu

SEQ ID NO: 9083 - RNA, 17 nt, Homo sapiens
agucuguggcaucugaa

SEQ ID NO: 9084 - RNA, 17 nt, Homo sapiens
aucugaaggcucaaacc

SEQ ID NO: 9085 - RNA, 17 nt, Homo sapiens
aggcucaaaccagacaa

SEQ ID NO: 9086 - RNA, 17 nt, Homo sapiens
caaaccagacaagcggc

SEQ ID NO: 9087 - RNA, 17 nt, Homo sapiens
ccagacaagcggcuacc

SEQ ID NO: 9088 - RNA, 17 nt, Homo sapiens
gacaagcggcuaccagu

SEQ ID NO: 9089 - RNA, 17 nt, Homo sapiens
ggcuaccaguccggaua

SEQ ID NO: 9090 - RNA, 17 nt, Homo sapiens
caguccggauaucacuc

SEQ ID NO: 9091 - RNA, 17 nt, Homo sapiens
ucacuccgaugacacag

SEQ ID NO: 9092 - RNA, 17 nt, Homo sapiens
cuccgaugacacagaca

SEQ ID NO: 9093 - RNA, 17 nt, Homo sapiens
ugacacagacaccaccg

SEQ ID NO: 9094 - RNA, 17 nt, Homo sapiens
acaccaccguguacucc

SEQ ID NO: 9095 - RNA, 17 nt, Homo sapiens
accaccguguacuccag

SEQ ID NO: 9096 - RNA, 17 nt, Homo sapiens
guacuccagugaggaag

SEQ ID NO: 9097 - RNA, 17 nt, Homo sapiens
gugaggaagcagaacuu

SEQ ID NO: 9098 - RNA, 17 nt, Homo sapiens
gaagcagaacuuuuaaa

SEQ ID NO: 9099 - RNA, 17 nt, Homo sapiens
cuuuuaaagcugauaga

SEQ ID NO: 9100 - RNA, 17 nt, Homo sapiens
uaaagcugauagagauu

SEQ ID NO: 9101 - RNA, 17 nt, Homo sapiens
ugauagagauuggagug

SEQ ID NO: 9102 - RNA, 17 nt, Homo sapiens
agauuggagugcaaacc

SEQ ID NO: 9103 - RNA, 17 nt, Homo sapiens
auuggagugcaaaccgg

SEQ ID NO: 9104 - RNA, 17 nt, Homo sapiens
gagugcaaaccgguagc

SEQ ID NO: 9105 - RNA, 17 nt, Homo sapiens
gcaaaccgguagcacag

SEQ ID NO: 9106 - RNA, 17 nt, Homo sapiens
aaccgguagcacagccc

SEQ ID NO: 9107 - RNA, 17 nt, Homo sapiens
guagcacagcccagauu

SEQ ID NO: 9108 - RNA, 17 nt, Homo sapiens
cagcccagauucuccag

SEQ ID NO: 9109 - RNA, 17 nt, Homo sapiens
auucuccagccugacuc

SEQ ID NO: 9110 - RNA, 17 nt, Homo sapiens
ccagccugacucgggga

SEQ ID NO: 9111 - RNA, 17 nt, Homo sapiens
acucggggaccacacug

SEQ ID NO: 9112 - RNA, 17 nt, Homo sapiens
cacacugagcucuccuc

SEQ ID NO: 9113 - RNA, 17 nt, Homo sapiens
cuccuccuguuuaaaag

SEQ ID NO: 9114 - RNA, 17 nt, Homo sapiens
aaaaggaagcauccaca

SEQ ID NO: 9115 - RNA, 17 nt, Homo sapiens
acaccccaacucccgga

SEQ ID NO: 9116 - RNA, 17 nt, Homo sapiens
acucccggacaucacau

SEQ ID NO: 9117 - RNA, 17 nt, Homo sapiens
caugagaggucugcuca

SEQ ID NO: 9118 - RNA, 17 nt, Homo sapiens
agaggucugcucagauu

SEQ ID NO: 9119 - RNA, 17 nt, Homo sapiens
cugcucagauuuugaag

SEQ ID NO: 9120 - RNA, 17 nt, Homo sapiens
auuuugaaguguuguuc

SEQ ID NO: 9121 - RNA, 17 nt, Homo sapiens
uuugaaguguuguucuu

SEQ ID NO: 9122 - RNA, 17 nt, Homo sapiens
gaaguguuguucuuucc

SEQ ID NO: 9123 - RNA, 17 nt, Homo sapiens
uuccaccagcaggaagu

SEQ ID NO: 9124 - RNA, 17 nt, Homo sapiens
agcaggaaguagccgca

SEQ ID NO: 9125 - RNA, 17 nt, Homo sapiens
aggaaguagccgcauuu

SEQ ID NO: 9126 - RNA, 17 nt, Homo sapiens
aaguagccgcauuugau

SEQ ID NO: 9127 - RNA, 17 nt, Homo sapiens
cgcauuugauuuucauu

SEQ ID NO: 9128 - RNA, 17 nt, Homo sapiens
ucauuucgacaacagaa

SEQ ID NO: 9129 - RNA, 17 nt, Homo sapiens
uuucgacaacagaaaaa

SEQ ID NO: 9130 - RNA, 17 nt, Homo sapiens
gaaaaaggaccucggac

SEQ ID NO: 9131 - RNA, 17 nt, Homo sapiens
gaccucggacugcaggg

SEQ ID NO: 9132 - RNA, 17 nt, Homo sapiens
cucggacugcagggagc

SEQ ID NO: 9133 - RNA, 17 nt, Homo sapiens
ugcagggagccagucuu

SEQ ID NO: 9134 - RNA, 17 nt, Homo sapiens
gggagccagucuucuag

SEQ ID NO: 9135 - RNA, 17 nt, Homo sapiens
ucuucuaggcauauccu

SEQ ID NO: 9136 - RNA, 17 nt, Homo sapiens
uucuaggcauauccugg

SEQ ID NO: 9137 - RNA, 17 nt, Homo sapiens
cuaggcauauccuggaa

SEQ ID NO: 9138 - RNA, 17 nt, Homo sapiens
uggaagaggcuugugac

SEQ ID NO: 9139 - RNA, 17 nt, Homo sapiens
agaggcuugugacccaa

SEQ ID NO: 9140 - RNA, 17 nt, Homo sapiens
ggcuugugacccaagaa

SEQ ID NO: 9141 - RNA, 17 nt, Homo sapiens
acccaagaaugugucug

SEQ ID NO: 9142 - RNA, 17 nt, Homo sapiens
ccaagaaugugucugug

SEQ ID NO: 9143 - RNA, 17 nt, Homo sapiens
aagaaugugucuguguc

SEQ ID NO: 9144 - RNA, 17 nt, Homo sapiens
augugucugugucuucu

SEQ ID NO: 9145 - RNA, 17 nt, Homo sapiens
gugucugugucuucucc

SEQ ID NO: 9146 - RNA, 17 nt, Homo sapiens
uucucccaguguugacc

SEQ ID NO: 9147 - RNA, 17 nt, Homo sapiens
cucccaguguugaccug

SEQ ID NO: 9148 - RNA, 17 nt, Homo sapiens
caguguugaccugaucc

SEQ ID NO: 9149 - RNA, 17 nt, Homo sapiens
uugaccugauccucuuu

SEQ ID NO: 9150 - RNA, 17 nt, Homo sapiens
cuuuuuucauucauuua

SEQ ID NO: 9151 - RNA, 17 nt, Homo sapiens
uuucauucauuuaaaaa

SEQ ID NO: 9152 - RNA, 17 nt, Homo sapiens
uuuaaaaagcauuauca

SEQ ID NO: 9153 - RNA, 17 nt, Homo sapiens
uaaaaagcauuaucaug

SEQ ID NO: 9154 - RNA, 17 nt, Homo sapiens
aaagcauuaucaugccc

SEQ ID NO: 9155 - RNA, 17 nt, Homo sapiens
gcauuaucaugccccug

SEQ ID NO: 9156 - RNA, 17 nt, Homo sapiens
auuaucaugccccugcu

SEQ ID NO: 9157 - RNA, 17 nt, Homo sapiens
augccccugcugcgggu

SEQ ID NO: 9158 - RNA, 17 nt, Homo sapiens
ccccugcugcgggucuc

SEQ ID NO: 9159 - RNA, 17 nt, Homo sapiens
ugcugcgggucucacca

SEQ ID NO: 9160 - RNA, 17 nt, Homo sapiens
cgggucucaccaugggu

SEQ ID NO: 9161 - RNA, 17 nt, Homo sapiens
gucucaccauggguuua

SEQ ID NO: 9162 - RNA, 17 nt, Homo sapiens
caccauggguuuagaac

SEQ ID NO: 9163 - RNA, 17 nt, Homo sapiens
gguuuagaacaaagagc

SEQ ID NO: 9164 - RNA, 17 nt, Homo sapiens
aacaaagagcuucaagc

SEQ ID NO: 9165 - RNA, 17 nt, Homo sapiens
agcuucaagcaauggcc

SEQ ID NO: 9166 - RNA, 17 nt, Homo sapiens
uucaagcaauggcccca

SEQ ID NO: 9167 - RNA, 17 nt, Homo sapiens
aagcaauggccccaucc

SEQ ID NO: 9168 - RNA, 17 nt, Homo sapiens
auggccccauccucaaa

SEQ ID NO: 9169 - RNA, 17 nt, Homo sapiens
ucaaagaaguagcagua

SEQ ID NO: 9170 - RNA, 17 nt, Homo sapiens
aagaaguagcaguaccu

SEQ ID NO: 9171 - RNA, 17 nt, Homo sapiens
aaguagcaguaccuggg

SEQ ID NO: 9172 - RNA, 17 nt, Homo sapiens
guagcaguaccugggga

SEQ ID NO: 9173 - RNA, 17 nt, Homo sapiens
ccuggggagcugacacu

SEQ ID NO: 9174 - RNA, 17 nt, Homo sapiens
gggagcugacacuucug

SEQ ID NO: 9175 - RNA, 17 nt, Homo sapiens
gagcugacacuucugua

SEQ ID NO: 9176 - RNA, 17 nt, Homo sapiens
acacuucuguaaaacua

SEQ ID NO: 9177 - RNA, 17 nt, Homo sapiens
ucuguaaaacuagaaga

SEQ ID NO: 9178 - RNA, 17 nt, Homo sapiens
acuagaagauaaaccag

SEQ ID NO: 9179 - RNA, 17 nt, Homo sapiens
gaagauaaaccaggcaa

SEQ ID NO: 9180 - RNA, 17 nt, Homo sapiens
uaaaccaggcaacguaa

SEQ ID NO: 9181 - RNA, 17 nt, Homo sapiens
accaggcaacguaagug

SEQ ID NO: 9182 - RNA, 17 nt, Homo sapiens
caggcaacguaaguguu

SEQ ID NO: 9183 - RNA, 17 nt, Homo sapiens
caacguaaguguucgag

SEQ ID NO: 9184 - RNA, 17 nt, Homo sapiens
acguaaguguucgaggu

SEQ ID NO: 9185 - RNA, 17 nt, Homo sapiens
uguucgagguguugaag

SEQ ID NO: 9186 - RNA, 17 nt, Homo sapiens
uucgagguguugaagau

SEQ ID NO: 9187 - RNA, 17 nt, Homo sapiens
uguugaagaugggaagg

SEQ ID NO: 9188 - RNA, 17 nt, Homo sapiens
ugggaaggauuugcagg

SEQ ID NO: 9189 - RNA, 17 nt, Homo sapiens
aaggauuugcagggcug

SEQ ID NO: 9190 - RNA, 17 nt, Homo sapiens
uuugcagggcugagucu

SEQ ID NO: 9191 - RNA, 17 nt, Homo sapiens
agggcugagucuaucca

SEQ ID NO: 9192 - RNA, 17 nt, Homo sapiens
cugagucuauccaagag

SEQ ID NO: 9193 - RNA, 17 nt, Homo sapiens
uccaagaggcuuuguuu

SEQ ID NO: 9194 - RNA, 17 nt, Homo sapiens
gaggcuuuguuuaggac

SEQ ID NO: 9195 - RNA, 17 nt, Homo sapiens
uguuuaggacguggguc

SEQ ID NO: 9196 - RNA, 17 nt, Homo sapiens
uuuaggacguggguccc

SEQ ID NO: 9197 - RNA, 17 nt, Homo sapiens
ggacgugggucccaagc

SEQ ID NO: 9198 - RNA, 17 nt, Homo sapiens
ggucccaagccaagccu

SEQ ID NO: 9199 - RNA, 17 nt, Homo sapiens
caagccaagccuuaagu

SEQ ID NO: 9200 - RNA, 17 nt, Homo sapiens
agccuuaaguguggaau

SEQ ID NO: 9201 - RNA, 17 nt, Homo sapiens
ccuuaaguguggaauuc

SEQ ID NO: 9202 - RNA, 17 nt, Homo sapiens
aguguggaauucggauu

SEQ ID NO: 9203 - RNA, 17 nt, Homo sapiens
gaauucggauugauaga

SEQ ID NO: 9204 - RNA, 17 nt, Homo sapiens
ucggauugauagaaagg

SEQ ID NO: 9205 - RNA, 17 nt, Homo sapiens
aaaggaagacuaacguu

SEQ ID NO: 9206 - RNA, 17 nt, Homo sapiens
gaagacuaacguuaccu

SEQ ID NO: 9207 - RNA, 17 nt, Homo sapiens
agacuaacguuaccuug

SEQ ID NO: 9208 - RNA, 17 nt, Homo sapiens
cuaacguuaccuugcuu

SEQ ID NO: 9209 - RNA, 17 nt, Homo sapiens
guuaccuugcuuuggag

SEQ ID NO: 9210 - RNA, 17 nt, Homo sapiens
uuuggagaguacuggag

SEQ ID NO: 9211 - RNA, 17 nt, Homo sapiens
uggagaguacuggagcc

SEQ ID NO: 9212 - RNA, 17 nt, Homo sapiens
guacuggagccugcaaa

SEQ ID NO: 9213 - RNA, 17 nt, Homo sapiens
uggagccugcaaaugca

SEQ ID NO: 9214 - RNA, 17 nt, Homo sapiens
gccugcaaaugcauugu

SEQ ID NO: 9215 - RNA, 17 nt, Homo sapiens
cugcaaaugcauugugu

SEQ ID NO: 9216 - RNA, 17 nt, Homo sapiens
gcaaaugcauuguguuu

SEQ ID NO: 9217 - RNA, 17 nt, Homo sapiens
aaugcauuguguuugcu

SEQ ID NO: 9218 - RNA, 17 nt, Homo sapiens
ugcauuguguuugcucu

SEQ ID NO: 9219 - RNA, 17 nt, Homo sapiens
uuguguuugcucuggug

SEQ ID NO: 9220 - RNA, 17 nt, Homo sapiens
uugcucugguggaggug

SEQ ID NO: 9221 - RNA, 17 nt, Homo sapiens
ugguggaggugggcaug

SEQ ID NO: 9222 - RNA, 17 nt, Homo sapiens
ggaggugggcauggggu

SEQ ID NO: 9223 - RNA, 17 nt, Homo sapiens
aggugggcauggggucu

SEQ ID NO: 9224 - RNA, 17 nt, Homo sapiens
ggcauggggucuguucu

SEQ ID NO: 9225 - RNA, 17 nt, Homo sapiens
uggggucuguucugaaa

SEQ ID NO: 9226 - RNA, 17 nt, Homo sapiens
guucugaaauguaaagg

SEQ ID NO: 9227 - RNA, 17 nt, Homo sapiens
ucugaaauguaaagggu

SEQ ID NO: 9228 - RNA, 17 nt, Homo sapiens
uguaaaggguucagacg

SEQ ID NO: 9229 - RNA, 17 nt, Homo sapiens
ggguucagacgggguuu

SEQ ID NO: 9230 - RNA, 17 nt, Homo sapiens
cagacgggguuucuggu

SEQ ID NO: 9231 - RNA, 17 nt, Homo sapiens
gguuucugguuuuagaa

SEQ ID NO: 9232 - RNA, 17 nt, Homo sapiens
uuuagaagguugcgugu

SEQ ID NO: 9233 - RNA, 17 nt, Homo sapiens
agaagguugcguguucu

SEQ ID NO: 9234 - RNA, 17 nt, Homo sapiens
aagguugcguguucuuc

SEQ ID NO: 9235 - RNA, 17 nt, Homo sapiens
gguugcguguucuucga

SEQ ID NO: 9236 - RNA, 17 nt, Homo sapiens
uucuucgaguugggcua

SEQ ID NO: 9237 - RNA, 17 nt, Homo sapiens
cgaguugggcuaaagua

SEQ ID NO: 9238 - RNA, 17 nt, Homo sapiens
gggcuaaaguagaguuc

SEQ ID NO: 9239 - RNA, 17 nt, Homo sapiens
aaaguagaguucguugu

SEQ ID NO: 9240 - RNA, 17 nt, Homo sapiens
uagaguucguugugcug

SEQ ID NO: 9241 - RNA, 17 nt, Homo sapiens
aguucguugugcuguuu

SEQ ID NO: 9242 - RNA, 17 nt, Homo sapiens
uucguugugcuguuucu

SEQ ID NO: 9243 - RNA, 17 nt, Homo sapiens
guugugcuguuucugac

SEQ ID NO: 9244 - RNA, 17 nt, Homo sapiens
uguuucugacuccuaau

SEQ ID NO: 9245 - RNA, 17 nt, Homo sapiens
gacuccuaaugagaguu

SEQ ID NO: 9246 - RNA, 17 nt, Homo sapiens
uaaugagaguuccuucc

SEQ ID NO: 9247 - RNA, 17 nt, Homo sapiens
ccuuccagaccguuagc

SEQ ID NO: 9248 - RNA, 17 nt, Homo sapiens
uccagaccguuagcugu

SEQ ID NO: 9249 - RNA, 17 nt, Homo sapiens
gaccguuagcugucucc

SEQ ID NO: 9250 - RNA, 17 nt, Homo sapiens
cguuagcugucuccuug

SEQ ID NO: 9251 - RNA, 17 nt, Homo sapiens
gucuccuugccaagccc

SEQ ID NO: 9252 - RNA, 17 nt, Homo sapiens
cuugccaagccccagga

SEQ ID NO: 9253 - RNA, 17 nt, Homo sapiens
ggaagaaaaugaugcag

SEQ ID NO: 9254 - RNA, 17 nt, Homo sapiens
agaaaaugaugcagcuc

SEQ ID NO: 9255 - RNA, 17 nt, Homo sapiens
aaaaugaugcagcucug

SEQ ID NO: 9256 - RNA, 17 nt, Homo sapiens
augaugcagcucuggcu

SEQ ID NO: 9257 - RNA, 17 nt, Homo sapiens
cagcucuggcuccuugu

SEQ ID NO: 9258 - RNA, 17 nt, Homo sapiens
ggcuccuugucucccag

SEQ ID NO: 9259 - RNA, 17 nt, Homo sapiens
ucucccaggcugauccu

SEQ ID NO: 9260 - RNA, 17 nt, Homo sapiens
ccaggcugauccuuuau

SEQ ID NO: 9261 - RNA, 17 nt, Homo sapiens
gauccuuuauucagaau

SEQ ID NO: 9262 - RNA, 17 nt, Homo sapiens
uauucagaauaccacaa

SEQ ID NO: 9263 - RNA, 17 nt, Homo sapiens
uucagaauaccacaaag

SEQ ID NO: 9264 - RNA, 17 nt, Homo sapiens
agaauaccacaaagaaa

SEQ ID NO: 9265 - RNA, 17 nt, Homo sapiens
aagaaaggacauucagc

SEQ ID NO: 9266 - RNA, 17 nt, Homo sapiens
gaaaggacauucagcuc

SEQ ID NO: 9267 - RNA, 17 nt, Homo sapiens
gacauucagcucaaggc

SEQ ID NO: 9268 - RNA, 17 nt, Homo sapiens
agcucaaggcucccugc

SEQ ID NO: 9269 - RNA, 17 nt, Homo sapiens
ggcucccugccguguug

SEQ ID NO: 9270 - RNA, 17 nt, Homo sapiens
ucccugccguguugaag

SEQ ID NO: 9271 - RNA, 17 nt, Homo sapiens
ccugccguguugaagag

SEQ ID NO: 9272 - RNA, 17 nt, Homo sapiens
guugaagaguucugacu

SEQ ID NO: 9273 - RNA, 17 nt, Homo sapiens
gaguucugacugcacaa

SEQ ID NO: 9274 - RNA, 17 nt, Homo sapiens
uucugacugcacaaacc

SEQ ID NO: 9275 - RNA, 17 nt, Homo sapiens
cugacugcacaaaccag

SEQ ID NO: 9276 - RNA, 17 nt, Homo sapiens
cugcacaaaccagcuuc

SEQ ID NO: 9277 - RNA, 17 nt, Homo sapiens
acaaaccagcuucuggu

SEQ ID NO: 9278 - RNA, 17 nt, Homo sapiens
agcuucugguuucuucu

SEQ ID NO: 9279 - RNA, 17 nt, Homo sapiens
cuucuggaaugaauacc

SEQ ID NO: 9280 - RNA, 17 nt, Homo sapiens
uggaaugaauacccuca

SEQ ID NO: 9281 - RNA, 17 nt, Homo sapiens
gaaugaauacccucaua

SEQ ID NO: 9282 - RNA, 17 nt, Homo sapiens
auacccucauaucuguc

SEQ ID NO: 9283 - RNA, 17 nt, Homo sapiens
acccucauaucuguccu

SEQ ID NO: 9284 - RNA, 17 nt, Homo sapiens
ucauaucuguccugaug

SEQ ID NO: 9285 - RNA, 17 nt, Homo sapiens
cuguccugaugugauau

SEQ ID NO: 9286 - RNA, 17 nt, Homo sapiens
guccugaugugauaugu

SEQ ID NO: 9287 - RNA, 17 nt, Homo sapiens
cugaugugauaugucug

SEQ ID NO: 9288 - RNA, 17 nt, Homo sapiens
gaugugauaugucugag

SEQ ID NO: 9289 - RNA, 17 nt, Homo sapiens
ugugauaugucugagac

SEQ ID NO: 9290 - RNA, 17 nt, Homo sapiens
ugucugagacugaaugc

SEQ ID NO: 9291 - RNA, 17 nt, Homo sapiens
gagacugaaugcgggag

SEQ ID NO: 9292 - RNA, 17 nt, Homo sapiens
gacugaaugcgggaggu

SEQ ID NO: 9293 - RNA, 17 nt, Homo sapiens
ugcgggagguucaaugu

SEQ ID NO: 9294 - RNA, 17 nt, Homo sapiens
gagguucaaugugaagc

SEQ ID NO: 9295 - RNA, 17 nt, Homo sapiens
gguucaaugugaagcug

SEQ ID NO: 9296 - RNA, 17 nt, Homo sapiens
aaugugaagcugugugu

SEQ ID NO: 9297 - RNA, 17 nt, Homo sapiens
gugaagcuguguguggu

SEQ ID NO: 9298 - RNA, 17 nt, Homo sapiens
gaagcuguguguggugu

SEQ ID NO: 9299 - RNA, 17 nt, Homo sapiens
agcugugugugguguca

SEQ ID NO: 9300 - RNA, 17 nt, Homo sapiens
uguguguggugucaaag

SEQ ID NO: 9301 - RNA, 17 nt, Homo sapiens
uguguggugucaaaguu

SEQ ID NO: 9302 - RNA, 17 nt, Homo sapiens
gugucaaaguuucagga

SEQ ID NO: 9303 - RNA, 17 nt, Homo sapiens
caggaaggauuuuaccc

SEQ ID NO: 9304 - RNA, 17 nt, Homo sapiens
aggauuuuacccuuuug

SEQ ID NO: 9305 - RNA, 17 nt, Homo sapiens
acccuuuuguucuuccc

SEQ ID NO: 9306 - RNA, 17 nt, Homo sapiens
uucccccuguccccaac

SEQ ID NO: 9307 - RNA, 17 nt, Homo sapiens
uguccccaacccacucu

SEQ ID NO: 9308 - RNA, 17 nt, Homo sapiens
cccaacccacucucacc

SEQ ID NO: 9309 - RNA, 17 nt, Homo sapiens
ccacucucaccccgcaa

SEQ ID NO: 9310 - RNA, 17 nt, Homo sapiens
cucaccccgcaacccau

SEQ ID NO: 9311 - RNA, 17 nt, Homo sapiens
accccgcaacccaucag

SEQ ID NO: 9312 - RNA, 17 nt, Homo sapiens
cgcaacccaucaguauu

SEQ ID NO: 9313 - RNA, 17 nt, Homo sapiens
acccaucaguauuuuag

SEQ ID NO: 9314 - RNA, 17 nt, Homo sapiens
ccaucaguauuuuaguu

SEQ ID NO: 9315 - RNA, 17 nt, Homo sapiens
guauuuuaguuauuugg

SEQ ID NO: 9316 - RNA, 17 nt, Homo sapiens
uuuuaguuauuuggccu

SEQ ID NO: 9317 - RNA, 17 nt, Homo sapiens
guuauuuggccucuacu

SEQ ID NO: 9318 - RNA, 17 nt, Homo sapiens
uggccucuacuccagua

SEQ ID NO: 9319 - RNA, 17 nt, Homo sapiens
cuacuccaguaaaccug

SEQ ID NO: 9320 - RNA, 17 nt, Homo sapiens
uccaguaaaccugauug

SEQ ID NO: 9321 - RNA, 17 nt, Homo sapiens
uaaaccugauuggguuu

SEQ ID NO: 9322 - RNA, 17 nt, Homo sapiens
cugauuggguuuguuca

SEQ ID NO: 9323 - RNA, 17 nt, Homo sapiens
uuggguuuguucacucu

SEQ ID NO: 9324 - RNA, 17 nt, Homo sapiens
guuuguucacucucuga

SEQ ID NO: 9325 - RNA, 17 nt, Homo sapiens
cucucugaaugauuauu

SEQ ID NO: 9326 - RNA, 17 nt, Homo sapiens
ucugaaugauuauuagc

SEQ ID NO: 9327 - RNA, 17 nt, Homo sapiens
gaaugauuauuagccag

SEQ ID NO: 9328 - RNA, 17 nt, Homo sapiens
gauuauuagccagacuu

SEQ ID NO: 9329 - RNA, 17 nt, Homo sapiens
uuagccagacuucaaaa

SEQ ID NO: 9330 - RNA, 17 nt, Homo sapiens
acuucaaaauuauuuua

SEQ ID NO: 9331 - RNA, 17 nt, Homo sapiens
ucaaaauuauuuuauag

SEQ ID NO: 9332 - RNA, 17 nt, Homo sapiens
auuauuuuauagcccaa

SEQ ID NO: 9333 - RNA, 17 nt, Homo sapiens
auuuuauagcccaaauu

SEQ ID NO: 9334 - RNA, 17 nt, Homo sapiens
uagcccaaauuauaaca

SEQ ID NO: 9335 - RNA, 17 nt, Homo sapiens
cccaaauuauaacaucu

SEQ ID NO: 9336 - RNA, 17 nt, Homo sapiens
aaauuauaacaucuauu

SEQ ID NO: 9337 - RNA, 17 nt, Homo sapiens
auuauaacaucuauugu

SEQ ID NO: 9338 - RNA, 17 nt, Homo sapiens
uaacaucuauuguauua

SEQ ID NO: 9339 - RNA, 17 nt, Homo sapiens
caucuauuguauuauuu

SEQ ID NO: 9340 - RNA, 17 nt, Homo sapiens
ucuauuguauuauuuag

SEQ ID NO: 9341 - RNA, 17 nt, Homo sapiens
auuguauuauuuagacu

SEQ ID NO: 9342 - RNA, 17 nt, Homo sapiens
uuauuuagacuuuuaac

SEQ ID NO: 9343 - RNA, 17 nt, Homo sapiens
gacuuuuaacauauaga

SEQ ID NO: 9344 - RNA, 17 nt, Homo sapiens
cuuuuaacauauagagc

SEQ ID NO: 9345 - RNA, 17 nt, Homo sapiens
uuuaacauauagagcua

SEQ ID NO: 9346 - RNA, 17 nt, Homo sapiens
cauauagagcuauuucu

SEQ ID NO: 9347 - RNA, 17 nt, Homo sapiens
auagagcuauuucuacu

SEQ ID NO: 9348 - RNA, 17 nt, Homo sapiens
cuauuucuacugauuuu

SEQ ID NO: 9349 - RNA, 17 nt, Homo sapiens
uucuacugauuuuugcc

SEQ ID NO: 9350 - RNA, 17 nt, Homo sapiens
ugauuuuugcccuuguu

SEQ ID NO: 9351 - RNA, 17 nt, Homo sapiens
uugcccuuguucugucc

SEQ ID NO: 9352 - RNA, 17 nt, Homo sapiens
cuuguucuguccuuuuu

SEQ ID NO: 9353 - RNA, 17 nt, Homo sapiens
aaaagaaaauguguuuu

SEQ ID NO: 9354 - RNA, 17 nt, Homo sapiens
aagaaaauguguuuuuu

SEQ ID NO: 9355 - RNA, 17 nt, Homo sapiens
gaaaauguguuuuuugu

SEQ ID NO: 9356 - RNA, 17 nt, Homo sapiens
uguuuuuuguuugguac

SEQ ID NO: 9357 - RNA, 17 nt, Homo sapiens
uuuguuugguaccauag

SEQ ID NO: 9358 - RNA, 17 nt, Homo sapiens
uguuugguaccauagug

SEQ ID NO: 9359 - RNA, 17 nt, Homo sapiens
uugguaccauaguguga

SEQ ID NO: 9360 - RNA, 17 nt, Homo sapiens
guaccauagugugaaau

SEQ ID NO: 9361 - RNA, 17 nt, Homo sapiens
accauagugugaaaugc

SEQ ID NO: 9362 - RNA, 17 nt, Homo sapiens
agugugaaaugcuggga

SEQ ID NO: 9363 - RNA, 17 nt, Homo sapiens
ugugaaaugcugggaac

SEQ ID NO: 9364 - RNA, 17 nt, Homo sapiens
ugcugggaacaaugacu

SEQ ID NO: 9365 - RNA, 17 nt, Homo sapiens
ugggaacaaugacuaua

SEQ ID NO: 9366 - RNA, 17 nt, Homo sapiens
gaacaaugacuauaaga

SEQ ID NO: 9367 - RNA, 17 nt, Homo sapiens
caaugacuauaagacau

SEQ ID NO: 9368 - RNA, 17 nt, Homo sapiens
acuauaagacaugcuau

SEQ ID NO: 9369 - RNA, 17 nt, Homo sapiens
uauaagacaugcuaugg

SEQ ID NO: 9370 - RNA, 17 nt, Homo sapiens
uaagacaugcuauggca

SEQ ID NO: 9371 - RNA, 17 nt, Homo sapiens
gacaugcuauggcacau

SEQ ID NO: 9372 - RNA, 17 nt, Homo sapiens
augcuauggcacauaua

SEQ ID NO: 9373 - RNA, 17 nt, Homo sapiens
gcuauggcacauauauu

SEQ ID NO: 9374 - RNA, 17 nt, Homo sapiens
uauggcacauauauuua

SEQ ID NO: 9375 - RNA, 17 nt, Homo sapiens
uggcacauauauuuaua

SEQ ID NO: 9376 - RNA, 17 nt, Homo sapiens
gcacauauauuuauagu

SEQ ID NO: 9377 - RNA, 17 nt, Homo sapiens
auauauuuauagucugu

SEQ ID NO: 9378 - RNA, 17 nt, Homo sapiens
uauuuauagucuguuua

SEQ ID NO: 9379 - RNA, 17 nt, Homo sapiens
uauagucuguuuaugua

SEQ ID NO: 9380 - RNA, 17 nt, Homo sapiens
gucuguuuauguagaaa

SEQ ID NO: 9381 - RNA, 17 nt, Homo sapiens
cuguuuauguagaaaca

SEQ ID NO: 9382 - RNA, 17 nt, Homo sapiens
auguagaaacaaaugua

SEQ ID NO: 9383 - RNA, 17 nt, Homo sapiens
agaaacaaauguaauau

SEQ ID NO: 9384 - RNA, 17 nt, Homo sapiens
aaacaaauguaauauau

SEQ ID NO: 9385 - RNA, 17 nt, Homo sapiens
caaauguaauauauuaa

SEQ ID NO: 9386 - RNA, 17 nt, Homo sapiens
aauguaauauauuaaag

SEQ ID NO: 9387 - RNA, 17 nt, Homo sapiens
uguaauauauuaaagcc

SEQ ID NO: 9388 - RNA, 17 nt, Homo sapiens
auauuaaagccuuauau

SEQ ID NO: 9389 - RNA, 17 nt, Homo sapiens
aaagccuuauauauaau

SEQ ID NO: 9390 - RNA, 17 nt, Homo sapiens
agccuuauauauaauga

SEQ ID NO: 9391 - RNA, 17 nt, Homo sapiens
ccuuauauauaaugaac

SEQ ID NO: 9392 - RNA, 17 nt, Homo sapiens
uauauauaaugaacuuu

SEQ ID NO: 9393 - RNA, 17 nt, Homo sapiens
uauaaugaacuuuguac

SEQ ID NO: 9394 - RNA, 17 nt, Homo sapiens
ugaacuuuguacuauuc

SEQ ID NO: 9395 - RNA, 17 nt, Homo sapiens
aacuuuguacuauucac

SEQ ID NO: 9396 - RNA, 17 nt, Homo sapiens
uuuguacuauucacauu

SEQ ID NO: 9397 - RNA, 17 nt, Homo sapiens
uacuauucacauuuugu

SEQ ID NO: 9398 - RNA, 17 nt, Homo sapiens
cuauucacauuuuguau

SEQ ID NO: 9399 - RNA, 17 nt, Homo sapiens
cacauuuuguaucagua

SEQ ID NO: 9400 - RNA, 17 nt, Homo sapiens
cauuuuguaucaguauu

SEQ ID NO: 9401 - RNA, 17 nt, Homo sapiens
uuguaucaguauuaugu

SEQ ID NO: 9402 - RNA, 17 nt, Homo sapiens
guaucaguauuauguag

SEQ ID NO: 9403 - RNA, 17 nt, Homo sapiens
ucaguauuauguagcau

SEQ ID NO: 9404 - RNA, 17 nt, Homo sapiens
aguauuauguagcauaa

SEQ ID NO: 9405 - RNA, 17 nt, Homo sapiens
auuauguagcauaacaa

SEQ ID NO: 9406 - RNA, 17 nt, Homo sapiens
uauguagcauaacaaag

SEQ ID NO: 9407 - RNA, 17 nt, Homo sapiens
guagcauaacaaagguc

SEQ ID NO: 9408 - RNA, 17 nt, Homo sapiens
uaacaaaggucauaaug

SEQ ID NO: 9409 - RNA, 17 nt, Homo sapiens
caaaggucauaaugcuu

SEQ ID NO: 9410 - RNA, 17 nt, Homo sapiens
aggucauaaugcuuuca

SEQ ID NO: 9411 - RNA, 17 nt, Homo sapiens
gucauaaugcuuucagc

SEQ ID NO: 9412 - RNA, 17 nt, Homo sapiens
ugcuuucagcaauugau

SEQ ID NO: 9413 - RNA, 17 nt, Homo sapiens
uuucagcaauugauguc

SEQ ID NO: 9414 - RNA, 17 nt, Homo sapiens
agcaauugaugucauuu

SEQ ID NO: 9415 - RNA, 17 nt, Homo sapiens
caauugaugucauuuua

SEQ ID NO: 9416 - RNA, 17 nt, Homo sapiens
uugaugucauuuuauua

SEQ ID NO: 9417 - RNA, 17 nt, Homo sapiens
gucauuuuauuaaagaa

SEQ ID NO: 9418 - RNA, 17 nt, Homo sapiens
auuaaagaacauugaaa

SEQ ID NO: 9419 - RNA, 17 nt, Homo sapiens
uaaagaacauugaaaaa

SEQ ID NO: 9420 - RNA, 38 nt, Artificial Sequence
  Description of Artificial Sequence:  Enzymatic Nucleic Acid
gccgagagcugaugaggccguuaggccgaaaguguccg

SEQ ID NO: 9421 - RNA, 38 nt, Artificial Sequence
  Description of Artificial Sequence:  Enzymatic Nucleic Acid
ggagccgacugaugaggccguuaggccgaaaggagugu

SEQ ID NO: 9422 - RNA, 38 nt, Artificial Sequence
  Description of Artificial Sequence:  Enzymatic Nucleic Acid
gaggagcccugaugaggccguuaggccgaaagaggagu

SEQ ID NO: 9423 - RNA, 38 nt, Artificial Sequence
  Description of Artificial Sequence:  Enzymatic Nucleic Acid
ccggggagcugaugaggccguuaggccgaaagccgaga

SEQ ID NO: 9424 - RNA, 38 nt, Artificial Sequence
  Description of Artificial Sequence:  Enzymatic Nucleic Acid
cugccgggcugaugaggccguuaggccgaaaggagccg

SEQ ID NO: 9425 - RNA, 38 nt, Artificial Sequence
  Description of Artificial Sequence:  Enzymatic Nucleic Acid
cccgcucccugaugaggccguuaggccgaaagccgccg

SEQ ID NO: 9426 - RNA, 38 nt, Artificial Sequence
  Description of Artificial Sequence:  Enzymatic Nucleic Acid
gagccccgcugaugaggccguuaggccgaaagcccgcu

SEQ ID NO: 9427 - RNA, 38 nt, Artificial Sequence
  Description of Artificial Sequence:  Enzymatic Nucleic Acid
cugcaccccugaugaggccguuaggccgaaagccccgg

SEQ ID NO: 9428 - RNA, 38 nt, Artificial Sequence
  Description of Artificial Sequence:  Enzymatic Nucleic Acid
ccccgggucugaugaggccguuaggccgaaauccucgc

SEQ ID NO: 9429 - RNA, 38 nt, Artificial Sequence
  Description of Artificial Sequence:  Enzymatic Nucleic Acid
uccccgggcugaugaggccguuaggccgaaaauccucg

SEQ ID NO: 9430 - RNA, 38 nt, Artificial Sequence
  Description of Artificial Sequence:  Enzymatic Nucleic Acid
caggagaccugaugaggccguuaggccgaaaccacuuc

SEQ ID NO: 9431 - RNA, 38 nt, Artificial Sequence
  Description of Artificial Sequence:  Enzymatic Nucleic Acid
agccaggacugaugaggccguuaggccgaaacaaccac

SEQ ID NO: 9432 - RNA, 38 nt, Artificial Sequence
  Description of Artificial Sequence:  Enzymatic Nucleic Acid
ccagccagcugaugaggccguuaggccgaaagacaacc

SEQ ID NO: 9433 - RNA, 38 nt, Artificial Sequence
  Description of Artificial Sequence:  Enzymatic Nucleic Acid
cgcgcccucugaugaggccguuaggccgaaagcgcccg

SEQ ID NO: 9434 - RNA, 38 nt, Artificial Sequence
  Description of Artificial Sequence:  Enzymatic Nucleic Acid
ggccgccacugaugaggccguuaggccgaaaguccguc

SEQ ID NO: 9435 - RNA, 38 nt, Artificial Sequence
  Description of Artificial Sequence:  Enzymatic Nucleic Acid
cggccaaccugaugaggccguuaggccgaaacccggcc

SEQ ID NO: 9436 - RNA, 38 nt, Artificial Sequence
  Description of Artificial Sequence:  Enzymatic Nucleic Acid
ccccggcccugaugaggccguuaggccgaaacgacccg

SEQ ID NO: 9437 - RNA, 38 nt, Artificial Sequence
  Description of Artificial Sequence:  Enzymatic Nucleic Acid
gugagcgccugaugaggccguuaggccgaaacgcggcc

SEQ ID NO: 9438 - RNA, 38 nt, Artificial Sequence
  Description of Artificial Sequence:  Enzymatic Nucleic Acid
accauggucugaugaggccguuaggccgaaagcgcgac

SEQ ID NO: 9439 - RNA, 38 nt, Artificial Sequence
  Description of Artificial Sequence:  Enzymatic Nucleic Acid
caguagcucugaugaggccguuaggccgaaaccauggu

SEQ ID NO: 9440 - RNA, 38 nt, Artificial Sequence
  Description of Artificial Sequence:  Enzymatic Nucleic Acid
ugucccagcugaugaggccguuaggccgaaagcugacc

SEQ ID NO: 9441 - RNA, 38 nt, Artificial Sequence
  Description of Artificial Sequence:  Enzymatic Nucleic Acid
cacagcagcugaugaggccguuaggccgaaaccccggu

SEQ ID NO: 9442 - RNA, 38 nt, Artificial Sequence
  Description of Artificial Sequence:  Enzymatic Nucleic Acid
agacagcucugaugaggccguuaggccgaaagcagcgc

SEQ ID NO: 9443 - RNA, 38 nt, Artificial Sequence
  Description of Artificial Sequence:  Enzymatic Nucleic Acid
gagaagcacugaugaggccguuaggccgaaacagcuga

SEQ ID NO: 9444 - RNA, 38 nt, Artificial Sequence
  Description of Artificial Sequence:  Enzymatic Nucleic Acid
ccugugagcugaugaggccguuaggccgaaagcagaca

SEQ ID NO: 9445 - RNA, 38 nt, Artificial Sequence
  Description of Artificial Sequence:  Enzymatic Nucleic Acid
uccugugacugaugaggccguuaggccgaaaagcagac

SEQ ID NO: 9446 - RNA, 38 nt, Artificial Sequence
  Description of Artificial Sequence:  Enzymatic Nucleic Acid
gauccugucugaugaggccguuaggccgaaagaagcag

SEQ ID NO: 9447 - RNA, 38 nt, Artificial Sequence
  Description of Artificial Sequence:  Enzymatic Nucleic Acid
cugaacuacugaugaggccguuaggccgaaauccugug

SEQ ID NO: 9448 - RNA, 38 nt, Artificial Sequence
  Description of Artificial Sequence:  Enzymatic Nucleic Acid
accugaaccugaugaggccguuaggccgaaagauccug

SEQ ID NO: 9449 - RNA, 38 nt, Artificial Sequence
  Description of Artificial Sequence:  Enzymatic Nucleic Acid
ugaaccugcugaugaggccguuaggccgaaacuagauc

SEQ ID NO: 9450 - RNA, 38 nt, Artificial Sequence
  Description of Artificial Sequence:  Enzymatic Nucleic Acid
uugaaccucugaugaggccguuaggccgaaaacuagau

SEQ ID NO: 9451 - RNA, 38 nt, Artificial Sequence
  Description of Artificial Sequence:  Enzymatic Nucleic Acid
uaauuuugcugaugaggccguuaggccgaaaccugaac

SEQ ID NO: 9452 - RNA, 38 nt, Artificial Sequence
  Description of Artificial Sequence:  Enzymatic Nucleic Acid
uuaauuuucugaugaggccguuaggccgaaaaccugaa

SEQ ID NO: 9453 - RNA, 38 nt, Artificial Sequence
  Description of Artificial Sequence:  Enzymatic Nucleic Acid
gaucuuuucugaugaggccguuaggccgaaauuuugaa

SEQ ID NO: 9454 - RNA, 38 nt, Artificial Sequence
  Description of Artificial Sequence:  Enzymatic Nucleic Acid
ggaucuuucugaugaggccguuaggccgaaaauuuuga

SEQ ID NO: 9455 - RNA, 38 nt, Artificial Sequence
  Description of Artificial Sequence:  Enzymatic Nucleic Acid
caguucagcugaugaggccguuaggccgaaaucuuuua

SEQ ID NO: 9456 - RNA, 38 nt, Artificial Sequence
  Description of Artificial Sequence:  Enzymatic Nucleic Acid
gccuuuuacugaugaggccguuaggccgaaacucaguu

SEQ ID NO: 9457 - RNA, 38 nt, Artificial Sequence
  Description of Artificial Sequence:  Enzymatic Nucleic Acid
ugccuuuucugaugaggccguuaggccgaaaacucagu

SEQ ID NO: 9458 - RNA, 38 nt, Artificial Sequence
  Description of Artificial Sequence:  Enzymatic Nucleic Acid
gugccuuucugaugaggccguuaggccgaaaaacucag

SEQ ID NO: 9459 - RNA, 38 nt, Artificial Sequence
  Description of Artificial Sequence:  Enzymatic Nucleic Acid
gcuugcaucugaugaggccguuaggccgaaaugugcug

SEQ ID NO: 9460 - RNA, 38 nt, Artificial Sequence
  Description of Artificial Sequence:  Enzymatic Nucleic Acid
gcauuggacugaugaggccguuaggccgaaaugcagug

SEQ ID NO: 9461 - RNA, 38 nt, Artificial Sequence
  Description of Artificial Sequence:  Enzymatic Nucleic Acid
cugcauugcugaugaggccguuaggccgaaagaugcag

SEQ ID NO: 9462 - RNA, 38 nt, Artificial Sequence
  Description of Artificial Sequence:  Enzymatic Nucleic Acid
agaccauucugaugaggccguuaggccgaaaugggcug

SEQ ID NO: 9463 - RNA, 38 nt, Artificial Sequence
  Description of Artificial Sequence:  Enzymatic Nucleic Acid
caggcaaacugaugaggccguuaggccgaaaccauuua

SEQ ID NO: 9464 - RNA, 38 nt, Artificial Sequence
  Description of Artificial Sequence:  Enzymatic Nucleic Acid
uucaggcacugaugaggccguuaggccgaaagaccauu

SEQ ID NO: 9465 - RNA, 38 nt, Artificial Sequence
  Description of Artificial Sequence:  Enzymatic Nucleic Acid
uuucaggccugaugaggccguuaggccgaaaagaccau

SEQ ID NO: 9466 - RNA, 38 nt, Artificial Sequence
  Description of Artificial Sequence:  Enzymatic Nucleic Acid
gcuuuccucugaugaggccguuaggccgaaacucacca

SEQ ID NO: 9467 - RNA, 38 nt, Artificial Sequence
  Description of Artificial Sequence:  Enzymatic Nucleic Acid
gauuuagucugaugaggccguuaggccgaaaugcucag

SEQ ID NO: 9468 - RNA, 38 nt, Artificial Sequence
  Description of Artificial Sequence:  Enzymatic Nucleic Acid
ggcagauucugaugaggccguuaggccgaaaguuaugc

SEQ ID NO: 9469 - RNA, 38 nt, Artificial Sequence
  Description of Artificial Sequence:  Enzymatic Nucleic Acid
cacaggcacugaugaggccguuaggccgaaauuuaguu

SEQ ID NO: 9470 - RNA, 38 nt, Artificial Sequence
  Description of Artificial Sequence:  Enzymatic Nucleic Acid
uacugcagcugaugaggccguuaggccgaaauuguuug

SEQ ID NO: 9471 - RNA, 38 nt, Artificial Sequence
  Description of Artificial Sequence:  Enzymatic Nucleic Acid
guacugcacugaugaggccguuaggccgaaaauuguuu

SEQ ID NO: 9472 - RNA, 38 nt, Artificial Sequence
  Description of Artificial Sequence:  Enzymatic Nucleic Acid
gguuaaagcugaugaggccguuaggccgaaacugcaga

SEQ ID NO: 9473 - RNA, 38 nt, Artificial Sequence
  Description of Artificial Sequence:  Enzymatic Nucleic Acid
caagguuacugaugaggccguuaggccgaaaguacugc

SEQ ID NO: 9474 - RNA, 38 nt, Artificial Sequence
  Description of Artificial Sequence:  Enzymatic Nucleic Acid
ucaagguucugaugaggccguuaggccgaaaaguacug

SEQ ID NO: 9475 - RNA, 38 nt, Artificial Sequence
  Description of Artificial Sequence:  Enzymatic Nucleic Acid
uucaaggucugaugaggccguuaggccgaaaaaguacu

SEQ ID NO: 9476 - RNA, 38 nt, Artificial Sequence
  Description of Artificial Sequence:  Enzymatic Nucleic Acid
cuguguuccugaugaggccguuaggccgaaagguuaaa

SEQ ID NO: 9477 - RNA, 38 nt, Artificial Sequence
  Description of Artificial Sequence:  Enzymatic Nucleic Acid
guuugcuucugaugaggccguuaggccgaaagcugugu

SEQ ID NO: 9478 - RNA, 38 nt, Artificial Sequence
  Description of Artificial Sequence:  Enzymatic Nucleic Acid
agcuguagcugaugaggccguuaggccgaaagccagug

SEQ ID NO: 9479 - RNA, 38 nt, Artificial Sequence
  Description of Artificial Sequence:  Enzymatic Nucleic Acid
cagcuguacugaugaggccguuaggccgaaaagccagu

SEQ ID NO: 9480 - RNA, 38 nt, Artificial Sequence
  Description of Artificial Sequence:  Enzymatic Nucleic Acid
ugcagcugcugaugaggccguuaggccgaaagaagcca

SEQ ID NO: 9481 - RNA, 38 nt, Artificial Sequence
  Description of Artificial Sequence:  Enzymatic Nucleic Acid
cagcuagacugaugaggccguuaggccgaaauuugcag

SEQ ID NO: 9482 - RNA, 38 nt, Artificial Sequence
  Description of Artificial Sequence:  Enzymatic Nucleic Acid
uacagcuacugaugaggccguuaggccgaaauauuugc

SEQ ID NO: 9483 - RNA, 38 nt, Artificial Sequence
  Description of Artificial Sequence:  Enzymatic Nucleic Acid
gguacagccugaugaggccguuaggccgaaagauauuu

SEQ ID NO: 9484 - RNA, 38 nt, Artificial Sequence
  Description of Artificial Sequence:  Enzymatic Nucleic Acid
gaaguaggcugaugaggccguuaggccgaaacagcuag

SEQ ID NO: 9485 - RNA, 38 nt, Artificial Sequence
  Description of Artificial Sequence:  Enzymatic Nucleic Acid
cuuugaagcugaugaggccguuaggccgaaagguacag

SEQ ID NO: 9486 - RNA, 38 nt, Artificial Sequence
  Description of Artificial Sequence:  Enzymatic Nucleic Acid
cuucuuugcugaugaggccguuaggccgaaaguaggua

SEQ ID NO: 9487 - RNA, 38 nt, Artificial Sequence
  Description of Artificial Sequence:  Enzymatic Nucleic Acid
ucuucuuucugaugaggccguuaggccgaaaaguaggu

SEQ ID NO: 9488 - RNA, 38 nt, Artificial Sequence
  Description of Artificial Sequence:  Enzymatic Nucleic Acid
agauugcacugaugaggccguuaggccgaaauucuguu

SEQ ID NO: 9489 - RNA, 38 nt, Artificial Sequence
  Description of Artificial Sequence:  Enzymatic Nucleic Acid
aauauauacugaugaggccguuaggccgaaauugcaga

SEQ ID NO: 9490 - RNA, 38 nt, Artificial Sequence
  Description of Artificial Sequence:  Enzymatic Nucleic Acid
uaaauauacugaugaggccguuaggccgaaagauugca

SEQ ID NO: 9491 - RNA, 38 nt, Artificial Sequence
  Description of Artificial Sequence:  Enzymatic Nucleic Acid
aauaaauacugaugaggccguuaggccgaaauagauug

SEQ ID NO: 9492 - RNA, 38 nt, Artificial Sequence
  Description of Artificial Sequence:  Enzymatic Nucleic Acid
cuaauaaacugaugaggccguuaggccgaaauauagau

SEQ ID NO: 9493 - RNA, 38 nt, Artificial Sequence
  Description of Artificial Sequence:  Enzymatic Nucleic Acid
cacuaauacugaugaggccguuaggccgaaauauauag

SEQ ID NO: 9494 - RNA, 38 nt, Artificial Sequence
  Description of Artificial Sequence:  Enzymatic Nucleic Acid
ucacuaaucugaugaggccguuaggccgaaaauauaua

SEQ ID NO: 9495 - RNA, 38 nt, Artificial Sequence
  Description of Artificial Sequence:  Enzymatic Nucleic Acid
aucacuaacugaugaggccguuaggccgaaaaauauau

SEQ ID NO: 9496 - RNA, 38 nt, Artificial Sequence
  Description of Artificial Sequence:  Enzymatic Nucleic Acid
guaucacucugaugaggccguuaggccgaaauaaauau

SEQ ID NO: 9497 - RNA, 38 nt, Artificial Sequence
  Description of Artificial Sequence:  Enzymatic Nucleic Acid
uguaucaccugaugaggccguuaggccgaaaauaaaua

SEQ ID NO: 9498 - RNA, 38 nt, Artificial Sequence
  Description of Artificial Sequence:  Enzymatic Nucleic Acid
ucuaccugcugaugaggccguuaggccgaaaucacuaa

SEQ ID NO: 9499 - RNA, 38 nt, Artificial Sequence
  Description of Artificial Sequence:  Enzymatic Nucleic Acid
gaaagguccugaugaggccguuaggccgaaaccuguau

SEQ ID NO: 9500 - RNA, 38 nt, Artificial Sequence
  Description of Artificial Sequence:  Enzymatic Nucleic Acid
cucuacgacugaugaggccguuaggccgaaaggucuac

SEQ ID NO: 9501 - RNA, 38 nt, Artificial Sequence
  Description of Artificial Sequence:  Enzymatic Nucleic Acid
ucucuacgcugaugaggccguuaggccgaaaaggucua

SEQ ID NO: 9502 - RNA, 38 nt, Artificial Sequence
  Description of Artificial Sequence:  Enzymatic Nucleic Acid
aucucuaccugaugaggccguuaggccgaaaaaggucu

SEQ ID NO: 9503 - RNA, 38 nt, Artificial Sequence
  Description of Artificial Sequence:  Enzymatic Nucleic Acid
uacaucuccugaugaggccguuaggccgaaacgaaagg

SEQ ID NO: 9504 - RNA, 38 nt, Artificial Sequence
  Description of Artificial Sequence:  Enzymatic Nucleic Acid
uuucacugcugaugaggccguuaggccgaaacaucucu

SEQ ID NO: 9505 - RNA, 38 nt, Artificial Sequence
  Description of Artificial Sequence:  Enzymatic Nucleic Acid
auuucgggcugaugaggccguuaggccgaaauuucacu

SEQ ID NO: 9506 - RNA, 38 nt, Artificial Sequence
  Description of Artificial Sequence:  Enzymatic Nucleic Acid
auguguaucugaugaggccguuaggccgaaauuucggg

SEQ ID NO: 9507 - RNA, 38 nt, Artificial Sequence
  Description of Artificial Sequence:  Enzymatic Nucleic Acid
cauguguacugaugaggccguuaggccgaaaauuucgg

SEQ ID NO: 9508 - RNA, 38 nt, Artificial Sequence
  Description of Artificial Sequence:  Enzymatic Nucleic Acid
gucaugugcugaugaggccguuaggccgaaauaauuuc

SEQ ID NO: 9509 - RNA, 38 nt, Artificial Sequence
  Description of Artificial Sequence:  Enzymatic Nucleic Acid
ggaaugaccugaugaggccguuaggccgaaagcucccu

SEQ ID NO: 9510 - RNA, 38 nt, Artificial Sequence
  Description of Artificial Sequence:  Enzymatic Nucleic Acid
cagggaaucugaugaggccguuaggccgaaacgagcuc

SEQ ID NO: 9511 - RNA, 38 nt, Artificial Sequence
  Description of Artificial Sequence:  Enzymatic Nucleic Acid
cggcagggcugaugaggccguuaggccgaaaugacgag

SEQ ID NO: 9512 - RNA, 38 nt, Artificial Sequence
  Description of Artificial Sequence:  Enzymatic Nucleic Acid
ccggcaggcugaugaggccguuaggccgaaaaugacga

SEQ ID NO: 9513 - RNA, 38 nt, Artificial Sequence
  Description of Artificial Sequence:  Enzymatic Nucleic Acid
ggugacgucugaugaggccguuaggccgaaacccggca

SEQ ID NO: 9514 - RNA, 38 nt, Artificial Sequence
  Description of Artificial Sequence:  Enzymatic Nucleic Acid
aggugacgcugaugaggccguuaggccgaaaacccggc

SEQ ID NO: 9515 - RNA, 38 nt, Artificial Sequence
  Description of Artificial Sequence:  Enzymatic Nucleic Acid
uguuaggucugaugaggccguuaggccgaaacguaacc

SEQ ID NO: 9516 - RNA, 38 nt, Artificial Sequence
  Description of Artificial Sequence:  Enzymatic Nucleic Acid
agugaugucugaugaggccguuaggccgaaaggugacg

SEQ ID NO: 9517 - RNA, 38 nt, Artificial Sequence
  Description of Artificial Sequence:  Enzymatic Nucleic Acid
guaacagucugaugaggccguuaggccgaaauguuagg

SEQ ID NO: 9518 - RNA, 38 nt, Artificial Sequence
  Description of Artificial Sequence:  Enzymatic Nucleic Acid
uuuaaagucugaugaggccguuaggccgaaacagugau

SEQ ID NO: 9519 - RNA, 38 nt, Artificial Sequence
  Description of Artificial Sequence:  Enzymatic Nucleic Acid
uuuuaaagcugaugaggccguuaggccgaaaacaguga

SEQ ID NO: 9520 - RNA, 38 nt, Artificial Sequence
  Description of Artificial Sequence:  Enzymatic Nucleic Acid
cuuuuuuacugaugaggccguuaggccgaaaguaacag

SEQ ID NO: 9521 - RNA, 38 nt, Artificial Sequence
  Description of Artificial Sequence:  Enzymatic Nucleic Acid
acuuuuuucugaugaggccguuaggccgaaaaguaaca

SEQ ID NO: 9522 - RNA, 38 nt, Artificial Sequence
  Description of Artificial Sequence:  Enzymatic Nucleic Acid
aacuuuuucugaugaggccguuaggccgaaaaaguaac

SEQ ID NO: 9523 - RNA, 38 nt, Artificial Sequence
  Description of Artificial Sequence:  Enzymatic Nucleic Acid
caaguggacugaugaggccguuaggccgaaacuuuuuu

SEQ ID NO: 9524 - RNA, 38 nt, Artificial Sequence
  Description of Artificial Sequence:  Enzymatic Nucleic Acid
ucaaguggcugaugaggccguuaggccgaaaacuuuuu

SEQ ID NO: 9525 - RNA, 38 nt, Artificial Sequence
  Description of Artificial Sequence:  Enzymatic Nucleic Acid
gucaagugcugaugaggccguuaggccgaaaaacuuuu

SEQ ID NO: 9526 - RNA, 38 nt, Artificial Sequence
  Description of Artificial Sequence:  Enzymatic Nucleic Acid
aaaguguccugaugaggccguuaggccgaaaguggaaa

SEQ ID NO: 9527 - RNA, 38 nt, Artificial Sequence
  Description of Artificial Sequence:  Enzymatic Nucleic Acid
agggaucacugaugaggccguuaggccgaaagugucaa

SEQ ID NO: 9528 - RNA, 38 nt, Artificial Sequence
  Description of Artificial Sequence:  Enzymatic Nucleic Acid
cagggauccugaugaggccguuaggccgaaaaguguca

SEQ ID NO: 9529 - RNA, 38 nt, Artificial Sequence
  Description of Artificial Sequence:  Enzymatic Nucleic Acid
ccaucaggcugaugaggccguuaggccgaaaucaaagu

SEQ ID NO: 9530 - RNA, 38 nt, Artificial Sequence
  Description of Artificial Sequence:  Enzymatic Nucleic Acid
ucccagaucugaugaggccguuaggccgaaaugcguuu

SEQ ID NO: 9531 - RNA, 38 nt, Artificial Sequence
  Description of Artificial Sequence:  Enzymatic Nucleic Acid
cugucccacugaugaggccguuaggccgaaauuaugcg

SEQ ID NO: 9532 - RNA, 38 nt, Artificial Sequence
  Description of Artificial Sequence:  Enzymatic Nucleic Acid
gcccuuuccugaugaggccguuaggccgaaacuguccc

SEQ ID NO: 9533 - RNA, 38 nt, Artificial Sequence
  Description of Artificial Sequence:  Enzymatic Nucleic Acid
auaugaugcugaugaggccguuaggccgaaagcccuuu

SEQ ID NO: 9534 - RNA, 38 nt, Artificial Sequence
  Description of Artificial Sequence:  Enzymatic Nucleic Acid
gauaugaucugaugaggccguuaggccgaaaagcccuu

SEQ ID NO: 9535 - RNA, 38 nt, Artificial Sequence
  Description of Artificial Sequence:  Enzymatic Nucleic Acid
uuugauaucugaugaggccguuaggccgaaaugaagcc

SEQ ID NO: 9536 - RNA, 38 nt, Artificial Sequence
  Description of Artificial Sequence:  Enzymatic Nucleic Acid
gcauuugacugaugaggccguuaggccgaaaugaugaa

SEQ ID NO: 9537 - RNA, 38 nt, Artificial Sequence
  Description of Artificial Sequence:  Enzymatic Nucleic Acid
uugcauuucugaugaggccguuaggccgaaauaugaug

SEQ ID NO: 9538 - RNA, 38 nt, Artificial Sequence
  Description of Artificial Sequence:  Enzymatic Nucleic Acid
uuucuuugcugaugaggccguuaggccgaaacguugca

SEQ ID NO: 9539 - RNA, 38 nt, Artificial Sequence
  Description of Artificial Sequence:  Enzymatic Nucleic Acid
agaagccccugaugaggccguuaggccgaaauuucuuu

SEQ ID NO: 9540 - RNA, 38 nt, Artificial Sequence
  Description of Artificial Sequence:  Enzymatic Nucleic Acid
caggucagcugaugaggccguuaggccgaaagcccuau

SEQ ID NO: 9541 - RNA, 38 nt, Artificial Sequence
  Description of Artificial Sequence:  Enzymatic Nucleic Acid
acaggucacugaugaggccguuaggccgaaaagcccua

SEQ ID NO: 9542 - RNA, 38 nt, Artificial Sequence
  Description of Artificial Sequence:  Enzymatic Nucleic Acid
ugcccauucugaugaggccguuaggccgaaacuguugc

SEQ ID NO: 9543 - RNA, 38 nt, Artificial Sequence
  Description of Artificial Sequence:  Enzymatic Nucleic Acid
cuuauacacugaugaggccguuaggccgaaaugcccau

SEQ ID NO: 9544 - RNA, 38 nt, Artificial Sequence
  Description of Artificial Sequence:  Enzymatic Nucleic Acid
ucuuauaccugaugaggccguuaggccgaaaaugccca

SEQ ID NO: 9545 - RNA, 38 nt, Artificial Sequence
  Description of Artificial Sequence:  Enzymatic Nucleic Acid
uugucuuacugaugaggccguuaggccgaaacaaaugc

SEQ ID NO: 9546 - RNA, 38 nt, Artificial Sequence
  Description of Artificial Sequence:  Enzymatic Nucleic Acid
guuugucucugaugaggccguuaggccgaaauacaaau

SEQ ID NO: 9547 - RNA, 38 nt, Artificial Sequence
  Description of Artificial Sequence:  Enzymatic Nucleic Acid
gugugagacugaugaggccguuaggccgaaaguuuguc

SEQ ID NO: 9548 - RNA, 38 nt, Artificial Sequence
  Description of Artificial Sequence:  Enzymatic Nucleic Acid
augugugacugaugaggccguuaggccgaaauaguuug

SEQ ID NO: 9549 - RNA, 38 nt, Artificial Sequence
  Description of Artificial Sequence:  Enzymatic Nucleic Acid
cgaugugucugaugaggccguuaggccgaaagauaguu

SEQ ID NO: 9550 - RNA, 38 nt, Artificial Sequence
  Description of Artificial Sequence:  Enzymatic Nucleic Acid
gguuuguccugaugaggccguuaggccgaaauguguga

SEQ ID NO: 9551 - RNA, 38 nt, Artificial Sequence
  Description of Artificial Sequence:  Enzymatic Nucleic Acid
uaugauugcugaugaggccguuaggccgaaauugguuu

SEQ ID NO: 9552 - RNA, 38 nt, Artificial Sequence
  Description of Artificial Sequence:  Enzymatic Nucleic Acid
acaucuaucugaugaggccguuaggccgaaauuguauu

SEQ ID NO: 9553 - RNA, 38 nt, Artificial Sequence
  Description of Artificial Sequence:  Enzymatic Nucleic Acid
uggacauccugaugaggccguuaggccgaaaugauugu

SEQ ID NO: 9554 - RNA, 38 nt, Artificial Sequence
  Description of Artificial Sequence:  Enzymatic Nucleic Acid
cuuauuugcugaugaggccguuaggccgaaacaucuau

SEQ ID NO: 9555 - RNA, 38 nt, Artificial Sequence
  Description of Artificial Sequence:  Enzymatic Nucleic Acid
ggugugcucugaugaggccguuaggccgaaauuuggac

SEQ ID NO: 9556 - RNA, 38 nt, Artificial Sequence
  Description of Artificial Sequence:  Enzymatic Nucleic Acid
aguaauuucugaugaggccguuaggccgaaacugggcg

SEQ ID NO: 9557 - RNA, 38 nt, Artificial Sequence
  Description of Artificial Sequence:  Enzymatic Nucleic Acid
cucuaagucugaugaggccguuaggccgaaauuugacu

SEQ ID NO: 9558 - RNA, 38 nt, Artificial Sequence
  Description of Artificial Sequence:  Enzymatic Nucleic Acid
ccucuaagcugaugaggccguuaggccgaaaauuugac

SEQ ID NO: 9559 - RNA, 38 nt, Artificial Sequence
  Description of Artificial Sequence:  Enzymatic Nucleic Acid
uggccucucugaugaggccguuaggccgaaaguaauuu

SEQ ID NO: 9560 - RNA, 38 nt, Artificial Sequence
  Description of Artificial Sequence:  Enzymatic Nucleic Acid
auggccuccugaugaggccguuaggccgaaaaguaauu

SEQ ID NO: 9561 - RNA, 38 nt, Artificial Sequence
  Description of Artificial Sequence:  Enzymatic Nucleic Acid
gacaagagcugaugaggccguuaggccgaaauggccuc

SEQ ID NO: 9562 - RNA, 38 nt, Artificial Sequence
  Description of Artificial Sequence:  Enzymatic Nucleic Acid
gaggacaacugaugaggccguuaggccgaaaguauggc

SEQ ID NO: 9563 - RNA, 38 nt, Artificial Sequence
  Description of Artificial Sequence:  Enzymatic Nucleic Acid
uugaggaccugaugaggccguuaggccgaaagaguaug

SEQ ID NO: 9564 - RNA, 38 nt, Artificial Sequence
  Description of Artificial Sequence:  Enzymatic Nucleic Acid
caauugagcugaugaggccguuaggccgaaacaagagu

SEQ ID NO: 9565 - RNA, 38 nt, Artificial Sequence
  Description of Artificial Sequence:  Enzymatic Nucleic Acid
guacaauucugaugaggccguuaggccgaaaggacaag

SEQ ID NO: 9566 - RNA, 38 nt, Artificial Sequence
  Description of Artificial Sequence:  Enzymatic Nucleic Acid
agcaguaccugaugaggccguuaggccgaaauugagga

SEQ ID NO: 9567 - RNA, 38 nt, Artificial Sequence
  Description of Artificial Sequence:  Enzymatic Nucleic Acid
gguagcagcugaugaggccguuaggccgaaacaauuga

SEQ ID NO: 9568 - RNA, 38 nt, Artificial Sequence
  Description of Artificial Sequence:  Enzymatic Nucleic Acid
gggaguggcugaugaggccguuaggccgaaagcaguac

SEQ ID NO: 9569 - RNA, 38 nt, Artificial Sequence
  Description of Artificial Sequence:  Enzymatic Nucleic Acid
guucaaggcugaugaggccguuaggccgaaagugguag

SEQ ID NO: 9570 - RNA, 38 nt, Artificial Sequence
  Description of Artificial Sequence:  Enzymatic Nucleic Acid
ucguguuccugaugaggccguuaggccgaaagggagug

SEQ ID NO: 9571 - RNA, 38 nt, Artificial Sequence
  Description of Artificial Sequence:  Enzymatic Nucleic Acid
gucauuugcugaugaggccguuaggccgaaacucucgu

SEQ ID NO: 9572 - RNA, 38 nt, Artificial Sequence
  Description of Artificial Sequence:  Enzymatic Nucleic Acid
ggucauuucugaugaggccguuaggccgaaaacucucg

SEQ ID NO: 9573 - RNA, 38 nt, Artificial Sequence
  Description of Artificial Sequence:  Enzymatic Nucleic Acid
aucagggucugaugaggccguuaggccgaaacuccagg

SEQ ID NO: 9574 - RNA, 38 nt, Artificial Sequence
  Description of Artificial Sequence:  Enzymatic Nucleic Acid
caucagggcugaugaggccguuaggccgaaaacuccag

SEQ ID NO: 9575 - RNA, 38 nt, Artificial Sequence
  Description of Artificial Sequence:  Enzymatic Nucleic Acid
agcucucucugaugaggccguuaggccgaaauuuuuuu

SEQ ID NO: 9576 - RNA, 38 nt, Artificial Sequence
  Description of Artificial Sequence:  Enzymatic Nucleic Acid
ccuuacggcugaugaggccguuaggccgaaagcucucu

SEQ ID NO: 9577 - RNA, 38 nt, Artificial Sequence
  Description of Artificial Sequence:  Enzymatic Nucleic Acid
gccuuacgcugaugaggccguuaggccgaaaagcucuc

SEQ ID NO: 9578 - RNA, 38 nt, Artificial Sequence
  Description of Artificial Sequence:  Enzymatic Nucleic Acid
cgucgccucugaugaggccguuaggccgaaacggaagc

SEQ ID NO: 9579 - RNA, 38 nt, Artificial Sequence
  Description of Artificial Sequence:  Enzymatic Nucleic Acid
cuuugguccugaugaggccguuaggccgaaauucgucg

SEQ ID NO: 9580 - RNA, 38 nt, Artificial Sequence
  Description of Artificial Sequence:  Enzymatic Nucleic Acid
ggcaugggcugaugaggccguuaggccgaaauugcuuu

SEQ ID NO: 9581 - RNA, 38 nt, Artificial Sequence
  Description of Artificial Sequence:  Enzymatic Nucleic Acid
uggcauggcugaugaggccguuaggccgaaaauugcuu

SEQ ID NO: 9582 - RNA, 38 nt, Artificial Sequence
  Description of Artificial Sequence:  Enzymatic Nucleic Acid
cuguagaacugaugaggccguuaggccgaaauguuggc

SEQ ID NO: 9583 - RNA, 38 nt, Artificial Sequence
  Description of Artificial Sequence:  Enzymatic Nucleic Acid
cacuguagcugaugaggccguuaggccgaaauauguug

SEQ ID NO: 9584 - RNA, 38 nt, Artificial Sequence
  Description of Artificial Sequence:  Enzymatic Nucleic Acid
acacuguacugaugaggccguuaggccgaaaauauguu

SEQ ID NO: 9585 - RNA, 38 nt, Artificial Sequence
  Description of Artificial Sequence:  Enzymatic Nucleic Acid
gaacacugcugaugaggccguuaggccgaaagaauaug

SEQ ID NO: 9586 - RNA, 38 nt, Artificial Sequence
  Description of Artificial Sequence:  Enzymatic Nucleic Acid
auaguaagcugaugaggccguuaggccgaaacacugua

SEQ ID NO: 9587 - RNA, 38 nt, Artificial Sequence
  Description of Artificial Sequence:  Enzymatic Nucleic Acid
aauaguaacugaugaggccguuaggccgaaaacacugu

SEQ ID NO: 9588 - RNA, 38 nt, Artificial Sequence
  Description of Artificial Sequence:  Enzymatic Nucleic Acid
ucaauagucugaugaggccguuaggccgaaagaacacu

SEQ ID NO: 9589 - RNA, 38 nt, Artificial Sequence
  Description of Artificial Sequence:  Enzymatic Nucleic Acid
gucaauagcugaugaggccguuaggccgaaaagaacac

SEQ ID NO: 9590 - RNA, 38 nt, Artificial Sequence
  Description of Artificial Sequence:  Enzymatic Nucleic Acid
uuugucaacugaugaggccguuaggccgaaaguaagaa

SEQ ID NO: 9591 - RNA, 38 nt, Artificial Sequence
  Description of Artificial Sequence:  Enzymatic Nucleic Acid
auuuuguccugaugaggccguuaggccgaaauaguaag

SEQ ID NO: 9592 - RNA, 38 nt, Artificial Sequence
  Description of Artificial Sequence:  Enzymatic Nucleic Acid
caaguauacugaugaggccguuaggccgaaaguccuuu

SEQ ID NO: 9593 - RNA, 38 nt, Artificial Sequence
  Description of Artificial Sequence:  Enzymatic Nucleic Acid
acaaguaucugaugaggccguuaggccgaaaaguccuu

SEQ ID NO: 9594 - RNA, 38 nt, Artificial Sequence
  Description of Artificial Sequence:  Enzymatic Nucleic Acid
gacaaguacugaugaggccguuaggccgaaaaaguccu

SEQ ID NO: 9595 - RNA, 38 nt, Artificial Sequence
  Description of Artificial Sequence:  Enzymatic Nucleic Acid
acgacaagcugaugaggccguuaggccgaaauaaaguc

SEQ ID NO: 9596 - RNA, 38 nt, Artificial Sequence
  Description of Artificial Sequence:  Enzymatic Nucleic Acid
uacacgaccugaugaggccguuaggccgaaaguauaaa

SEQ ID NO: 9597 - RNA, 38 nt, Artificial Sequence
  Description of Artificial Sequence:  Enzymatic Nucleic Acid
ccuuacaccugaugaggccguuaggccgaaacaaguau

SEQ ID NO: 9598 - RNA, 38 nt, Artificial Sequence
  Description of Artificial Sequence:  Enzymatic Nucleic Acid
ccacuccucugaugaggccguuaggccgaaacacgaca

SEQ ID NO: 9599 - RNA, 38 nt, Artificial Sequence
  Description of Artificial Sequence:  Enzymatic Nucleic Acid
auuugaaucugaugaggccguuaggccgaaauggucca

SEQ ID NO: 9600 - RNA, 38 nt, Artificial Sequence
  Description of Artificial Sequence:  Enzymatic Nucleic Acid
cagauuugcugaugaggccguuaggccgaaaugauggu

SEQ ID NO: 9601 - RNA, 38 nt, Artificial Sequence
  Description of Artificial Sequence:  Enzymatic Nucleic Acid
acagauuucugaugaggccguuaggccgaaaaugaugg

SEQ ID NO: 9602 - RNA, 38 nt, Artificial Sequence
  Description of Artificial Sequence:  Enzymatic Nucleic Acid
uguuaacacugaugaggccguuaggccgaaauuugaau

SEQ ID NO: 9603 - RNA, 38 nt, Artificial Sequence
  Description of Artificial Sequence:  Enzymatic Nucleic Acid
gagguguucugaugaggccguuaggccgaaacagauuu

SEQ ID NO: 9604 - RNA, 38 nt, Artificial Sequence
  Description of Artificial Sequence:  Enzymatic Nucleic Acid
ugaggugucugaugaggccguuaggccgaaaacagauu

SEQ ID NO: 9605 - RNA, 38 nt, Artificial Sequence
  Description of Artificial Sequence:  Enzymatic Nucleic Acid
uaugcacucugaugaggccguuaggccgaaagguguua

SEQ ID NO: 9606 - RNA, 38 nt, Artificial Sequence
  Description of Artificial Sequence:  Enzymatic Nucleic Acid
aucauauacugaugaggccguuaggccgaaaugcacug

SEQ ID NO: 9607 - RNA, 38 nt, Artificial Sequence
  Description of Artificial Sequence:  Enzymatic Nucleic Acid
uuaucauacugaugaggccguuaggccgaaauaugcac

SEQ ID NO: 9608 - RNA, 38 nt, Artificial Sequence
  Description of Artificial Sequence:  Enzymatic Nucleic Acid
cuuuaucacugaugaggccguuaggccgaaauauaugc

SEQ ID NO: 9609 - RNA, 38 nt, Artificial Sequence
  Description of Artificial Sequence:  Enzymatic Nucleic Acid
gaaugcuucugaugaggccguuaggccgaaaucauaua

SEQ ID NO: 9610 - RNA, 38 nt, Artificial Sequence
  Description of Artificial Sequence:  Enzymatic Nucleic Acid
cagugaugcugaugaggccguuaggccgaaaugcuuua

SEQ ID NO: 9611 - RNA, 38 nt, Artificial Sequence
  Description of Artificial Sequence:  Enzymatic Nucleic Acid
acagugaucugaugaggccguuaggccgaaaaugcuuu

SEQ ID NO: 9612 - RNA, 38 nt, Artificial Sequence
  Description of Artificial Sequence:  Enzymatic Nucleic Acid
uucacagucugaugaggccguuaggccgaaaugaaugc

SEQ ID NO: 9613 - RNA, 38 nt, Artificial Sequence
  Description of Artificial Sequence:  Enzymatic Nucleic Acid
cuguuuuccugaugaggccguuaggccgaaauguuuca

SEQ ID NO: 9614 - RNA, 38 nt, Artificial Sequence
  Description of Artificial Sequence:  Enzymatic Nucleic Acid
acgguuuccugaugaggccguuaggccgaaagcaccug

SEQ ID NO: 9615 - RNA, 38 nt, Artificial Sequence
  Description of Artificial Sequence:  Enzymatic Nucleic Acid
uugccagccugaugaggccguuaggccgaaacgguuuc

SEQ ID NO: 9616 - RNA, 38 nt, Artificial Sequence
  Description of Artificial Sequence:  Enzymatic Nucleic Acid
gccgguaacugaugaggccguuaggccgaaaccgcuug

SEQ ID NO: 9617 - RNA, 38 nt, Artificial Sequence
  Description of Artificial Sequence:  Enzymatic Nucleic Acid
gagccggucugaugaggccguuaggccgaaagaccgcu

SEQ ID NO: 9618 - RNA, 38 nt, Artificial Sequence
  Description of Artificial Sequence:  Enzymatic Nucleic Acid
agagccggcugaugaggccguuaggccgaaaagaccgc

SEQ ID NO: 9619 - RNA, 38 nt, Artificial Sequence
  Description of Artificial Sequence:  Enzymatic Nucleic Acid
uucauagacugaugaggccguuaggccgaaagccggua

SEQ ID NO: 9620 - RNA, 38 nt, Artificial Sequence
  Description of Artificial Sequence:  Enzymatic Nucleic Acid
cuuucauacugaugaggccguuaggccgaaagagccgg

SEQ ID NO: 9621 - RNA, 38 nt, Artificial Sequence
  Description of Artificial Sequence:  Enzymatic Nucleic Acid
cacuuucacugaugaggccguuaggccgaaagagagcc

SEQ ID NO: 9622 - RNA, 38 nt, Artificial Sequence
  Description of Artificial Sequence:  Enzymatic Nucleic Acid
gcgagggacugaugaggccguuaggccgaaaugccuuc

SEQ ID NO: 9623 - RNA, 38 nt, Artificial Sequence
  Description of Artificial Sequence:  Enzymatic Nucleic Acid
ggcgagggcugaugaggccguuaggccgaaaaugccuu

SEQ ID NO: 9624 - RNA, 38 nt, Artificial Sequence
  Description of Artificial Sequence:  Enzymatic Nucleic Acid
cggcgaggcugaugaggccguuaggccgaaaaaugccu

SEQ ID NO: 9625 - RNA, 38 nt, Artificial Sequence
  Description of Artificial Sequence:  Enzymatic Nucleic Acid
cuuccggccugaugaggccguuaggccgaaagggaaau

SEQ ID NO: 9626 - RNA, 38 nt, Artificial Sequence
  Description of Artificial Sequence:  Enzymatic Nucleic Acid
aaccauaccugaugaggccguuaggccgaaacuuccgg

SEQ ID NO: 9627 - RNA, 38 nt, Artificial Sequence
  Description of Artificial Sequence:  Enzymatic Nucleic Acid
uuuaaccacugaugaggccguuaggccgaaacaacuuc

SEQ ID NO: 9628 - RNA, 38 nt, Artificial Sequence
  Description of Artificial Sequence:  Enzymatic Nucleic Acid
caucuuuucugaugaggccguuaggccgaaaccauaca

SEQ ID NO: 9629 - RNA, 38 nt, Artificial Sequence
  Description of Artificial Sequence:  Enzymatic Nucleic Acid
ccaucuuucugaugaggccguuaggccgaaaaccauac

SEQ ID NO: 9630 - RNA, 38 nt, Artificial Sequence
  Description of Artificial Sequence:  Enzymatic Nucleic Acid
ucgcaggucugaugaggccguuaggccgaaacccaucu

SEQ ID NO: 9631 - RNA, 38 nt, Artificial Sequence
  Description of Artificial Sequence:  Enzymatic Nucleic Acid
gucgcaggcugaugaggccguuaggccgaaaacccauc

SEQ ID NO: 9632 - RNA, 38 nt, Artificial Sequence
  Description of Artificial Sequence:  Enzymatic Nucleic Acid
agcgagcacugaugaggccguuaggccgaaauuucuca

SEQ ID NO: 9633 - RNA, 38 nt, Artificial Sequence
  Description of Artificial Sequence:  Enzymatic Nucleic Acid
caaauagccugaugaggccguuaggccgaaagcagauu

SEQ ID NO: 9634 - RNA, 38 nt, Artificial Sequence
  Description of Artificial Sequence:  Enzymatic Nucleic Acid
gagucaaacugaugaggccguuaggccgaaagcgagca

SEQ ID NO: 9635 - RNA, 38 nt, Artificial Sequence
  Description of Artificial Sequence:  Enzymatic Nucleic Acid
acgagucacugaugaggccguuaggccgaaauagcgag

SEQ ID NO: 9636 - RNA, 38 nt, Artificial Sequence
  Description of Artificial Sequence:  Enzymatic Nucleic Acid
cacgaguccugaugaggccguuaggccgaaaauagcga

SEQ ID NO: 9637 - RNA, 38 nt, Artificial Sequence
  Description of Artificial Sequence:  Enzymatic Nucleic Acid
guagccaccugaugaggccguuaggccgaaagucaaau

SEQ ID NO: 9638 - RNA, 38 nt, Artificial Sequence
  Description of Artificial Sequence:  Enzymatic Nucleic Acid
uuaacgagcugaugaggccguuaggccgaaagccacga

SEQ ID NO: 9639 - RNA, 38 nt, Artificial Sequence
  Description of Artificial Sequence:  Enzymatic Nucleic Acid
uaauuaaccugaugaggccguuaggccgaaaguagcca

SEQ ID NO: 9640 - RNA, 38 nt, Artificial Sequence
  Description of Artificial Sequence:  Enzymatic Nucleic Acid
ugauaauucugaugaggccguuaggccgaaacgaguag

SEQ ID NO: 9641 - RNA, 38 nt, Artificial Sequence
  Description of Artificial Sequence:  Enzymatic Nucleic Acid
uugauaaucugaugaggccguuaggccgaaaacgagua

SEQ ID NO: 9642 - RNA, 38 nt, Artificial Sequence
  Description of Artificial Sequence:  Enzymatic Nucleic Acid
uccuugaucugaugaggccguuaggccgaaauuaacga

SEQ ID NO: 9643 - RNA, 38 nt, Artificial Sequence
  Description of Artificial Sequence:  Enzymatic Nucleic Acid
guccuugacugaugaggccguuaggccgaaaauuaacg

SEQ ID NO: 9644 - RNA, 38 nt, Artificial Sequence
  Description of Artificial Sequence:  Enzymatic Nucleic Acid
acguccuucugaugaggccguuaggccgaaauaauuaa

SEQ ID NO: 9645 - RNA, 38 nt, Artificial Sequence
  Description of Artificial Sequence:  Enzymatic Nucleic Acid
ucuucagucugaugaggccguuaggccgaaacguccuu

SEQ ID NO: 9646 - RNA, 38 nt, Artificial Sequence
  Description of Artificial Sequence:  Enzymatic Nucleic Acid
gauuguaucugaugaggccguuaggccgaaauucccug

SEQ ID NO: 9647 - RNA, 38 nt, Artificial Sequence
  Description of Artificial Sequence:  Enzymatic Nucleic Acid
agauuguacugaugaggccguuaggccgaaaauucccu

SEQ ID NO: 9648 - RNA, 38 nt, Artificial Sequence
  Description of Artificial Sequence:  Enzymatic Nucleic Acid
caagauugcugaugaggccguuaggccgaaauaauucc

SEQ ID NO: 9649 - RNA, 38 nt, Artificial Sequence
  Description of Artificial Sequence:  Enzymatic Nucleic Acid
cucagcaacugaugaggccguuaggccgaaauuguaua

SEQ ID NO: 9650 - RNA, 38 nt, Artificial Sequence
  Description of Artificial Sequence:  Enzymatic Nucleic Acid
ugcucagccugaugaggccguuaggccgaaagauugua

SEQ ID NO: 9651 - RNA, 38 nt, Artificial Sequence
  Description of Artificial Sequence:  Enzymatic Nucleic Acid
gacuguuucugaugaggccguuaggccgaaaugcucag

SEQ ID NO: 9652 - RNA, 38 nt, Artificial Sequence
  Description of Artificial Sequence:  Enzymatic Nucleic Acid
acacauuucugaugaggccguuaggccgaaacuguuuu

SEQ ID NO: 9653 - RNA, 38 nt, Artificial Sequence
  Description of Artificial Sequence:  Enzymatic Nucleic Acid
gguuuuuacugaugaggccguuaggccgaaacacauuu

SEQ ID NO: 9654 - RNA, 38 nt, Artificial Sequence
  Description of Artificial Sequence:  Enzymatic Nucleic Acid
agguuuuucugaugaggccguuaggccgaaaacacauu

SEQ ID NO: 9655 - RNA, 38 nt, Artificial Sequence
  Description of Artificial Sequence:  Enzymatic Nucleic Acid
gagguuuucugaugaggccguuaggccgaaaaacacau

SEQ ID NO: 9656 - RNA, 38 nt, Artificial Sequence
  Description of Artificial Sequence:  Enzymatic Nucleic Acid
guggcagucugaugaggccguuaggccgaaagguuuuu

SEQ ID NO: 9657 - RNA, 38 nt, Artificial Sequence
  Description of Artificial Sequence:  Enzymatic Nucleic Acid
gacaauuacugaugaggccguuaggccgaaaguggcag

SEQ ID NO: 9658 - RNA, 38 nt, Artificial Sequence
  Description of Artificial Sequence:  Enzymatic Nucleic Acid
uugacaaucugaugaggccguuaggccgaaagaguggc

SEQ ID NO: 9659 - RNA, 38 nt, Artificial Sequence
  Description of Artificial Sequence:  Enzymatic Nucleic Acid
acauugaccugaugaggccguuaggccgaaauuagagu

SEQ ID NO: 9660 - RNA, 38 nt, Artificial Sequence
  Description of Artificial Sequence:  Enzymatic Nucleic Acid
uucacauucugaugaggccguuaggccgaaacaauuag

SEQ ID NO: 9661 - RNA, 38 nt, Artificial Sequence
  Description of Artificial Sequence:  Enzymatic Nucleic Acid
uuuucguacugaugaggccguuaggccgaaaucugggg

SEQ ID NO: 9662 - RNA, 38 nt, Artificial Sequence
  Description of Artificial Sequence:  Enzymatic Nucleic Acid
cuuuucgucugaugaggccguuaggccgaaaaucuggg

SEQ ID NO: 9663 - RNA, 38 nt, Artificial Sequence
  Description of Artificial Sequence:  Enzymatic Nucleic Acid
ccuuuucgcugaugaggccguuaggccgaaaaaucugg

SEQ ID NO: 9664 - RNA, 38 nt, Artificial Sequence
  Description of Artificial Sequence:  Enzymatic Nucleic Acid
gaaacgaucugaugaggccguuaggccgaaacacggcc

SEQ ID NO: 9665 - RNA, 38 nt, Artificial Sequence
  Description of Artificial Sequence:  Enzymatic Nucleic Acid
cuggaaaccugaugaggccguuaggccgaaaugacacg

SEQ ID NO: 9666 - RNA, 38 nt, Artificial Sequence
  Description of Artificial Sequence:  Enzymatic Nucleic Acid
ggucuggacugaugaggccguuaggccgaaacgaugac

SEQ ID NO: 9667 - RNA, 38 nt, Artificial Sequence
  Description of Artificial Sequence:  Enzymatic Nucleic Acid
gggucuggcugaugaggccguuaggccgaaaacgauga

SEQ ID NO: 9668 - RNA, 38 nt, Artificial Sequence
  Description of Artificial Sequence:  Enzymatic Nucleic Acid
cgggucugcugaugaggccguuaggccgaaaaacgaug

SEQ ID NO: 9669 - RNA, 38 nt, Artificial Sequence
  Description of Artificial Sequence:  Enzymatic Nucleic Acid
uggguagacugaugaggccguuaggccgaaagccgggu

SEQ ID NO: 9670 - RNA, 38 nt, Artificial Sequence
  Description of Artificial Sequence:  Enzymatic Nucleic Acid
aguggguacugaugaggccguuaggccgaaagagccgg

SEQ ID NO: 9671 - RNA, 38 nt, Artificial Sequence
  Description of Artificial Sequence:  Enzymatic Nucleic Acid
ccagugggcugaugaggccguuaggccgaaagagagcc

SEQ ID NO: 9672 - RNA, 38 nt, Artificial Sequence
  Description of Artificial Sequence:  Enzymatic Nucleic Acid
caagucagcugaugaggccguuaggccgaaauuugucu

SEQ ID NO: 9673 - RNA, 38 nt, Artificial Sequence
  Description of Artificial Sequence:  Enzymatic Nucleic Acid
ugcgguaccugaugaggccguuaggccgaaagucagga

SEQ ID NO: 9674 - RNA, 38 nt, Artificial Sequence
  Description of Artificial Sequence:  Enzymatic Nucleic Acid
auaugcggcugaugaggccguuaggccgaaacaaguca

SEQ ID NO: 9675 - RNA, 38 nt, Artificial Sequence
  Description of Artificial Sequence:  Enzymatic Nucleic Acid
ggauaccacugaugaggccguuaggccgaaaugcggua

SEQ ID NO: 9676 - RNA, 38 nt, Artificial Sequence
  Description of Artificial Sequence:  Enzymatic Nucleic Acid
uugagggacugaugaggccguuaggccgaaaccauaug

SEQ ID NO: 9677 - RNA, 38 nt, Artificial Sequence
  Description of Artificial Sequence:  Enzymatic Nucleic Acid
gguugaggcugaugaggccguuaggccgaaauaccaua

SEQ ID NO: 9678 - RNA, 38 nt, Artificial Sequence
  Description of Artificial Sequence:  Enzymatic Nucleic Acid
uguagguucugaugaggccguuaggccgaaagggauac

SEQ ID NO: 9679 - RNA, 38 nt, Artificial Sequence
  Description of Artificial Sequence:  Enzymatic Nucleic Acid
cuugauugcugaugaggccguuaggccgaaagguugag

SEQ ID NO: 9680 - RNA, 38 nt, Artificial Sequence
  Description of Artificial Sequence:  Enzymatic Nucleic Acid
aaccacuucugaugaggccguuaggccgaaauuguagg

SEQ ID NO: 9681 - RNA, 38 nt, Artificial Sequence
  Description of Artificial Sequence:  Enzymatic Nucleic Acid
ggugccagcugaugaggccguuaggccgaaaccacuug

SEQ ID NO: 9682 - RNA, 38 nt, Artificial Sequence
  Description of Artificial Sequence:  Enzymatic Nucleic Acid
gggugccacugaugaggccguuaggccgaaaaccacuu

SEQ ID NO: 9683 - RNA, 38 nt, Artificial Sequence
  Description of Artificial Sequence:  Enzymatic Nucleic Acid
auuauggucugaugaggccguuaggccgaaacaggggu

SEQ ID NO: 9684 - RNA, 38 nt, Artificial Sequence
  Description of Artificial Sequence:  Enzymatic Nucleic Acid
ggaaugaucugaugaggccguuaggccgaaaugguuac

SEQ ID NO: 9685 - RNA, 38 nt, Artificial Sequence
  Description of Artificial Sequence:  Enzymatic Nucleic Acid
uucggaaucugaugaggccguuaggccgaaauuauggu

SEQ ID NO: 9686 - RNA, 38 nt, Artificial Sequence
  Description of Artificial Sequence:  Enzymatic Nucleic Acid
ugcuucggcugaugaggccguuaggccgaaaugauuau

SEQ ID NO: 9687 - RNA, 38 nt, Artificial Sequence
  Description of Artificial Sequence:  Enzymatic Nucleic Acid
uugcuucgcugaugaggccguuaggccgaaaaugauua

SEQ ID NO: 9688 - RNA, 38 nt, Artificial Sequence
  Description of Artificial Sequence:  Enzymatic Nucleic Acid
uggaacaacugaugaggccguuaggccgaaagucacac

SEQ ID NO: 9689 - RNA, 38 nt, Artificial Sequence
  Description of Artificial Sequence:  Enzymatic Nucleic Acid
uuggaacacugaugaggccguuaggccgaaaagucaca

SEQ ID NO: 9690 - RNA, 38 nt, Artificial Sequence
  Description of Artificial Sequence:  Enzymatic Nucleic Acid
auuggaaccugaugaggccguuaggccgaaaaagucac

SEQ ID NO: 9691 - RNA, 38 nt, Artificial Sequence
  Description of Artificial Sequence:  Enzymatic Nucleic Acid
auuauuggcugaugaggccguuaggccgaaacaaaagu

SEQ ID NO: 9692 - RNA, 38 nt, Artificial Sequence
  Description of Artificial Sequence:  Enzymatic Nucleic Acid
cauuauugcugaugaggccguuaggccgaaaacaaaag

SEQ ID NO: 9693 - RNA, 38 nt, Artificial Sequence
  Description of Artificial Sequence:  Enzymatic Nucleic Acid
cucuucaucugaugaggccguuaggccgaaauuggaac

SEQ ID NO: 9694 - RNA, 38 nt, Artificial Sequence
  Description of Artificial Sequence:  Enzymatic Nucleic Acid
ggauaaagcugaugaggccguuaggccgaaacucuuca

SEQ ID NO: 9695 - RNA, 38 nt, Artificial Sequence
  Description of Artificial Sequence:  Enzymatic Nucleic Acid
ccaggauacugaugaggccguuaggccgaaaggacucu

SEQ ID NO: 9696 - RNA, 38 nt, Artificial Sequence
  Description of Artificial Sequence:  Enzymatic Nucleic Acid
uccaggaucugaugaggccguuaggccgaaaaggacuc

SEQ ID NO: 9697 - RNA, 38 nt, Artificial Sequence
  Description of Artificial Sequence:  Enzymatic Nucleic Acid
auccaggacugaugaggccguuaggccgaaaaaggacu

SEQ ID NO: 9698 - RNA, 38 nt, Artificial Sequence
  Description of Artificial Sequence:  Enzymatic Nucleic Acid
gcauccagcugaugaggccguuaggccgaaauaaagga

SEQ ID NO: 9699 - RNA, 38 nt, Artificial Sequence
  Description of Artificial Sequence:  Enzymatic Nucleic Acid
augcucuccugaugaggccguuaggccgaaauucuguu

SEQ ID NO: 9700 - RNA, 38 nt, Artificial Sequence
  Description of Artificial Sequence:  Enzymatic Nucleic Acid
cgcugagucugaugaggccguuaggccgaaaugcucuc

SEQ ID NO: 9701 - RNA, 38 nt, Artificial Sequence
  Description of Artificial Sequence:  Enzymatic Nucleic Acid
caugcgcucugaugaggccguuaggccgaaagugaugc

SEQ ID NO: 9702 - RNA, 38 nt, Artificial Sequence
  Description of Artificial Sequence:  Enzymatic Nucleic Acid
ccuucuaucugaugaggccguuaggccgaaauugccau

SEQ ID NO: 9703 - RNA, 38 nt, Artificial Sequence
  Description of Artificial Sequence:  Enzymatic Nucleic Acid
uuuccuuccugaugaggccguuaggccgaaauuauugc

SEQ ID NO: 9704 - RNA, 38 nt, Artificial Sequence
  Description of Artificial Sequence:  Enzymatic Nucleic Acid
agccaucucugaugaggccguuaggccgaaauucuuuc

SEQ ID NO: 9705 - RNA, 38 nt, Artificial Sequence
  Description of Artificial Sequence:  Enzymatic Nucleic Acid
caaggugccugaugaggccguuaggccgaaagccaucu

SEQ ID NO: 9706 - RNA, 38 nt, Artificial Sequence
  Description of Artificial Sequence:  Enzymatic Nucleic Acid
ccacaacccugaugaggccguuaggccgaaaggugcua

SEQ ID NO: 9707 - RNA, 38 nt, Artificial Sequence
  Description of Artificial Sequence:  Enzymatic Nucleic Acid
ucagccaccugaugaggccguuaggccgaaaccaaggu

SEQ ID NO: 9708 - RNA, 38 nt, Artificial Sequence
  Description of Artificial Sequence:  Enzymatic Nucleic Acid
aaauucuacugaugaggccguuaggccgaaagucagcc

SEQ ID NO: 9709 - RNA, 38 nt, Artificial Sequence
  Description of Artificial Sequence:  Enzymatic Nucleic Acid
agaaauuccugaugaggccguuaggccgaaagagucag

SEQ ID NO: 9710 - RNA, 38 nt, Artificial Sequence
  Description of Artificial Sequence:  Enzymatic Nucleic Acid
auuccagacugaugaggccguuaggccgaaauucuaga

SEQ ID NO: 9711 - RNA, 38 nt, Artificial Sequence
  Description of Artificial Sequence:  Enzymatic Nucleic Acid
gauuccagcugaugaggccguuaggccgaaaauucuag

SEQ ID NO: 9712 - RNA, 38 nt, Artificial Sequence
  Description of Artificial Sequence:  Enzymatic Nucleic Acid
agauuccacugaugaggccguuaggccgaaaaauucua

SEQ ID NO: 9713 - RNA, 38 nt, Artificial Sequence
  Description of Artificial Sequence:  Enzymatic Nucleic Acid
caaauguacugaugaggccguuaggccgaaauuccaga

SEQ ID NO: 9714 - RNA, 38 nt, Artificial Sequence
  Description of Artificial Sequence:  Enzymatic Nucleic Acid
ugcaaaugcugaugaggccguuaggccgaaagauucca

SEQ ID NO: 9715 - RNA, 38 nt, Artificial Sequence
  Description of Artificial Sequence:  Enzymatic Nucleic Acid
gcuaugcacugaugaggccguuaggccgaaauguagau

SEQ ID NO: 9716 - RNA, 38 nt, Artificial Sequence
  Description of Artificial Sequence:  Enzymatic Nucleic Acid
agcuaugccugaugaggccguuaggccgaaaauguaga

SEQ ID NO: 9717 - RNA, 38 nt, Artificial Sequence
  Description of Artificial Sequence:  Enzymatic Nucleic Acid
uuggaagccugaugaggccguuaggccgaaaugcaaau

SEQ ID NO: 9718 - RNA, 38 nt, Artificial Sequence
  Description of Artificial Sequence:  Enzymatic Nucleic Acid
uuuauuggcugaugaggccguuaggccgaaagcuaugc

SEQ ID NO: 9719 - RNA, 38 nt, Artificial Sequence
  Description of Artificial Sequence:  Enzymatic Nucleic Acid
cuuuauugcugaugaggccguuaggccgaaaagcuaug

SEQ ID NO: 9720 - RNA, 38 nt, Artificial Sequence
  Description of Artificial Sequence:  Enzymatic Nucleic Acid
cccaacuucugaugaggccguuaggccgaaauuggaag

SEQ ID NO: 9721 - RNA, 38 nt, Artificial Sequence
  Description of Artificial Sequence:  Enzymatic Nucleic Acid
acaguccccugaugaggccguuaggccgaaacuuuauu

SEQ ID NO: 9722 - RNA, 38 nt, Artificial Sequence
  Description of Artificial Sequence:  Enzymatic Nucleic Acid
uaaaagcucugaugaggccguuaggccgaaauguuucu

SEQ ID NO: 9723 - RNA, 38 nt, Artificial Sequence
  Description of Artificial Sequence:  Enzymatic Nucleic Acid
ugauauaacugaugaggccguuaggccgaaagcuuaug

SEQ ID NO: 9724 - RNA, 38 nt, Artificial Sequence
  Description of Artificial Sequence:  Enzymatic Nucleic Acid
gugauauacugaugaggccguuaggccgaaaagcuuau

SEQ ID NO: 9725 - RNA, 38 nt, Artificial Sequence
  Description of Artificial Sequence:  Enzymatic Nucleic Acid
ugugauaucugaugaggccguuaggccgaaaaagcuua

SEQ ID NO: 9726 - RNA, 38 nt, Artificial Sequence
  Description of Artificial Sequence:  Enzymatic Nucleic Acid
cugugauacugaugaggccguuaggccgaaaaaagcuu

SEQ ID NO: 9727 - RNA, 38 nt, Artificial Sequence
  Description of Artificial Sequence:  Enzymatic Nucleic Acid
aucugugacugaugaggccguuaggccgaaauaaaagc

SEQ ID NO: 9728 - RNA, 38 nt, Artificial Sequence
  Description of Artificial Sequence:  Enzymatic Nucleic Acid
acaucugucugaugaggccguuaggccgaaauauaaaa

SEQ ID NO: 9729 - RNA, 38 nt, Artificial Sequence
  Description of Artificial Sequence:  Enzymatic Nucleic Acid
uaacaugacugaugaggccguuaggccgaaacccauuu

SEQ ID NO: 9730 - RNA, 38 nt, Artificial Sequence
  Description of Artificial Sequence:  Enzymatic Nucleic Acid
uuaacaugcugaugaggccguuaggccgaaaacccauu

SEQ ID NO: 9731 - RNA, 38 nt, Artificial Sequence
  Description of Artificial Sequence:  Enzymatic Nucleic Acid
guuaacaucugaugaggccguuaggccgaaaaacccau

SEQ ID NO: 9732 - RNA, 38 nt, Artificial Sequence
  Description of Artificial Sequence:  Enzymatic Nucleic Acid
uccaaguucugaugaggccguuaggccgaaacaugaaa

SEQ ID NO: 9733 - RNA, 38 nt, Artificial Sequence
  Description of Artificial Sequence:  Enzymatic Nucleic Acid
uuccaagucugaugaggccguuaggccgaaaacaugaa

SEQ ID NO: 9734 - RNA, 38 nt, Artificial Sequence
  Description of Artificial Sequence:  Enzymatic Nucleic Acid
uuuuuucccugaugaggccguuaggccgaaaguuaaca

SEQ ID NO: 9735 - RNA, 38 nt, Artificial Sequence
  Description of Artificial Sequence:  Enzymatic Nucleic Acid
cugugcaacugaugaggccguuaggccgaaacaguuuc

SEQ ID NO: 9736 - RNA, 38 nt, Artificial Sequence
  Description of Artificial Sequence:  Enzymatic Nucleic Acid
aacugugccugaugaggccguuaggccgaaagacaguu

SEQ ID NO: 9737 - RNA, 38 nt, Artificial Sequence
  Description of Artificial Sequence:  Enzymatic Nucleic Acid
aacuuguucugaugaggccguuaggccgaaacugugca

SEQ ID NO: 9738 - RNA, 38 nt, Artificial Sequence
  Description of Artificial Sequence:  Enzymatic Nucleic Acid
gaacuugucugaugaggccguuaggccgaaaacugugc

SEQ ID NO: 9739 - RNA, 38 nt, Artificial Sequence
  Description of Artificial Sequence:  Enzymatic Nucleic Acid
uguauaagcugaugaggccguuaggccgaaacuuguua

SEQ ID NO: 9740 - RNA, 38 nt, Artificial Sequence
  Description of Artificial Sequence:  Enzymatic Nucleic Acid
cuguauaacugaugaggccguuaggccgaaaacuuguu

SEQ ID NO: 9741 - RNA, 38 nt, Artificial Sequence
  Description of Artificial Sequence:  Enzymatic Nucleic Acid
cucuguaucugaugaggccguuaggccgaaagaacuug

SEQ ID NO: 9742 - RNA, 38 nt, Artificial Sequence
  Description of Artificial Sequence:  Enzymatic Nucleic Acid
ucucuguacugaugaggccguuaggccgaaaagaacuu

SEQ ID NO: 9743 - RNA, 38 nt, Artificial Sequence
  Description of Artificial Sequence:  Enzymatic Nucleic Acid
cgucucugcugaugaggccguuaggccgaaauaagaac

SEQ ID NO: 9744 - RNA, 38 nt, Artificial Sequence
  Description of Artificial Sequence:  Enzymatic Nucleic Acid
auccaagucugaugaggccguuaggccgaaacgucucu

SEQ ID NO: 9745 - RNA, 38 nt, Artificial Sequence
  Description of Artificial Sequence:  Enzymatic Nucleic Acid
aauccaagcugaugaggccguuaggccgaaaacgucuc

SEQ ID NO: 9746 - RNA, 38 nt, Artificial Sequence
  Description of Artificial Sequence:  Enzymatic Nucleic Acid
uaaaaucccugaugaggccguuaggccgaaaguaacgu

SEQ ID NO: 9747 - RNA, 38 nt, Artificial Sequence
  Description of Artificial Sequence:  Enzymatic Nucleic Acid
cgcaguaacugaugaggccguuaggccgaaauccaagu

SEQ ID NO: 9748 - RNA, 38 nt, Artificial Sequence
  Description of Artificial Sequence:  Enzymatic Nucleic Acid
ccgcaguacugaugaggccguuaggccgaaaauccaag

SEQ ID NO: 9749 - RNA, 38 nt, Artificial Sequence
  Description of Artificial Sequence:  Enzymatic Nucleic Acid
uccgcagucugaugaggccguuaggccgaaaaauccaa

SEQ ID NO: 9750 - RNA, 38 nt, Artificial Sequence
  Description of Artificial Sequence:  Enzymatic Nucleic Acid
guccgcagcugaugaggccguuaggccgaaaaaaucca

SEQ ID NO: 9751 - RNA, 38 nt, Artificial Sequence
  Description of Artificial Sequence:  Enzymatic Nucleic Acid
cuguuauucugaugaggccguuaggccgaaacuguccg

SEQ ID NO: 9752 - RNA, 38 nt, Artificial Sequence
  Description of Artificial Sequence:  Enzymatic Nucleic Acid
ucuguuaucugaugaggccguuaggccgaaaacugucc

SEQ ID NO: 9753 - RNA, 38 nt, Artificial Sequence
  Description of Artificial Sequence:  Enzymatic Nucleic Acid
uguucugucugaugaggccguuaggccgaaauuaacug

SEQ ID NO: 9754 - RNA, 38 nt, Artificial Sequence
  Description of Artificial Sequence:  Enzymatic Nucleic Acid
uaauacugcugaugaggccguuaggccgaaagugcauu

SEQ ID NO: 9755 - RNA, 38 nt, Artificial Sequence
  Description of Artificial Sequence:  Enzymatic Nucleic Acid
cuugcuaacugaugaggccguuaggccgaaacuguagu

SEQ ID NO: 9756 - RNA, 38 nt, Artificial Sequence
  Description of Artificial Sequence:  Enzymatic Nucleic Acid
ugcuugcucugaugaggccguuaggccgaaauacugua

SEQ ID NO: 9757 - RNA, 38 nt, Artificial Sequence
  Description of Artificial Sequence:  Enzymatic Nucleic Acid
uugcuugccugaugaggccguuaggccgaaaauacugu

SEQ ID NO: 9758 - RNA, 38 nt, Artificial Sequence
  Description of Artificial Sequence:  Enzymatic Nucleic Acid
uccuuagucugaugaggccguuaggccgaaauggccau

SEQ ID NO: 9759 - RNA, 38 nt, Artificial Sequence
  Description of Artificial Sequence:  Enzymatic Nucleic Acid
gugcuccucugaugaggccguuaggccgaaagugaugg

SEQ ID NO: 9760 - RNA, 38 nt, Artificial Sequence
  Description of Artificial Sequence:  Enzymatic Nucleic Acid
gagugaugcugaugaggccguuaggccgaaagugcucc

SEQ ID NO: 9761 - RNA, 38 nt, Artificial Sequence
  Description of Artificial Sequence:  Enzymatic Nucleic Acid
uuaagagucugaugaggccguuaggccgaaauggagug

SEQ ID NO: 9762 - RNA, 38 nt, Artificial Sequence
  Description of Artificial Sequence:  Enzymatic Nucleic Acid
aagauuaacugaugaggccguuaggccgaaagugaugg

SEQ ID NO: 9763 - RNA, 38 nt, Artificial Sequence
  Description of Artificial Sequence:  Enzymatic Nucleic Acid
guaagauucugaugaggccguuaggccgaaagagugau

SEQ ID NO: 9764 - RNA, 38 nt, Artificial Sequence
  Description of Artificial Sequence:  Enzymatic Nucleic Acid
gguaagaucugaugaggccguuaggccgaaaagaguga

SEQ ID NO: 9765 - RNA, 38 nt, Artificial Sequence
  Description of Artificial Sequence:  Enzymatic Nucleic Acid
gaugguaacugaugaggccguuaggccgaaauuaagag

SEQ ID NO: 9766 - RNA, 38 nt, Artificial Sequence
  Description of Artificial Sequence:  Enzymatic Nucleic Acid
augauggucugaugaggccguuaggccgaaagauuaag

SEQ ID NO: 9767 - RNA, 38 nt, Artificial Sequence
  Description of Artificial Sequence:  Enzymatic Nucleic Acid
caugauggcugaugaggccguuaggccgaaaagauuaa

SEQ ID NO: 9768 - RNA, 38 nt, Artificial Sequence
  Description of Artificial Sequence:  Enzymatic Nucleic Acid
acauucaucugaugaggccguuaggccgaaaugguaag

SEQ ID NO: 9769 - RNA, 38 nt, Artificial Sequence
  Description of Artificial Sequence:  Enzymatic Nucleic Acid
ugcagggacugaugaggccguuaggccgaaacauucau

SEQ ID NO: 9770 - RNA, 38 nt, Artificial Sequence
  Description of Artificial Sequence:  Enzymatic Nucleic Acid
uugcagggcugaugaggccguuaggccgaaaacauuca

SEQ ID NO: 9771 - RNA, 38 nt, Artificial Sequence
  Description of Artificial Sequence:  Enzymatic Nucleic Acid
cuugcaggcugaugaggccguuaggccgaaaaacauuc

SEQ ID NO: 9772 - RNA, 38 nt, Artificial Sequence
  Description of Artificial Sequence:  Enzymatic Nucleic Acid
ggugccugcugaugaggccguuaggccgaaaucuugca

SEQ ID NO: 9773 - RNA, 38 nt, Artificial Sequence
  Description of Artificial Sequence:  Enzymatic Nucleic Acid
aggugccucugaugaggccguuaggccgaaaaucuugc

SEQ ID NO: 9774 - RNA, 38 nt, Artificial Sequence
  Description of Artificial Sequence:  Enzymatic Nucleic Acid
ugcaggcacugaugaggccguuaggccgaaaggugccu

SEQ ID NO: 9775 - RNA, 38 nt, Artificial Sequence
  Description of Artificial Sequence:  Enzymatic Nucleic Acid
ccuguguacugaugaggccguuaggccgaaacauuccu

SEQ ID NO: 9776 - RNA, 38 nt, Artificial Sequence
  Description of Artificial Sequence:  Enzymatic Nucleic Acid
ccccugugcugaugaggccguuaggccgaaauacauuc

SEQ ID NO: 9777 - RNA, 38 nt, Artificial Sequence
  Description of Artificial Sequence:  Enzymatic Nucleic Acid
uucuggagcugaugaggccguuaggccgaaauuucuuc

SEQ ID NO: 9778 - RNA, 38 nt, Artificial Sequence
  Description of Artificial Sequence:  Enzymatic Nucleic Acid
uucuucugcugaugaggccguuaggccgaaaggauuuc

SEQ ID NO: 9779 - RNA, 38 nt, Artificial Sequence
  Description of Artificial Sequence:  Enzymatic Nucleic Acid
cugauugucugaugaggccguuaggccgaaauuucuuu

SEQ ID NO: 9780 - RNA, 38 nt, Artificial Sequence
  Description of Artificial Sequence:  Enzymatic Nucleic Acid
ucugauugcugaugaggccguuaggccgaaaauuucuu

SEQ ID NO: 9781 - RNA, 38 nt, Artificial Sequence
  Description of Artificial Sequence:  Enzymatic Nucleic Acid
ugaucucucugaugaggccguuaggccgaaauuguaau

SEQ ID NO: 9782 - RNA, 38 nt, Artificial Sequence
  Description of Artificial Sequence:  Enzymatic Nucleic Acid
ugcuuccucugaugaggccguuaggccgaaaucucuga

SEQ ID NO: 9783 - RNA, 38 nt, Artificial Sequence
  Description of Artificial Sequence:  Enzymatic Nucleic Acid
gcaggaggcugaugaggccguuaggccgaaauggugcu

SEQ ID NO: 9784 - RNA, 38 nt, Artificial Sequence
  Description of Artificial Sequence:  Enzymatic Nucleic Acid
uuucgcagcugaugaggccguuaggccgaaagguaugg

SEQ ID NO: 9785 - RNA, 38 nt, Artificial Sequence
  Description of Artificial Sequence:  Enzymatic Nucleic Acid
ugaucacucugaugaggccguuaggccgaaagguuucg

SEQ ID NO: 9786 - RNA, 38 nt, Artificial Sequence
  Description of Artificial Sequence:  Enzymatic Nucleic Acid
cacugugucugaugaggccguuaggccgaaaucacuga

SEQ ID NO: 9787 - RNA, 38 nt, Artificial Sequence
  Description of Artificial Sequence:  Enzymatic Nucleic Acid
gaacugcucugaugaggccguuaggccgaaauggccac

SEQ ID NO: 9788 - RNA, 38 nt, Artificial Sequence
  Description of Artificial Sequence:  Enzymatic Nucleic Acid
agugguggcugaugaggccguuaggccgaaacugcuga

SEQ ID NO: 9789 - RNA, 38 nt, Artificial Sequence
  Description of Artificial Sequence:  Enzymatic Nucleic Acid
aaguggugcugaugaggccguuaggccgaaaacugcug

SEQ ID NO: 9790 - RNA, 38 nt, Artificial Sequence
  Description of Artificial Sequence:  Enzymatic Nucleic Acid
acagucuacugaugaggccguuaggccgaaaguggugg

SEQ ID NO: 9791 - RNA, 38 nt, Artificial Sequence
  Description of Artificial Sequence:  Enzymatic Nucleic Acid
gacagucucugaugaggccguuaggccgaaaaguggug

SEQ ID NO: 9792 - RNA, 38 nt, Artificial Sequence
  Description of Artificial Sequence:  Enzymatic Nucleic Acid
ugacaguccugaugaggccguuaggccgaaaaaguggu

SEQ ID NO: 9793 - RNA, 38 nt, Artificial Sequence
  Description of Artificial Sequence:  Enzymatic Nucleic Acid
auuagcaucugaugaggccguuaggccgaaacagucua

SEQ ID NO: 9794 - RNA, 38 nt, Artificial Sequence
  Description of Artificial Sequence:  Enzymatic Nucleic Acid
gacaccaucugaugaggccguuaggccgaaagcaugac

SEQ ID NO: 9795 - RNA, 38 nt, Artificial Sequence
  Description of Artificial Sequence:  Enzymatic Nucleic Acid
ggcucgggcugaugaggccguuaggccgaaacaccauu

SEQ ID NO: 9796 - RNA, 38 nt, Artificial Sequence
  Description of Artificial Sequence:  Enzymatic Nucleic Acid
agugaucucugaugaggccguuaggccgaaaggcucgg

SEQ ID NO: 9797 - RNA, 38 nt, Artificial Sequence
  Description of Artificial Sequence:  Enzymatic Nucleic Acid
aaccaagucugaugaggccguuaggccgaaaucugagg

SEQ ID NO: 9798 - RNA, 38 nt, Artificial Sequence
  Description of Artificial Sequence:  Enzymatic Nucleic Acid
uuuaaacccugaugaggccguuaggccgaaagugaucu

SEQ ID NO: 9799 - RNA, 38 nt, Artificial Sequence
  Description of Artificial Sequence:  Enzymatic Nucleic Acid
uguuuuuacugaugaggccguuaggccgaaaccaagug

SEQ ID NO: 9800 - RNA, 38 nt, Artificial Sequence
  Description of Artificial Sequence:  Enzymatic Nucleic Acid
uuguuuuucugaugaggccguuaggccgaaaaccaagu

SEQ ID NO: 9801 - RNA, 38 nt, Artificial Sequence
  Description of Artificial Sequence:  Enzymatic Nucleic Acid
guuguuuucugaugaggccguuaggccgaaaaaccaag

SEQ ID NO: 9802 - RNA, 38 nt, Artificial Sequence
  Description of Artificial Sequence:  Enzymatic Nucleic Acid
ucuuguugcugaugaggccguuaggccgaaauuuugug

SEQ ID NO: 9803 - RNA, 38 nt, Artificial Sequence
  Description of Artificial Sequence:  Enzymatic Nucleic Acid
ccuaaaaucugaugaggccguuaggccgaaauuccagg

SEQ ID NO: 9804 - RNA, 38 nt, Artificial Sequence
  Description of Artificial Sequence:  Enzymatic Nucleic Acid
uccuaaaacugaugaggccguuaggccgaaaauuccag

SEQ ID NO: 9805 - RNA, 38 nt, Artificial Sequence
  Description of Artificial Sequence:  Enzymatic Nucleic Acid
gguccuaacugaugaggccguuaggccgaaauaauucc

SEQ ID NO: 9806 - RNA, 38 nt, Artificial Sequence
  Description of Artificial Sequence:  Enzymatic Nucleic Acid
ugguccuacugaugaggccguuaggccgaaaauaauuc

SEQ ID NO: 9807 - RNA, 38 nt, Artificial Sequence
  Description of Artificial Sequence:  Enzymatic Nucleic Acid
cugguccucugaugaggccguuaggccgaaaaauaauu

SEQ ID NO: 9808 - RNA, 38 nt, Artificial Sequence
  Description of Artificial Sequence:  Enzymatic Nucleic Acid
ccuggucccugaugaggccguuaggccgaaaaaauaau

SEQ ID NO: 9809 - RNA, 38 nt, Artificial Sequence
  Description of Artificial Sequence:  Enzymatic Nucleic Acid
uuucaauacugaugaggccguuaggccgaaacagcgug

SEQ ID NO: 9810 - RNA, 38 nt, Artificial Sequence
  Description of Artificial Sequence:  Enzymatic Nucleic Acid
cuuucaaucugaugaggccguuaggccgaaaacagcgu

SEQ ID NO: 9811 - RNA, 38 nt, Artificial Sequence
  Description of Artificial Sequence:  Enzymatic Nucleic Acid
ucuuucaacugaugaggccguuaggccgaaaaacagcg

SEQ ID NO: 9812 - RNA, 38 nt, Artificial Sequence
  Description of Artificial Sequence:  Enzymatic Nucleic Acid
acucuuuccugaugaggccguuaggccgaaauaaacag

SEQ ID NO: 9813 - RNA, 38 nt, Artificial Sequence
  Description of Artificial Sequence:  Enzymatic Nucleic Acid
ucuucugucugaugaggccguuaggccgaaacucuuuc

SEQ ID NO: 9814 - RNA, 38 nt, Artificial Sequence
  Description of Artificial Sequence:  Enzymatic Nucleic Acid
cagugauacugaugaggccguuaggccgaaacaccuuc

SEQ ID NO: 9815 - RNA, 38 nt, Artificial Sequence
  Description of Artificial Sequence:  Enzymatic Nucleic Acid
ugcagugacugaugaggccguuaggccgaaagacaccu

SEQ ID NO: 9816 - RNA, 38 nt, Artificial Sequence
  Description of Artificial Sequence:  Enzymatic Nucleic Acid
uuugcagucugaugaggccguuaggccgaaauagacac

SEQ ID NO: 9817 - RNA, 38 nt, Artificial Sequence
  Description of Artificial Sequence:  Enzymatic Nucleic Acid
uuuccacacugaugaggccguuaggccgaaagcccuuc

SEQ ID NO: 9818 - RNA, 38 nt, Artificial Sequence
  Description of Artificial Sequence:  Enzymatic Nucleic Acid
guaugcugcugaugaggccguuaggccgaaacuuucca

SEQ ID NO: 9819 - RNA, 38 nt, Artificial Sequence
  Description of Artificial Sequence:  Enzymatic Nucleic Acid
gguaugcucugaugaggccguuaggccgaaaacuuucc

SEQ ID NO: 9820 - RNA, 38 nt, Artificial Sequence
  Description of Artificial Sequence:  Enzymatic Nucleic Acid
cagugaggcugaugaggccguuaggccgaaaugcugaa

SEQ ID NO: 9821 - RNA, 38 nt, Artificial Sequence
  Description of Artificial Sequence:  Enzymatic Nucleic Acid
ugaacagucugaugaggccguuaggccgaaagguaugc

SEQ ID NO: 9822 - RNA, 38 nt, Artificial Sequence
  Description of Artificial Sequence:  Enzymatic Nucleic Acid
guuccuugcugaugaggccguuaggccgaaacagugag

SEQ ID NO: 9823 - RNA, 38 nt, Artificial Sequence
  Description of Artificial Sequence:  Enzymatic Nucleic Acid
gguuccuucugaugaggccguuaggccgaaaacaguga

SEQ ID NO: 9824 - RNA, 38 nt, Artificial Sequence
  Description of Artificial Sequence:  Enzymatic Nucleic Acid
acuugucccugaugaggccguuaggccgaaagguuccu

SEQ ID NO: 9825 - RNA, 38 nt, Artificial Sequence
  Description of Artificial Sequence:  Enzymatic Nucleic Acid
ccagauuacugaugaggccguuaggccgaaacuugucc

SEQ ID NO: 9826 - RNA, 38 nt, Artificial Sequence
  Description of Artificial Sequence:  Enzymatic Nucleic Acid
cuccagaucugaugaggccguuaggccgaaagacuugu

SEQ ID NO: 9827 - RNA, 38 nt, Artificial Sequence
  Description of Artificial Sequence:  Enzymatic Nucleic Acid
cagcuccacugaugaggccguuaggccgaaauuagacu

SEQ ID NO: 9828 - RNA, 38 nt, Artificial Sequence
  Description of Artificial Sequence:  Enzymatic Nucleic Acid
guuagagucugaugaggccguuaggccgaaaucagcuc

SEQ ID NO: 9829 - RNA, 38 nt, Artificial Sequence
  Description of Artificial Sequence:  Enzymatic Nucleic Acid
gcauguuacugaugaggccguuaggccgaaagugauca

SEQ ID NO: 9830 - RNA, 38 nt, Artificial Sequence
  Description of Artificial Sequence:  Enzymatic Nucleic Acid
gugcaugucugaugaggccguuaggccgaaagagugau

SEQ ID NO: 9831 - RNA, 38 nt, Artificial Sequence
  Description of Artificial Sequence:  Enzymatic Nucleic Acid
ccagaagacugaugaggccguuaggccgaaagucgcag

SEQ ID NO: 9832 - RNA, 38 nt, Artificial Sequence
  Description of Artificial Sequence:  Enzymatic Nucleic Acid
agccagaacugaugaggccguuaggccgaaagagucgc

SEQ ID NO: 9833 - RNA, 38 nt, Artificial Sequence
  Description of Artificial Sequence:  Enzymatic Nucleic Acid
ggagccagcugaugaggccguuaggccgaaagagaguc

SEQ ID NO: 9834 - RNA, 38 nt, Artificial Sequence
  Description of Artificial Sequence:  Enzymatic Nucleic Acid
aggagccacugaugaggccguuaggccgaaaagagagu

SEQ ID NO: 9835 - RNA, 38 nt, Artificial Sequence
  Description of Artificial Sequence:  Enzymatic Nucleic Acid
guuaauagcugaugaggccguuaggccgaaagccagaa

SEQ ID NO: 9836 - RNA, 38 nt, Artificial Sequence
  Description of Artificial Sequence:  Enzymatic Nucleic Acid
aggguuaacugaugaggccguuaggccgaaaggagcca

SEQ ID NO: 9837 - RNA, 38 nt, Artificial Sequence
  Description of Artificial Sequence:  Enzymatic Nucleic Acid
ggaggguucugaugaggccguuaggccgaaauaggagc

SEQ ID NO: 9838 - RNA, 38 nt, Artificial Sequence
  Description of Artificial Sequence:  Enzymatic Nucleic Acid
aggagggucugaugaggccguuaggccgaaaauaggag

SEQ ID NO: 9839 - RNA, 38 nt, Artificial Sequence
  Description of Artificial Sequence:  Enzymatic Nucleic Acid
cggauaagcugaugaggccguuaggccgaaaggguuaa

SEQ ID NO: 9840 - RNA, 38 nt, Artificial Sequence
  Description of Artificial Sequence:  Enzymatic Nucleic Acid
uuucggaucugaugaggccguuaggccgaaaggagggu

SEQ ID NO: 9841 - RNA, 38 nt, Artificial Sequence
  Description of Artificial Sequence:  Enzymatic Nucleic Acid
uuuucggacugaugaggccguuaggccgaaaaggaggg

SEQ ID NO: 9842 - RNA, 38 nt, Artificial Sequence
  Description of Artificial Sequence:  Enzymatic Nucleic Acid
auuuuucgcugaugaggccguuaggccgaaauaaggag

SEQ ID NO: 9843 - RNA, 38 nt, Artificial Sequence
  Description of Artificial Sequence:  Enzymatic Nucleic Acid
cagaagaacugaugaggccguuaggccgaaaccuuuuc

SEQ ID NO: 9844 - RNA, 38 nt, Artificial Sequence
  Description of Artificial Sequence:  Enzymatic Nucleic Acid
uucagaagcugaugaggccguuaggccgaaagaccuuu

SEQ ID NO: 9845 - RNA, 38 nt, Artificial Sequence
  Description of Artificial Sequence:  Enzymatic Nucleic Acid
uuucagaacugaugaggccguuaggccgaaaagaccuu

SEQ ID NO: 9846 - RNA, 38 nt, Artificial Sequence
  Description of Artificial Sequence:  Enzymatic Nucleic Acid
uauuucagcugaugaggccguuaggccgaaagaagacc

SEQ ID NO: 9847 - RNA, 38 nt, Artificial Sequence
  Description of Artificial Sequence:  Enzymatic Nucleic Acid
uuauuucacugaugaggccguuaggccgaaaagaagac

SEQ ID NO: 9848 - RNA, 38 nt, Artificial Sequence
  Description of Artificial Sequence:  Enzymatic Nucleic Acid
ucagucuucugaugaggccguuaggccgaaauuucaga

SEQ ID NO: 9849 - RNA, 38 nt, Artificial Sequence
  Description of Artificial Sequence:  Enzymatic Nucleic Acid
uugauaggcugaugaggccguuaggccgaaagucaguc

SEQ ID NO: 9850 - RNA, 38 nt, Artificial Sequence
  Description of Artificial Sequence:  Enzymatic Nucleic Acid
auaauugacugaugaggccguuaggccgaaagguaguc

SEQ ID NO: 9851 - RNA, 38 nt, Artificial Sequence
  Description of Artificial Sequence:  Enzymatic Nucleic Acid
uuauaauucugaugaggccguuaggccgaaauagguag

SEQ ID NO: 9852 - RNA, 38 nt, Artificial Sequence
  Description of Artificial Sequence:  Enzymatic Nucleic Acid
uccauuaucugaugaggccguuaggccgaaauugauag

SEQ ID NO: 9853 - RNA, 38 nt, Artificial Sequence
  Description of Artificial Sequence:  Enzymatic Nucleic Acid
guccauuacugaugaggccguuaggccgaaaauugaua

SEQ ID NO: 9854 - RNA, 38 nt, Artificial Sequence
  Description of Artificial Sequence:  Enzymatic Nucleic Acid
ggguccaucugaugaggccguuaggccgaaauaauuga

SEQ ID NO: 9855 - RNA, 38 nt, Artificial Sequence
  Description of Artificial Sequence:  Enzymatic Nucleic Acid
uccaaaggcugaugaggccguuaggccgaaacuucauc

SEQ ID NO: 9856 - RNA, 38 nt, Artificial Sequence
  Description of Artificial Sequence:  Enzymatic Nucleic Acid
auccaaagcugaugaggccguuaggccgaaaacuucau

SEQ ID NO: 9857 - RNA, 38 nt, Artificial Sequence
  Description of Artificial Sequence:  Enzymatic Nucleic Acid
cucauccacugaugaggccguuaggccgaaaggaacuu

SEQ ID NO: 9858 - RNA, 38 nt, Artificial Sequence
  Description of Artificial Sequence:  Enzymatic Nucleic Acid
gcucaucccugaugaggccguuaggccgaaaaggaacu

SEQ ID NO: 9859 - RNA, 38 nt, Artificial Sequence
  Description of Artificial Sequence:  Enzymatic Nucleic Acid
ucauaaggcugaugaggccguuaggccgaaagccgcuc

SEQ ID NO: 9860 - RNA, 38 nt, Artificial Sequence
  Description of Artificial Sequence:  Enzymatic Nucleic Acid
ggcaucaucugaugaggccguuaggccgaaagggagcc

SEQ ID NO: 9861 - RNA, 38 nt, Artificial Sequence
  Description of Artificial Sequence:  Enzymatic Nucleic Acid
uggcaucacugaugaggccguuaggccgaaaagggagc

SEQ ID NO: 9862 - RNA, 38 nt, Artificial Sequence
  Description of Artificial Sequence:  Enzymatic Nucleic Acid
cccgggcacugaugaggccguuaggccgaaacucccac

SEQ ID NO: 9863 - RNA, 38 nt, Artificial Sequence
  Description of Artificial Sequence:  Enzymatic Nucleic Acid
ucccgggccugaugaggccguuaggccgaaaacuccca

SEQ ID NO: 9864 - RNA, 38 nt, Artificial Sequence
  Description of Artificial Sequence:  Enzymatic Nucleic Acid
cccaguuucugaugaggccguuaggccgaaagucucuc

SEQ ID NO: 9865 - RNA, 38 nt, Artificial Sequence
  Description of Artificial Sequence:  Enzymatic Nucleic Acid
gcccaguucugaugaggccguuaggccgaaaagucucu

SEQ ID NO: 9866 - RNA, 38 nt, Artificial Sequence
  Description of Artificial Sequence:  Enzymatic Nucleic Acid
uuccaagucugaugaggccguuaggccgaaauuugccc

SEQ ID NO: 9867 - RNA, 38 nt, Artificial Sequence
  Description of Artificial Sequence:  Enzymatic Nucleic Acid
ccucuucccugaugaggccguuaggccgaaagugauuu

SEQ ID NO: 9868 - RNA, 38 nt, Artificial Sequence
  Description of Artificial Sequence:  Enzymatic Nucleic Acid
uuuuccaacugaugaggccguuaggccgaaagccccuc

SEQ ID NO: 9869 - RNA, 38 nt, Artificial Sequence
  Description of Artificial Sequence:  Enzymatic Nucleic Acid
cuuuuccacugaugaggccguuaggccgaaaagccccu

SEQ ID NO: 9870 - RNA, 38 nt, Artificial Sequence
  Description of Artificial Sequence:  Enzymatic Nucleic Acid
acuuuucccugaugaggccguuaggccgaaaaagcccc

SEQ ID NO: 9871 - RNA, 38 nt, Artificial Sequence
  Description of Artificial Sequence:  Enzymatic Nucleic Acid
gaugcuugcugaugaggccguuaggccgaaaccacuuu

SEQ ID NO: 9872 - RNA, 38 nt, Artificial Sequence
  Description of Artificial Sequence:  Enzymatic Nucleic Acid
ugaugcuucugaugaggccguuaggccgaaaaccacuu

SEQ ID NO: 9873 - RNA, 38 nt, Artificial Sequence
  Description of Artificial Sequence:  Enzymatic Nucleic Acid
caaaugcucugaugaggccguuaggccgaaaugcuuga

SEQ ID NO: 9874 - RNA, 38 nt, Artificial Sequence
  Description of Artificial Sequence:  Enzymatic Nucleic Acid
uaaugccacugaugaggccguuaggccgaaaugcugau

SEQ ID NO: 9875 - RNA, 38 nt, Artificial Sequence
  Description of Artificial Sequence:  Enzymatic Nucleic Acid
uuaaugcccugaugaggccguuaggccgaaaaugcuga

SEQ ID NO: 9876 - RNA, 38 nt, Artificial Sequence
  Description of Artificial Sequence:  Enzymatic Nucleic Acid
gauuucuucugaugaggccguuaggccgaaaugccaaa

SEQ ID NO: 9877 - RNA, 38 nt, Artificial Sequence
  Description of Artificial Sequence:  Enzymatic Nucleic Acid
ugauuucucugaugaggccguuaggccgaaaaugccaa

SEQ ID NO: 9878 - RNA, 38 nt, Artificial Sequence
  Description of Artificial Sequence:  Enzymatic Nucleic Acid
acguaggucugaugaggccguuaggccgaaauuucuua

SEQ ID NO: 9879 - RNA, 38 nt, Artificial Sequence
  Description of Artificial Sequence:  Enzymatic Nucleic Acid
ccggcacgcugaugaggccguuaggccgaaaggugauu

SEQ ID NO: 9880 - RNA, 38 nt, Artificial Sequence
  Description of Artificial Sequence:  Enzymatic Nucleic Acid
gagcuuugcugaugaggccguuaggccgaaacucgcug

SEQ ID NO: 9881 - RNA, 38 nt, Artificial Sequence
  Description of Artificial Sequence:  Enzymatic Nucleic Acid
agucaucacugaugaggccguuaggccgaaagcuuugu

SEQ ID NO: 9882 - RNA, 38 nt, Artificial Sequence
  Description of Artificial Sequence:  Enzymatic Nucleic Acid
aagauuuucugaugaggccguuaggccgaaagcucagu

SEQ ID NO: 9883 - RNA, 38 nt, Artificial Sequence
  Description of Artificial Sequence:  Enzymatic Nucleic Acid
ugggucaacugaugaggccguuaggccgaaauuuuuag

SEQ ID NO: 9884 - RNA, 38 nt, Artificial Sequence
  Description of Artificial Sequence:  Enzymatic Nucleic Acid
uguggguccugaugaggccguuaggccgaaagauuuuu

SEQ ID NO: 9885 - RNA, 38 nt, Artificial Sequence
  Description of Artificial Sequence:  Enzymatic Nucleic Acid
ugguggcccugaugaggccguuaggccgaaaugugggu

SEQ ID NO: 9886 - RNA, 38 nt, Artificial Sequence
  Description of Artificial Sequence:  Enzymatic Nucleic Acid
cacguucacugaugaggccguuaggccgaaaugguggc

SEQ ID NO: 9887 - RNA, 38 nt, Artificial Sequence
  Description of Artificial Sequence:  Enzymatic Nucleic Acid
agcagguucugaugaggccguuaggccgaaaccacguu

SEQ ID NO: 9888 - RNA, 38 nt, Artificial Sequence
  Description of Artificial Sequence:  Enzymatic Nucleic Acid
cagcaggucugaugaggccguuaggccgaaaaccacgu

SEQ ID NO: 9889 - RNA, 38 nt, Artificial Sequence
  Description of Artificial Sequence:  Enzymatic Nucleic Acid
caccaucacugaugaggccguuaggccgaaaggcccuc

SEQ ID NO: 9890 - RNA, 38 nt, Artificial Sequence
  Description of Artificial Sequence:  Enzymatic Nucleic Acid
uauucaaccugaugaggccguuaggccgaaaucaccau

SEQ ID NO: 9891 - RNA, 38 nt, Artificial Sequence
  Description of Artificial Sequence:  Enzymatic Nucleic Acid
caguauuccugaugaggccguuaggccgaaacaaucac

SEQ ID NO: 9892 - RNA, 38 nt, Artificial Sequence
  Description of Artificial Sequence:  Enzymatic Nucleic Acid
auuugcagcugaugaggccguuaggccgaaauucaaca

SEQ ID NO: 9893 - RNA, 38 nt, Artificial Sequence
  Description of Artificial Sequence:  Enzymatic Nucleic Acid
gauuuccacugaugaggccguuaggccgaaauuugcag

SEQ ID NO: 9894 - RNA, 38 nt, Artificial Sequence
  Description of Artificial Sequence:  Enzymatic Nucleic Acid
guuggagacugaugaggccguuaggccgaaauuuccau

SEQ ID NO: 9895 - RNA, 38 nt, Artificial Sequence
  Description of Artificial Sequence:  Enzymatic Nucleic Acid
uaguuggacugaugaggccguuaggccgaaagauuucc

SEQ ID NO: 9896 - RNA, 38 nt, Artificial Sequence
  Description of Artificial Sequence:  Enzymatic Nucleic Acid
gguaguugcugaugaggccguuaggccgaaagagauuu

SEQ ID NO: 9897 - RNA, 38 nt, Artificial Sequence
  Description of Artificial Sequence:  Enzymatic Nucleic Acid
ucuugaggcugaugaggccguuaggccgaaaguuggag

SEQ ID NO: 9898 - RNA, 38 nt, Artificial Sequence
  Description of Artificial Sequence:  Enzymatic Nucleic Acid
uugcucuucugaugaggccguuaggccgaaagguaguu

SEQ ID NO: 9899 - RNA, 38 nt, Artificial Sequence
  Description of Artificial Sequence:  Enzymatic Nucleic Acid
gaaaaaaucugaugaggccguuaggccgaaagucacgu

SEQ ID NO: 9900 - RNA, 38 nt, Artificial Sequence
  Description of Artificial Sequence:  Enzymatic Nucleic Acid
agaaaaaacugaugaggccguuaggccgaaaagucacg

SEQ ID NO: 9901 - RNA, 38 nt, Artificial Sequence
  Description of Artificial Sequence:  Enzymatic Nucleic Acid
ugagaaaacugaugaggccguuaggccgaaauaaguca

SEQ ID NO: 9902 - RNA, 38 nt, Artificial Sequence
  Description of Artificial Sequence:  Enzymatic Nucleic Acid
uugagaaacugaugaggccguuaggccgaaaauaaguc

SEQ ID NO: 9903 - RNA, 38 nt, Artificial Sequence
  Description of Artificial Sequence:  Enzymatic Nucleic Acid
guugagaacugaugaggccguuaggccgaaaaauaagu

SEQ ID NO: 9904 - RNA, 38 nt, Artificial Sequence
  Description of Artificial Sequence:  Enzymatic Nucleic Acid
uguugagacugaugaggccguuaggccgaaaaaauaag

SEQ ID NO: 9905 - RNA, 38 nt, Artificial Sequence
  Description of Artificial Sequence:  Enzymatic Nucleic Acid
uuguugagcugaugaggccguuaggccgaaaaaaauaa

SEQ ID NO: 9906 - RNA, 38 nt, Artificial Sequence
  Description of Artificial Sequence:  Enzymatic Nucleic Acid
cuuguugacugaugaggccguuaggccgaaaaaaaaua

SEQ ID NO: 9907 - RNA, 38 nt, Artificial Sequence
  Description of Artificial Sequence:  Enzymatic Nucleic Acid
uccuuguucugaugaggccguuaggccgaaagaaaaaa

SEQ ID NO: 9908 - RNA, 38 nt, Artificial Sequence
  Description of Artificial Sequence:  Enzymatic Nucleic Acid
uccaugugcugaugaggccguuaggccgaaagugcugc

SEQ ID NO: 9909 - RNA, 38 nt, Artificial Sequence
  Description of Artificial Sequence:  Enzymatic Nucleic Acid
uucuuucucugaugaggccguuaggccgaaaggcucca

SEQ ID NO: 9910 - RNA, 38 nt, Artificial Sequence
  Description of Artificial Sequence:  Enzymatic Nucleic Acid
acgcuauccugaugaggccguuaggccgaaagucuugg

SEQ ID NO: 9911 - RNA, 38 nt, Artificial Sequence
  Description of Artificial Sequence:  Enzymatic Nucleic Acid
ggugacgccugaugaggccguuaggccgaaaucuaguc

SEQ ID NO: 9912 - RNA, 38 nt, Artificial Sequence
  Description of Artificial Sequence:  Enzymatic Nucleic Acid
cugcuggucugaugaggccguuaggccgaaacgcuauc

SEQ ID NO: 9913 - RNA, 38 nt, Artificial Sequence
  Description of Artificial Sequence:  Enzymatic Nucleic Acid
agcucgcacugaugaggccguuaggccgaaagcuuucg

SEQ ID NO: 9914 - RNA, 38 nt, Artificial Sequence
  Description of Artificial Sequence:  Enzymatic Nucleic Acid
gagcucgccugaugaggccguuaggccgaaaagcuuuc

SEQ ID NO: 9915 - RNA, 38 nt, Artificial Sequence
  Description of Artificial Sequence:  Enzymatic Nucleic Acid
gaaagccgcugaugaggccguuaggccgaaagcucgca

SEQ ID NO: 9916 - RNA, 38 nt, Artificial Sequence
  Description of Artificial Sequence:  Enzymatic Nucleic Acid
cuuccugacugaugaggccguuaggccgaaagccggag

SEQ ID NO: 9917 - RNA, 38 nt, Artificial Sequence
  Description of Artificial Sequence:  Enzymatic Nucleic Acid
ucuuccugcugaugaggccguuaggccgaaaagccgga

SEQ ID NO: 9918 - RNA, 38 nt, Artificial Sequence
  Description of Artificial Sequence:  Enzymatic Nucleic Acid
aucuuccucugaugaggccguuaggccgaaaaagccgg

SEQ ID NO: 9919 - RNA, 38 nt, Artificial Sequence
  Description of Artificial Sequence:  Enzymatic Nucleic Acid
cagacuuucugaugaggccguuaggccgaaaucuuccu

SEQ ID NO: 9920 - RNA, 38 nt, Artificial Sequence
  Description of Artificial Sequence:  Enzymatic Nucleic Acid
aucacucacugaugaggccguuaggccgaaacuuuuau

SEQ ID NO: 9921 - RNA, 38 nt, Artificial Sequence
  Description of Artificial Sequence:  Enzymatic Nucleic Acid
ucuuccuccugaugaggccguuaggccgaaacaucacu

SEQ ID NO: 9922 - RNA, 38 nt, Artificial Sequence
  Description of Artificial Sequence:  Enzymatic Nucleic Acid
accgucagcugaugaggccguuaggccgaaauccuccu

SEQ ID NO: 9923 - RNA, 38 nt, Artificial Sequence
  Description of Artificial Sequence:  Enzymatic Nucleic Acid
aaccgucacugaugaggccguuaggccgaaaauccucc

SEQ ID NO: 9924 - RNA, 38 nt, Artificial Sequence
  Description of Artificial Sequence:  Enzymatic Nucleic Acid
cuuguagacugaugaggccguuaggccgaaaccgucag

SEQ ID NO: 9925 - RNA, 38 nt, Artificial Sequence
  Description of Artificial Sequence:  Enzymatic Nucleic Acid
ccuuguagcugaugaggccguuaggccgaaaaccguca

SEQ ID NO: 9926 - RNA, 38 nt, Artificial Sequence
  Description of Artificial Sequence:  Enzymatic Nucleic Acid
uccuuguacugaugaggccguuaggccgaaaaaccguc

SEQ ID NO: 9927 - RNA, 38 nt, Artificial Sequence
  Description of Artificial Sequence:  Enzymatic Nucleic Acid
gcuccuugcugaugaggccguuaggccgaaagaaaccg

SEQ ID NO: 9928 - RNA, 38 nt, Artificial Sequence
  Description of Artificial Sequence:  Enzymatic Nucleic Acid
uccauagucugaugaggccguuaggccgaaaugggcuc

SEQ ID NO: 9929 - RNA, 38 nt, Artificial Sequence
  Description of Artificial Sequence:  Enzymatic Nucleic Acid
aucuuccacugaugaggccguuaggccgaaagugaugg

SEQ ID NO: 9930 - RNA, 38 nt, Artificial Sequence
  Description of Artificial Sequence:  Enzymatic Nucleic Acid
agaaaucacugaugaggccguuaggccgaaaucuucca

SEQ ID NO: 9931 - RNA, 38 nt, Artificial Sequence
  Description of Artificial Sequence:  Enzymatic Nucleic Acid
cuguaagacugaugaggccguuaggccgaaaucagauc

SEQ ID NO: 9932 - RNA, 38 nt, Artificial Sequence
  Description of Artificial Sequence:  Enzymatic Nucleic Acid
acuguaagcugaugaggccguuaggccgaaaaucagau

SEQ ID NO: 9933 - RNA, 38 nt, Artificial Sequence
  Description of Artificial Sequence:  Enzymatic Nucleic Acid
aacuguaacugaugaggccguuaggccgaaaaaucaga

SEQ ID NO: 9934 - RNA, 38 nt, Artificial Sequence
  Description of Artificial Sequence:  Enzymatic Nucleic Acid
aaaacugucugaugaggccguuaggccgaaagaaauca

SEQ ID NO: 9935 - RNA, 38 nt, Artificial Sequence
  Description of Artificial Sequence:  Enzymatic Nucleic Acid
gaaaacugcugaugaggccguuaggccgaaaagaaauc

SEQ ID NO: 9936 - RNA, 38 nt, Artificial Sequence
  Description of Artificial Sequence:  Enzymatic Nucleic Acid
cacuugaacugaugaggccguuaggccgaaacuguaag

SEQ ID NO: 9937 - RNA, 38 nt, Artificial Sequence
  Description of Artificial Sequence:  Enzymatic Nucleic Acid
ccacuugacugaugaggccguuaggccgaaaacuguaa

SEQ ID NO: 9938 - RNA, 38 nt, Artificial Sequence
  Description of Artificial Sequence:  Enzymatic Nucleic Acid
gccacuugcugaugaggccguuaggccgaaaaacugua

SEQ ID NO: 9939 - RNA, 38 nt, Artificial Sequence
  Description of Artificial Sequence:  Enzymatic Nucleic Acid
ggccacuucugaugaggccguuaggccgaaaaaacugu

SEQ ID NO: 9940 - RNA, 38 nt, Artificial Sequence
  Description of Artificial Sequence:  Enzymatic Nucleic Acid
aagacaggcugaugaggccguuaggccgaaacuccaug

SEQ ID NO: 9941 - RNA, 38 nt, Artificial Sequence
  Description of Artificial Sequence:  Enzymatic Nucleic Acid
gaagacagcugaugaggccguuaggccgaaaacuccau

SEQ ID NO: 9942 - RNA, 38 nt, Artificial Sequence
  Description of Artificial Sequence:  Enzymatic Nucleic Acid
uucuggaacugaugaggccguuaggccgaaacaggaac

SEQ ID NO: 9943 - RNA, 38 nt, Artificial Sequence
  Description of Artificial Sequence:  Enzymatic Nucleic Acid
cuuucuggcugaugaggccguuaggccgaaagacagga

SEQ ID NO: 9944 - RNA, 38 nt, Artificial Sequence
  Description of Artificial Sequence:  Enzymatic Nucleic Acid
acuuucugcugaugaggccguuaggccgaaaagacagg

SEQ ID NO: 9945 - RNA, 38 nt, Artificial Sequence
  Description of Artificial Sequence:  Enzymatic Nucleic Acid
ucccgaugcugaugaggccguuaggccgaaaugcacuu

SEQ ID NO: 9946 - RNA, 38 nt, Artificial Sequence
  Description of Artificial Sequence:  Enzymatic Nucleic Acid
gucccgaucugaugaggccguuaggccgaaaaugcacu

SEQ ID NO: 9947 - RNA, 38 nt, Artificial Sequence
  Description of Artificial Sequence:  Enzymatic Nucleic Acid
cagguccccugaugaggccguuaggccgaaaugaaugc

SEQ ID NO: 9948 - RNA, 38 nt, Artificial Sequence
  Description of Artificial Sequence:  Enzymatic Nucleic Acid
gauaaaagcugaugaggccguuaggccgaaauguuucu

SEQ ID NO: 9949 - RNA, 38 nt, Artificial Sequence
  Description of Artificial Sequence:  Enzymatic Nucleic Acid
agauaaaacugaugaggccguuaggccgaaaauguuuc

SEQ ID NO: 9950 - RNA, 38 nt, Artificial Sequence
  Description of Artificial Sequence:  Enzymatic Nucleic Acid
ucagauaacugaugaggccguuaggccgaaagaauguu

SEQ ID NO: 9951 - RNA, 38 nt, Artificial Sequence
  Description of Artificial Sequence:  Enzymatic Nucleic Acid
cucagauacugaugaggccguuaggccgaaaagaaugu

SEQ ID NO: 9952 - RNA, 38 nt, Artificial Sequence
  Description of Artificial Sequence:  Enzymatic Nucleic Acid
ucucagaucugaugaggccguuaggccgaaaaagaaug

SEQ ID NO: 9953 - RNA, 38 nt, Artificial Sequence
  Description of Artificial Sequence:  Enzymatic Nucleic Acid
uucucagacugaugaggccguuaggccgaaaaaagaau

SEQ ID NO: 9954 - RNA, 38 nt, Artificial Sequence
  Description of Artificial Sequence:  Enzymatic Nucleic Acid
uguucucacugaugaggccguuaggccgaaauaaaaga

SEQ ID NO: 9955 - RNA, 38 nt, Artificial Sequence
  Description of Artificial Sequence:  Enzymatic Nucleic Acid
aaaucacacugaugaggccguuaggccgaaaucuucac

SEQ ID NO: 9956 - RNA, 38 nt, Artificial Sequence
  Description of Artificial Sequence:  Enzymatic Nucleic Acid
aaaaucaccugaugaggccguuaggccgaaaaucuuca

SEQ ID NO: 9957 - RNA, 38 nt, Artificial Sequence
  Description of Artificial Sequence:  Enzymatic Nucleic Acid
aaggccaacugaugaggccguuaggccgaaaucacaaa

SEQ ID NO: 9958 - RNA, 38 nt, Artificial Sequence
  Description of Artificial Sequence:  Enzymatic Nucleic Acid
caaggccacugaugaggccguuaggccgaaaaucacaa

SEQ ID NO: 9959 - RNA, 38 nt, Artificial Sequence
  Description of Artificial Sequence:  Enzymatic Nucleic Acid
gcaaggcccugaugaggccguuaggccgaaaaaucaca

SEQ ID NO: 9960 - RNA, 38 nt, Artificial Sequence
  Description of Artificial Sequence:  Enzymatic Nucleic Acid
ucccgggccugaugaggccguuaggccgaaaggccaaa

SEQ ID NO: 9961 - RNA, 38 nt, Artificial Sequence
  Description of Artificial Sequence:  Enzymatic Nucleic Acid
cuuauaaacugaugaggccguuaggccgaaaucccggg

SEQ ID NO: 9962 - RNA, 38 nt, Artificial Sequence
  Description of Artificial Sequence:  Enzymatic Nucleic Acid
uucuuauacugaugaggccguuaggccgaaauaucccg

SEQ ID NO: 9963 - RNA, 38 nt, Artificial Sequence
  Description of Artificial Sequence:  Enzymatic Nucleic Acid
guucuuaucugaugaggccguuaggccgaaaauauccc

SEQ ID NO: 9964 - RNA, 38 nt, Artificial Sequence
  Description of Artificial Sequence:  Enzymatic Nucleic Acid
gguucuuacugaugaggccguuaggccgaaaaauaucc

SEQ ID NO: 9965 - RNA, 38 nt, Artificial Sequence
  Description of Artificial Sequence:  Enzymatic Nucleic Acid
gggguucucugaugaggccguuaggccgaaauaaauau

SEQ ID NO: 9966 - RNA, 38 nt, Artificial Sequence
  Description of Artificial Sequence:  Enzymatic Nucleic Acid
ucucacaucugaugaggccguuaggccgaaaucggggu

SEQ ID NO: 9967 - RNA, 38 nt, Artificial Sequence
  Description of Artificial Sequence:  Enzymatic Nucleic Acid
uucucacacugaugaggccguuaggccgaaaaucgggg

SEQ ID NO: 9968 - RNA, 38 nt, Artificial Sequence
  Description of Artificial Sequence:  Enzymatic Nucleic Acid
aagucgagcugaugaggccguuaggccgaaaucuccuu

SEQ ID NO: 9969 - RNA, 38 nt, Artificial Sequence
  Description of Artificial Sequence:  Enzymatic Nucleic Acid
aggaaguccugaugaggccguuaggccgaaaguaucuc

SEQ ID NO: 9970 - RNA, 38 nt, Artificial Sequence
  Description of Artificial Sequence:  Enzymatic Nucleic Acid
uucagaggcugaugaggccguuaggccgaaagucgagu

SEQ ID NO: 9971 - RNA, 38 nt, Artificial Sequence
  Description of Artificial Sequence:  Enzymatic Nucleic Acid
uuucagagcugaugaggccguuaggccgaaaagucgag

SEQ ID NO: 9972 - RNA, 38 nt, Artificial Sequence
  Description of Artificial Sequence:  Enzymatic Nucleic Acid
ccauuucacugaugaggccguuaggccgaaaggaaguc

SEQ ID NO: 9973 - RNA, 38 nt, Artificial Sequence
  Description of Artificial Sequence:  Enzymatic Nucleic Acid
agauucggcugaugaggccguuaggccgaaagccaucc

SEQ ID NO: 9974 - RNA, 38 nt, Artificial Sequence
  Description of Artificial Sequence:  Enzymatic Nucleic Acid
caaagauacugaugaggccguuaggccgaaauucggga

SEQ ID NO: 9975 - RNA, 38 nt, Artificial Sequence
  Description of Artificial Sequence:  Enzymatic Nucleic Acid
gucaaagacugaugaggccguuaggccgaaagauucgg

SEQ ID NO: 9976 - RNA, 38 nt, Artificial Sequence
  Description of Artificial Sequence:  Enzymatic Nucleic Acid
uugucaaacugaugaggccguuaggccgaaauagauuc

SEQ ID NO: 9977 - RNA, 38 nt, Artificial Sequence
  Description of Artificial Sequence:  Enzymatic Nucleic Acid
uuuugucacugaugaggccguuaggccgaaagauagau

SEQ ID NO: 9978 - RNA, 38 nt, Artificial Sequence
  Description of Artificial Sequence:  Enzymatic Nucleic Acid
auuuuguccugaugaggccguuaggccgaaaagauaga

SEQ ID NO: 9979 - RNA, 38 nt, Artificial Sequence
  Description of Artificial Sequence:  Enzymatic Nucleic Acid
gugcuguacugaugaggccguuaggccgaaauuuuguc

SEQ ID NO: 9980 - RNA, 38 nt, Artificial Sequence
  Description of Artificial Sequence:  Enzymatic Nucleic Acid
uggugcugcugaugaggccguuaggccgaaagauuuug

SEQ ID NO: 9981 - RNA, 38 nt, Artificial Sequence
  Description of Artificial Sequence:  Enzymatic Nucleic Acid
cuccguaacugaugaggccguuaggccgaaaccacacg

SEQ ID NO: 9982 - RNA, 38 nt, Artificial Sequence
  Description of Artificial Sequence:  Enzymatic Nucleic Acid
uacuccgucugaugaggccguuaggccgaaagaccaca

SEQ ID NO: 9983 - RNA, 38 nt, Artificial Sequence
  Description of Artificial Sequence:  Enzymatic Nucleic Acid
auacuccgcugaugaggccguuaggccgaaaagaccac

SEQ ID NO: 9984 - RNA, 38 nt, Artificial Sequence
  Description of Artificial Sequence:  Enzymatic Nucleic Acid
cacagcaacugaugaggccguuaggccgaaacuccgua

SEQ ID NO: 9985 - RNA, 38 nt, Artificial Sequence
  Description of Artificial Sequence:  Enzymatic Nucleic Acid
cccacagccugaugaggccguuaggccgaaauacuccg

SEQ ID NO: 9986 - RNA, 38 nt, Artificial Sequence
  Description of Artificial Sequence:  Enzymatic Nucleic Acid
aaggagaacugaugaggccguuaggccgaaauuuccca

SEQ ID NO: 9987 - RNA, 38 nt, Artificial Sequence
  Description of Artificial Sequence:  Enzymatic Nucleic Acid
cuaaggagcugaugaggccguuaggccgaaagauuucc

SEQ ID NO: 9988 - RNA, 38 nt, Artificial Sequence
  Description of Artificial Sequence:  Enzymatic Nucleic Acid
ccuaaggacugaugaggccguuaggccgaaaagauuuc

SEQ ID NO: 9989 - RNA, 38 nt, Artificial Sequence
  Description of Artificial Sequence:  Enzymatic Nucleic Acid
caccuaagcugaugaggccguuaggccgaaagaagauu

SEQ ID NO: 9990 - RNA, 38 nt, Artificial Sequence
  Description of Artificial Sequence:  Enzymatic Nucleic Acid
acccaccucugaugaggccguuaggccgaaaggagaag

SEQ ID NO: 9991 - RNA, 38 nt, Artificial Sequence
  Description of Artificial Sequence:  Enzymatic Nucleic Acid
gacccacccugaugaggccguuaggccgaaaaggagaa

SEQ ID NO: 9992 - RNA, 38 nt, Artificial Sequence
  Description of Artificial Sequence:  Enzymatic Nucleic Acid
gguauggacugaugaggccguuaggccgaaacccaccu

SEQ ID NO: 9993 - RNA, 38 nt, Artificial Sequence
  Description of Artificial Sequence:  Enzymatic Nucleic Acid
uggguaugcugaugaggccguuaggccgaaagacccac

SEQ ID NO: 9994 - RNA, 38 nt, Artificial Sequence
  Description of Artificial Sequence:  Enzymatic Nucleic Acid
cuccugggcugaugaggccguuaggccgaaauggagac

SEQ ID NO: 9995 - RNA, 38 nt, Artificial Sequence
  Description of Artificial Sequence:  Enzymatic Nucleic Acid
uccauuugcugaugaggccguuaggccgaaacuccugg

SEQ ID NO: 9996 - RNA, 38 nt, Artificial Sequence
  Description of Artificial Sequence:  Enzymatic Nucleic Acid
gacugcaacugaugaggccguuaggccgaaaguccuca

SEQ ID NO: 9997 - RNA, 38 nt, Artificial Sequence
  Description of Artificial Sequence:  Enzymatic Nucleic Acid
cgacugcacugaugaggccguuaggccgaaaaguccuc

SEQ ID NO: 9998 - RNA, 38 nt, Artificial Sequence
  Description of Artificial Sequence:  Enzymatic Nucleic Acid
gcgacugccugaugaggccguuaggccgaaaaaguccu

SEQ ID NO: 9999 - RNA, 38 nt, Artificial Sequence
  Description of Artificial Sequence:  Enzymatic Nucleic Acid
ccucaggccugaugaggccguuaggccgaaacugcaaa

SEQ ID NO: 10000 - RNA, 38 nt, Artificial Sequence
  Description of Artificial Sequence:  Enzymatic Nucleic Acid
guacucagcugaugaggccguuaggccgaaagcucuca

SEQ ID NO: 10001 - RNA, 38 nt, Artificial Sequence
  Description of Artificial Sequence:  Enzymatic Nucleic Acid
gaguagagcugaugaggccguuaggccgaaacucagga

SEQ ID NO: 10002 - RNA, 38 nt, Artificial Sequence
  Description of Artificial Sequence:  Enzymatic Nucleic Acid
caggaguacugaugaggccguuaggccgaaaguacuca

SEQ ID NO: 10003 - RNA, 38 nt, Artificial Sequence
  Description of Artificial Sequence:  Enzymatic Nucleic Acid
uucaggagcugaugaggccguuaggccgaaagaguacu

SEQ ID NO: 10004 - RNA, 38 nt, Artificial Sequence
  Description of Artificial Sequence:  Enzymatic Nucleic Acid
gauuucagcugaugaggccguuaggccgaaaguagagu

SEQ ID NO: 10005 - RNA, 38 nt, Artificial Sequence
  Description of Artificial Sequence:  Enzymatic Nucleic Acid
aucugauacugaugaggccguuaggccgaaauuucagg

SEQ ID NO: 10006 - RNA, 38 nt, Artificial Sequence
  Description of Artificial Sequence:  Enzymatic Nucleic Acid
ugaucugacugaugaggccguuaggccgaaagauuuca

SEQ ID NO: 10007 - RNA, 38 nt, Artificial Sequence
  Description of Artificial Sequence:  Enzymatic Nucleic Acid
caugaucucugaugaggccguuaggccgaaauagauuu

SEQ ID NO: 10008 - RNA, 38 nt, Artificial Sequence
  Description of Artificial Sequence:  Enzymatic Nucleic Acid
uccagcaucugaugaggccguuaggccgaaaucugaua

SEQ ID NO: 10009 - RNA, 38 nt, Artificial Sequence
  Description of Artificial Sequence:  Enzymatic Nucleic Acid
guucugcacugaugaggccguuaggccgaaaucuuggc

SEQ ID NO: 10010 - RNA, 38 nt, Artificial Sequence
  Description of Artificial Sequence:  Enzymatic Nucleic Acid
aguucugccugaugaggccguuaggccgaaaaucuugg

SEQ ID NO: 10011 - RNA, 38 nt, Artificial Sequence
  Description of Artificial Sequence:  Enzymatic Nucleic Acid
uuuuccaccugaugaggccguuaggccgaaaguucugc

SEQ ID NO: 10012 - RNA, 38 nt, Artificial Sequence
  Description of Artificial Sequence:  Enzymatic Nucleic Acid
aaaucacccugaugaggccguuaggccgaaaguuuuuc

SEQ ID NO: 10013 - RNA, 38 nt, Artificial Sequence
  Description of Artificial Sequence:  Enzymatic Nucleic Acid
uugaagcacugaugaggccguuaggccgaaaucaccua

SEQ ID NO: 10014 - RNA, 38 nt, Artificial Sequence
  Description of Artificial Sequence:  Enzymatic Nucleic Acid
cuugaagccugaugaggccguuaggccgaaaaucaccu

SEQ ID NO: 10015 - RNA, 38 nt, Artificial Sequence
  Description of Artificial Sequence:  Enzymatic Nucleic Acid
uuugcuugcugaugaggccguuaggccgaaagcaaauc

SEQ ID NO: 10016 - RNA, 38 nt, Artificial Sequence
  Description of Artificial Sequence:  Enzymatic Nucleic Acid
auuugcuucugaugaggccguuaggccgaaaagcaaau

SEQ ID NO: 10017 - RNA, 38 nt, Artificial Sequence
  Description of Artificial Sequence:  Enzymatic Nucleic Acid
uccuguugcugaugaggccguuaggccgaaacauuugc

SEQ ID NO: 10018 - RNA, 38 nt, Artificial Sequence
  Description of Artificial Sequence:  Enzymatic Nucleic Acid
guagucuucugaugaggccguuaggccgaaaccauccu

SEQ ID NO: 10019 - RNA, 38 nt, Artificial Sequence
  Description of Artificial Sequence:  Enzymatic Nucleic Acid
uugggaugcugaugaggccguuaggccgaaagucuuua

SEQ ID NO: 10020 - RNA, 38 nt, Artificial Sequence
  Description of Artificial Sequence:  Enzymatic Nucleic Acid
uugauuggcugaugaggccguuaggccgaaauguaguc

SEQ ID NO: 10021 - RNA, 38 nt, Artificial Sequence
  Description of Artificial Sequence:  Enzymatic Nucleic Acid
auggcauucugaugaggccguuaggccgaaauugggau

SEQ ID NO: 10022 - RNA, 38 nt, Artificial Sequence
  Description of Artificial Sequence:  Enzymatic Nucleic Acid
ccugucagcugaugaggccguuaggccgaaauggcauu

SEQ ID NO: 10023 - RNA, 38 nt, Artificial Sequence
  Description of Artificial Sequence:  Enzymatic Nucleic Acid
aaacccaccugaugaggccguuaggccgaaauuuccug

SEQ ID NO: 10024 - RNA, 38 nt, Artificial Sequence
  Description of Artificial Sequence:  Enzymatic Nucleic Acid
aguauguacugaugaggccguuaggccgaaacccacua

SEQ ID NO: 10025 - RNA, 38 nt, Artificial Sequence
  Description of Artificial Sequence:  Enzymatic Nucleic Acid
gaguaugucugaugaggccguuaggccgaaaacccacu

SEQ ID NO: 10026 - RNA, 38 nt, Artificial Sequence
  Description of Artificial Sequence:  Enzymatic Nucleic Acid
ugaguaugcugaugaggccguuaggccgaaaaacccac

SEQ ID NO: 10027 - RNA, 38 nt, Artificial Sequence
  Description of Artificial Sequence:  Enzymatic Nucleic Acid
gaguugagcugaugaggccguuaggccgaaauguaaac

SEQ ID NO: 10028 - RNA, 38 nt, Artificial Sequence
  Description of Artificial Sequence:  Enzymatic Nucleic Acid
caggaguucugaugaggccguuaggccgaaaguaugua

SEQ ID NO: 10029 - RNA, 38 nt, Artificial Sequence
  Description of Artificial Sequence:  Enzymatic Nucleic Acid
gaaggcagcugaugaggccguuaggccgaaaguugagu

SEQ ID NO: 10030 - RNA, 38 nt, Artificial Sequence
  Description of Artificial Sequence:  Enzymatic Nucleic Acid
ccucagagcugaugaggccguuaggccgaaaggcagga

SEQ ID NO: 10031 - RNA, 38 nt, Artificial Sequence
  Description of Artificial Sequence:  Enzymatic Nucleic Acid
uccucagacugaugaggccguuaggccgaaaaggcagg

SEQ ID NO: 10032 - RNA, 38 nt, Artificial Sequence
  Description of Artificial Sequence:  Enzymatic Nucleic Acid
aguccucacugaugaggccguuaggccgaaagaaggca

SEQ ID NO: 10033 - RNA, 38 nt, Artificial Sequence
  Description of Artificial Sequence:  Enzymatic Nucleic Acid
ccuugaagcugaugaggccguuaggccgaaaguccuca

SEQ ID NO: 10034 - RNA, 38 nt, Artificial Sequence
  Description of Artificial Sequence:  Enzymatic Nucleic Acid
uccuugaacugaugaggccguuaggccgaaaaguccuc

SEQ ID NO: 10035 - RNA, 38 nt, Artificial Sequence
  Description of Artificial Sequence:  Enzymatic Nucleic Acid
uuuccuugcugaugaggccguuaggccgaaagaagucc

SEQ ID NO: 10036 - RNA, 38 nt, Artificial Sequence
  Description of Artificial Sequence:  Enzymatic Nucleic Acid
cuuuccuucugaugaggccguuaggccgaaaagaaguc

SEQ ID NO: 10037 - RNA, 38 nt, Artificial Sequence
  Description of Artificial Sequence:  Enzymatic Nucleic Acid
agcugaaacugaugaggccguuaggccgaaacuuuccu

SEQ ID NO: 10038 - RNA, 38 nt, Artificial Sequence
  Description of Artificial Sequence:  Enzymatic Nucleic Acid
ggagcugacugaugaggccguuaggccgaaauacuuuc

SEQ ID NO: 10039 - RNA, 38 nt, Artificial Sequence
  Description of Artificial Sequence:  Enzymatic Nucleic Acid
cggagcugcugaugaggccguuaggccgaaaauacuuu

SEQ ID NO: 10040 - RNA, 38 nt, Artificial Sequence
  Description of Artificial Sequence:  Enzymatic Nucleic Acid
ucggagcucugaugaggccguuaggccgaaaaauacuu

SEQ ID NO: 10041 - RNA, 38 nt, Artificial Sequence
  Description of Artificial Sequence:  Enzymatic Nucleic Acid
aaacuucgcugaugaggccguuaggccgaaagcugaaa

SEQ ID NO: 10042 - RNA, 38 nt, Artificial Sequence
  Description of Artificial Sequence:  Enzymatic Nucleic Acid
cugaauuacugaugaggccguuaggccgaaacuucgga

SEQ ID NO: 10043 - RNA, 38 nt, Artificial Sequence
  Description of Artificial Sequence:  Enzymatic Nucleic Acid
ccugaauucugaugaggccguuaggccgaaaacuucgg

SEQ ID NO: 10044 - RNA, 38 nt, Artificial Sequence
  Description of Artificial Sequence:  Enzymatic Nucleic Acid
uccugaaucugaugaggccguuaggccgaaaaacuucg

SEQ ID NO: 10045 - RNA, 38 nt, Artificial Sequence
  Description of Artificial Sequence:  Enzymatic Nucleic Acid
gcuuccugcugaugaggccguuaggccgaaauuaaacu

SEQ ID NO: 10046 - RNA, 38 nt, Artificial Sequence
  Description of Artificial Sequence:  Enzymatic Nucleic Acid
agcuuccucugaugaggccguuaggccgaaaauuaaac

SEQ ID NO: 10047 - RNA, 38 nt, Artificial Sequence
  Description of Artificial Sequence:  Enzymatic Nucleic Acid
caucaucacugaugaggccguuaggccgaaagcuuccu

SEQ ID NO: 10048 - RNA, 38 nt, Artificial Sequence
  Description of Artificial Sequence:  Enzymatic Nucleic Acid
acauaucucugaugaggccguuaggccgaaacaucauc

SEQ ID NO: 10049 - RNA, 38 nt, Artificial Sequence
  Description of Artificial Sequence:  Enzymatic Nucleic Acid
cauuuacacugaugaggccguuaggccgaaaucugaca

SEQ ID NO: 10050 - RNA, 38 nt, Artificial Sequence
  Description of Artificial Sequence:  Enzymatic Nucleic Acid
aaagcauucugaugaggccguuaggccgaaacauaucu

SEQ ID NO: 10051 - RNA, 38 nt, Artificial Sequence
  Description of Artificial Sequence:  Enzymatic Nucleic Acid
gaacuugacugaugaggccguuaggccgaaagcauuua

SEQ ID NO: 10052 - RNA, 38 nt, Artificial Sequence
  Description of Artificial Sequence:  Enzymatic Nucleic Acid
ugaacuugcugaugaggccguuaggccgaaaagcauuu

SEQ ID NO: 10053 - RNA, 38 nt, Artificial Sequence
  Description of Artificial Sequence:  Enzymatic Nucleic Acid
augaacuucugaugaggccguuaggccgaaaaagcauu

SEQ ID NO: 10054 - RNA, 38 nt, Artificial Sequence
  Description of Artificial Sequence:  Enzymatic Nucleic Acid
ggcucaugcugaugaggccguuaggccgaaacuugaaa

SEQ ID NO: 10055 - RNA, 38 nt, Artificial Sequence
  Description of Artificial Sequence:  Enzymatic Nucleic Acid
aggcucaucugaugaggccguuaggccgaaaacuugaa

SEQ ID NO: 10056 - RNA, 38 nt, Artificial Sequence
  Description of Artificial Sequence:  Enzymatic Nucleic Acid
aagguuuucugaugaggccguuaggccgaaauucuuuc

SEQ ID NO: 10057 - RNA, 38 nt, Artificial Sequence
  Description of Artificial Sequence:  Enzymatic Nucleic Acid
guucuucacugaugaggccguuaggccgaaagguuuug

SEQ ID NO: 10058 - RNA, 38 nt, Artificial Sequence
  Description of Artificial Sequence:  Enzymatic Nucleic Acid
aguucuuccugaugaggccguuaggccgaaaagguuuu

SEQ ID NO: 10059 - RNA, 38 nt, Artificial Sequence
  Description of Artificial Sequence:  Enzymatic Nucleic Acid
uucgguaacugaugaggccguuaggccgaaaguucuuc

SEQ ID NO: 10060 - RNA, 38 nt, Artificial Sequence
  Description of Artificial Sequence:  Enzymatic Nucleic Acid
auucgguacugaugaggccguuaggccgaaaaguucuu

SEQ ID NO: 10061 - RNA, 38 nt, Artificial Sequence
  Description of Artificial Sequence:  Enzymatic Nucleic Acid
cauucggucugaugaggccguuaggccgaaaaaguucu

SEQ ID NO: 10062 - RNA, 38 nt, Artificial Sequence
  Description of Artificial Sequence:  Enzymatic Nucleic Acid
gcauucggcugaugaggccguuaggccgaaaaaaguuc

SEQ ID NO: 10063 - RNA, 38 nt, Artificial Sequence
  Description of Artificial Sequence:  Enzymatic Nucleic Acid
caaacaugcugaugaggccguuaggccgaaagguggca

SEQ ID NO: 10064 - RNA, 38 nt, Artificial Sequence
  Description of Artificial Sequence:  Enzymatic Nucleic Acid
agucaucacugaugaggccguuaggccgaaacauggag

SEQ ID NO: 10065 - RNA, 38 nt, Artificial Sequence
  Description of Artificial Sequence:  Enzymatic Nucleic Acid
uagucauccugaugaggccguuaggccgaaaacaugga

SEQ ID NO: 10066 - RNA, 38 nt, Artificial Sequence
  Description of Artificial Sequence:  Enzymatic Nucleic Acid
cgcccuggcugaugaggccguuaggccgaaagucauca

SEQ ID NO: 10067 - RNA, 38 nt, Artificial Sequence
  Description of Artificial Sequence:  Enzymatic Nucleic Acid
ggccaacacugaugaggccguuaggccgaaagugcugc

SEQ ID NO: 10068 - RNA, 38 nt, Artificial Sequence
  Description of Artificial Sequence:  Enzymatic Nucleic Acid
gagaggcccugaugaggccguuaggccgaaacagagug

SEQ ID NO: 10069 - RNA, 38 nt, Artificial Sequence
  Description of Artificial Sequence:  Enzymatic Nucleic Acid
gcaugggacugaugaggccguuaggccgaaaggccaac

SEQ ID NO: 10070 - RNA, 38 nt, Artificial Sequence
  Description of Artificial Sequence:  Enzymatic Nucleic Acid
cagcauggcugaugaggccguuaggccgaaagaggcca

SEQ ID NO: 10071 - RNA, 38 nt, Artificial Sequence
  Description of Artificial Sequence:  Enzymatic Nucleic Acid
uccaggugcugaugaggccguuaggccgaaagcgcuuc

SEQ ID NO: 10072 - RNA, 38 nt, Artificial Sequence
  Description of Artificial Sequence:  Enzymatic Nucleic Acid
guccaggucugaugaggccguuaggccgaaaagcgcuu

SEQ ID NO: 10073 - RNA, 38 nt, Artificial Sequence
  Description of Artificial Sequence:  Enzymatic Nucleic Acid
ucuugagccugaugaggccguuaggccgaaaggccuug

SEQ ID NO: 10074 - RNA, 38 nt, Artificial Sequence
  Description of Artificial Sequence:  Enzymatic Nucleic Acid
ucaaucuucugaugaggccguuaggccgaaagcgaggc

SEQ ID NO: 10075 - RNA, 38 nt, Artificial Sequence
  Description of Artificial Sequence:  Enzymatic Nucleic Acid
cucaaguccugaugaggccguuaggccgaaaucuugag

SEQ ID NO: 10076 - RNA, 38 nt, Artificial Sequence
  Description of Artificial Sequence:  Enzymatic Nucleic Acid
uuacucuccugaugaggccguuaggccgaaagucaauc

SEQ ID NO: 10077 - RNA, 38 nt, Artificial Sequence
  Description of Artificial Sequence:  Enzymatic Nucleic Acid
uuacuggucugaugaggccguuaggccgaaacucucaa

SEQ ID NO: 10078 - RNA, 38 nt, Artificial Sequence
  Description of Artificial Sequence:  Enzymatic Nucleic Acid
cuuacuuucugaugaggccguuaggccgaaacugguua

SEQ ID NO: 10079 - RNA, 38 nt, Artificial Sequence
  Description of Artificial Sequence:  Enzymatic Nucleic Acid
cgacuccucugaugaggccguuaggccgaaacuuuuac

SEQ ID NO: 10080 - RNA, 38 nt, Artificial Sequence
  Description of Artificial Sequence:  Enzymatic Nucleic Acid
acagcccccugaugaggccguuaggccgaaacuccuua

SEQ ID NO: 10081 - RNA, 38 nt, Artificial Sequence
  Description of Artificial Sequence:  Enzymatic Nucleic Acid
ugacaucacugaugaggccguuaggccgaaacagcccc

SEQ ID NO: 10082 - RNA, 38 nt, Artificial Sequence
  Description of Artificial Sequence:  Enzymatic Nucleic Acid
ggccugcucugaugaggccguuaggccgaaacaucaga

SEQ ID NO: 10083 - RNA, 38 nt, Artificial Sequence
  Description of Artificial Sequence:  Enzymatic Nucleic Acid
auggcagacugaugaggccguuaggccgaaacugggcc

SEQ ID NO: 10084 - RNA, 38 nt, Artificial Sequence
  Description of Artificial Sequence:  Enzymatic Nucleic Acid
aauggcagcugaugaggccguuaggccgaaaacugggc

SEQ ID NO: 10085 - RNA, 38 nt, Artificial Sequence
  Description of Artificial Sequence:  Enzymatic Nucleic Acid
gaauggcacugaugaggccguuaggccgaaaaacuggg

SEQ ID NO: 10086 - RNA, 38 nt, Artificial Sequence
  Description of Artificial Sequence:  Enzymatic Nucleic Acid
acagcuggcugaugaggccguuaggccgaaauggcaga

SEQ ID NO: 10087 - RNA, 38 nt, Artificial Sequence
  Description of Artificial Sequence:  Enzymatic Nucleic Acid
cacagcugcugaugaggccguuaggccgaaaauggcag

SEQ ID NO: 10088 - RNA, 38 nt, Artificial Sequence
  Description of Artificial Sequence:  Enzymatic Nucleic Acid
ccuucgcucugaugaggccguuaggccgaaacgugccc

SEQ ID NO: 10089 - RNA, 38 nt, Artificial Sequence
  Description of Artificial Sequence:  Enzymatic Nucleic Acid
cguaggugcugaugaggccguuaggccgaaaccugcgc

SEQ ID NO: 10090 - RNA, 38 nt, Artificial Sequence
  Description of Artificial Sequence:  Enzymatic Nucleic Acid
ucguaggucugaugaggccguuaggccgaaaaccugcg

SEQ ID NO: 10091 - RNA, 38 nt, Artificial Sequence
  Description of Artificial Sequence:  Enzymatic Nucleic Acid
cguggucgcugaugaggccguuaggccgaaaggugaac

SEQ ID NO: 10092 - RNA, 38 nt, Artificial Sequence
  Description of Artificial Sequence:  Enzymatic Nucleic Acid
cagcacgccugaugaggccguuaggccgaaauuuuccu

SEQ ID NO: 10093 - RNA, 38 nt, Artificial Sequence
  Description of Artificial Sequence:  Enzymatic Nucleic Acid
ggggcgggcugaugaggccguuaggccgaaagcagcac

SEQ ID NO: 10094 - RNA, 38 nt, Artificial Sequence
  Description of Artificial Sequence:  Enzymatic Nucleic Acid
ccgaguugcugaugaggccguuaggccgaaagucuggg

SEQ ID NO: 10095 - RNA, 38 nt, Artificial Sequence
  Description of Artificial Sequence:  Enzymatic Nucleic Acid
ggaccacccugaugaggccguuaggccgaaaguuguag

SEQ ID NO: 10096 - RNA, 38 nt, Artificial Sequence
  Description of Artificial Sequence:  Enzymatic Nucleic Acid
gaguacagcugaugaggccguuaggccgaaaccaccga

SEQ ID NO: 10097 - RNA, 38 nt, Artificial Sequence
  Description of Artificial Sequence:  Enzymatic Nucleic Acid
ggguggagcugaugaggccguuaggccgaaacaggacc

SEQ ID NO: 10098 - RNA, 38 nt, Artificial Sequence
  Description of Artificial Sequence:  Enzymatic Nucleic Acid
guggggugcugaugaggccguuaggccgaaaguacagg

SEQ ID NO: 10099 - RNA, 38 nt, Artificial Sequence
  Description of Artificial Sequence:  Enzymatic Nucleic Acid
aaacucuacugaugaggccguuaggccgaaaugggugg

SEQ ID NO: 10100 - RNA, 38 nt, Artificial Sequence
  Description of Artificial Sequence:  Enzymatic Nucleic Acid
ucaaacuccugaugaggccguuaggccgaaagaugggu

SEQ ID NO: 10101 - RNA, 38 nt, Artificial Sequence
  Description of Artificial Sequence:  Enzymatic Nucleic Acid
ucgugucacugaugaggccguuaggccgaaacucuaga

SEQ ID NO: 10102 - RNA, 38 nt, Artificial Sequence
  Description of Artificial Sequence:  Enzymatic Nucleic Acid
uucguguccugaugaggccguuaggccgaaaacucuag

SEQ ID NO: 10103 - RNA, 38 nt, Artificial Sequence
  Description of Artificial Sequence:  Enzymatic Nucleic Acid
cuagaaaucugaugaggccguuaggccgaaaggcuucg

SEQ ID NO: 10104 - RNA, 38 nt, Artificial Sequence
  Description of Artificial Sequence:  Enzymatic Nucleic Acid
ucuagaaacugaugaggccguuaggccgaaaaggcuuc

SEQ ID NO: 10105 - RNA, 38 nt, Artificial Sequence
  Description of Artificial Sequence:  Enzymatic Nucleic Acid
cuucuagacugaugaggccguuaggccgaaauaaggcu

SEQ ID NO: 10106 - RNA, 38 nt, Artificial Sequence
  Description of Artificial Sequence:  Enzymatic Nucleic Acid
gcuucuagcugaugaggccguuaggccgaaaauaaggc

SEQ ID NO: 10107 - RNA, 38 nt, Artificial Sequence
  Description of Artificial Sequence:  Enzymatic Nucleic Acid
ugcuucuacugaugaggccguuaggccgaaaaauaagg

SEQ ID NO: 10108 - RNA, 38 nt, Artificial Sequence
  Description of Artificial Sequence:  Enzymatic Nucleic Acid
ugugcuuccugaugaggccguuaggccgaaagaaauaa

SEQ ID NO: 10109 - RNA, 38 nt, Artificial Sequence
  Description of Artificial Sequence:  Enzymatic Nucleic Acid
gguauaaacugaugaggccguuaggccgaaacacaugu

SEQ ID NO: 10110 - RNA, 38 nt, Artificial Sequence
  Description of Artificial Sequence:  Enzymatic Nucleic Acid
gggguauacugaugaggccguuaggccgaaauacacau

SEQ ID NO: 10111 - RNA, 38 nt, Artificial Sequence
  Description of Artificial Sequence:  Enzymatic Nucleic Acid
ggggguaucugaugaggccguuaggccgaaaauacaca

SEQ ID NO: 10112 - RNA, 38 nt, Artificial Sequence
  Description of Artificial Sequence:  Enzymatic Nucleic Acid
uggggguacugaugaggccguuaggccgaaaaauacac

SEQ ID NO: 10113 - RNA, 38 nt, Artificial Sequence
  Description of Artificial Sequence:  Enzymatic Nucleic Acid
ccugggggcugaugaggccguuaggccgaaauaaauac

SEQ ID NO: 10114 - RNA, 38 nt, Artificial Sequence
  Description of Artificial Sequence:  Enzymatic Nucleic Acid
gcaaaagccugaugaggccguuaggccgaaaguuuccu

SEQ ID NO: 10115 - RNA, 38 nt, Artificial Sequence
  Description of Artificial Sequence:  Enzymatic Nucleic Acid
acuggcaacugaugaggccguuaggccgaaagcuaguu

SEQ ID NO: 10116 - RNA, 38 nt, Artificial Sequence
  Description of Artificial Sequence:  Enzymatic Nucleic Acid
uacuggcacugaugaggccguuaggccgaaaagcuagu

SEQ ID NO: 10117 - RNA, 38 nt, Artificial Sequence
  Description of Artificial Sequence:  Enzymatic Nucleic Acid
auacuggccugaugaggccguuaggccgaaaaagcuag

SEQ ID NO: 10118 - RNA, 38 nt, Artificial Sequence
  Description of Artificial Sequence:  Enzymatic Nucleic Acid
augcauaacugaugaggccguuaggccgaaacuggcaa

SEQ ID NO: 10119 - RNA, 38 nt, Artificial Sequence
  Description of Artificial Sequence:  Enzymatic Nucleic Acid
auaugcaucugaugaggccguuaggccgaaauacuggc

SEQ ID NO: 10120 - RNA, 38 nt, Artificial Sequence
  Description of Artificial Sequence:  Enzymatic Nucleic Acid
uauaugcacugaugaggccguuaggccgaaaauacugg

SEQ ID NO: 10121 - RNA, 38 nt, Artificial Sequence
  Description of Artificial Sequence:  Enzymatic Nucleic Acid
aacuuauacugaugaggccguuaggccgaaaugcauaa

SEQ ID NO: 10122 - RNA, 38 nt, Artificial Sequence
  Description of Artificial Sequence:  Enzymatic Nucleic Acid
uaaacuuacugaugaggccguuaggccgaaauaugcau

SEQ ID NO: 10123 - RNA, 38 nt, Artificial Sequence
  Description of Artificial Sequence:  Enzymatic Nucleic Acid
uguaaacucugaugaggccguuaggccgaaauauaugc

SEQ ID NO: 10124 - RNA, 38 nt, Artificial Sequence
  Description of Artificial Sequence:  Enzymatic Nucleic Acid
aagguguacugaugaggccguuaggccgaaacuuauau

SEQ ID NO: 10125 - RNA, 38 nt, Artificial Sequence
  Description of Artificial Sequence:  Enzymatic Nucleic Acid
aaaggugucugaugaggccguuaggccgaaaacuuaua

SEQ ID NO: 10126 - RNA, 38 nt, Artificial Sequence
  Description of Artificial Sequence:  Enzymatic Nucleic Acid
uaaaggugcugaugaggccguuaggccgaaaaacuuau

SEQ ID NO: 10127 - RNA, 38 nt, Artificial Sequence
  Description of Artificial Sequence:  Enzymatic Nucleic Acid
gaaagauacugaugaggccguuaggccgaaagguguaa

SEQ ID NO: 10128 - RNA, 38 nt, Artificial Sequence
  Description of Artificial Sequence:  Enzymatic Nucleic Acid
ggaaagaucugaugaggccguuaggccgaaaaggugua

SEQ ID NO: 10129 - RNA, 38 nt, Artificial Sequence
  Description of Artificial Sequence:  Enzymatic Nucleic Acid
uggaaagacugaugaggccguuaggccgaaaaaggugu

SEQ ID NO: 10130 - RNA, 38 nt, Artificial Sequence
  Description of Artificial Sequence:  Enzymatic Nucleic Acid
cauggaaacugaugaggccguuaggccgaaauaaaggu

SEQ ID NO: 10131 - RNA, 38 nt, Artificial Sequence
  Description of Artificial Sequence:  Enzymatic Nucleic Acid
cccauggacugaugaggccguuaggccgaaagauaaag

SEQ ID NO: 10132 - RNA, 38 nt, Artificial Sequence
  Description of Artificial Sequence:  Enzymatic Nucleic Acid
ucccauggcugaugaggccguuaggccgaaaagauaaa

SEQ ID NO: 10133 - RNA, 38 nt, Artificial Sequence
  Description of Artificial Sequence:  Enzymatic Nucleic Acid
cucccaugcugaugaggccguuaggccgaaaaagauaa

SEQ ID NO: 10134 - RNA, 38 nt, Artificial Sequence
  Description of Artificial Sequence:  Enzymatic Nucleic Acid
aucacaaacugaugaggccguuaggccgaaagcagcug

SEQ ID NO: 10135 - RNA, 38 nt, Artificial Sequence
  Description of Artificial Sequence:  Enzymatic Nucleic Acid
aaucacaacugaugaggccguuaggccgaaaagcagcu

SEQ ID NO: 10136 - RNA, 38 nt, Artificial Sequence
  Description of Artificial Sequence:  Enzymatic Nucleic Acid
aaaucacacugaugaggccguuaggccgaaaaagcagc

SEQ ID NO: 10137 - RNA, 38 nt, Artificial Sequence
  Description of Artificial Sequence:  Enzymatic Nucleic Acid
aaaaucaccugaugaggccguuaggccgaaaaaagcag

SEQ ID NO: 10138 - RNA, 38 nt, Artificial Sequence
  Description of Artificial Sequence:  Enzymatic Nucleic Acid
auuaaaaacugaugaggccguuaggccgaaaucacaaa

SEQ ID NO: 10139 - RNA, 38 nt, Artificial Sequence
  Description of Artificial Sequence:  Enzymatic Nucleic Acid
uauuaaaacugaugaggccguuaggccgaaaaucacaa

SEQ ID NO: 10140 - RNA, 38 nt, Artificial Sequence
  Description of Artificial Sequence:  Enzymatic Nucleic Acid
cuauuaaacugaugaggccguuaggccgaaaaaucaca

SEQ ID NO: 10141 - RNA, 38 nt, Artificial Sequence
  Description of Artificial Sequence:  Enzymatic Nucleic Acid
acuauuaacugaugaggccguuaggccgaaaaaaucac

SEQ ID NO: 10142 - RNA, 38 nt, Artificial Sequence
  Description of Artificial Sequence:  Enzymatic Nucleic Acid
cacuauuacugaugaggccguuaggccgaaaaaaauca

SEQ ID NO: 10143 - RNA, 38 nt, Artificial Sequence
  Description of Artificial Sequence:  Enzymatic Nucleic Acid
gcacuauucugaugaggccguuaggccgaaaaaaaauc

SEQ ID NO: 10144 - RNA, 38 nt, Artificial Sequence
  Description of Artificial Sequence:  Enzymatic Nucleic Acid
agcacuaucugaugaggccguuaggccgaaaaaaaaau

SEQ ID NO: 10145 - RNA, 38 nt, Artificial Sequence
  Description of Artificial Sequence:  Enzymatic Nucleic Acid
aaaagcaccugaugaggccguuaggccgaaauuaaaaa

SEQ ID NO: 10146 - RNA, 38 nt, Artificial Sequence
  Description of Artificial Sequence:  Enzymatic Nucleic Acid
aaaaaaaacugaugaggccguuaggccgaaagcacuau

SEQ ID NO: 10147 - RNA, 38 nt, Artificial Sequence
  Description of Artificial Sequence:  Enzymatic Nucleic Acid
aaaaaaaacugaugaggccguuaggccgaaaagcacua

SEQ ID NO: 10148 - RNA, 38 nt, Artificial Sequence
  Description of Artificial Sequence:  Enzymatic Nucleic Acid
caaaaaaacugaugaggccguuaggccgaaaaagcacu

SEQ ID NO: 10149 - RNA, 38 nt, Artificial Sequence
  Description of Artificial Sequence:  Enzymatic Nucleic Acid
ucaaaaaacugaugaggccguuaggccgaaaaaagcac

SEQ ID NO: 10150 - RNA, 38 nt, Artificial Sequence
  Description of Artificial Sequence:  Enzymatic Nucleic Acid
gucaaaaacugaugaggccguuaggccgaaaaaaagca

SEQ ID NO: 10151 - RNA, 38 nt, Artificial Sequence
  Description of Artificial Sequence:  Enzymatic Nucleic Acid
agucaaaacugaugaggccguuaggccgaaaaaaaagc

SEQ ID NO: 10152 - RNA, 38 nt, Artificial Sequence
  Description of Artificial Sequence:  Enzymatic Nucleic Acid
uagucaaacugaugaggccguuaggccgaaaaaaaaag

SEQ ID NO: 10153 - RNA, 38 nt, Artificial Sequence
  Description of Artificial Sequence:  Enzymatic Nucleic Acid
uuagucaacugaugaggccguuaggccgaaaaaaaaaa

SEQ ID NO: 10154 - RNA, 38 nt, Artificial Sequence
  Description of Artificial Sequence:  Enzymatic Nucleic Acid
guuagucacugaugaggccguuaggccgaaaaaaaaaa

SEQ ID NO: 10155 - RNA, 38 nt, Artificial Sequence
  Description of Artificial Sequence:  Enzymatic Nucleic Acid
uguuaguccugaugaggccguuaggccgaaaaaaaaaa

SEQ ID NO: 10156 - RNA, 38 nt, Artificial Sequence
  Description of Artificial Sequence:  Enzymatic Nucleic Acid
auucuugucugaugaggccguuaggccgaaagucaaaa

SEQ ID NO: 10157 - RNA, 38 nt, Artificial Sequence
  Description of Artificial Sequence:  Enzymatic Nucleic Acid
ucuggagucugaugaggccguuaggccgaaacauucuu

SEQ ID NO: 10158 - RNA, 38 nt, Artificial Sequence
  Description of Artificial Sequence:  Enzymatic Nucleic Acid
ucuaucugcugaugaggccguuaggccgaaaguuacau

SEQ ID NO: 10159 - RNA, 38 nt, Artificial Sequence
  Description of Artificial Sequence:  Enzymatic Nucleic Acid
uauuucuccugaugaggccguuaggccgaaaucuggag

SEQ ID NO: 10160 - RNA, 38 nt, Artificial Sequence
  Description of Artificial Sequence:  Enzymatic Nucleic Acid
cuugucaccugaugaggccguuaggccgaaauuucucu

SEQ ID NO: 10161 - RNA, 38 nt, Artificial Sequence
  Description of Artificial Sequence:  Enzymatic Nucleic Acid
uuuagcagcugaugaggccguuaggccgaaaguguucu

SEQ ID NO: 10162 - RNA, 38 nt, Artificial Sequence
  Description of Artificial Sequence:  Enzymatic Nucleic Acid
ugaggauucugaugaggccguuaggccgaaagcaguag

SEQ ID NO: 10163 - RNA, 38 nt, Artificial Sequence
  Description of Artificial Sequence:  Enzymatic Nucleic Acid
aacaugagcugaugaggccguuaggccgaaauuuagca

SEQ ID NO: 10164 - RNA, 38 nt, Artificial Sequence
  Description of Artificial Sequence:  Enzymatic Nucleic Acid
aguaacaucugaugaggccguuaggccgaaaggauuua

SEQ ID NO: 10165 - RNA, 38 nt, Artificial Sequence
  Description of Artificial Sequence:  Enzymatic Nucleic Acid
cacugagucugaugaggccguuaggccgaaacaugagg

SEQ ID NO: 10166 - RNA, 38 nt, Artificial Sequence
  Description of Artificial Sequence:  Enzymatic Nucleic Acid
acacugagcugaugaggccguuaggccgaaaacaugag

SEQ ID NO: 10167 - RNA, 38 nt, Artificial Sequence
  Description of Artificial Sequence:  Enzymatic Nucleic Acid
cuaacacucugaugaggccguuaggccgaaaguaacau

SEQ ID NO: 10168 - RNA, 38 nt, Artificial Sequence
  Description of Artificial Sequence:  Enzymatic Nucleic Acid
auuucucucugaugaggccguuaggccgaaacacugag

SEQ ID NO: 10169 - RNA, 38 nt, Artificial Sequence
  Description of Artificial Sequence:  Enzymatic Nucleic Acid
gauuucuccugaugaggccguuaggccgaaaacacuga

SEQ ID NO: 10170 - RNA, 38 nt, Artificial Sequence
  Description of Artificial Sequence:  Enzymatic Nucleic Acid
uuaggaagcugaugaggccguuaggccgaaauuucucu

SEQ ID NO: 10171 - RNA, 38 nt, Artificial Sequence
  Description of Artificial Sequence:  Enzymatic Nucleic Acid
gguuuaggcugaugaggccguuaggccgaaaggauuuc

SEQ ID NO: 10172 - RNA, 38 nt, Artificial Sequence
  Description of Artificial Sequence:  Enzymatic Nucleic Acid
ggguuuagcugaugaggccguuaggccgaaaaggauuu

SEQ ID NO: 10173 - RNA, 38 nt, Artificial Sequence
  Description of Artificial Sequence:  Enzymatic Nucleic Acid
auuggguucugaugaggccguuaggccgaaaggaagga

SEQ ID NO: 10174 - RNA, 38 nt, Artificial Sequence
  Description of Artificial Sequence:  Enzymatic Nucleic Acid
gagcagggcugaugaggccguuaggccgaaagucauug

SEQ ID NO: 10175 - RNA, 38 nt, Artificial Sequence
  Description of Artificial Sequence:  Enzymatic Nucleic Acid
ggagcaggcugaugaggccguuaggccgaaaagucauu

SEQ ID NO: 10176 - RNA, 38 nt, Artificial Sequence
  Description of Artificial Sequence:  Enzymatic Nucleic Acid
ggggguugcugaugaggccguuaggccgaaagcaggga

SEQ ID NO: 10177 - RNA, 38 nt, Artificial Sequence
  Description of Artificial Sequence:  Enzymatic Nucleic Acid
cgugcccucugaugaggccguuaggccgaaagguggcg

SEQ ID NO: 10178 - RNA, 38 nt, Artificial Sequence
  Description of Artificial Sequence:  Enzymatic Nucleic Acid
cucaaucacugaugaggccguuaggccgaaacuggucc

SEQ ID NO: 10179 - RNA, 38 nt, Artificial Sequence
  Description of Artificial Sequence:  Enzymatic Nucleic Acid
ccucaauccugaugaggccguuaggccgaaaacugguc

SEQ ID NO: 10180 - RNA, 38 nt, Artificial Sequence
  Description of Artificial Sequence:  Enzymatic Nucleic Acid
agcuccuccugaugaggccguuaggccgaaaucaaacu

SEQ ID NO: 10181 - RNA, 38 nt, Artificial Sequence
  Description of Artificial Sequence:  Enzymatic Nucleic Acid
cauugggucugaugaggccguuaggccgaaaucagugc

SEQ ID NO: 10182 - RNA, 38 nt, Artificial Sequence
  Description of Artificial Sequence:  Enzymatic Nucleic Acid
ggguacgucugaugaggccguuaggccgaaaugcauug

SEQ ID NO: 10183 - RNA, 38 nt, Artificial Sequence
  Description of Artificial Sequence:  Enzymatic Nucleic Acid
caguggggcugaugaggccguuaggccgaaacgugaug

SEQ ID NO: 10184 - RNA, 38 nt, Artificial Sequence
  Description of Artificial Sequence:  Enzymatic Nucleic Acid
cuggggcucugaugaggccguuaggccgaaacgggcuu

SEQ ID NO: 10185 - RNA, 38 nt, Artificial Sequence
  Description of Artificial Sequence:  Enzymatic Nucleic Acid
ccuggggccugaugaggccguuaggccgaaaacgggcu

SEQ ID NO: 10186 - RNA, 38 nt, Artificial Sequence
  Description of Artificial Sequence:  Enzymatic Nucleic Acid
cagccagucugaugaggccguuaggccgaaauccccug

SEQ ID NO: 10187 - RNA, 38 nt, Artificial Sequence
  Description of Artificial Sequence:  Enzymatic Nucleic Acid
acucccgacugaugaggccguuaggccgaaauguugcu

SEQ ID NO: 10188 - RNA, 38 nt, Artificial Sequence
  Description of Artificial Sequence:  Enzymatic Nucleic Acid
ggacuccccugaugaggccguuaggccgaaagauguug

SEQ ID NO: 10189 - RNA, 38 nt, Artificial Sequence
  Description of Artificial Sequence:  Enzymatic Nucleic Acid
ugcuagagcugaugaggccguuaggccgaaacucccga

SEQ ID NO: 10190 - RNA, 38 nt, Artificial Sequence
  Description of Artificial Sequence:  Enzymatic Nucleic Acid
gccugcuacugaugaggccguuaggccgaaaggacucc

SEQ ID NO: 10191 - RNA, 38 nt, Artificial Sequence
  Description of Artificial Sequence:  Enzymatic Nucleic Acid
aggccugccugaugaggccguuaggccgaaagaggacu

SEQ ID NO: 10192 - RNA, 38 nt, Artificial Sequence
  Description of Artificial Sequence:  Enzymatic Nucleic Acid
acaugucucugaugaggccguuaggccgaaaggccugc

SEQ ID NO: 10193 - RNA, 38 nt, Artificial Sequence
  Description of Artificial Sequence:  Enzymatic Nucleic Acid
gcgucucacugaugaggccguuaggccgaaauucuuuc

SEQ ID NO: 10194 - RNA, 38 nt, Artificial Sequence
  Description of Artificial Sequence:  Enzymatic Nucleic Acid
ugcgucuccugaugaggccguuaggccgaaaauucuuu

SEQ ID NO: 10195 - RNA, 38 nt, Artificial Sequence
  Description of Artificial Sequence:  Enzymatic Nucleic Acid
gcauugcucugaugaggccguuaggccgaaagccccgu

SEQ ID NO: 10196 - RNA, 38 nt, Artificial Sequence
  Description of Artificial Sequence:  Enzymatic Nucleic Acid
gccacugacugaugaggccguuaggccgaaauggcauu

SEQ ID NO: 10197 - RNA, 38 nt, Artificial Sequence
  Description of Artificial Sequence:  Enzymatic Nucleic Acid
agccacugcugaugaggccguuaggccgaaaauggcau

SEQ ID NO: 10198 - RNA, 38 nt, Artificial Sequence
  Description of Artificial Sequence:  Enzymatic Nucleic Acid
aagccacucugaugaggccguuaggccgaaaaauggca

SEQ ID NO: 10199 - RNA, 38 nt, Artificial Sequence
  Description of Artificial Sequence:  Enzymatic Nucleic Acid
gagcugggcugaugaggccguuaggccgaaagccacug

SEQ ID NO: 10200 - RNA, 38 nt, Artificial Sequence
  Description of Artificial Sequence:  Enzymatic Nucleic Acid
agagcuggcugaugaggccguuaggccgaaaagccacu

SEQ ID NO: 10201 - RNA, 38 nt, Artificial Sequence
  Description of Artificial Sequence:  Enzymatic Nucleic Acid
aagggucacugaugaggccguuaggccgaaagcuggga

SEQ ID NO: 10202 - RNA, 38 nt, Artificial Sequence
  Description of Artificial Sequence:  Enzymatic Nucleic Acid
aaauguagcugaugaggccguuaggccgaaagggucag

SEQ ID NO: 10203 - RNA, 38 nt, Artificial Sequence
  Description of Artificial Sequence:  Enzymatic Nucleic Acid
caaauguacugaugaggccguuaggccgaaaaggguca

SEQ ID NO: 10204 - RNA, 38 nt, Artificial Sequence
  Description of Artificial Sequence:  Enzymatic Nucleic Acid
cucaaaugcugaugaggccguuaggccgaaagaagggu

SEQ ID NO: 10205 - RNA, 38 nt, Artificial Sequence
  Description of Artificial Sequence:  Enzymatic Nucleic Acid
ggcccucacugaugaggccguuaggccgaaauguagaa

SEQ ID NO: 10206 - RNA, 38 nt, Artificial Sequence
  Description of Artificial Sequence:  Enzymatic Nucleic Acid
gggcccuccugaugaggccguuaggccgaaaauguaga

SEQ ID NO: 10207 - RNA, 38 nt, Artificial Sequence
  Description of Artificial Sequence:  Enzymatic Nucleic Acid
auccagaacugaugaggccguuaggccgaaaugucccc

SEQ ID NO: 10208 - RNA, 38 nt, Artificial Sequence
  Description of Artificial Sequence:  Enzymatic Nucleic Acid
aauccagacugaugaggccguuaggccgaaaauguccc

SEQ ID NO: 10209 - RNA, 38 nt, Artificial Sequence
  Description of Artificial Sequence:  Enzymatic Nucleic Acid
gaauccagcugaugaggccguuaggccgaaaaaugucc

SEQ ID NO: 10210 - RNA, 38 nt, Artificial Sequence
  Description of Artificial Sequence:  Enzymatic Nucleic Acid
agaauccacugaugaggccguuaggccgaaaaaauguc

SEQ ID NO: 10211 - RNA, 38 nt, Artificial Sequence
  Description of Artificial Sequence:  Enzymatic Nucleic Acid
ccucccagcugaugaggccguuaggccgaaauccagaa

SEQ ID NO: 10212 - RNA, 38 nt, Artificial Sequence
  Description of Artificial Sequence:  Enzymatic Nucleic Acid
gccucccacugaugaggccguuaggccgaaaauccaga

SEQ ID NO: 10213 - RNA, 38 nt, Artificial Sequence
  Description of Artificial Sequence:  Enzymatic Nucleic Acid
aaaaaagacugaugaggccguuaggccgaaauuugucc

SEQ ID NO: 10214 - RNA, 38 nt, Artificial Sequence
  Description of Artificial Sequence:  Enzymatic Nucleic Acid
ccaaaaaacugaugaggccguuaggccgaaauauuugu

SEQ ID NO: 10215 - RNA, 38 nt, Artificial Sequence
  Description of Artificial Sequence:  Enzymatic Nucleic Acid
uuccaaaacugaugaggccguuaggccgaaagauauuu

SEQ ID NO: 10216 - RNA, 38 nt, Artificial Sequence
  Description of Artificial Sequence:  Enzymatic Nucleic Acid
guuccaaacugaugaggccguuaggccgaaaagauauu

SEQ ID NO: 10217 - RNA, 38 nt, Artificial Sequence
  Description of Artificial Sequence:  Enzymatic Nucleic Acid
aguuccaacugaugaggccguuaggccgaaaaagauau

SEQ ID NO: 10218 - RNA, 38 nt, Artificial Sequence
  Description of Artificial Sequence:  Enzymatic Nucleic Acid
uaguuccacugaugaggccguuaggccgaaaaaagaua

SEQ ID NO: 10219 - RNA, 38 nt, Artificial Sequence
  Description of Artificial Sequence:  Enzymatic Nucleic Acid
uuaguucccugaugaggccguuaggccgaaaaaaagau

SEQ ID NO: 10220 - RNA, 38 nt, Artificial Sequence
  Description of Artificial Sequence:  Enzymatic Nucleic Acid
auuugcuucugaugaggccguuaggccgaaaguuccaa

SEQ ID NO: 10221 - RNA, 38 nt, Artificial Sequence
  Description of Artificial Sequence:  Enzymatic Nucleic Acid
aggucuaacugaugaggccguuaggccgaaauuugcuu

SEQ ID NO: 10222 - RNA, 38 nt, Artificial Sequence
  Description of Artificial Sequence:  Enzymatic Nucleic Acid
aaggucuacugaugaggccguuaggccgaaaauuugcu

SEQ ID NO: 10223 - RNA, 38 nt, Artificial Sequence
  Description of Artificial Sequence:  Enzymatic Nucleic Acid
aaaggucucugaugaggccguuaggccgaaaaauuugc

SEQ ID NO: 10224 - RNA, 38 nt, Artificial Sequence
  Description of Artificial Sequence:  Enzymatic Nucleic Acid
uaaagguccugaugaggccguuaggccgaaaaaauuug

SEQ ID NO: 10225 - RNA, 38 nt, Artificial Sequence
  Description of Artificial Sequence:  Enzymatic Nucleic Acid
cauagguacugaugaggccguuaggccgaaaggucuaa

SEQ ID NO: 10226 - RNA, 38 nt, Artificial Sequence
  Description of Artificial Sequence:  Enzymatic Nucleic Acid
ccauaggucugaugaggccguuaggccgaaaaggucua

SEQ ID NO: 10227 - RNA, 38 nt, Artificial Sequence
  Description of Artificial Sequence:  Enzymatic Nucleic Acid
uccauaggcugaugaggccguuaggccgaaaaaggucu

SEQ ID NO: 10228 - RNA, 38 nt, Artificial Sequence
  Description of Artificial Sequence:  Enzymatic Nucleic Acid
cacuuccacugaugaggccguuaggccgaaagguaaag

SEQ ID NO: 10229 - RNA, 38 nt, Artificial Sequence
  Description of Artificial Sequence:  Enzymatic Nucleic Acid
ggacauagcugaugaggccguuaggccgaaaccacuuc

SEQ ID NO: 10230 - RNA, 38 nt, Artificial Sequence
  Description of Artificial Sequence:  Enzymatic Nucleic Acid
uggacauacugaugaggccguuaggccgaaaaccacuu

SEQ ID NO: 10231 - RNA, 38 nt, Artificial Sequence
  Description of Artificial Sequence:  Enzymatic Nucleic Acid
aauggacacugaugaggccguuaggccgaaagaaccac

SEQ ID NO: 10232 - RNA, 38 nt, Artificial Sequence
  Description of Artificial Sequence:  Enzymatic Nucleic Acid
ugagaaugcugaugaggccguuaggccgaaacauagaa

SEQ ID NO: 10233 - RNA, 38 nt, Artificial Sequence
  Description of Artificial Sequence:  Enzymatic Nucleic Acid
cgaaugagcugaugaggccguuaggccgaaauggacau

SEQ ID NO: 10234 - RNA, 38 nt, Artificial Sequence
  Description of Artificial Sequence:  Enzymatic Nucleic Acid
acgaaugacugaugaggccguuaggccgaaaauggaca

SEQ ID NO: 10235 - RNA, 38 nt, Artificial Sequence
  Description of Artificial Sequence:  Enzymatic Nucleic Acid
ccacgaaucugaugaggccguuaggccgaaagaaugga

SEQ ID NO: 10236 - RNA, 38 nt, Artificial Sequence
  Description of Artificial Sequence:  Enzymatic Nucleic Acid
augccacgcugaugaggccguuaggccgaaaugagaau

SEQ ID NO: 10237 - RNA, 38 nt, Artificial Sequence
  Description of Artificial Sequence:  Enzymatic Nucleic Acid
caugccaccugaugaggccguuaggccgaaaaugagaa

SEQ ID NO: 10238 - RNA, 38 nt, Artificial Sequence
  Description of Artificial Sequence:  Enzymatic Nucleic Acid
caaaucaacugaugaggccguuaggccgaaacaugcca

SEQ ID NO: 10239 - RNA, 38 nt, Artificial Sequence
  Description of Artificial Sequence:  Enzymatic Nucleic Acid
acaaaucacugaugaggccguuaggccgaaaacaugcc

SEQ ID NO: 10240 - RNA, 38 nt, Artificial Sequence
  Description of Artificial Sequence:  Enzymatic Nucleic Acid
uacaaauccugaugaggccguuaggccgaaaaacaugc

SEQ ID NO: 10241 - RNA, 38 nt, Artificial Sequence
  Description of Artificial Sequence:  Enzymatic Nucleic Acid
gugcuacacugaugaggccguuaggccgaaaucaaaac

SEQ ID NO: 10242 - RNA, 38 nt, Artificial Sequence
  Description of Artificial Sequence:  Enzymatic Nucleic Acid
agugcuaccugaugaggccguuaggccgaaaaucaaaa

SEQ ID NO: 10243 - RNA, 38 nt, Artificial Sequence
  Description of Artificial Sequence:  Enzymatic Nucleic Acid
cucagugccugaugaggccguuaggccgaaacaaauca

SEQ ID NO: 10244 - RNA, 38 nt, Artificial Sequence
  Description of Artificial Sequence:  Enzymatic Nucleic Acid
ucagaguucugaugaggccguuaggccgaaagugccac

SEQ ID NO: 10245 - RNA, 38 nt, Artificial Sequence
  Description of Artificial Sequence:  Enzymatic Nucleic Acid
ugggcucacugaugaggccguuaggccgaaaguugagu

SEQ ID NO: 10246 - RNA, 38 nt, Artificial Sequence
  Description of Artificial Sequence:  Enzymatic Nucleic Acid
gccaaaagcugaugaggccguuaggccgaaaugggcuc

SEQ ID NO: 10247 - RNA, 38 nt, Artificial Sequence
  Description of Artificial Sequence:  Enzymatic Nucleic Acid
ggagccaacugaugaggccguuaggccgaaaguauggg

SEQ ID NO: 10248 - RNA, 38 nt, Artificial Sequence
  Description of Artificial Sequence:  Enzymatic Nucleic Acid
aggagccacugaugaggccguuaggccgaaaaguaugg

SEQ ID NO: 10249 - RNA, 38 nt, Artificial Sequence
  Description of Artificial Sequence:  Enzymatic Nucleic Acid
gaggagcccugaugaggccguuaggccgaaaaaguaug

SEQ ID NO: 10250 - RNA, 38 nt, Artificial Sequence
  Description of Artificial Sequence:  Enzymatic Nucleic Acid
uacuagagcugaugaggccguuaggccgaaagccaaaa

SEQ ID NO: 10251 - RNA, 38 nt, Artificial Sequence
  Description of Artificial Sequence:  Enzymatic Nucleic Acid
ucuuacuacugaugaggccguuaggccgaaaggagcca

SEQ ID NO: 10252 - RNA, 38 nt, Artificial Sequence
  Description of Artificial Sequence:  Enzymatic Nucleic Acid
caucuuaccugaugaggccguuaggccgaaagaggagc

SEQ ID NO: 10253 - RNA, 38 nt, Artificial Sequence
  Description of Artificial Sequence:  Enzymatic Nucleic Acid
gugcaucucugaugaggccguuaggccgaaacuagagg

SEQ ID NO: 10254 - RNA, 38 nt, Artificial Sequence
  Description of Artificial Sequence:  Enzymatic Nucleic Acid
cucuggcucugaugaggccguuaggccgaaaguuuuca

SEQ ID NO: 10255 - RNA, 38 nt, Artificial Sequence
  Description of Artificial Sequence:  Enzymatic Nucleic Acid
acucuggccugaugaggccguuaggccgaaaaguuuuc

SEQ ID NO: 10256 - RNA, 38 nt, Artificial Sequence
  Description of Artificial Sequence:  Enzymatic Nucleic Acid
gacaaccucugaugaggccguuaggccgaaacucuggc

SEQ ID NO: 10257 - RNA, 38 nt, Artificial Sequence
  Description of Artificial Sequence:  Enzymatic Nucleic Acid
agacaacccugaugaggccguuaggccgaaaacucugg

SEQ ID NO: 10258 - RNA, 38 nt, Artificial Sequence
  Description of Artificial Sequence:  Enzymatic Nucleic Acid
cuggagaccugaugaggccguuaggccgaaaccuaacu

SEQ ID NO: 10259 - RNA, 38 nt, Artificial Sequence
  Description of Artificial Sequence:  Enzymatic Nucleic Acid
ggccuggacugaugaggccguuaggccgaaacaaccua

SEQ ID NO: 10260 - RNA, 38 nt, Artificial Sequence
  Description of Artificial Sequence:  Enzymatic Nucleic Acid
auggccugcugaugaggccguuaggccgaaagacaacc

SEQ ID NO: 10261 - RNA, 38 nt, Artificial Sequence
  Description of Artificial Sequence:  Enzymatic Nucleic Acid
uucagugucugaugaggccguuaggccgaaaggccauc

SEQ ID NO: 10262 - RNA, 38 nt, Artificial Sequence
  Description of Artificial Sequence:  Enzymatic Nucleic Acid
uuucagugcugaugaggccguuaggccgaaaaggccau

SEQ ID NO: 10263 - RNA, 38 nt, Artificial Sequence
  Description of Artificial Sequence:  Enzymatic Nucleic Acid
uagaaugucugaugaggccguuaggccgaaacauuuuc

SEQ ID NO: 10264 - RNA, 38 nt, Artificial Sequence
  Description of Artificial Sequence:  Enzymatic Nucleic Acid
caaaauagcugaugaggccguuaggccgaaaugugaca

SEQ ID NO: 10265 - RNA, 38 nt, Artificial Sequence
  Description of Artificial Sequence:  Enzymatic Nucleic Acid
ccaaaauacugaugaggccguuaggccgaaaaugugac

SEQ ID NO: 10266 - RNA, 38 nt, Artificial Sequence
  Description of Artificial Sequence:  Enzymatic Nucleic Acid
acccaaaacugaugaggccguuaggccgaaagaaugug

SEQ ID NO: 10267 - RNA, 38 nt, Artificial Sequence
  Description of Artificial Sequence:  Enzymatic Nucleic Acid
auacccaacugaugaggccguuaggccgaaauagaaug

SEQ ID NO: 10268 - RNA, 38 nt, Artificial Sequence
  Description of Artificial Sequence:  Enzymatic Nucleic Acid
aauacccacugaugaggccguuaggccgaaaauagaau

SEQ ID NO: 10269 - RNA, 38 nt, Artificial Sequence
  Description of Artificial Sequence:  Enzymatic Nucleic Acid
uaauaccccugaugaggccguuaggccgaaaaauagaa

SEQ ID NO: 10270 - RNA, 38 nt, Artificial Sequence
  Description of Artificial Sequence:  Enzymatic Nucleic Acid
uauauuaacugaugaggccguuaggccgaaacccaaaa

SEQ ID NO: 10271 - RNA, 38 nt, Artificial Sequence
  Description of Artificial Sequence:  Enzymatic Nucleic Acid
uauauauucugaugaggccguuaggccgaaauacccaa

SEQ ID NO: 10272 - RNA, 38 nt, Artificial Sequence
  Description of Artificial Sequence:  Enzymatic Nucleic Acid
cuauauaucugaugaggccguuaggccgaaaauaccca

SEQ ID NO: 10273 - RNA, 38 nt, Artificial Sequence
  Description of Artificial Sequence:  Enzymatic Nucleic Acid
ggacuauacugaugaggccguuaggccgaaauuaauac

SEQ ID NO: 10274 - RNA, 38 nt, Artificial Sequence
  Description of Artificial Sequence:  Enzymatic Nucleic Acid
cuggacuacugaugaggccguuaggccgaaauauuaau

SEQ ID NO: 10275 - RNA, 38 nt, Artificial Sequence
  Description of Artificial Sequence:  Enzymatic Nucleic Acid
gucuggaccugaugaggccguuaggccgaaauauauua

SEQ ID NO: 10276 - RNA, 38 nt, Artificial Sequence
  Description of Artificial Sequence:  Enzymatic Nucleic Acid
agugucugcugaugaggccguuaggccgaaacuauaua

SEQ ID NO: 10277 - RNA, 38 nt, Artificial Sequence
  Description of Artificial Sequence:  Enzymatic Nucleic Acid
auugaguucugaugaggccguuaggccgaaagugucug

SEQ ID NO: 10278 - RNA, 38 nt, Artificial Sequence
  Description of Artificial Sequence:  Enzymatic Nucleic Acid
aauugagucugaugaggccguuaggccgaaaagugucu

SEQ ID NO: 10279 - RNA, 38 nt, Artificial Sequence
  Description of Artificial Sequence:  Enzymatic Nucleic Acid
aagaaauucugaugaggccguuaggccgaaaguuaagu

SEQ ID NO: 10280 - RNA, 38 nt, Artificial Sequence
  Description of Artificial Sequence:  Enzymatic Nucleic Acid
uaccaagacugaugaggccguuaggccgaaauugaguu

SEQ ID NO: 10281 - RNA, 38 nt, Artificial Sequence
  Description of Artificial Sequence:  Enzymatic Nucleic Acid
auaccaagcugaugaggccguuaggccgaaaauugagu

SEQ ID NO: 10282 - RNA, 38 nt, Artificial Sequence
  Description of Artificial Sequence:  Enzymatic Nucleic Acid
aauaccaacugaugaggccguuaggccgaaaaauugag

SEQ ID NO: 10283 - RNA, 38 nt, Artificial Sequence
  Description of Artificial Sequence:  Enzymatic Nucleic Acid
auaauacccugaugaggccguuaggccgaaagaaauug

SEQ ID NO: 10284 - RNA, 38 nt, Artificial Sequence
  Description of Artificial Sequence:  Enzymatic Nucleic Acid
cagaauaacugaugaggccguuaggccgaaaccaagaa

SEQ ID NO: 10285 - RNA, 38 nt, Artificial Sequence
  Description of Artificial Sequence:  Enzymatic Nucleic Acid
aacagaaucugaugaggccguuaggccgaaauaccaag

SEQ ID NO: 10286 - RNA, 38 nt, Artificial Sequence
  Description of Artificial Sequence:  Enzymatic Nucleic Acid
aaacagaacugaugaggccguuaggccgaaaauaccaa

SEQ ID NO: 10287 - RNA, 38 nt, Artificial Sequence
  Description of Artificial Sequence:  Enzymatic Nucleic Acid
caaaacagcugaugaggccguuaggccgaaauaauacc

SEQ ID NO: 10288 - RNA, 38 nt, Artificial Sequence
  Description of Artificial Sequence:  Enzymatic Nucleic Acid
gcaaaacacugaugaggccguuaggccgaaaauaauac

SEQ ID NO: 10289 - RNA, 38 nt, Artificial Sequence
  Description of Artificial Sequence:  Enzymatic Nucleic Acid
cugugcaacugaugaggccguuaggccgaaacagaaua

SEQ ID NO: 10290 - RNA, 38 nt, Artificial Sequence
  Description of Artificial Sequence:  Enzymatic Nucleic Acid
acugugcacugaugaggccguuaggccgaaaacagaau

SEQ ID NO: 10291 - RNA, 38 nt, Artificial Sequence
  Description of Artificial Sequence:  Enzymatic Nucleic Acid
aacugugccugaugaggccguuaggccgaaaaacagaa

SEQ ID NO: 10292 - RNA, 38 nt, Artificial Sequence
  Description of Artificial Sequence:  Enzymatic Nucleic Acid
ucacaacucugaugaggccguuaggccgaaacugugca

SEQ ID NO: 10293 - RNA, 38 nt, Artificial Sequence
  Description of Artificial Sequence:  Enzymatic Nucleic Acid
uucacaaccugaugaggccguuaggccgaaaacugugc

SEQ ID NO: 10294 - RNA, 38 nt, Artificial Sequence
  Description of Artificial Sequence:  Enzymatic Nucleic Acid
ucuuucaccugaugaggccguuaggccgaaacuaacug

SEQ ID NO: 10295 - RNA, 38 nt, Artificial Sequence
  Description of Artificial Sequence:  Enzymatic Nucleic Acid
cuccucagcugaugaggccguuaggccgaaacugcauu

SEQ ID NO: 10296 - RNA, 38 nt, Artificial Sequence
  Description of Artificial Sequence:  Enzymatic Nucleic Acid
auggagaacugaugaggccguuaggccgaaacucuccu

SEQ ID NO: 10297 - RNA, 38 nt, Artificial Sequence
  Description of Artificial Sequence:  Enzymatic Nucleic Acid
uauggagacugaugaggccguuaggccgaaaacucucc

SEQ ID NO: 10298 - RNA, 38 nt, Artificial Sequence
  Description of Artificial Sequence:  Enzymatic Nucleic Acid
auauggagcugaugaggccguuaggccgaaaaacucuc

SEQ ID NO: 10299 - RNA, 38 nt, Artificial Sequence
  Description of Artificial Sequence:  Enzymatic Nucleic Acid
gauauggacugaugaggccguuaggccgaaaaaacucu

SEQ ID NO: 10300 - RNA, 38 nt, Artificial Sequence
  Description of Artificial Sequence:  Enzymatic Nucleic Acid
uugauaugcugaugaggccguuaggccgaaagaaaacu

SEQ ID NO: 10301 - RNA, 38 nt, Artificial Sequence
  Description of Artificial Sequence:  Enzymatic Nucleic Acid
cguuuugacugaugaggccguuaggccgaaauggagaa

SEQ ID NO: 10302 - RNA, 38 nt, Artificial Sequence
  Description of Artificial Sequence:  Enzymatic Nucleic Acid
cucguuuucugaugaggccguuaggccgaaauauggag

SEQ ID NO: 10303 - RNA, 38 nt, Artificial Sequence
  Description of Artificial Sequence:  Enzymatic Nucleic Acid
accuuauucugaugaggccguuaggccgaaaccuuuuu

SEQ ID NO: 10304 - RNA, 38 nt, Artificial Sequence
  Description of Artificial Sequence:  Enzymatic Nucleic Acid
cuugaccucugaugaggccguuaggccgaaauugaccu

SEQ ID NO: 10305 - RNA, 38 nt, Artificial Sequence
  Description of Artificial Sequence:  Enzymatic Nucleic Acid
cuucccuucugaugaggccguuaggccgaaaccuuauu

SEQ ID NO: 10306 - RNA, 38 nt, Artificial Sequence
  Description of Artificial Sequence:  Enzymatic Nucleic Acid
gguauagacugaugaggccguuaggccgaaacgggguc

SEQ ID NO: 10307 - RNA, 38 nt, Artificial Sequence
  Description of Artificial Sequence:  Enzymatic Nucleic Acid
uugguauacugaugaggccguuaggccgaaagacgggg

SEQ ID NO: 10308 - RNA, 38 nt, Artificial Sequence
  Description of Artificial Sequence:  Enzymatic Nucleic Acid
gguugguacugaugaggccguuaggccgaaagagacgg

SEQ ID NO: 10309 - RNA, 38 nt, Artificial Sequence
  Description of Artificial Sequence:  Enzymatic Nucleic Acid
uugguuggcugaugaggccguuaggccgaaauagagac

SEQ ID NO: 10310 - RNA, 38 nt, Artificial Sequence
  Description of Artificial Sequence:  Enzymatic Nucleic Acid
uguuggugcugaugaggccguuaggccgaaauugguuu

SEQ ID NO: 10311 - RNA, 38 nt, Artificial Sequence
  Description of Artificial Sequence:  Enzymatic Nucleic Acid
guguuggucugaugaggccguuaggccgaaaauugguu

SEQ ID NO: 10312 - RNA, 38 nt, Artificial Sequence
  Description of Artificial Sequence:  Enzymatic Nucleic Acid
uggguccccugaugaggccguuaggccgaaacuguguu

SEQ ID NO: 10313 - RNA, 38 nt, Artificial Sequence
  Description of Artificial Sequence:  Enzymatic Nucleic Acid
acgugacucugaugaggccguuaggccgaaacuuccug

SEQ ID NO: 10314 - RNA, 38 nt, Artificial Sequence
  Description of Artificial Sequence:  Enzymatic Nucleic Acid
ggaaacgucugaugaggccguuaggccgaaacugacuu

SEQ ID NO: 10315 - RNA, 38 nt, Artificial Sequence
  Description of Artificial Sequence:  Enzymatic Nucleic Acid
gaaaaggacugaugaggccguuaggccgaaacgugacu

SEQ ID NO: 10316 - RNA, 38 nt, Artificial Sequence
  Description of Artificial Sequence:  Enzymatic Nucleic Acid
ugaaaaggcugaugaggccguuaggccgaaaacgugac

SEQ ID NO: 10317 - RNA, 38 nt, Artificial Sequence
  Description of Artificial Sequence:  Enzymatic Nucleic Acid
augaaaagcugaugaggccguuaggccgaaaaacguga

SEQ ID NO: 10318 - RNA, 38 nt, Artificial Sequence
  Description of Artificial Sequence:  Enzymatic Nucleic Acid
uaaaugaacugaugaggccguuaggccgaaaggaaacg

SEQ ID NO: 10319 - RNA, 38 nt, Artificial Sequence
  Description of Artificial Sequence:  Enzymatic Nucleic Acid
uuaaaugacugaugaggccguuaggccgaaaaggaaac

SEQ ID NO: 10320 - RNA, 38 nt, Artificial Sequence
  Description of Artificial Sequence:  Enzymatic Nucleic Acid
auuaaaugcugaugaggccguuaggccgaaaaaggaaa

SEQ ID NO: 10321 - RNA, 38 nt, Artificial Sequence
  Description of Artificial Sequence:  Enzymatic Nucleic Acid
cauuaaaucugaugaggccguuaggccgaaaaaaggaa

SEQ ID NO: 10322 - RNA, 38 nt, Artificial Sequence
  Description of Artificial Sequence:  Enzymatic Nucleic Acid
ccccauuacugaugaggccguuaggccgaaaugaaaag

SEQ ID NO: 10323 - RNA, 38 nt, Artificial Sequence
  Description of Artificial Sequence:  Enzymatic Nucleic Acid
uccccauucugaugaggccguuaggccgaaaaugaaaa

SEQ ID NO: 10324 - RNA, 38 nt, Artificial Sequence
  Description of Artificial Sequence:  Enzymatic Nucleic Acid
auccccaucugaugaggccguuaggccgaaaaaugaaa

SEQ ID NO: 10325 - RNA, 38 nt, Artificial Sequence
  Description of Artificial Sequence:  Enzymatic Nucleic Acid
gauaguggcugaugaggccguuaggccgaaauccccau

SEQ ID NO: 10326 - RNA, 38 nt, Artificial Sequence
  Description of Artificial Sequence:  Enzymatic Nucleic Acid
agauagugcugaugaggccguuaggccgaaaaucccca

SEQ ID NO: 10327 - RNA, 38 nt, Artificial Sequence
  Description of Artificial Sequence:  Enzymatic Nucleic Acid
gugugagacugaugaggccguuaggccgaaaguggaau

SEQ ID NO: 10328 - RNA, 38 nt, Artificial Sequence
  Description of Artificial Sequence:  Enzymatic Nucleic Acid
uagugugacugaugaggccguuaggccgaaauagugga

SEQ ID NO: 10329 - RNA, 38 nt, Artificial Sequence
  Description of Artificial Sequence:  Enzymatic Nucleic Acid
auuagugucugaugaggccguuaggccgaaagauagug

SEQ ID NO: 10330 - RNA, 38 nt, Artificial Sequence
  Description of Artificial Sequence:  Enzymatic Nucleic Acid
uuucagaucugaugaggccguuaggccgaaagugugag

SEQ ID NO: 10331 - RNA, 38 nt, Artificial Sequence
  Description of Artificial Sequence:  Enzymatic Nucleic Acid
uccuuucacugaugaggccguuaggccgaaauuagugu

SEQ ID NO: 10332 - RNA, 38 nt, Artificial Sequence
  Description of Artificial Sequence:  Enzymatic Nucleic Acid
cgccagcucugaugaggccguuaggccgaaaugcucuu

SEQ ID NO: 10333 - RNA, 38 nt, Artificial Sequence
  Description of Artificial Sequence:  Enzymatic Nucleic Acid
gcgccagccugaugaggccguuaggccgaaaaugcucu

SEQ ID NO: 10334 - RNA, 38 nt, Artificial Sequence
  Description of Artificial Sequence:  Enzymatic Nucleic Acid
gugcuuaacugaugaggccguuaggccgaaaugcgcca

SEQ ID NO: 10335 - RNA, 38 nt, Artificial Sequence
  Description of Artificial Sequence:  Enzymatic Nucleic Acid
aagugcuucugaugaggccguuaggccgaaauaugcgc

SEQ ID NO: 10336 - RNA, 38 nt, Artificial Sequence
  Description of Artificial Sequence:  Enzymatic Nucleic Acid
aaagugcucugaugaggccguuaggccgaaaauaugcg

SEQ ID NO: 10337 - RNA, 38 nt, Artificial Sequence
  Description of Artificial Sequence:  Enzymatic Nucleic Acid
ggagcuuacugaugaggccguuaggccgaaagugcuua

SEQ ID NO: 10338 - RNA, 38 nt, Artificial Sequence
  Description of Artificial Sequence:  Enzymatic Nucleic Acid
aggagcuucugaugaggccguuaggccgaaaagugcuu

SEQ ID NO: 10339 - RNA, 38 nt, Artificial Sequence
  Description of Artificial Sequence:  Enzymatic Nucleic Acid
aaggagcucugaugaggccguuaggccgaaaaagugcu

SEQ ID NO: 10340 - RNA, 38 nt, Artificial Sequence
  Description of Artificial Sequence:  Enzymatic Nucleic Acid
uacucaagcugaugaggccguuaggccgaaagcuuaaa

SEQ ID NO: 10341 - RNA, 38 nt, Artificial Sequence
  Description of Artificial Sequence:  Enzymatic Nucleic Acid
uuuuacuccugaugaggccguuaggccgaaaggagcuu

SEQ ID NO: 10342 - RNA, 38 nt, Artificial Sequence
  Description of Artificial Sequence:  Enzymatic Nucleic Acid
caccuuuucugaugaggccguuaggccgaaacucaagg

SEQ ID NO: 10343 - RNA, 38 nt, Artificial Sequence
  Description of Artificial Sequence:  Enzymatic Nucleic Acid
aaauuacacugaugaggccguuaggccgaaaccaccuu

SEQ ID NO: 10344 - RNA, 38 nt, Artificial Sequence
  Description of Artificial Sequence:  Enzymatic Nucleic Acid
gcauaaaucugaugaggccguuaggccgaaacauacca

SEQ ID NO: 10345 - RNA, 38 nt, Artificial Sequence
  Description of Artificial Sequence:  Enzymatic Nucleic Acid
cuugcauacugaugaggccguuaggccgaaauuacaua

SEQ ID NO: 10346 - RNA, 38 nt, Artificial Sequence
  Description of Artificial Sequence:  Enzymatic Nucleic Acid
ccuugcaucugaugaggccguuaggccgaaaauuacau

SEQ ID NO: 10347 - RNA, 38 nt, Artificial Sequence
  Description of Artificial Sequence:  Enzymatic Nucleic Acid
accuugcacugaugaggccguuaggccgaaaaauuaca

SEQ ID NO: 10348 - RNA, 38 nt, Artificial Sequence
  Description of Artificial Sequence:  Enzymatic Nucleic Acid
uggagaaacugaugaggccguuaggccgaaaccuugca

SEQ ID NO: 10349 - RNA, 38 nt, Artificial Sequence
  Description of Artificial Sequence:  Enzymatic Nucleic Acid
acuggagacugaugaggccguuaggccgaaauaccuug

SEQ ID NO: 10350 - RNA, 38 nt, Artificial Sequence
  Description of Artificial Sequence:  Enzymatic Nucleic Acid
aacuggagcugaugaggccguuaggccgaaaauaccuu

SEQ ID NO: 10351 - RNA, 38 nt, Artificial Sequence
  Description of Artificial Sequence:  Enzymatic Nucleic Acid
caacuggacugaugaggccguuaggccgaaaaauaccu

SEQ ID NO: 10352 - RNA, 38 nt, Artificial Sequence
  Description of Artificial Sequence:  Enzymatic Nucleic Acid
cccaacugcugaugaggccguuaggccgaaagaaauac

SEQ ID NO: 10353 - RNA, 38 nt, Artificial Sequence
  Description of Artificial Sequence:  Enzymatic Nucleic Acid
ugaguccccugaugaggccguuaggccgaaacuggaga

SEQ ID NO: 10354 - RNA, 38 nt, Artificial Sequence
  Description of Artificial Sequence:  Enzymatic Nucleic Acid
aauauccucugaugaggccguuaggccgaaagucccaa

SEQ ID NO: 10355 - RNA, 38 nt, Artificial Sequence
  Description of Artificial Sequence:  Enzymatic Nucleic Acid
uuaacuaacugaugaggccguuaggccgaaauccugag

SEQ ID NO: 10356 - RNA, 38 nt, Artificial Sequence
  Description of Artificial Sequence:  Enzymatic Nucleic Acid
cauuaacucugaugaggccguuaggccgaaauauccug

SEQ ID NO: 10357 - RNA, 38 nt, Artificial Sequence
  Description of Artificial Sequence:  Enzymatic Nucleic Acid
ucauuaaccugaugaggccguuaggccgaaaauauccu

SEQ ID NO: 10358 - RNA, 38 nt, Artificial Sequence
  Description of Artificial Sequence:  Enzymatic Nucleic Acid
ggcucauucugaugaggccguuaggccgaaacuaauau

SEQ ID NO: 10359 - RNA, 38 nt, Artificial Sequence
  Description of Artificial Sequence:  Enzymatic Nucleic Acid
uggcucaucugaugaggccguuaggccgaaaacuaaua

SEQ ID NO: 10360 - RNA, 38 nt, Artificial Sequence
  Description of Artificial Sequence:  Enzymatic Nucleic Acid
cuucuagucugaugaggccguuaggccgaaauggcuca

SEQ ID NO: 10361 - RNA, 38 nt, Artificial Sequence
  Description of Artificial Sequence:  Enzymatic Nucleic Acid
uuuucuuccugaugaggccguuaggccgaaagugaugg

SEQ ID NO: 10362 - RNA, 38 nt, Artificial Sequence
  Description of Artificial Sequence:  Enzymatic Nucleic Acid
caguugaacugaugaggccguuaggccgaaaugggcuu

SEQ ID NO: 10363 - RNA, 38 nt, Artificial Sequence
  Description of Artificial Sequence:  Enzymatic Nucleic Acid
gcaguugacugaugaggccguuaggccgaaaaugggcu

SEQ ID NO: 10364 - RNA, 38 nt, Artificial Sequence
  Description of Artificial Sequence:  Enzymatic Nucleic Acid
agcaguugcugaugaggccguuaggccgaaaaaugggc

SEQ ID NO: 10365 - RNA, 38 nt, Artificial Sequence
  Description of Artificial Sequence:  Enzymatic Nucleic Acid
aagcaguucugaugaggccguuaggccgaaaaaauggg

SEQ ID NO: 10366 - RNA, 38 nt, Artificial Sequence
  Description of Artificial Sequence:  Enzymatic Nucleic Acid
aaguuucacugaugaggccguuaggccgaaagcaguug

SEQ ID NO: 10367 - RNA, 38 nt, Artificial Sequence
  Description of Artificial Sequence:  Enzymatic Nucleic Acid
caaguuuccugaugaggccguuaggccgaaaagcaguu

SEQ ID NO: 10368 - RNA, 38 nt, Artificial Sequence
  Description of Artificial Sequence:  Enzymatic Nucleic Acid
ccccaggccugaugaggccguuaggccgaaaguuucaa

SEQ ID NO: 10369 - RNA, 38 nt, Artificial Sequence
  Description of Artificial Sequence:  Enzymatic Nucleic Acid
caugcucacugaugaggccguuaggccgaaaccccagg

SEQ ID NO: 10370 - RNA, 38 nt, Artificial Sequence
  Description of Artificial Sequence:  Enzymatic Nucleic Acid
ugucuccccugaugaggccguuaggccgaaauucccau

SEQ ID NO: 10371 - RNA, 38 nt, Artificial Sequence
  Description of Artificial Sequence:  Enzymatic Nucleic Acid
cccuuucccugaugaggccguuaggccgaaacccuguc

SEQ ID NO: 10372 - RNA, 38 nt, Artificial Sequence
  Description of Artificial Sequence:  Enzymatic Nucleic Acid
cugaagagcugaugaggccguuaggccgaaaggcgccc

SEQ ID NO: 10373 - RNA, 38 nt, Artificial Sequence
  Description of Artificial Sequence:  Enzymatic Nucleic Acid
acccugaacugaugaggccguuaggccgaaaguaggcg

SEQ ID NO: 10374 - RNA, 38 nt, Artificial Sequence
  Description of Artificial Sequence:  Enzymatic Nucleic Acid
agacccugcugaugaggccguuaggccgaaagaguagg

SEQ ID NO: 10375 - RNA, 38 nt, Artificial Sequence
  Description of Artificial Sequence:  Enzymatic Nucleic Acid
uagacccucugaugaggccguuaggccgaaaagaguag

SEQ ID NO: 10376 - RNA, 38 nt, Artificial Sequence
  Description of Artificial Sequence:  Enzymatic Nucleic Acid
gaucuuuacugaugaggccguuaggccgaaacccugaa

SEQ ID NO: 10377 - RNA, 38 nt, Artificial Sequence
  Description of Artificial Sequence:  Enzymatic Nucleic Acid
uugaucuucugaugaggccguuaggccgaaagacccug

SEQ ID NO: 10378 - RNA, 38 nt, Artificial Sequence
  Description of Artificial Sequence:  Enzymatic Nucleic Acid
gcccacuucugaugaggccguuaggccgaaaucuuuag

SEQ ID NO: 10379 - RNA, 38 nt, Artificial Sequence
  Description of Artificial Sequence:  Enzymatic Nucleic Acid
agcgaucccugaugaggccguuaggccgaaaggcccac

SEQ ID NO: 10380 - RNA, 38 nt, Artificial Sequence
  Description of Artificial Sequence:  Enzymatic Nucleic Acid
agcuuagccugaugaggccguuaggccgaaauccaagg

SEQ ID NO: 10381 - RNA, 38 nt, Artificial Sequence
  Description of Artificial Sequence:  Enzymatic Nucleic Acid
agccagcucugaugaggccguuaggccgaaagcgaucc

SEQ ID NO: 10382 - RNA, 38 nt, Artificial Sequence
  Description of Artificial Sequence:  Enzymatic Nucleic Acid
aucaaacacugaugaggccguuaggccgaaagccagcu

SEQ ID NO: 10383 - RNA, 38 nt, Artificial Sequence
  Description of Artificial Sequence:  Enzymatic Nucleic Acid
uagcaucacugaugaggccguuaggccgaaacagagcc

SEQ ID NO: 10384 - RNA, 38 nt, Artificial Sequence
  Description of Artificial Sequence:  Enzymatic Nucleic Acid
auagcauccugaugaggccguuaggccgaaaacagagc

SEQ ID NO: 10385 - RNA, 38 nt, Artificial Sequence
  Description of Artificial Sequence:  Enzymatic Nucleic Acid
ugcauaaacugaugaggccguuaggccgaaagcaucaa

SEQ ID NO: 10386 - RNA, 38 nt, Artificial Sequence
  Description of Artificial Sequence:  Enzymatic Nucleic Acid
cuugcauacugaugaggccguuaggccgaaauagcauc

SEQ ID NO: 10387 - RNA, 38 nt, Artificial Sequence
  Description of Artificial Sequence:  Enzymatic Nucleic Acid
acuugcaucugaugaggccguuaggccgaaaauagcau

SEQ ID NO: 10388 - RNA, 38 nt, Artificial Sequence
  Description of Artificial Sequence:  Enzymatic Nucleic Acid
aacuugcacugaugaggccguuaggccgaaaaauagca

SEQ ID NO: 10389 - RNA, 38 nt, Artificial Sequence
  Description of Artificial Sequence:  Enzymatic Nucleic Acid
uagacccucugaugaggccguuaggccgaaacuugcau

SEQ ID NO: 10390 - RNA, 38 nt, Artificial Sequence
  Description of Artificial Sequence:  Enzymatic Nucleic Acid
auagaccccugaugaggccguuaggccgaaaacuugca

SEQ ID NO: 10391 - RNA, 38 nt, Artificial Sequence
  Description of Artificial Sequence:  Enzymatic Nucleic Acid
aauacauacugaugaggccguuaggccgaaacccuaac

SEQ ID NO: 10392 - RNA, 38 nt, Artificial Sequence
  Description of Artificial Sequence:  Enzymatic Nucleic Acid
uaaauacacugaugaggccguuaggccgaaagacccua

SEQ ID NO: 10393 - RNA, 38 nt, Artificial Sequence
  Description of Artificial Sequence:  Enzymatic Nucleic Acid
auccuaaacugaugaggccguuaggccgaaacauagac

SEQ ID NO: 10394 - RNA, 38 nt, Artificial Sequence
  Description of Artificial Sequence:  Enzymatic Nucleic Acid
gcauccuacugaugaggccguuaggccgaaauacauag

SEQ ID NO: 10395 - RNA, 38 nt, Artificial Sequence
  Description of Artificial Sequence:  Enzymatic Nucleic Acid
cgcauccucugaugaggccguuaggccgaaaauacaua

SEQ ID NO: 10396 - RNA, 38 nt, Artificial Sequence
  Description of Artificial Sequence:  Enzymatic Nucleic Acid
gcgcaucccugaugaggccguuaggccgaaaaauacau

SEQ ID NO: 10397 - RNA, 38 nt, Artificial Sequence
  Description of Artificial Sequence:  Enzymatic Nucleic Acid
cugaagagcugaugaggccguuaggccgaaaggcgcau

SEQ ID NO: 10398 - RNA, 38 nt, Artificial Sequence
  Description of Artificial Sequence:  Enzymatic Nucleic Acid
acauccuacugaugaggccguuaggccgaaauacauag

SEQ ID NO: 10399 - RNA, 38 nt, Artificial Sequence
  Description of Artificial Sequence:  Enzymatic Nucleic Acid
gacauccucugaugaggccguuaggccgaaaauacaua

SEQ ID NO: 10400 - RNA, 38 nt, Artificial Sequence
  Description of Artificial Sequence:  Enzymatic Nucleic Acid
agacaucccugaugaggccguuaggccgaaaaauacau

SEQ ID NO: 10401 - RNA, 38 nt, Artificial Sequence
  Description of Artificial Sequence:  Enzymatic Nucleic Acid
aaggugcacugaugaggccguuaggccgaaacauccua

SEQ ID NO: 10402 - RNA, 38 nt, Artificial Sequence
  Description of Artificial Sequence:  Enzymatic Nucleic Acid
ggcugcagcugaugaggccguuaggccgaaaggugcag

SEQ ID NO: 10403 - RNA, 38 nt, Artificial Sequence
  Description of Artificial Sequence:  Enzymatic Nucleic Acid
uggcugcacugaugaggccguuaggccgaaaaggugca

SEQ ID NO: 10404 - RNA, 38 nt, Artificial Sequence
  Description of Artificial Sequence:  Enzymatic Nucleic Acid
cagcuucucugaugaggccguuaggccgaaacuggcug

SEQ ID NO: 10405 - RNA, 38 nt, Artificial Sequence
  Description of Artificial Sequence:  Enzymatic Nucleic Acid
gaagcagccugaugaggccguuaggccgaaauccacug

SEQ ID NO: 10406 - RNA, 38 nt, Artificial Sequence
  Description of Artificial Sequence:  Enzymatic Nucleic Acid
uccccaagcugaugaggccguuaggccgaaagcagcaa

SEQ ID NO: 10407 - RNA, 38 nt, Artificial Sequence
  Description of Artificial Sequence:  Enzymatic Nucleic Acid
cuccccaacugaugaggccguuaggccgaaaagcagca

SEQ ID NO: 10408 - RNA, 38 nt, Artificial Sequence
  Description of Artificial Sequence:  Enzymatic Nucleic Acid
uucucccccugaugaggccguuaggccgaaagaagcag

SEQ ID NO: 10409 - RNA, 38 nt, Artificial Sequence
  Description of Artificial Sequence:  Enzymatic Nucleic Acid
aggaagcacugaugaggccguuaggccgaaacucuucu

SEQ ID NO: 10410 - RNA, 38 nt, Artificial Sequence
  Description of Artificial Sequence:  Enzymatic Nucleic Acid
auaaaaggcugaugaggccguuaggccgaaagcauacu

SEQ ID NO: 10411 - RNA, 38 nt, Artificial Sequence
  Description of Artificial Sequence:  Enzymatic Nucleic Acid
gauaaaagcugaugaggccguuaggccgaaaagcauac

SEQ ID NO: 10412 - RNA, 38 nt, Artificial Sequence
  Description of Artificial Sequence:  Enzymatic Nucleic Acid
auggauaacugaugaggccguuaggccgaaaggaagca

SEQ ID NO: 10413 - RNA, 38 nt, Artificial Sequence
  Description of Artificial Sequence:  Enzymatic Nucleic Acid
cauggauacugaugaggccguuaggccgaaaaggaagc

SEQ ID NO: 10414 - RNA, 38 nt, Artificial Sequence
  Description of Artificial Sequence:  Enzymatic Nucleic Acid
acauggaucugaugaggccguuaggccgaaaaaggaag

SEQ ID NO: 10415 - RNA, 38 nt, Artificial Sequence
  Description of Artificial Sequence:  Enzymatic Nucleic Acid
uacauggacugaugaggccguuaggccgaaaaaaggaa

SEQ ID NO: 10416 - RNA, 38 nt, Artificial Sequence
  Description of Artificial Sequence:  Enzymatic Nucleic Acid
auuacaugcugaugaggccguuaggccgaaauaaaagg

SEQ ID NO: 10417 - RNA, 38 nt, Artificial Sequence
  Description of Artificial Sequence:  Enzymatic Nucleic Acid
aguuaaaucugaugaggccguuaggccgaaacauggau

SEQ ID NO: 10418 - RNA, 38 nt, Artificial Sequence
  Description of Artificial Sequence:  Enzymatic Nucleic Acid
uacaguuacugaugaggccguuaggccgaaauuacaug

SEQ ID NO: 10419 - RNA, 38 nt, Artificial Sequence
  Description of Artificial Sequence:  Enzymatic Nucleic Acid
cuacaguucugaugaggccguuaggccgaaaauuacau

SEQ ID NO: 10420 - RNA, 38 nt, Artificial Sequence
  Description of Artificial Sequence:  Enzymatic Nucleic Acid
ucuacagucugaugaggccguuaggccgaaaaauuaca

SEQ ID NO: 10421 - RNA, 38 nt, Artificial Sequence
  Description of Artificial Sequence:  Enzymatic Nucleic Acid
ucagguuccugaugaggccguuaggccgaaacaguuaa

SEQ ID NO: 10422 - RNA, 38 nt, Artificial Sequence
  Description of Artificial Sequence:  Enzymatic Nucleic Acid
guuacuuacugaugaggccguuaggccgaaagcucagg

SEQ ID NO: 10423 - RNA, 38 nt, Artificial Sequence
  Description of Artificial Sequence:  Enzymatic Nucleic Acid
cgguuacucugaugaggccguuaggccgaaagagcuca

SEQ ID NO: 10424 - RNA, 38 nt, Artificial Sequence
  Description of Artificial Sequence:  Enzymatic Nucleic Acid
ucuucggucugaugaggccguuaggccgaaacuuagag

SEQ ID NO: 10425 - RNA, 38 nt, Artificial Sequence
  Description of Artificial Sequence:  Enzymatic Nucleic Acid
cagaggcacugaugaggccguuaggccgaaacauucuu

SEQ ID NO: 10426 - RNA, 38 nt, Artificial Sequence
  Description of Artificial Sequence:  Enzymatic Nucleic Acid
uaagaacacugaugaggccguuaggccgaaaggcauac

SEQ ID NO: 10427 - RNA, 38 nt, Artificial Sequence
  Description of Artificial Sequence:  Enzymatic Nucleic Acid
cacauaagcugaugaggccguuaggccgaaacagaggc

SEQ ID NO: 10428 - RNA, 38 nt, Artificial Sequence
  Description of Artificial Sequence:  Enzymatic Nucleic Acid
gcacauaacugaugaggccguuaggccgaaaacagagg

SEQ ID NO: 10429 - RNA, 38 nt, Artificial Sequence
  Description of Artificial Sequence:  Enzymatic Nucleic Acid
uggcacaucugaugaggccguuaggccgaaagaacaga

SEQ ID NO: 10430 - RNA, 38 nt, Artificial Sequence
  Description of Artificial Sequence:  Enzymatic Nucleic Acid
guggcacacugaugaggccguuaggccgaaaagaacag

SEQ ID NO: 10431 - RNA, 38 nt, Artificial Sequence
  Description of Artificial Sequence:  Enzymatic Nucleic Acid
uaaacaagcugaugaggccguuaggccgaaauguggca

SEQ ID NO: 10432 - RNA, 38 nt, Artificial Sequence
  Description of Artificial Sequence:  Enzymatic Nucleic Acid
cuuuaaaccugaugaggccguuaggccgaaaggaugug

SEQ ID NO: 10433 - RNA, 38 nt, Artificial Sequence
  Description of Artificial Sequence:  Enzymatic Nucleic Acid
agccuuuacugaugaggccguuaggccgaaacaaggau

SEQ ID NO: 10434 - RNA, 38 nt, Artificial Sequence
  Description of Artificial Sequence:  Enzymatic Nucleic Acid
gagccuuucugaugaggccguuaggccgaaaacaagga

SEQ ID NO: 10435 - RNA, 38 nt, Artificial Sequence
  Description of Artificial Sequence:  Enzymatic Nucleic Acid
agagccuucugaugaggccguuaggccgaaaaacaagg

SEQ ID NO: 10436 - RNA, 38 nt, Artificial Sequence
  Description of Artificial Sequence:  Enzymatic Nucleic Acid
cauacagacugaugaggccguuaggccgaaagccuuua

SEQ ID NO: 10437 - RNA, 38 nt, Artificial Sequence
  Description of Artificial Sequence:  Enzymatic Nucleic Acid
uucauacacugaugaggccguuaggccgaaagagccuu

SEQ ID NO: 10438 - RNA, 38 nt, Artificial Sequence
  Description of Artificial Sequence:  Enzymatic Nucleic Acid
ucucuucacugaugaggccguuaggccgaaacagagag

SEQ ID NO: 10439 - RNA, 38 nt, Artificial Sequence
  Description of Artificial Sequence:  Enzymatic Nucleic Acid
gugcugaucugaugaggccguuaggccgaaacgguccc

SEQ ID NO: 10440 - RNA, 38 nt, Artificial Sequence
  Description of Artificial Sequence:  Enzymatic Nucleic Acid
aaugugcucugaugaggccguuaggccgaaaugacggu

SEQ ID NO: 10441 - RNA, 38 nt, Artificial Sequence
  Description of Artificial Sequence:  Enzymatic Nucleic Acid
cacuagggcugaugaggccguuaggccgaaaugugcug

SEQ ID NO: 10442 - RNA, 38 nt, Artificial Sequence
  Description of Artificial Sequence:  Enzymatic Nucleic Acid
ucacuaggcugaugaggccguuaggccgaaaaugugcu

SEQ ID NO: 10443 - RNA, 38 nt, Artificial Sequence
  Description of Artificial Sequence:  Enzymatic Nucleic Acid
aggcucaccugaugaggccguuaggccgaaagggaaug

SEQ ID NO: 10444 - RNA, 38 nt, Artificial Sequence
  Description of Artificial Sequence:  Enzymatic Nucleic Acid
ggagccagcugaugaggccguuaggccgaaaggcucac

SEQ ID NO: 10445 - RNA, 38 nt, Artificial Sequence
  Description of Artificial Sequence:  Enzymatic Nucleic Acid
gcugccagcugaugaggccguuaggccgaaagccagua

SEQ ID NO: 10446 - RNA, 38 nt, Artificial Sequence
  Description of Artificial Sequence:  Enzymatic Nucleic Acid
uuccacaacugaugaggccguuaggccgaaagccgcug

SEQ ID NO: 10447 - RNA, 38 nt, Artificial Sequence
  Description of Artificial Sequence:  Enzymatic Nucleic Acid
cuuccacacugaugaggccguuaggccgaaaagccgcu

SEQ ID NO: 10448 - RNA, 38 nt, Artificial Sequence
  Description of Artificial Sequence:  Enzymatic Nucleic Acid
ucuuccaccugaugaggccguuaggccgaaaaagccgc

SEQ ID NO: 10449 - RNA, 38 nt, Artificial Sequence
  Description of Artificial Sequence:  Enzymatic Nucleic Acid
uggcuagucugaugaggccguuaggccgaaagucuucc

SEQ ID NO: 10450 - RNA, 38 nt, Artificial Sequence
  Description of Artificial Sequence:  Enzymatic Nucleic Acid
cuucuggccugaugaggccguuaggccgaaagugaguc

SEQ ID NO: 10451 - RNA, 38 nt, Artificial Sequence
  Description of Artificial Sequence:  Enzymatic Nucleic Acid
guggagagcugaugaggccguuaggccgaaacuguccc

SEQ ID NO: 10452 - RNA, 38 nt, Artificial Sequence
  Description of Artificial Sequence:  Enzymatic Nucleic Acid
uugguggacugaugaggccguuaggccgaaaggacugu

SEQ ID NO: 10453 - RNA, 38 nt, Artificial Sequence
  Description of Artificial Sequence:  Enzymatic Nucleic Acid
ucuuggugcugaugaggccguuaggccgaaagaggacu

SEQ ID NO: 10454 - RNA, 38 nt, Artificial Sequence
  Description of Artificial Sequence:  Enzymatic Nucleic Acid
uggauuuacugaugaggccguuaggccgaaaucuuggu

SEQ ID NO: 10455 - RNA, 38 nt, Artificial Sequence
  Description of Artificial Sequence:  Enzymatic Nucleic Acid
uuuggauucugaugaggccguuaggccgaaagaucuug

SEQ ID NO: 10456 - RNA, 38 nt, Artificial Sequence
  Description of Artificial Sequence:  Enzymatic Nucleic Acid
uuuguuugcugaugaggccguuaggccgaaauuuagau

SEQ ID NO: 10457 - RNA, 38 nt, Artificial Sequence
  Description of Artificial Sequence:  Enzymatic Nucleic Acid
ucuggcuccugaugaggccguuaggccgaaagccugcu

SEQ ID NO: 10458 - RNA, 38 nt, Artificial Sequence
  Description of Artificial Sequence:  Enzymatic Nucleic Acid
acaacaaacugaugaggccguuaggccgaaauuugucc

SEQ ID NO: 10459 - RNA, 38 nt, Artificial Sequence
  Description of Artificial Sequence:  Enzymatic Nucleic Acid
gaacaacacugaugaggccguuaggccgaaagauuugu

SEQ ID NO: 10460 - RNA, 38 nt, Artificial Sequence
  Description of Artificial Sequence:  Enzymatic Nucleic Acid
ggaacaaccugaugaggccguuaggccgaaaagauuug

SEQ ID NO: 10461 - RNA, 38 nt, Artificial Sequence
  Description of Artificial Sequence:  Enzymatic Nucleic Acid
agaggaaccugaugaggccguuaggccgaaacaaagau

SEQ ID NO: 10462 - RNA, 38 nt, Artificial Sequence
  Description of Artificial Sequence:  Enzymatic Nucleic Acid
agaagaggcugaugaggccguuaggccgaaacaacaaa

SEQ ID NO: 10463 - RNA, 38 nt, Artificial Sequence
  Description of Artificial Sequence:  Enzymatic Nucleic Acid
aagaagagcugaugaggccguuaggccgaaaacaacaa

SEQ ID NO: 10464 - RNA, 38 nt, Artificial Sequence
  Description of Artificial Sequence:  Enzymatic Nucleic Acid
guaaagaacugaugaggccguuaggccgaaaggaacaa

SEQ ID NO: 10465 - RNA, 38 nt, Artificial Sequence
  Description of Artificial Sequence:  Enzymatic Nucleic Acid
guguaaagcugaugaggccguuaggccgaaagaggaac

SEQ ID NO: 10466 - RNA, 38 nt, Artificial Sequence
  Description of Artificial Sequence:  Enzymatic Nucleic Acid
uguguaaacugaugaggccguuaggccgaaaagaggaa

SEQ ID NO: 10467 - RNA, 38 nt, Artificial Sequence
  Description of Artificial Sequence:  Enzymatic Nucleic Acid
uauguguacugaugaggccguuaggccgaaagaagagg

SEQ ID NO: 10468 - RNA, 38 nt, Artificial Sequence
  Description of Artificial Sequence:  Enzymatic Nucleic Acid
guaugugucugaugaggccguuaggccgaaaagaagag

SEQ ID NO: 10469 - RNA, 38 nt, Artificial Sequence
  Description of Artificial Sequence:  Enzymatic Nucleic Acid
cguaugugcugaugaggccguuaggccgaaaaagaaga

SEQ ID NO: 10470 - RNA, 38 nt, Artificial Sequence
  Description of Artificial Sequence:  Enzymatic Nucleic Acid
gguuugcgcugaugaggccguuaggccgaaauguguaa

SEQ ID NO: 10471 - RNA, 38 nt, Artificial Sequence
  Description of Artificial Sequence:  Enzymatic Nucleic Acid
auuuauaacugaugaggccguuaggccgaaauugccag

SEQ ID NO: 10472 - RNA, 38 nt, Artificial Sequence
  Description of Artificial Sequence:  Enzymatic Nucleic Acid
gauuuauacugaugaggccguuaggccgaaaauugcca

SEQ ID NO: 10473 - RNA, 38 nt, Artificial Sequence
  Description of Artificial Sequence:  Enzymatic Nucleic Acid
ugauuuaucugaugaggccguuaggccgaaaaauugcc

SEQ ID NO: 10474 - RNA, 38 nt, Artificial Sequence
  Description of Artificial Sequence:  Enzymatic Nucleic Acid
cugauuuacugaugaggccguuaggccgaaaaaauugc

SEQ ID NO: 10475 - RNA, 38 nt, Artificial Sequence
  Description of Artificial Sequence:  Enzymatic Nucleic Acid
accugauucugaugaggccguuaggccgaaauaaaauu

SEQ ID NO: 10476 - RNA, 38 nt, Artificial Sequence
  Description of Artificial Sequence:  Enzymatic Nucleic Acid
aguuaccucugaugaggccguuaggccgaaauuuauaa

SEQ ID NO: 10477 - RNA, 38 nt, Artificial Sequence
  Description of Artificial Sequence:  Enzymatic Nucleic Acid
cuuccagucugaugaggccguuaggccgaaaccugauu

SEQ ID NO: 10478 - RNA, 38 nt, Artificial Sequence
  Description of Artificial Sequence:  Enzymatic Nucleic Acid
cugaguuucugaugaggccguuaggccgaaaccuccuu

SEQ ID NO: 10479 - RNA, 38 nt, Artificial Sequence
  Description of Artificial Sequence:  Enzymatic Nucleic Acid
ucugaguucugaugaggccguuaggccgaaaaccuccu

SEQ ID NO: 10480 - RNA, 38 nt, Artificial Sequence
  Description of Artificial Sequence:  Enzymatic Nucleic Acid
uuuuuucucugaugaggccguuaggccgaaaguuuaac

SEQ ID NO: 10481 - RNA, 38 nt, Artificial Sequence
  Description of Artificial Sequence:  Enzymatic Nucleic Acid
aauugacucugaugaggccguuaggccgaaaggucuuc

SEQ ID NO: 10482 - RNA, 38 nt, Artificial Sequence
  Description of Artificial Sequence:  Enzymatic Nucleic Acid
agagaauucugaugaggccguuaggccgaaacugaggu

SEQ ID NO: 10483 - RNA, 38 nt, Artificial Sequence
  Description of Artificial Sequence:  Enzymatic Nucleic Acid
aaguagagcugaugaggccguuaggccgaaauugacug

SEQ ID NO: 10484 - RNA, 38 nt, Artificial Sequence
  Description of Artificial Sequence:  Enzymatic Nucleic Acid
aaaguagacugaugaggccguuaggccgaaaauugacu

SEQ ID NO: 10485 - RNA, 38 nt, Artificial Sequence
  Description of Artificial Sequence:  Enzymatic Nucleic Acid
aaaaaguacugaugaggccguuaggccgaaagaauuga

SEQ ID NO: 10486 - RNA, 38 nt, Artificial Sequence
  Description of Artificial Sequence:  Enzymatic Nucleic Acid
aaaaaaagcugaugaggccguuaggccgaaagagaauu

SEQ ID NO: 10487 - RNA, 38 nt, Artificial Sequence
  Description of Artificial Sequence:  Enzymatic Nucleic Acid
aaaaaaaacugaugaggccguuaggccgaaaguagaga

SEQ ID NO: 10488 - RNA, 38 nt, Artificial Sequence
  Description of Artificial Sequence:  Enzymatic Nucleic Acid
aaaaaaaacugaugaggccguuaggccgaaaaguagag

SEQ ID NO: 10489 - RNA, 38 nt, Artificial Sequence
  Description of Artificial Sequence:  Enzymatic Nucleic Acid
aaaaaaaacugaugaggccguuaggccgaaaaaguaga

SEQ ID NO: 10490 - RNA, 38 nt, Artificial Sequence
  Description of Artificial Sequence:  Enzymatic Nucleic Acid
aaaaaaaacugaugaggccguuaggccgaaaaaaguag

SEQ ID NO: 10491 - RNA, 38 nt, Artificial Sequence
  Description of Artificial Sequence:  Enzymatic Nucleic Acid
aaaaaaaacugaugaggccguuaggccgaaaaaaagua

SEQ ID NO: 10492 - RNA, 38 nt, Artificial Sequence
  Description of Artificial Sequence:  Enzymatic Nucleic Acid
aaaaaaaacugaugaggccguuaggccgaaaaaaaagu

SEQ ID NO: 10493 - RNA, 38 nt, Artificial Sequence
  Description of Artificial Sequence:  Enzymatic Nucleic Acid
aaaaaaaacugaugaggccguuaggccgaaaaaaaaag

SEQ ID NO: 10494 - RNA, 38 nt, Artificial Sequence
  Description of Artificial Sequence:  Enzymatic Nucleic Acid
gaaaaaaacugaugaggccguuaggccgaaaaaaaaaa

SEQ ID NO: 10495 - RNA, 38 nt, Artificial Sequence
  Description of Artificial Sequence:  Enzymatic Nucleic Acid
ggaaaaaacugaugaggccguuaggccgaaaaaaaaaa

SEQ ID NO: 10496 - RNA, 38 nt, Artificial Sequence
  Description of Artificial Sequence:  Enzymatic Nucleic Acid
uggaaaaacugaugaggccguuaggccgaaaaaaaaaa

SEQ ID NO: 10497 - RNA, 38 nt, Artificial Sequence
  Description of Artificial Sequence:  Enzymatic Nucleic Acid
uuggaaaacugaugaggccguuaggccgaaaaaaaaaa

SEQ ID NO: 10498 - RNA, 38 nt, Artificial Sequence
  Description of Artificial Sequence:  Enzymatic Nucleic Acid
uuuggaaacugaugaggccguuaggccgaaaaaaaaaa

SEQ ID NO: 10499 - RNA, 38 nt, Artificial Sequence
  Description of Artificial Sequence:  Enzymatic Nucleic Acid
auuuggaacugaugaggccguuaggccgaaaaaaaaaa

SEQ ID NO: 10500 - RNA, 38 nt, Artificial Sequence
  Description of Artificial Sequence:  Enzymatic Nucleic Acid
gauuuggacugaugaggccguuaggccgaaaaaaaaaa

SEQ ID NO: 10501 - RNA, 38 nt, Artificial Sequence
  Description of Artificial Sequence:  Enzymatic Nucleic Acid
ugauuuggcugaugaggccguuaggccgaaaaaaaaaa

SEQ ID NO: 10502 - RNA, 38 nt, Artificial Sequence
  Description of Artificial Sequence:  Enzymatic Nucleic Acid
cugauuugcugaugaggccguuaggccgaaaaaaaaaa

SEQ ID NO: 10503 - RNA, 38 nt, Artificial Sequence
  Description of Artificial Sequence:  Enzymatic Nucleic Acid
uauuaucucugaugaggccguuaggccgaaauuuggaa

SEQ ID NO: 10504 - RNA, 38 nt, Artificial Sequence
  Description of Artificial Sequence:  Enzymatic Nucleic Acid
ugggcuaucugaugaggccguuaggccgaaaucugauu

SEQ ID NO: 10505 - RNA, 38 nt, Artificial Sequence
  Description of Artificial Sequence:  Enzymatic Nucleic Acid
ugcugggccugaugaggccguuaggccgaaauuaucug

SEQ ID NO: 10506 - RNA, 38 nt, Artificial Sequence
  Description of Artificial Sequence:  Enzymatic Nucleic Acid
guuaucaccugaugaggccguuaggccgaaauuugcug

SEQ ID NO: 10507 - RNA, 38 nt, Artificial Sequence
  Description of Artificial Sequence:  Enzymatic Nucleic Acid
uuauuugucugaugaggccguuaggccgaaaucacuau

SEQ ID NO: 10508 - RNA, 38 nt, Artificial Sequence
  Description of Artificial Sequence:  Enzymatic Nucleic Acid
uaagguuucugaugaggccguuaggccgaaauuuguua

SEQ ID NO: 10509 - RNA, 38 nt, Artificial Sequence
  Description of Artificial Sequence:  Enzymatic Nucleic Acid
gaacagcucugaugaggccguuaggccgaaagguuuua

SEQ ID NO: 10510 - RNA, 38 nt, Artificial Sequence
  Description of Artificial Sequence:  Enzymatic Nucleic Acid
ugaacagccugaugaggccguuaggccgaaaagguuuu

SEQ ID NO: 10511 - RNA, 38 nt, Artificial Sequence
  Description of Artificial Sequence:  Enzymatic Nucleic Acid
aagacaugcugaugaggccguuaggccgaaacagcuaa

SEQ ID NO: 10512 - RNA, 38 nt, Artificial Sequence
  Description of Artificial Sequence:  Enzymatic Nucleic Acid
caagacaucugaugaggccguuaggccgaaaacagcua

SEQ ID NO: 10513 - RNA, 38 nt, Artificial Sequence
  Description of Artificial Sequence:  Enzymatic Nucleic Acid
gaaaucaacugaugaggccguuaggccgaaacaugaac

SEQ ID NO: 10514 - RNA, 38 nt, Artificial Sequence
  Description of Artificial Sequence:  Enzymatic Nucleic Acid
uugaaauccugaugaggccguuaggccgaaagacauga

SEQ ID NO: 10515 - RNA, 38 nt, Artificial Sequence
  Description of Artificial Sequence:  Enzymatic Nucleic Acid
auuauugacugaugaggccguuaggccgaaaucaagac

SEQ ID NO: 10516 - RNA, 38 nt, Artificial Sequence
  Description of Artificial Sequence:  Enzymatic Nucleic Acid
aauuauugcugaugaggccguuaggccgaaaaucaaga

SEQ ID NO: 10517 - RNA, 38 nt, Artificial Sequence
  Description of Artificial Sequence:  Enzymatic Nucleic Acid
uaauuauucugaugaggccguuaggccgaaaaaucaag

SEQ ID NO: 10518 - RNA, 38 nt, Artificial Sequence
  Description of Artificial Sequence:  Enzymatic Nucleic Acid
gaauuaaucugaugaggccguuaggccgaaauugaaau

SEQ ID NO: 10519 - RNA, 38 nt, Artificial Sequence
  Description of Artificial Sequence:  Enzymatic Nucleic Acid
uaagaauucugaugaggccguuaggccgaaauuauuga

SEQ ID NO: 10520 - RNA, 38 nt, Artificial Sequence
  Description of Artificial Sequence:  Enzymatic Nucleic Acid
uuaagaaucugaugaggccguuaggccgaaaauuauug

SEQ ID NO: 10521 - RNA, 38 nt, Artificial Sequence
  Description of Artificial Sequence:  Enzymatic Nucleic Acid
ugauuaagcugaugaggccguuaggccgaaauuaauua

SEQ ID NO: 10522 - RNA, 38 nt, Artificial Sequence
  Description of Artificial Sequence:  Enzymatic Nucleic Acid
augauuaacugaugaggccguuaggccgaaaauuaauu

SEQ ID NO: 10523 - RNA, 38 nt, Artificial Sequence
  Description of Artificial Sequence:  Enzymatic Nucleic Acid
uaaugauucugaugaggccguuaggccgaaagaauuaa

SEQ ID NO: 10524 - RNA, 38 nt, Artificial Sequence
  Description of Artificial Sequence:  Enzymatic Nucleic Acid
uuaaugaucugaugaggccguuaggccgaaaagaauua

SEQ ID NO: 10525 - RNA, 38 nt, Artificial Sequence
  Description of Artificial Sequence:  Enzymatic Nucleic Acid
cucuuaaucugaugaggccguuaggccgaaauuaagaa

SEQ ID NO: 10526 - RNA, 38 nt, Artificial Sequence
  Description of Artificial Sequence:  Enzymatic Nucleic Acid
ggucucuucugaugaggccguuaggccgaaaugauuaa

SEQ ID NO: 10527 - RNA, 38 nt, Artificial Sequence
  Description of Artificial Sequence:  Enzymatic Nucleic Acid
uggucucucugaugaggccguuaggccgaaaaugauua

SEQ ID NO: 10528 - RNA, 38 nt, Artificial Sequence
  Description of Artificial Sequence:  Enzymatic Nucleic Acid
guauuuaucugaugaggccguuaggccgaaauggucuc

SEQ ID NO: 10529 - RNA, 38 nt, Artificial Sequence
  Description of Artificial Sequence:  Enzymatic Nucleic Acid
ggaguauucugaugaggccguuaggccgaaauuauggu

SEQ ID NO: 10530 - RNA, 38 nt, Artificial Sequence
  Description of Artificial Sequence:  Enzymatic Nucleic Acid
aaaaggagcugaugaggccguuaggccgaaauuuauua

SEQ ID NO: 10531 - RNA, 38 nt, Artificial Sequence
  Description of Artificial Sequence:  Enzymatic Nucleic Acid
uugaaaagcugaugaggccguuaggccgaaaguauuua

SEQ ID NO: 10532 - RNA, 38 nt, Artificial Sequence
  Description of Artificial Sequence:  Enzymatic Nucleic Acid
cucuugaacugaugaggccguuaggccgaaaggaguau

SEQ ID NO: 10533 - RNA, 38 nt, Artificial Sequence
  Description of Artificial Sequence:  Enzymatic Nucleic Acid
ucucuugacugaugaggccguuaggccgaaaaggagua

SEQ ID NO: 10534 - RNA, 38 nt, Artificial Sequence
  Description of Artificial Sequence:  Enzymatic Nucleic Acid
uucucuugcugaugaggccguuaggccgaaaaaggagu

SEQ ID NO: 10535 - RNA, 38 nt, Artificial Sequence
  Description of Artificial Sequence:  Enzymatic Nucleic Acid
uuucucuucugaugaggccguuaggccgaaaaaaggag

SEQ ID NO: 10536 - RNA, 38 nt, Artificial Sequence
  Description of Artificial Sequence:  Enzymatic Nucleic Acid
acaauucucugaugaggccguuaggccgaaaugguuuu

SEQ ID NO: 10537 - RNA, 38 nt, Artificial Sequence
  Description of Artificial Sequence:  Enzymatic Nucleic Acid
aacaauuccugaugaggccguuaggccgaaaaugguuu

SEQ ID NO: 10538 - RNA, 38 nt, Artificial Sequence
  Description of Artificial Sequence:  Enzymatic Nucleic Acid
ugaguaaccugaugaggccguuaggccgaaauucuaau

SEQ ID NO: 10539 - RNA, 38 nt, Artificial Sequence
  Description of Artificial Sequence:  Enzymatic Nucleic Acid
agcugagucugaugaggccguuaggccgaaacaauucu

SEQ ID NO: 10540 - RNA, 38 nt, Artificial Sequence
  Description of Artificial Sequence:  Enzymatic Nucleic Acid
gagcugagcugaugaggccguuaggccgaaaacaauuc

SEQ ID NO: 10541 - RNA, 38 nt, Artificial Sequence
  Description of Artificial Sequence:  Enzymatic Nucleic Acid
aaggagcucugaugaggccguuaggccgaaaguaacaa

SEQ ID NO: 10542 - RNA, 38 nt, Artificial Sequence
  Description of Artificial Sequence:  Enzymatic Nucleic Acid
guuugaagcugaugaggccguuaggccgaaagcugagu

SEQ ID NO: 10543 - RNA, 38 nt, Artificial Sequence
  Description of Artificial Sequence:  Enzymatic Nucleic Acid
ugaguuugcugaugaggccguuaggccgaaaggagcug

SEQ ID NO: 10544 - RNA, 38 nt, Artificial Sequence
  Description of Artificial Sequence:  Enzymatic Nucleic Acid
cugaguuucugaugaggccguuaggccgaaaaggagcu

SEQ ID NO: 10545 - RNA, 38 nt, Artificial Sequence
  Description of Artificial Sequence:  Enzymatic Nucleic Acid
acaaaccucugaugaggccguuaggccgaaaguuugaa

SEQ ID NO: 10546 - RNA, 38 nt, Artificial Sequence
  Description of Artificial Sequence:  Enzymatic Nucleic Acid
augcuacacugaugaggccguuaggccgaaaccugagu

SEQ ID NO: 10547 - RNA, 38 nt, Artificial Sequence
  Description of Artificial Sequence:  Enzymatic Nucleic Acid
uaugcuaccugaugaggccguuaggccgaaaaccugag

SEQ ID NO: 10548 - RNA, 38 nt, Artificial Sequence
  Description of Artificial Sequence:  Enzymatic Nucleic Acid
auguaugccugaugaggccguuaggccgaaacaaaccu

SEQ ID NO: 10549 - RNA, 38 nt, Artificial Sequence
  Description of Artificial Sequence:  Enzymatic Nucleic Acid
gacucaugcugaugaggccguuaggccgaaaugcuaca

SEQ ID NO: 10550 - RNA, 38 nt, Artificial Sequence
  Description of Artificial Sequence:  Enzymatic Nucleic Acid
gauggaugcugaugaggccguuaggccgaaacucaugu

SEQ ID NO: 10551 - RNA, 38 nt, Artificial Sequence
  Description of Artificial Sequence:  Enzymatic Nucleic Acid
gacugaugcugaugaggccguuaggccgaaauggacuc

SEQ ID NO: 10552 - RNA, 38 nt, Artificial Sequence
  Description of Artificial Sequence:  Enzymatic Nucleic Acid
cuuugacucugaugaggccguuaggccgaaauggaugg

SEQ ID NO: 10553 - RNA, 38 nt, Artificial Sequence
  Description of Artificial Sequence:  Enzymatic Nucleic Acid
cauucuuucugaugaggccguuaggccgaaacugaugg

SEQ ID NO: 10554 - RNA, 38 nt, Artificial Sequence
  Description of Artificial Sequence:  Enzymatic Nucleic Acid
ccagauggcugaugaggccguuaggccgaaaccauucu

SEQ ID NO: 10555 - RNA, 38 nt, Artificial Sequence
  Description of Artificial Sequence:  Enzymatic Nucleic Acid
uccagaugcugaugaggccguuaggccgaaaaccauuc

SEQ ID NO: 10556 - RNA, 38 nt, Artificial Sequence
  Description of Artificial Sequence:  Enzymatic Nucleic Acid
agacuccacugaugaggccguuaggccgaaauggaacc

SEQ ID NO: 10557 - RNA, 38 nt, Artificial Sequence
  Description of Artificial Sequence:  Enzymatic Nucleic Acid
uacauuaacugaugaggccguuaggccgaaacuccaga

SEQ ID NO: 10558 - RNA, 38 nt, Artificial Sequence
  Description of Artificial Sequence:  Enzymatic Nucleic Acid
ucuacauucugaugaggccguuaggccgaaagacucca

SEQ ID NO: 10559 - RNA, 38 nt, Artificial Sequence
  Description of Artificial Sequence:  Enzymatic Nucleic Acid
uucuacaucugaugaggccguuaggccgaaaagacucc

SEQ ID NO: 10560 - RNA, 38 nt, Artificial Sequence
  Description of Artificial Sequence:  Enzymatic Nucleic Acid
uuucuuuccugaugaggccguuaggccgaaacauuaag

SEQ ID NO: 10561 - RNA, 38 nt, Artificial Sequence
  Description of Artificial Sequence:  Enzymatic Nucleic Acid
auuauuaccugaugaggccguuaggccgaaagucucca

SEQ ID NO: 10562 - RNA, 38 nt, Artificial Sequence
  Description of Artificial Sequence:  Enzymatic Nucleic Acid
cucauuaucugaugaggccguuaggccgaaacaagucu

SEQ ID NO: 10563 - RNA, 38 nt, Artificial Sequence
  Description of Artificial Sequence:  Enzymatic Nucleic Acid
uagcucaucugaugaggccguuaggccgaaauuacaag

SEQ ID NO: 10564 - RNA, 38 nt, Artificial Sequence
  Description of Artificial Sequence:  Enzymatic Nucleic Acid
uuuguaaccugaugaggccguuaggccgaaagcucauu

SEQ ID NO: 10565 - RNA, 38 nt, Artificial Sequence
  Description of Artificial Sequence:  Enzymatic Nucleic Acid
cacuuugucugaugaggccguuaggccgaaacuagcuc

SEQ ID NO: 10566 - RNA, 38 nt, Artificial Sequence
  Description of Artificial Sequence:  Enzymatic Nucleic Acid
gcacuuugcugaugaggccguuaggccgaaaacuagcu

SEQ ID NO: 10567 - RNA, 38 nt, Artificial Sequence
  Description of Artificial Sequence:  Enzymatic Nucleic Acid
uaaugaaccugaugaggccguuaggccgaaagcacuuu

SEQ ID NO: 10568 - RNA, 38 nt, Artificial Sequence
  Description of Artificial Sequence:  Enzymatic Nucleic Acid
uuuuaaugcugaugaggccguuaggccgaaacaagcac

SEQ ID NO: 10569 - RNA, 38 nt, Artificial Sequence
  Description of Artificial Sequence:  Enzymatic Nucleic Acid
auuuuaaucugaugaggccguuaggccgaaaacaagca

SEQ ID NO: 10570 - RNA, 38 nt, Artificial Sequence
  Description of Artificial Sequence:  Enzymatic Nucleic Acid
gcuauuuucugaugaggccguuaggccgaaaugaacaa

SEQ ID NO: 10571 - RNA, 38 nt, Artificial Sequence
  Description of Artificial Sequence:  Enzymatic Nucleic Acid
ugcuauuucugaugaggccguuaggccgaaaaugaaca

SEQ ID NO: 10572 - RNA, 38 nt, Artificial Sequence
  Description of Artificial Sequence:  Enzymatic Nucleic Acid
uucagugccugaugaggccguuaggccgaaauuuuaau

SEQ ID NO: 10573 - RNA, 38 nt, Artificial Sequence
  Description of Artificial Sequence:  Enzymatic Nucleic Acid
cauguuuccugaugaggccguuaggccgaaauuuucag

SEQ ID NO: 10574 - RNA, 38 nt, Artificial Sequence
  Description of Artificial Sequence:  Enzymatic Nucleic Acid
uaucaguucugaugaggccguuaggccgaaauucaugu

SEQ ID NO: 10575 - RNA, 38 nt, Artificial Sequence
  Description of Artificial Sequence:  Enzymatic Nucleic Acid
uuaucagucugaugaggccguuaggccgaaaauucaug

SEQ ID NO: 10576 - RNA, 38 nt, Artificial Sequence
  Description of Artificial Sequence:  Enzymatic Nucleic Acid
uggaauaucugaugaggccguuaggccgaaaucaguua

SEQ ID NO: 10577 - RNA, 38 nt, Artificial Sequence
  Description of Artificial Sequence:  Enzymatic Nucleic Acid
gauuggaacugaugaggccguuaggccgaaauuaucag

SEQ ID NO: 10578 - RNA, 38 nt, Artificial Sequence
  Description of Artificial Sequence:  Enzymatic Nucleic Acid
augauuggcugaugaggccguuaggccgaaauauuauc

SEQ ID NO: 10579 - RNA, 38 nt, Artificial Sequence
  Description of Artificial Sequence:  Enzymatic Nucleic Acid
aaugauugcugaugaggccguuaggccgaaaauauuau

SEQ ID NO: 10580 - RNA, 38 nt, Artificial Sequence
  Description of Artificial Sequence:  Enzymatic Nucleic Acid
uggcaaaucugaugaggccguuaggccgaaauuggaau

SEQ ID NO: 10581 - RNA, 38 nt, Artificial Sequence
  Description of Artificial Sequence:  Enzymatic Nucleic Acid
aaauggcacugaugaggccguuaggccgaaaugauugg

SEQ ID NO: 10582 - RNA, 38 nt, Artificial Sequence
  Description of Artificial Sequence:  Enzymatic Nucleic Acid
uaaauggccugaugaggccguuaggccgaaaaugauug

SEQ ID NO: 10583 - RNA, 38 nt, Artificial Sequence
  Description of Artificial Sequence:  Enzymatic Nucleic Acid
uugucauacugaugaggccguuaggccgaaauggcaaa

SEQ ID NO: 10584 - RNA, 38 nt, Artificial Sequence
  Description of Artificial Sequence:  Enzymatic Nucleic Acid
uuugucaucugaugaggccguuaggccgaaaauggcaa

SEQ ID NO: 10585 - RNA, 38 nt, Artificial Sequence
  Description of Artificial Sequence:  Enzymatic Nucleic Acid
uuuugucacugaugaggccguuaggccgaaaaauggca

SEQ ID NO: 10586 - RNA, 38 nt, Artificial Sequence
  Description of Artificial Sequence:  Enzymatic Nucleic Acid
uuagugcccugaugaggccguuaggccgaaaccauuuu

SEQ ID NO: 10587 - RNA, 38 nt, Artificial Sequence
  Description of Artificial Sequence:  Enzymatic Nucleic Acid
uucuuugucugaugaggccguuaggccgaaagugccaa

SEQ ID NO: 10588 - RNA, 38 nt, Artificial Sequence
  Description of Artificial Sequence:  Enzymatic Nucleic Acid
cugaaaggcugaugaggccguuaggccgaaagugcucg

SEQ ID NO: 10589 - RNA, 38 nt, Artificial Sequence
  Description of Artificial Sequence:  Enzymatic Nucleic Acid
ucugaaagcugaugaggccguuaggccgaaaagugcuc

SEQ ID NO: 10590 - RNA, 38 nt, Artificial Sequence
  Description of Artificial Sequence:  Enzymatic Nucleic Acid
aacucugacugaugaggccguuaggccgaaaggaagug

SEQ ID NO: 10591 - RNA, 38 nt, Artificial Sequence
  Description of Artificial Sequence:  Enzymatic Nucleic Acid
aaacucugcugaugaggccguuaggccgaaaaggaagu

SEQ ID NO: 10592 - RNA, 38 nt, Artificial Sequence
  Description of Artificial Sequence:  Enzymatic Nucleic Acid
gaaacucucugaugaggccguuaggccgaaaaaggaag

SEQ ID NO: 10593 - RNA, 38 nt, Artificial Sequence
  Description of Artificial Sequence:  Enzymatic Nucleic Acid
aucucagacugaugaggccguuaggccgaaacucugaa

SEQ ID NO: 10594 - RNA, 38 nt, Artificial Sequence
  Description of Artificial Sequence:  Enzymatic Nucleic Acid
uaucucagcugaugaggccguuaggccgaaaacucuga

SEQ ID NO: 10595 - RNA, 38 nt, Artificial Sequence
  Description of Artificial Sequence:  Enzymatic Nucleic Acid
uuaucucacugaugaggccguuaggccgaaaaacucug

SEQ ID NO: 10596 - RNA, 38 nt, Artificial Sequence
  Description of Artificial Sequence:  Enzymatic Nucleic Acid
acguacaucugaugaggccguuaggccgaaaucucaga

SEQ ID NO: 10597 - RNA, 38 nt, Artificial Sequence
  Description of Artificial Sequence:  Enzymatic Nucleic Acid
guuccacgcugaugaggccguuaggccgaaacauuauc

SEQ ID NO: 10598 - RNA, 38 nt, Artificial Sequence
  Description of Artificial Sequence:  Enzymatic Nucleic Acid
uccacccacugaugaggccguuaggccgaaacuguucc

SEQ ID NO: 10599 - RNA, 38 nt, Artificial Sequence
  Description of Artificial Sequence:  Enzymatic Nucleic Acid
aagacacacugaugaggccguuaggccgaaacuugcac

SEQ ID NO: 10600 - RNA, 38 nt, Artificial Sequence
  Description of Artificial Sequence:  Enzymatic Nucleic Acid
acugacaacugaugaggccguuaggccgaaacacagac

SEQ ID NO: 10601 - RNA, 38 nt, Artificial Sequence
  Description of Artificial Sequence:  Enzymatic Nucleic Acid
ggacugaccugaugaggccguuaggccgaaagacacag

SEQ ID NO: 10602 - RNA, 38 nt, Artificial Sequence
  Description of Artificial Sequence:  Enzymatic Nucleic Acid
cuuggacucugaugaggccguuaggccgaaacaagaca

SEQ ID NO: 10603 - RNA, 38 nt, Artificial Sequence
  Description of Artificial Sequence:  Enzymatic Nucleic Acid
acuucuugcugaugaggccguuaggccgaaacugacaa

SEQ ID NO: 10604 - RNA, 38 nt, Artificial Sequence
  Description of Artificial Sequence:  Enzymatic Nucleic Acid
cuaaaauucugaugaggccguuaggccgaaacaucucg

SEQ ID NO: 10605 - RNA, 38 nt, Artificial Sequence
  Description of Artificial Sequence:  Enzymatic Nucleic Acid
ccuaaaaucugaugaggccguuaggccgaaaacaucuc

SEQ ID NO: 10606 - RNA, 38 nt, Artificial Sequence
  Description of Artificial Sequence:  Enzymatic Nucleic Acid
gucccuaacugaugaggccguuaggccgaaauuaacau

SEQ ID NO: 10607 - RNA, 38 nt, Artificial Sequence
  Description of Artificial Sequence:  Enzymatic Nucleic Acid
ggucccuacugaugaggccguuaggccgaaaauuaaca

SEQ ID NO: 10608 - RNA, 38 nt, Artificial Sequence
  Description of Artificial Sequence:  Enzymatic Nucleic Acid
gggucccucugaugaggccguuaggccgaaaaauuaac

SEQ ID NO: 10609 - RNA, 38 nt, Artificial Sequence
  Description of Artificial Sequence:  Enzymatic Nucleic Acid
cggguccccugaugaggccguuaggccgaaaaaauuaa

SEQ ID NO: 10610 - RNA, 38 nt, Artificial Sequence
  Description of Artificial Sequence:  Enzymatic Nucleic Acid
uaggaaaccugaugaggccguuaggccgaaaggcacgg

SEQ ID NO: 10611 - RNA, 38 nt, Artificial Sequence
  Description of Artificial Sequence:  Enzymatic Nucleic Acid
ggcuaggacugaugaggccguuaggccgaaacaaggca

SEQ ID NO: 10612 - RNA, 38 nt, Artificial Sequence
  Description of Artificial Sequence:  Enzymatic Nucleic Acid
gggcuaggcugaugaggccguuaggccgaaaacaaggc

SEQ ID NO: 10613 - RNA, 38 nt, Artificial Sequence
  Description of Artificial Sequence:  Enzymatic Nucleic Acid
ugggcuagcugaugaggccguuaggccgaaaaacaagg

SEQ ID NO: 10614 - RNA, 38 nt, Artificial Sequence
  Description of Artificial Sequence:  Enzymatic Nucleic Acid
uugugggccugaugaggccguuaggccgaaaggaaaca

SEQ ID NO: 10615 - RNA, 38 nt, Artificial Sequence
  Description of Artificial Sequence:  Enzymatic Nucleic Acid
aucuguuucugaugaggccguuaggccgaaauguuugc

SEQ ID NO: 10616 - RNA, 38 nt, Artificial Sequence
  Description of Artificial Sequence:  Enzymatic Nucleic Acid
cuagcgagcugaugaggccguuaggccgaaaucuguuu

SEQ ID NO: 10617 - RNA, 38 nt, Artificial Sequence
  Description of Artificial Sequence:  Enzymatic Nucleic Acid
aggcuagccugaugaggccguuaggccgaaaguaucug

SEQ ID NO: 10618 - RNA, 38 nt, Artificial Sequence
  Description of Artificial Sequence:  Enzymatic Nucleic Acid
aaugaggccugaugaggccguuaggccgaaagcgagua

SEQ ID NO: 10619 - RNA, 38 nt, Artificial Sequence
  Description of Artificial Sequence:  Enzymatic Nucleic Acid
auuuaaaucugaugaggccguuaggccgaaaggcuagc

SEQ ID NO: 10620 - RNA, 38 nt, Artificial Sequence
  Description of Artificial Sequence:  Enzymatic Nucleic Acid
ucaauuuacugaugaggccguuaggccgaaaugaggcu

SEQ ID NO: 10621 - RNA, 38 nt, Artificial Sequence
  Description of Artificial Sequence:  Enzymatic Nucleic Acid
aucaauuucugaugaggccguuaggccgaaaaugaggc

SEQ ID NO: 10622 - RNA, 38 nt, Artificial Sequence
  Description of Artificial Sequence:  Enzymatic Nucleic Acid
aaucaauucugaugaggccguuaggccgaaaaaugagg

SEQ ID NO: 10623 - RNA, 38 nt, Artificial Sequence
  Description of Artificial Sequence:  Enzymatic Nucleic Acid
cuuuaauccugaugaggccguuaggccgaaauuuaaau

SEQ ID NO: 10624 - RNA, 38 nt, Artificial Sequence
  Description of Artificial Sequence:  Enzymatic Nucleic Acid
ccuccuuucugaugaggccguuaggccgaaaucaauuu

SEQ ID NO: 10625 - RNA, 38 nt, Artificial Sequence
  Description of Artificial Sequence:  Enzymatic Nucleic Acid
uccuccuucugaugaggccguuaggccgaaaaucaauu

SEQ ID NO: 10626 - RNA, 38 nt, Artificial Sequence
  Description of Artificial Sequence:  Enzymatic Nucleic Acid
cggccaaacugaugaggccguuaggccgaaaugcacuc

SEQ ID NO: 10627 - RNA, 38 nt, Artificial Sequence
  Description of Artificial Sequence:  Enzymatic Nucleic Acid
gucggccacugaugaggccguuaggccgaaagaugcac

SEQ ID NO: 10628 - RNA, 38 nt, Artificial Sequence
  Description of Artificial Sequence:  Enzymatic Nucleic Acid
ugucggcccugaugaggccguuaggccgaaaagaugca

SEQ ID NO: 10629 - RNA, 38 nt, Artificial Sequence
  Description of Artificial Sequence:  Enzymatic Nucleic Acid
cacacagucugaugaggccguuaggccgaaacaccacu

SEQ ID NO: 10630 - RNA, 38 nt, Artificial Sequence
  Description of Artificial Sequence:  Enzymatic Nucleic Acid
aacacacacugaugaggccguuaggccgaaacacccac

SEQ ID NO: 10631 - RNA, 38 nt, Artificial Sequence
  Description of Artificial Sequence:  Enzymatic Nucleic Acid
augcacaacugaugaggccguuaggccgaaacacacau

SEQ ID NO: 10632 - RNA, 38 nt, Artificial Sequence
  Description of Artificial Sequence:  Enzymatic Nucleic Acid
uaugcacacugaugaggccguuaggccgaaaacacaca

SEQ ID NO: 10633 - RNA, 38 nt, Artificial Sequence
  Description of Artificial Sequence:  Enzymatic Nucleic Acid
uuaugcaccugaugaggccguuaggccgaaaaacacac

SEQ ID NO: 10634 - RNA, 38 nt, Artificial Sequence
  Description of Artificial Sequence:  Enzymatic Nucleic Acid
uaaauagucugaugaggccguuaggccgaaaugcacaa

SEQ ID NO: 10635 - RNA, 38 nt, Artificial Sequence
  Description of Artificial Sequence:  Enzymatic Nucleic Acid
uccuuaaacugaugaggccguuaggccgaaaguuaugc

SEQ ID NO: 10636 - RNA, 38 nt, Artificial Sequence
  Description of Artificial Sequence:  Enzymatic Nucleic Acid
uuuccuuacugaugaggccguuaggccgaaauaguuau

SEQ ID NO: 10637 - RNA, 38 nt, Artificial Sequence
  Description of Artificial Sequence:  Enzymatic Nucleic Acid
guuuccuucugaugaggccguuaggccgaaaauaguua

SEQ ID NO: 10638 - RNA, 38 nt, Artificial Sequence
  Description of Artificial Sequence:  Enzymatic Nucleic Acid
aguuuccucugaugaggccguuaggccgaaaaauaguu

SEQ ID NO: 10639 - RNA, 38 nt, Artificial Sequence
  Description of Artificial Sequence:  Enzymatic Nucleic Acid
aacuuuaacugaugaggccguuaggccgaaauuccagu

SEQ ID NO: 10640 - RNA, 38 nt, Artificial Sequence
  Description of Artificial Sequence:  Enzymatic Nucleic Acid
uaacuuuacugaugaggccguuaggccgaaaauuccag

SEQ ID NO: 10641 - RNA, 38 nt, Artificial Sequence
  Description of Artificial Sequence:  Enzymatic Nucleic Acid
guaacuuucugaugaggccguuaggccgaaaaauucca

SEQ ID NO: 10642 - RNA, 38 nt, Artificial Sequence
  Description of Artificial Sequence:  Enzymatic Nucleic Acid
aguaacuucugaugaggccguuaggccgaaaaaauucc

SEQ ID NO: 10643 - RNA, 38 nt, Artificial Sequence
  Description of Artificial Sequence:  Enzymatic Nucleic Acid
auaaaagucugaugaggccguuaggccgaaacuuuaaa

SEQ ID NO: 10644 - RNA, 38 nt, Artificial Sequence
  Description of Artificial Sequence:  Enzymatic Nucleic Acid
uauaaaagcugaugaggccguuaggccgaaaacuuuaa

SEQ ID NO: 10645 - RNA, 38 nt, Artificial Sequence
  Description of Artificial Sequence:  Enzymatic Nucleic Acid
uuguauaacugaugaggccguuaggccgaaaguaacuu

SEQ ID NO: 10646 - RNA, 38 nt, Artificial Sequence
  Description of Artificial Sequence:  Enzymatic Nucleic Acid
uuuguauacugaugaggccguuaggccgaaaaguaacu

SEQ ID NO: 10647 - RNA, 38 nt, Artificial Sequence
  Description of Artificial Sequence:  Enzymatic Nucleic Acid
guuuguaucugaugaggccguuaggccgaaaaaguaac

SEQ ID NO: 10648 - RNA, 38 nt, Artificial Sequence
  Description of Artificial Sequence:  Enzymatic Nucleic Acid
gguuuguacugaugaggccguuaggccgaaaaaaguaa

SEQ ID NO: 10649 - RNA, 38 nt, Artificial Sequence
  Description of Artificial Sequence:  Enzymatic Nucleic Acid
uugguuugcugaugaggccguuaggccgaaauaaaagu

SEQ ID NO: 10650 - RNA, 38 nt, Artificial Sequence
  Description of Artificial Sequence:  Enzymatic Nucleic Acid
guagcauacugaugaggccguuaggccgaaauucuugg

SEQ ID NO: 10651 - RNA, 38 nt, Artificial Sequence
  Description of Artificial Sequence:  Enzymatic Nucleic Acid
cuguagcacugaugaggccguuaggccgaaauauucuu

SEQ ID NO: 10652 - RNA, 38 nt, Artificial Sequence
  Description of Artificial Sequence:  Enzymatic Nucleic Acid
uauaucugcugaugaggccguuaggccgaaagcauaua

SEQ ID NO: 10653 - RNA, 38 nt, Artificial Sequence
  Description of Artificial Sequence:  Enzymatic Nucleic Acid
cugucuuacugaugaggccguuaggccgaaaucuguag

SEQ ID NO: 10654 - RNA, 38 nt, Artificial Sequence
  Description of Artificial Sequence:  Enzymatic Nucleic Acid
gucugucucugaugaggccguuaggccgaaauaucugu

SEQ ID NO: 10655 - RNA, 38 nt, Artificial Sequence
  Description of Artificial Sequence:  Enzymatic Nucleic Acid
uaggaccacugaugaggccguuaggccgaaaccauguc

SEQ ID NO: 10656 - RNA, 38 nt, Artificial Sequence
  Description of Artificial Sequence:  Enzymatic Nucleic Acid
auaggacccugaugaggccguuaggccgaaaaccaugu

SEQ ID NO: 10657 - RNA, 38 nt, Artificial Sequence
  Description of Artificial Sequence:  Enzymatic Nucleic Acid
aaauauagcugaugaggccguuaggccgaaaccaaacc

SEQ ID NO: 10658 - RNA, 38 nt, Artificial Sequence
  Description of Artificial Sequence:  Enzymatic Nucleic Acid
uagaaauacugaugaggccguuaggccgaaaggaccaa

SEQ ID NO: 10659 - RNA, 38 nt, Artificial Sequence
  Description of Artificial Sequence:  Enzymatic Nucleic Acid
acuagaaacugaugaggccguuaggccgaaauaggacc

SEQ ID NO: 10660 - RNA, 38 nt, Artificial Sequence
  Description of Artificial Sequence:  Enzymatic Nucleic Acid
ugacuagacugaugaggccguuaggccgaaauauagga

SEQ ID NO: 10661 - RNA, 38 nt, Artificial Sequence
  Description of Artificial Sequence:  Enzymatic Nucleic Acid
augacuagcugaugaggccguuaggccgaaaauauagg

SEQ ID NO: 10662 - RNA, 38 nt, Artificial Sequence
  Description of Artificial Sequence:  Enzymatic Nucleic Acid
caugacuacugaugaggccguuaggccgaaaaauauag

SEQ ID NO: 10663 - RNA, 38 nt, Artificial Sequence
  Description of Artificial Sequence:  Enzymatic Nucleic Acid
aucaugaccugaugaggccguuaggccgaaagaaauau

SEQ ID NO: 10664 - RNA, 38 nt, Artificial Sequence
  Description of Artificial Sequence:  Enzymatic Nucleic Acid
uucaucaucugaugaggccguuaggccgaaacuagaaa

SEQ ID NO: 10665 - RNA, 38 nt, Artificial Sequence
  Description of Artificial Sequence:  Enzymatic Nucleic Acid
auacaaaacugaugaggccguuaggccgaaacauucau

SEQ ID NO: 10666 - RNA, 38 nt, Artificial Sequence
  Description of Artificial Sequence:  Enzymatic Nucleic Acid
guauacaacugaugaggccguuaggccgaaauacauuc

SEQ ID NO: 10667 - RNA, 38 nt, Artificial Sequence
  Description of Artificial Sequence:  Enzymatic Nucleic Acid
gguauacacugaugaggccguuaggccgaaaauacauu

SEQ ID NO: 10668 - RNA, 38 nt, Artificial Sequence
  Description of Artificial Sequence:  Enzymatic Nucleic Acid
ugguauaccugaugaggccguuaggccgaaaaauacau

SEQ ID NO: 10669 - RNA, 38 nt, Artificial Sequence
  Description of Artificial Sequence:  Enzymatic Nucleic Acid
agaugguacugaugaggccguuaggccgaaacaaaaua

SEQ ID NO: 10670 - RNA, 38 nt, Artificial Sequence
  Description of Artificial Sequence:  Enzymatic Nucleic Acid
gaagauggcugaugaggccguuaggccgaaauacaaaa

SEQ ID NO: 10671 - RNA, 38 nt, Artificial Sequence
  Description of Artificial Sequence:  Enzymatic Nucleic Acid
uauaugaacugaugaggccguuaggccgaaaugguaua

SEQ ID NO: 10672 - RNA, 38 nt, Artificial Sequence
  Description of Artificial Sequence:  Enzymatic Nucleic Acid
auuauaugcugaugaggccguuaggccgaaagauggua

SEQ ID NO: 10673 - RNA, 38 nt, Artificial Sequence
  Description of Artificial Sequence:  Enzymatic Nucleic Acid
uauuauaucugaugaggccguuaggccgaaaagauggu

SEQ ID NO: 10674 - RNA, 38 nt, Artificial Sequence
  Description of Artificial Sequence:  Enzymatic Nucleic Acid
guauauuacugaugaggccguuaggccgaaaugaagau

SEQ ID NO: 10675 - RNA, 38 nt, Artificial Sequence
  Description of Artificial Sequence:  Enzymatic Nucleic Acid
aaguauaucugaugaggccguuaggccgaaauaugaag

SEQ ID NO: 10676 - RNA, 38 nt, Artificial Sequence
  Description of Artificial Sequence:  Enzymatic Nucleic Acid
uuuaaguacugaugaggccguuaggccgaaauuauaug

SEQ ID NO: 10677 - RNA, 38 nt, Artificial Sequence
  Description of Artificial Sequence:  Enzymatic Nucleic Acid
uuuuuaagcugaugaggccguuaggccgaaauauuaua

SEQ ID NO: 10678 - RNA, 38 nt, Artificial Sequence
  Description of Artificial Sequence:  Enzymatic Nucleic Acid
auauuuuucugaugaggccguuaggccgaaaguauauu

SEQ ID NO: 10679 - RNA, 38 nt, Artificial Sequence
  Description of Artificial Sequence:  Enzymatic Nucleic Acid
aauauuuucugaugaggccguuaggccgaaaaguauau

SEQ ID NO: 10680 - RNA, 38 nt, Artificial Sequence
  Description of Artificial Sequence:  Enzymatic Nucleic Acid
uuaagaaacugaugaggccguuaggccgaaauuuuuaa

SEQ ID NO: 10681 - RNA, 38 nt, Artificial Sequence
  Description of Artificial Sequence:  Enzymatic Nucleic Acid
aauuaagacugaugaggccguuaggccgaaauauuuuu

SEQ ID NO: 10682 - RNA, 38 nt, Artificial Sequence
  Description of Artificial Sequence:  Enzymatic Nucleic Acid
caauuaagcugaugaggccguuaggccgaaaauauuuu

SEQ ID NO: 10683 - RNA, 38 nt, Artificial Sequence
  Description of Artificial Sequence:  Enzymatic Nucleic Acid
ccaauuaacugaugaggccguuaggccgaaaaauauuu

SEQ ID NO: 10684 - RNA, 38 nt, Artificial Sequence
  Description of Artificial Sequence:  Enzymatic Nucleic Acid
ucccaauucugaugaggccguuaggccgaaagaaauau

SEQ ID NO: 10685 - RNA, 38 nt, Artificial Sequence
  Description of Artificial Sequence:  Enzymatic Nucleic Acid
aucccaaucugaugaggccguuaggccgaaaagaaaua

SEQ ID NO: 10686 - RNA, 38 nt, Artificial Sequence
  Description of Artificial Sequence:  Enzymatic Nucleic Acid
caaauccccugaugaggccguuaggccgaaauuaagaa

SEQ ID NO: 10687 - RNA, 38 nt, Artificial Sequence
  Description of Artificial Sequence:  Enzymatic Nucleic Acid
cgauuacacugaugaggccguuaggccgaaaucccaau

SEQ ID NO: 10688 - RNA, 38 nt, Artificial Sequence
  Description of Artificial Sequence:  Enzymatic Nucleic Acid
acgauuaccugaugaggccguuaggccgaaaaucccaa

SEQ ID NO: 10689 - RNA, 38 nt, Artificial Sequence
  Description of Artificial Sequence:  Enzymatic Nucleic Acid
gguacgaucugaugaggccguuaggccgaaacaaaucc

SEQ ID NO: 10690 - RNA, 38 nt, Artificial Sequence
  Description of Artificial Sequence:  Enzymatic Nucleic Acid
guugguaccugaugaggccguuaggccgaaauuacaaa

SEQ ID NO: 10691 - RNA, 38 nt, Artificial Sequence
  Description of Artificial Sequence:  Enzymatic Nucleic Acid
uaaguuggcugaugaggccguuaggccgaaacgauuac

SEQ ID NO: 10692 - RNA, 38 nt, Artificial Sequence
  Description of Artificial Sequence:  Enzymatic Nucleic Acid
uaucaauucugaugaggccguuaggccgaaaguuggua

SEQ ID NO: 10693 - RNA, 38 nt, Artificial Sequence
  Description of Artificial Sequence:  Enzymatic Nucleic Acid
uuaucaaucugaugaggccguuaggccgaaaaguuggu

SEQ ID NO: 10694 - RNA, 38 nt, Artificial Sequence
  Description of Artificial Sequence:  Enzymatic Nucleic Acid
aguuuauccugaugaggccguuaggccgaaauuaaguu

SEQ ID NO: 10695 - RNA, 38 nt, Artificial Sequence
  Description of Artificial Sequence:  Enzymatic Nucleic Acid
gccaaguucugaugaggccguuaggccgaaaucaauua

SEQ ID NO: 10696 - RNA, 38 nt, Artificial Sequence
  Description of Artificial Sequence:  Enzymatic Nucleic Acid
caguugcccugaugaggccguuaggccgaaaguuuauc

SEQ ID NO: 10697 - RNA, 38 nt, Artificial Sequence
  Description of Artificial Sequence:  Enzymatic Nucleic Acid
gaacauaacugaugaggccguuaggccgaaagcaguug

SEQ ID NO: 10698 - RNA, 38 nt, Artificial Sequence
  Description of Artificial Sequence:  Enzymatic Nucleic Acid
agaacauacugaugaggccguuaggccgaaaagcaguu

SEQ ID NO: 10699 - RNA, 38 nt, Artificial Sequence
  Description of Artificial Sequence:  Enzymatic Nucleic Acid
cagaacaucugaugaggccguuaggccgaaaaagcagu

SEQ ID NO: 10700 - RNA, 38 nt, Artificial Sequence
  Description of Artificial Sequence:  Enzymatic Nucleic Acid
acagaacacugaugaggccguuaggccgaaaaaagcag

SEQ ID NO: 10701 - RNA, 38 nt, Artificial Sequence
  Description of Artificial Sequence:  Enzymatic Nucleic Acid
ggagacagcugaugaggccguuaggccgaaacauaaaa

SEQ ID NO: 10702 - RNA, 38 nt, Artificial Sequence
  Description of Artificial Sequence:  Enzymatic Nucleic Acid
aggagacacugaugaggccguuaggccgaaaacauaaa

SEQ ID NO: 10703 - RNA, 38 nt, Artificial Sequence
  Description of Artificial Sequence:  Enzymatic Nucleic Acid
uggaaggacugaugaggccguuaggccgaaacagaaca

SEQ ID NO: 10704 - RNA, 38 nt, Artificial Sequence
  Description of Artificial Sequence:  Enzymatic Nucleic Acid
uauggaagcugaugaggccguuaggccgaaagacagaa

SEQ ID NO: 10705 - RNA, 38 nt, Artificial Sequence
  Description of Artificial Sequence:  Enzymatic Nucleic Acid
auuuauggcugaugaggccguuaggccgaaaggagaca

SEQ ID NO: 10706 - RNA, 38 nt, Artificial Sequence
  Description of Artificial Sequence:  Enzymatic Nucleic Acid
aauuuaugcugaugaggccguuaggccgaaaaggagac

SEQ ID NO: 10707 - RNA, 38 nt, Artificial Sequence
  Description of Artificial Sequence:  Enzymatic Nucleic Acid
gaaaaauucugaugaggccguuaggccgaaauggaagg

SEQ ID NO: 10708 - RNA, 38 nt, Artificial Sequence
  Description of Artificial Sequence:  Enzymatic Nucleic Acid
uuuugaaacugaugaggccguuaggccgaaauuuaugg

SEQ ID NO: 10709 - RNA, 38 nt, Artificial Sequence
  Description of Artificial Sequence:  Enzymatic Nucleic Acid
auuuugaacugaugaggccguuaggccgaaaauuuaug

SEQ ID NO: 10710 - RNA, 38 nt, Artificial Sequence
  Description of Artificial Sequence:  Enzymatic Nucleic Acid
uauuuugacugaugaggccguuaggccgaaaaauuuau

SEQ ID NO: 10711 - RNA, 38 nt, Artificial Sequence
  Description of Artificial Sequence:  Enzymatic Nucleic Acid
guauuuugcugaugaggccguuaggccgaaaaaauuua

SEQ ID NO: 10712 - RNA, 38 nt, Artificial Sequence
  Description of Artificial Sequence:  Enzymatic Nucleic Acid
aguauuuucugaugaggccguuaggccgaaaaaaauuu

SEQ ID NO: 10713 - RNA, 38 nt, Artificial Sequence
  Description of Artificial Sequence:  Enzymatic Nucleic Acid
ugaauuagcugaugaggccguuaggccgaaauuuugaa

SEQ ID NO: 10714 - RNA, 38 nt, Artificial Sequence
  Description of Artificial Sequence:  Enzymatic Nucleic Acid
uguugaaucugaugaggccguuaggccgaaaguauuuu

SEQ ID NO: 10715 - RNA, 38 nt, Artificial Sequence
  Description of Artificial Sequence:  Enzymatic Nucleic Acid
cuuuguugcugaugaggccguuaggccgaaauuaguau

SEQ ID NO: 10716 - RNA, 38 nt, Artificial Sequence
  Description of Artificial Sequence:  Enzymatic Nucleic Acid
ucuuuguucugaugaggccguuaggccgaaaauuagua

SEQ ID NO: 10717 - RNA, 38 nt, Artificial Sequence
  Description of Artificial Sequence:  Enzymatic Nucleic Acid
aaaaaaaacugaugaggccguuaggccgaaagcuuuuu

SEQ ID NO: 10718 - RNA, 38 nt, Artificial Sequence
  Description of Artificial Sequence:  Enzymatic Nucleic Acid
ggaaaaaacugaugaggccguuaggccgaaagagcuuu

SEQ ID NO: 10719 - RNA, 38 nt, Artificial Sequence
  Description of Artificial Sequence:  Enzymatic Nucleic Acid
aggaaaaacugaugaggccguuaggccgaaaagagcuu

SEQ ID NO: 10720 - RNA, 38 nt, Artificial Sequence
  Description of Artificial Sequence:  Enzymatic Nucleic Acid
uaggaaaacugaugaggccguuaggccgaaaaagagcu

SEQ ID NO: 10721 - RNA, 38 nt, Artificial Sequence
  Description of Artificial Sequence:  Enzymatic Nucleic Acid
uuaggaaacugaugaggccguuaggccgaaaaaagagc

SEQ ID NO: 10722 - RNA, 38 nt, Artificial Sequence
  Description of Artificial Sequence:  Enzymatic Nucleic Acid
uuuaggaacugaugaggccguuaggccgaaaaaaagag

SEQ ID NO: 10723 - RNA, 38 nt, Artificial Sequence
  Description of Artificial Sequence:  Enzymatic Nucleic Acid
uuuuaggacugaugaggccguuaggccgaaaaaaaaga

SEQ ID NO: 10724 - RNA, 38 nt, Artificial Sequence
  Description of Artificial Sequence:  Enzymatic Nucleic Acid
auuuuaggcugaugaggccguuaggccgaaaaaaaaag

SEQ ID NO: 10725 - RNA, 38 nt, Artificial Sequence
  Description of Artificial Sequence:  Enzymatic Nucleic Acid
uauuuuagcugaugaggccguuaggccgaaaaaaaaaa

SEQ ID NO: 10726 - RNA, 38 nt, Artificial Sequence
  Description of Artificial Sequence:  Enzymatic Nucleic Acid
guuuauuucugaugaggccguuaggccgaaaggaaaaa

SEQ ID NO: 10727 - RNA, 38 nt, Artificial Sequence
  Description of Artificial Sequence:  Enzymatic Nucleic Acid
uuugaguucugaugaggccguuaggccgaaauuuuagg

SEQ ID NO: 10728 - RNA, 38 nt, Artificial Sequence
  Description of Artificial Sequence:  Enzymatic Nucleic Acid
auaaauuucugaugaggccguuaggccgaaaguuuauu

SEQ ID NO: 10729 - RNA, 38 nt, Artificial Sequence
  Description of Artificial Sequence:  Enzymatic Nucleic Acid
caaggauacugaugaggccguuaggccgaaauuugagu

SEQ ID NO: 10730 - RNA, 38 nt, Artificial Sequence
  Description of Artificial Sequence:  Enzymatic Nucleic Acid
acaaggaucugaugaggccguuaggccgaaaauuugag

SEQ ID NO: 10731 - RNA, 38 nt, Artificial Sequence
  Description of Artificial Sequence:  Enzymatic Nucleic Acid
aacaaggacugaugaggccguuaggccgaaaaauuuga

SEQ ID NO: 10732 - RNA, 38 nt, Artificial Sequence
  Description of Artificial Sequence:  Enzymatic Nucleic Acid
uaaacaagcugaugaggccguuaggccgaaauaaauuu

SEQ ID NO: 10733 - RNA, 38 nt, Artificial Sequence
  Description of Artificial Sequence:  Enzymatic Nucleic Acid
cucuaaaccugaugaggccguuaggccgaaaggauaaa

SEQ ID NO: 10734 - RNA, 38 nt, Artificial Sequence
  Description of Artificial Sequence:  Enzymatic Nucleic Acid
cugcucuacugaugaggccguuaggccgaaacaaggau

SEQ ID NO: 10735 - RNA, 38 nt, Artificial Sequence
  Description of Artificial Sequence:  Enzymatic Nucleic Acid
ucugcucucugaugaggccguuaggccgaaaacaagga

SEQ ID NO: 10736 - RNA, 38 nt, Artificial Sequence
  Description of Artificial Sequence:  Enzymatic Nucleic Acid
cucugcuccugaugaggccguuaggccgaaaaacaagg

SEQ ID NO: 10737 - RNA, 38 nt, Artificial Sequence
  Description of Artificial Sequence:  Enzymatic Nucleic Acid
uuuuucuucugaugaggccguuaggccgaaauuuuucu

SEQ ID NO: 10738 - RNA, 38 nt, Artificial Sequence
  Description of Artificial Sequence:  Enzymatic Nucleic Acid
guuuuucucugaugaggccguuaggccgaaaauuuuuc

SEQ ID NO: 10739 - RNA, 38 nt, Artificial Sequence
  Description of Artificial Sequence:  Enzymatic Nucleic Acid
ccauuucacugaugaggccguuaggccgaaaguuuuuc

SEQ ID NO: 10740 - RNA, 38 nt, Artificial Sequence
  Description of Artificial Sequence:  Enzymatic Nucleic Acid
accauuuccugaugaggccguuaggccgaaaaguuuuu

SEQ ID NO: 10741 - RNA, 38 nt, Artificial Sequence
  Description of Artificial Sequence:  Enzymatic Nucleic Acid
uuuuuugacugaugaggccguuaggccgaaaccauuuc

SEQ ID NO: 10742 - RNA, 38 nt, Artificial Sequence
  Description of Artificial Sequence:  Enzymatic Nucleic Acid
aauuuuuucugaugaggccguuaggccgaaagaccauu

SEQ ID NO: 10743 - RNA, 38 nt, Artificial Sequence
  Description of Artificial Sequence:  Enzymatic Nucleic Acid
uauuuagccugaugaggccguuaggccgaaauuuuuug

SEQ ID NO: 10744 - RNA, 38 nt, Artificial Sequence
  Description of Artificial Sequence:  Enzymatic Nucleic Acid
aaaauauucugaugaggccguuaggccgaaagcaauuu

SEQ ID NO: 10745 - RNA, 38 nt, Artificial Sequence
  Description of Artificial Sequence:  Enzymatic Nucleic Acid
auugaaaacugaugaggccguuaggccgaaauuuagca

SEQ ID NO: 10746 - RNA, 38 nt, Artificial Sequence
  Description of Artificial Sequence:  Enzymatic Nucleic Acid
ccauugaacugaugaggccguuaggccgaaauauuuag

SEQ ID NO: 10747 - RNA, 38 nt, Artificial Sequence
  Description of Artificial Sequence:  Enzymatic Nucleic Acid
uccauugacugaugaggccguuaggccgaaaauauuua

SEQ ID NO: 10748 - RNA, 38 nt, Artificial Sequence
  Description of Artificial Sequence:  Enzymatic Nucleic Acid
uuccauugcugaugaggccguuaggccgaaaaauauuu

SEQ ID NO: 10749 - RNA, 38 nt, Artificial Sequence
  Description of Artificial Sequence:  Enzymatic Nucleic Acid
uuuccauucugaugaggccguuaggccgaaaaaauauu

SEQ ID NO: 10750 - RNA, 38 nt, Artificial Sequence
  Description of Artificial Sequence:  Enzymatic Nucleic Acid
cuaacauucugaugaggccguuaggccgaaaguuuucc

SEQ ID NO: 10751 - RNA, 38 nt, Artificial Sequence
  Description of Artificial Sequence:  Enzymatic Nucleic Acid
gcuaaacucugaugaggccguuaggccgaaacauuuag

SEQ ID NO: 10752 - RNA, 38 nt, Artificial Sequence
  Description of Artificial Sequence:  Enzymatic Nucleic Acid
agcuaaaccugaugaggccguuaggccgaaaacauuua

SEQ ID NO: 10753 - RNA, 38 nt, Artificial Sequence
  Description of Artificial Sequence:  Enzymatic Nucleic Acid
aucagcuacugaugaggccguuaggccgaaacuaacau

SEQ ID NO: 10754 - RNA, 38 nt, Artificial Sequence
  Description of Artificial Sequence:  Enzymatic Nucleic Acid
aaucagcucugaugaggccguuaggccgaaaacuaaca

SEQ ID NO: 10755 - RNA, 38 nt, Artificial Sequence
  Description of Artificial Sequence:  Enzymatic Nucleic Acid
caaucagccugaugaggccguuaggccgaaaaacuaac

SEQ ID NO: 10756 - RNA, 38 nt, Artificial Sequence
  Description of Artificial Sequence:  Enzymatic Nucleic Acid
ccccauaccugaugaggccguuaggccgaaaucagcua

SEQ ID NO: 10757 - RNA, 38 nt, Artificial Sequence
  Description of Artificial Sequence:  Enzymatic Nucleic Acid
aaaccccacugaugaggccguuaggccgaaacaaucag

SEQ ID NO: 10758 - RNA, 38 nt, Artificial Sequence
  Description of Artificial Sequence:  Enzymatic Nucleic Acid
gguucgaacugaugaggccguuaggccgaaaccccaua

SEQ ID NO: 10759 - RNA, 38 nt, Artificial Sequence
  Description of Artificial Sequence:  Enzymatic Nucleic Acid
agguucgacugaugaggccguuaggccgaaaaccccau

SEQ ID NO: 10760 - RNA, 38 nt, Artificial Sequence
  Description of Artificial Sequence:  Enzymatic Nucleic Acid
aagguucgcugaugaggccguuaggccgaaaaacccca

SEQ ID NO: 10761 - RNA, 38 nt, Artificial Sequence
  Description of Artificial Sequence:  Enzymatic Nucleic Acid
aaagguuccugaugaggccguuaggccgaaaaaacccc

SEQ ID NO: 10762 - RNA, 38 nt, Artificial Sequence
  Description of Artificial Sequence:  Enzymatic Nucleic Acid
aaaagugacugaugaggccguuaggccgaaagguucga

SEQ ID NO: 10763 - RNA, 38 nt, Artificial Sequence
  Description of Artificial Sequence:  Enzymatic Nucleic Acid
aaaaagugcugaugaggccguuaggccgaaaagguucg

SEQ ID NO: 10764 - RNA, 38 nt, Artificial Sequence
  Description of Artificial Sequence:  Enzymatic Nucleic Acid
caaaaagucugaugaggccguuaggccgaaaaagguuc

SEQ ID NO: 10765 - RNA, 38 nt, Artificial Sequence
  Description of Artificial Sequence:  Enzymatic Nucleic Acid
caaacaaacugaugaggccguuaggccgaaagugaaag

SEQ ID NO: 10766 - RNA, 38 nt, Artificial Sequence
  Description of Artificial Sequence:  Enzymatic Nucleic Acid
acaaacaacugaugaggccguuaggccgaaaagugaaa

SEQ ID NO: 10767 - RNA, 38 nt, Artificial Sequence
  Description of Artificial Sequence:  Enzymatic Nucleic Acid
aacaaacacugaugaggccguuaggccgaaaaagugaa

SEQ ID NO: 10768 - RNA, 38 nt, Artificial Sequence
  Description of Artificial Sequence:  Enzymatic Nucleic Acid
aaacaaaccugaugaggccguuaggccgaaaaaaguga

SEQ ID NO: 10769 - RNA, 38 nt, Artificial Sequence
  Description of Artificial Sequence:  Enzymatic Nucleic Acid
guaaaacacugaugaggccguuaggccgaaacaaaaag

SEQ ID NO: 10770 - RNA, 38 nt, Artificial Sequence
  Description of Artificial Sequence:  Enzymatic Nucleic Acid
gguaaaaccugaugaggccguuaggccgaaaacaaaaa

SEQ ID NO: 10771 - RNA, 38 nt, Artificial Sequence
  Description of Artificial Sequence:  Enzymatic Nucleic Acid
auagguaacugaugaggccguuaggccgaaacaaacaa

SEQ ID NO: 10772 - RNA, 38 nt, Artificial Sequence
  Description of Artificial Sequence:  Enzymatic Nucleic Acid
aauagguacugaugaggccguuaggccgaaaacaaaca

SEQ ID NO: 10773 - RNA, 38 nt, Artificial Sequence
  Description of Artificial Sequence:  Enzymatic Nucleic Acid
aaauaggucugaugaggccguuaggccgaaaaacaaac

SEQ ID NO: 10774 - RNA, 38 nt, Artificial Sequence
  Description of Artificial Sequence:  Enzymatic Nucleic Acid
gaaauaggcugaugaggccguuaggccgaaaaaacaaa

SEQ ID NO: 10775 - RNA, 38 nt, Artificial Sequence
  Description of Artificial Sequence:  Enzymatic Nucleic Acid
uugugaaacugaugaggccguuaggccgaaagguaaaa

SEQ ID NO: 10776 - RNA, 38 nt, Artificial Sequence
  Description of Artificial Sequence:  Enzymatic Nucleic Acid
aguugugacugaugaggccguuaggccgaaauagguaa

SEQ ID NO: 10777 - RNA, 38 nt, Artificial Sequence
  Description of Artificial Sequence:  Enzymatic Nucleic Acid
caguugugcugaugaggccguuaggccgaaaauaggua

SEQ ID NO: 10778 - RNA, 38 nt, Artificial Sequence
  Description of Artificial Sequence:  Enzymatic Nucleic Acid
acaguugucugaugaggccguuaggccgaaaaauaggu

SEQ ID NO: 10779 - RNA, 38 nt, Artificial Sequence
  Description of Artificial Sequence:  Enzymatic Nucleic Acid
uggcaauucugaugaggccguuaggccgaaacacaguu

SEQ ID NO: 10780 - RNA, 38 nt, Artificial Sequence
  Description of Artificial Sequence:  Enzymatic Nucleic Acid
uuauuggccugaugaggccguuaggccgaaauuuacac

SEQ ID NO: 10781 - RNA, 38 nt, Artificial Sequence
  Description of Artificial Sequence:  Enzymatic Nucleic Acid
acaggaaucugaugaggccguuaggccgaaauuggcaa

SEQ ID NO: 10782 - RNA, 38 nt, Artificial Sequence
  Description of Artificial Sequence:  Enzymatic Nucleic Acid
uggacaggcugaugaggccguuaggccgaaauuauugg

SEQ ID NO: 10783 - RNA, 38 nt, Artificial Sequence
  Description of Artificial Sequence:  Enzymatic Nucleic Acid
auggacagcugaugaggccguuaggccgaaaauuauug

SEQ ID NO: 10784 - RNA, 38 nt, Artificial Sequence
  Description of Artificial Sequence:  Enzymatic Nucleic Acid
uuuucaugcugaugaggccguuaggccgaaacaggaau

SEQ ID NO: 10785 - RNA, 38 nt, Artificial Sequence
  Description of Artificial Sequence:  Enzymatic Nucleic Acid
cacuggaucugaugaggccguuaggccgaaauuugcau

SEQ ID NO: 10786 - RNA, 38 nt, Artificial Sequence
  Description of Artificial Sequence:  Enzymatic Nucleic Acid
acacuggacugaugaggccguuaggccgaaaauuugca

SEQ ID NO: 10787 - RNA, 38 nt, Artificial Sequence
  Description of Artificial Sequence:  Enzymatic Nucleic Acid
cuacacugcugaugaggccguuaggccgaaauaauuug

SEQ ID NO: 10788 - RNA, 38 nt, Artificial Sequence
  Description of Artificial Sequence:  Enzymatic Nucleic Acid
aauauauccugaugaggccguuaggccgaaacacugga

SEQ ID NO: 10789 - RNA, 38 nt, Artificial Sequence
  Description of Artificial Sequence:  Enzymatic Nucleic Acid
gucaaauacugaugaggccguuaggccgaaaucuacac

SEQ ID NO: 10790 - RNA, 38 nt, Artificial Sequence
  Description of Artificial Sequence:  Enzymatic Nucleic Acid
uggucaaacugaugaggccguuaggccgaaauaucuac

SEQ ID NO: 10791 - RNA, 38 nt, Artificial Sequence
  Description of Artificial Sequence:  Enzymatic Nucleic Acid
gauggucacugaugaggccguuaggccgaaauauaucu

SEQ ID NO: 10792 - RNA, 38 nt, Artificial Sequence
  Description of Artificial Sequence:  Enzymatic Nucleic Acid
ugaugguccugaugaggccguuaggccgaaaauauauc

SEQ ID NO: 10793 - RNA, 38 nt, Artificial Sequence
  Description of Artificial Sequence:  Enzymatic Nucleic Acid
cauagggucugaugaggccguuaggccgaaauggucaa

SEQ ID NO: 10794 - RNA, 38 nt, Artificial Sequence
  Description of Artificial Sequence:  Enzymatic Nucleic Acid
aauauccacugaugaggccguuaggccgaaagggugau

SEQ ID NO: 10795 - RNA, 38 nt, Artificial Sequence
  Description of Artificial Sequence:  Enzymatic Nucleic Acid
cuagccaacugaugaggccguuaggccgaaauccauag

SEQ ID NO: 10796 - RNA, 38 nt, Artificial Sequence
  Description of Artificial Sequence:  Enzymatic Nucleic Acid
aacuagcccugaugaggccguuaggccgaaauauccau

SEQ ID NO: 10797 - RNA, 38 nt, Artificial Sequence
  Description of Artificial Sequence:  Enzymatic Nucleic Acid
ggcaaaaccugaugaggccguuaggccgaaagccaaua

SEQ ID NO: 10798 - RNA, 38 nt, Artificial Sequence
  Description of Artificial Sequence:  Enzymatic Nucleic Acid
aaaggcaacugaugaggccguuaggccgaaacuagcca

SEQ ID NO: 10799 - RNA, 38 nt, Artificial Sequence
  Description of Artificial Sequence:  Enzymatic Nucleic Acid
uaaaggcacugaugaggccguuaggccgaaaacuagcc

SEQ ID NO: 10800 - RNA, 38 nt, Artificial Sequence
  Description of Artificial Sequence:  Enzymatic Nucleic Acid
auaaaggccugaugaggccguuaggccgaaaaacuagc

SEQ ID NO: 10801 - RNA, 38 nt, Artificial Sequence
  Description of Artificial Sequence:  Enzymatic Nucleic Acid
gcuuaauacugaugaggccguuaggccgaaaggcaaaa

SEQ ID NO: 10802 - RNA, 38 nt, Artificial Sequence
  Description of Artificial Sequence:  Enzymatic Nucleic Acid
ugcuuaaucugaugaggccguuaggccgaaaaggcaaa

SEQ ID NO: 10803 - RNA, 38 nt, Artificial Sequence
  Description of Artificial Sequence:  Enzymatic Nucleic Acid
uugcuuaacugaugaggccguuaggccgaaaaaggcaa

SEQ ID NO: 10804 - RNA, 38 nt, Artificial Sequence
  Description of Artificial Sequence:  Enzymatic Nucleic Acid
auuugcuucugaugaggccguuaggccgaaauaaaggc

SEQ ID NO: 10805 - RNA, 38 nt, Artificial Sequence
  Description of Artificial Sequence:  Enzymatic Nucleic Acid
aauuugcucugaugaggccguuaggccgaaaauaaagg

SEQ ID NO: 10806 - RNA, 38 nt, Artificial Sequence
  Description of Artificial Sequence:  Enzymatic Nucleic Acid
cugaaaugcugaugaggccguuaggccgaaauuugcuu

SEQ ID NO: 10807 - RNA, 38 nt, Artificial Sequence
  Description of Artificial Sequence:  Enzymatic Nucleic Acid
gcugaaaucugaugaggccguuaggccgaaaauuugcu

SEQ ID NO: 10808 - RNA, 38 nt, Artificial Sequence
  Description of Artificial Sequence:  Enzymatic Nucleic Acid
caggcugacugaugaggccguuaggccgaaaugaauuu

SEQ ID NO: 10809 - RNA, 38 nt, Artificial Sequence
  Description of Artificial Sequence:  Enzymatic Nucleic Acid
ucaggcugcugaugaggccguuaggccgaaaaugaauu

SEQ ID NO: 10810 - RNA, 38 nt, Artificial Sequence
  Description of Artificial Sequence:  Enzymatic Nucleic Acid
uucaggcucugaugaggccguuaggccgaaaaaugaau

SEQ ID NO: 10811 - RNA, 38 nt, Artificial Sequence
  Description of Artificial Sequence:  Enzymatic Nucleic Acid
uauaggcacugaugaggccguuaggccgaaacauucag

SEQ ID NO: 10812 - RNA, 38 nt, Artificial Sequence
  Description of Artificial Sequence:  Enzymatic Nucleic Acid
agaauauacugaugaggccguuaggccgaaaggcagac

SEQ ID NO: 10813 - RNA, 38 nt, Artificial Sequence
  Description of Artificial Sequence:  Enzymatic Nucleic Acid
agagaauacugaugaggccguuaggccgaaauaggcag

SEQ ID NO: 10814 - RNA, 38 nt, Artificial Sequence
  Description of Artificial Sequence:  Enzymatic Nucleic Acid
gcagagaacugaugaggccguuaggccgaaauauaggc

SEQ ID NO: 10815 - RNA, 38 nt, Artificial Sequence
  Description of Artificial Sequence:  Enzymatic Nucleic Acid
gagcagagcugaugaggccguuaggccgaaauauauag

SEQ ID NO: 10816 - RNA, 38 nt, Artificial Sequence
  Description of Artificial Sequence:  Enzymatic Nucleic Acid
agagcagacugaugaggccguuaggccgaaaauauaua

SEQ ID NO: 10817 - RNA, 38 nt, Artificial Sequence
  Description of Artificial Sequence:  Enzymatic Nucleic Acid
aaagagcacugaugaggccguuaggccgaaagaauaua

SEQ ID NO: 10818 - RNA, 38 nt, Artificial Sequence
  Description of Artificial Sequence:  Enzymatic Nucleic Acid
aauacaaacugaugaggccguuaggccgaaagcagaga

SEQ ID NO: 10819 - RNA, 38 nt, Artificial Sequence
  Description of Artificial Sequence:  Enzymatic Nucleic Acid
agaauacacugaugaggccguuaggccgaaagagcaga

SEQ ID NO: 10820 - RNA, 38 nt, Artificial Sequence
  Description of Artificial Sequence:  Enzymatic Nucleic Acid
gagaauaccugaugaggccguuaggccgaaaagagcag

SEQ ID NO: 10821 - RNA, 38 nt, Artificial Sequence
  Description of Artificial Sequence:  Enzymatic Nucleic Acid
aaggagaacugaugaggccguuaggccgaaacaaagag

SEQ ID NO: 10822 - RNA, 38 nt, Artificial Sequence
  Description of Artificial Sequence:  Enzymatic Nucleic Acid
caaaggagcugaugaggccguuaggccgaaauacaaag

SEQ ID NO: 10823 - RNA, 38 nt, Artificial Sequence
  Description of Artificial Sequence:  Enzymatic Nucleic Acid
ucaaaggacugaugaggccguuaggccgaaaauacaaa

SEQ ID NO: 10824 - RNA, 38 nt, Artificial Sequence
  Description of Artificial Sequence:  Enzymatic Nucleic Acid
guucaaagcugaugaggccguuaggccgaaagaauaca

SEQ ID NO: 10825 - RNA, 38 nt, Artificial Sequence
  Description of Artificial Sequence:  Enzymatic Nucleic Acid
cggguucacugaugaggccguuaggccgaaaggagaau

SEQ ID NO: 10826 - RNA, 38 nt, Artificial Sequence
  Description of Artificial Sequence:  Enzymatic Nucleic Acid
acggguuccugaugaggccguuaggccgaaaaggagaa

SEQ ID NO: 10827 - RNA, 38 nt, Artificial Sequence
  Description of Artificial Sequence:  Enzymatic Nucleic Acid
gauguuuucugaugaggccguuaggccgaaacggguuc

SEQ ID NO: 10828 - RNA, 38 nt, Artificial Sequence
  Description of Artificial Sequence:  Enzymatic Nucleic Acid
ggauguuucugaugaggccguuaggccgaaaacggguu

SEQ ID NO: 10829 - RNA, 38 nt, Artificial Sequence
  Description of Artificial Sequence:  Enzymatic Nucleic Acid
ugccacagcugaugaggccguuaggccgaaauguuuua

SEQ ID NO: 10830 - RNA, 54 nt, Artificial Sequence
  Description of Artificial Sequence:  Enzymatic Nucleic Acid
cggggaggagaagagaggaccagagaaacacacguugugguacauuaccuggua

SEQ ID NO: 10831 - RNA, 54 nt, Artificial Sequence
  Description of Artificial Sequence:  Enzymatic Nucleic Acid
ccgcuccgagaagccgccaccagagaaacacacguugugguacauuaccuggua

SEQ ID NO: 10832 - RNA, 54 nt, Artificial Sequence
  Description of Artificial Sequence:  Enzymatic Nucleic Acid
ccgccagaagaaguccucaccagagaaacacacguugugguacauuaccuggua

SEQ ID NO: 10833 - RNA, 54 nt, Artificial Sequence
  Description of Artificial Sequence:  Enzymatic Nucleic Acid
aacgacccagaagccagaaccagagaaacacacguugugguacauuaccuggua

SEQ ID NO: 10834 - RNA, 54 nt, Artificial Sequence
  Description of Artificial Sequence:  Enzymatic Nucleic Acid
gcgcgcacagaaggacccaccagagaaacacacguugugguacauuaccuggua

SEQ ID NO: 10835 - RNA, 54 nt, Artificial Sequence
  Description of Artificial Sequence:  Enzymatic Nucleic Acid
gacagcugagaagcgcgcaccagagaaacacacguugugguacauuaccuggua

SEQ ID NO: 10836 - RNA, 54 nt, Artificial Sequence
  Description of Artificial Sequence:  Enzymatic Nucleic Acid
aagcagacagaagagcagaccagagaaacacacguugugguacauuaccuggua

SEQ ID NO: 10837 - RNA, 54 nt, Artificial Sequence
  Description of Artificial Sequence:  Enzymatic Nucleic Acid
gagaagcaagaagcugagaccagagaaacacacguugugguacauuaccuggua

SEQ ID NO: 10838 - RNA, 54 nt, Artificial Sequence
  Description of Artificial Sequence:  Enzymatic Nucleic Acid
cugugagaagaagacagcaccagagaaacacacguugugguacauuaccuggua

SEQ ID NO: 10839 - RNA, 54 nt, Artificial Sequence
  Description of Artificial Sequence:  Enzymatic Nucleic Acid
cauuuaugagaagcuuccaccagagaaacacacguugugguacauuaccuggua

SEQ ID NO: 10840 - RNA, 54 nt, Artificial Sequence
  Description of Artificial Sequence:  Enzymatic Nucleic Acid
cuuccacaagaagauuuaaccagagaaacacacguugugguacauuaccuggua

SEQ ID NO: 10841 - RNA, 54 nt, Artificial Sequence
  Description of Artificial Sequence:  Enzymatic Nucleic Acid
uuugcuugagaaguguucaccagagaaacacacguugugguacauuaccuggua

SEQ ID NO: 10842 - RNA, 54 nt, Artificial Sequence
  Description of Artificial Sequence:  Enzymatic Nucleic Acid
auauuugcagaaguagaaaccagagaaacacacguugugguacauuaccuggua

SEQ ID NO: 10843 - RNA, 54 nt, Artificial Sequence
  Description of Artificial Sequence:  Enzymatic Nucleic Acid
cguaacccagaagggaauaccagagaaacacacguugugguacauuaccuggua

SEQ ID NO: 10844 - RNA, 54 nt, Artificial Sequence
  Description of Artificial Sequence:  Enzymatic Nucleic Acid
cguuuuccagaagggaucaccagagaaacacacguugugguacauuaccuggua

SEQ ID NO: 10845 - RNA, 54 nt, Artificial Sequence
  Description of Artificial Sequence:  Enzymatic Nucleic Acid
cuucacagagaagaagccaccagagaaacacacguugugguacauuaccuggua

SEQ ID NO: 10846 - RNA, 54 nt, Artificial Sequence
  Description of Artificial Sequence:  Enzymatic Nucleic Acid
uuuuuuucagaaggguaaaccagagaaacacacguugugguacauuaccuggua

SEQ ID NO: 10847 - RNA, 54 nt, Artificial Sequence
  Description of Artificial Sequence:  Enzymatic Nucleic Acid
gccgguaaagaagcuugcaccagagaaacacacguugugguacauuaccuggua

SEQ ID NO: 10848 - RNA, 54 nt, Artificial Sequence
  Description of Artificial Sequence:  Enzymatic Nucleic Acid
ucauagagagaagguaagaccagagaaacacacguugugguacauuaccuggua

SEQ ID NO: 10849 - RNA, 54 nt, Artificial Sequence
  Description of Artificial Sequence:  Enzymatic Nucleic Acid
aaauagcgagaagauuucaccagagaaacacacguugugguacauuaccuggua

SEQ ID NO: 10850 - RNA, 54 nt, Artificial Sequence
  Description of Artificial Sequence:  Enzymatic Nucleic Acid
uuucguaaagaagggguuaccagagaaacacacguugugguacauuaccuggua

SEQ ID NO: 10851 - RNA, 54 nt, Artificial Sequence
  Description of Artificial Sequence:  Enzymatic Nucleic Acid
agagccggagaaggaaacaccagagaaacacacguugugguacauuaccuggua

SEQ ID NO: 10852 - RNA, 54 nt, Artificial Sequence
  Description of Artificial Sequence:  Enzymatic Nucleic Acid
ggguagagagaagggucuaccagagaaacacacguugugguacauuaccuggua

SEQ ID NO: 10853 - RNA, 54 nt, Artificial Sequence
  Description of Artificial Sequence:  Enzymatic Nucleic Acid
cgguacaaagaaggauuuaccagagaaacacacguugugguacauuaccuggua

SEQ ID NO: 10854 - RNA, 54 nt, Artificial Sequence
  Description of Artificial Sequence:  Enzymatic Nucleic Acid
auucuagaagaagccacaaccagagaaacacacguugugguacauuaccuggua

SEQ ID NO: 10855 - RNA, 54 nt, Artificial Sequence
  Description of Artificial Sequence:  Enzymatic Nucleic Acid
uuuggcacagaagugauaaccagagaaacacacguugugguacauuaccuggua

SEQ ID NO: 10856 - RNA, 54 nt, Artificial Sequence
  Description of Artificial Sequence:  Enzymatic Nucleic Acid
cuccuuccagaagcauuuaccagagaaacacacguugugguacauuaccuggua

SEQ ID NO: 10857 - RNA, 54 nt, Artificial Sequence
  Description of Artificial Sequence:  Enzymatic Nucleic Acid
cugugcaaagaaguuucaaccagagaaacacacguugugguacauuaccuggua

SEQ ID NO: 10858 - RNA, 54 nt, Artificial Sequence
  Description of Artificial Sequence:  Enzymatic Nucleic Acid
agugguggagaagcugauaccagagaaacacacguugugguacauuaccuggua

SEQ ID NO: 10859 - RNA, 54 nt, Artificial Sequence
  Description of Artificial Sequence:  Enzymatic Nucleic Acid
accaagugagaagaggcuaccagagaaacacacguugugguacauuaccuggua

SEQ ID NO: 10860 - RNA, 54 nt, Artificial Sequence
  Description of Artificial Sequence:  Enzymatic Nucleic Acid
uuucaauaagaagcgugcaccagagaaacacacguugugguacauuaccuggua

SEQ ID NO: 10861 - RNA, 54 nt, Artificial Sequence
  Description of Artificial Sequence:  Enzymatic Nucleic Acid
guuccuugagaagugaggaccagagaaacacacguugugguacauuaccuggua

SEQ ID NO: 10862 - RNA, 54 nt, Artificial Sequence
  Description of Artificial Sequence:  Enzymatic Nucleic Acid
uuagagugagaagcuccaaccagagaaacacacguugugguacauuaccuggua

SEQ ID NO: 10863 - RNA, 54 nt, Artificial Sequence
  Description of Artificial Sequence:  Enzymatic Nucleic Acid
gauagguaagaagucuuuaccagagaaacacacguugugguacauuaccuggua

SEQ ID NO: 10864 - RNA, 54 nt, Artificial Sequence
  Description of Artificial Sequence:  Enzymatic Nucleic Acid
ggaacuucagaaggguccaccagagaaacacacguugugguacauuaccuggua

SEQ ID NO: 10865 - RNA, 54 nt, Artificial Sequence
  Description of Artificial Sequence:  Enzymatic Nucleic Acid
cauaagggagaagcucacaccagagaaacacacguugugguacauuaccuggua

SEQ ID NO: 10866 - RNA, 54 nt, Artificial Sequence
  Description of Artificial Sequence:  Enzymatic Nucleic Acid
cagccacaagaaggcacgaccagagaaacacacguugugguacauuaccuggua

SEQ ID NO: 10867 - RNA, 54 nt, Artificial Sequence
  Description of Artificial Sequence:  Enzymatic Nucleic Acid
gcucagucagaagagcuuaccagagaaacacacguugugguacauuaccuggua

SEQ ID NO: 10868 - RNA, 54 nt, Artificial Sequence
  Description of Artificial Sequence:  Enzymatic Nucleic Acid
aggcucccagaagguuaaaccagagaaacacacguugugguacauuaccuggua

SEQ ID NO: 10869 - RNA, 54 nt, Artificial Sequence
  Description of Artificial Sequence:  Enzymatic Nucleic Acid
caaucaccagaagaggccaccagagaaacacacguugugguacauuaccuggua

SEQ ID NO: 10870 - RNA, 54 nt, Artificial Sequence
  Description of Artificial Sequence:  Enzymatic Nucleic Acid
uuccugaaagaaggagcuaccagagaaacacacguugugguacauuaccuggua

SEQ ID NO: 10871 - RNA, 54 nt, Artificial Sequence
  Description of Artificial Sequence:  Enzymatic Nucleic Acid
uagaaaccagaagaauccaccagagaaacacacguugugguacauuaccuggua

SEQ ID NO: 10872 - RNA, 54 nt, Artificial Sequence
  Description of Artificial Sequence:  Enzymatic Nucleic Acid
cuuguagaagaagucagaaccagagaaacacacguugugguacauuaccuggua

SEQ ID NO: 10873 - RNA, 54 nt, Artificial Sequence
  Description of Artificial Sequence:  Enzymatic Nucleic Acid
uguaagaaagaagaucuuaccagagaaacacacguugugguacauuaccuggua

SEQ ID NO: 10874 - RNA, 54 nt, Artificial Sequence
  Description of Artificial Sequence:  Enzymatic Nucleic Acid
cacuugaaagaaguaagaaccagagaaacacacguugugguacauuaccuggua

SEQ ID NO: 10875 - RNA, 54 nt, Artificial Sequence
  Description of Artificial Sequence:  Enzymatic Nucleic Acid
uucuggaaagaaggaacuaccagagaaacacacguugugguacauuaccuggua

SEQ ID NO: 10876 - RNA, 54 nt, Artificial Sequence
  Description of Artificial Sequence:  Enzymatic Nucleic Acid
cucacauaagaaggguucaccagagaaacacacguugugguacauuaccuggua

SEQ ID NO: 10877 - RNA, 54 nt, Artificial Sequence
  Description of Artificial Sequence:  Enzymatic Nucleic Acid
ccucaggcagaagcaaaaaccagagaaacacacguugugguacauuaccuggua

SEQ ID NO: 10878 - RNA, 54 nt, Artificial Sequence
  Description of Artificial Sequence:  Enzymatic Nucleic Acid
ccagcaugagaagauagaaccagagaaacacacguugugguacauuaccuggua

SEQ ID NO: 10879 - RNA, 54 nt, Artificial Sequence
  Description of Artificial Sequence:  Enzymatic Nucleic Acid
ucugugccagaaguccagaccagagaaacacacguugugguacauuaccuggua

SEQ ID NO: 10880 - RNA, 54 nt, Artificial Sequence
  Description of Artificial Sequence:  Enzymatic Nucleic Acid
ucagagaaagaaggaguuaccagagaaacacacguugugguacauuaccuggua

SEQ ID NO: 10881 - RNA, 54 nt, Artificial Sequence
  Description of Artificial Sequence:  Enzymatic Nucleic Acid
aacuucggagaagaaauaaccagagaaacacacguugugguacauuaccuggua

SEQ ID NO: 10882 - RNA, 54 nt, Artificial Sequence
  Description of Artificial Sequence:  Enzymatic Nucleic Acid
cugacaucagaagagcuuaccagagaaacacacguugugguacauuaccuggua

SEQ ID NO: 10883 - RNA, 54 nt, Artificial Sequence
  Description of Artificial Sequence:  Enzymatic Nucleic Acid
gagaggccagaagagugcaccagagaaacacacguugugguacauuaccuggua

SEQ ID NO: 10884 - RNA, 54 nt, Artificial Sequence
  Description of Artificial Sequence:  Enzymatic Nucleic Acid
ugacaucaagaagccccgaccagagaaacacacguugugguacauuaccuggua

SEQ ID NO: 10885 - RNA, 54 nt, Artificial Sequence
  Description of Artificial Sequence:  Enzymatic Nucleic Acid
cugcugacagaagacagcaccagagaaacacacguugugguacauuaccuggua

SEQ ID NO: 10886 - RNA, 54 nt, Artificial Sequence
  Description of Artificial Sequence:  Enzymatic Nucleic Acid
auggcagaagaagggccuaccagagaaacacacguugugguacauuaccuggua

SEQ ID NO: 10887 - RNA, 54 nt, Artificial Sequence
  Description of Artificial Sequence:  Enzymatic Nucleic Acid
gugcccacagaaggaaugaccagagaaacacacguugugguacauuaccuggua

SEQ ID NO: 10888 - RNA, 54 nt, Artificial Sequence
  Description of Artificial Sequence:  Enzymatic Nucleic Acid
gggcggggagaagcacgcaccagagaaacacacguugugguacauuaccuggua

SEQ ID NO: 10889 - RNA, 54 nt, Artificial Sequence
  Description of Artificial Sequence:  Enzymatic Nucleic Acid
agucugggagaagggagcaccagagaaacacacguugugguacauuaccuggua

SEQ ID NO: 10890 - RNA, 54 nt, Artificial Sequence
  Description of Artificial Sequence:  Enzymatic Nucleic Acid
gaguuguaagaagggggcaccagagaaacacacguugugguacauuaccuggua

SEQ ID NO: 10891 - RNA, 54 nt, Artificial Sequence
  Description of Artificial Sequence:  Enzymatic Nucleic Acid
caaaaagcagaaggcuccaccagagaaacacacguugugguacauuaccuggua

SEQ ID NO: 10892 - RNA, 54 nt, Artificial Sequence
  Description of Artificial Sequence:  Enzymatic Nucleic Acid
ucacaaaaagaagcuggcaccagagaaacacacguugugguacauuaccuggua

SEQ ID NO: 10893 - RNA, 54 nt, Artificial Sequence
  Description of Artificial Sequence:  Enzymatic Nucleic Acid
gggguuggagaagggaagaccagagaaacacacguugugguacauuaccuggua

SEQ ID NO: 10894 - RNA, 54 nt, Artificial Sequence
  Description of Artificial Sequence:  Enzymatic Nucleic Acid
cucaaucaagaagguccuaccagagaaacacacguugugguacauuaccuggua

SEQ ID NO: 10895 - RNA, 54 nt, Artificial Sequence
  Description of Artificial Sequence:  Enzymatic Nucleic Acid
auugggugagaagugcagaccagagaaacacacguugugguacauuaccuggua

SEQ ID NO: 10896 - RNA, 54 nt, Artificial Sequence
  Description of Artificial Sequence:  Enzymatic Nucleic Acid
ggcugcagagaaggcccaaccagagaaacacacguugugguacauuaccuggua

SEQ ID NO: 10897 - RNA, 54 nt, Artificial Sequence
  Description of Artificial Sequence:  Enzymatic Nucleic Acid
ggguuuugagaagcagggaccagagaaacacacguugugguacauuaccuggua

SEQ ID NO: 10898 - RNA, 54 nt, Artificial Sequence
  Description of Artificial Sequence:  Enzymatic Nucleic Acid
agggucagagaagggaagaccagagaaacacacguugugguacauuaccuggua

SEQ ID NO: 10899 - RNA, 54 nt, Artificial Sequence
  Description of Artificial Sequence:  Enzymatic Nucleic Acid
guagaaggagaagagcugaccagagaaacacacguugugguacauuaccuggua

SEQ ID NO: 10900 - RNA, 54 nt, Artificial Sequence
  Description of Artificial Sequence:  Enzymatic Nucleic Acid
cgcuguccagaagcuccuaccagagaaacacacguugugguacauuaccuggua

SEQ ID NO: 10901 - RNA, 54 nt, Artificial Sequence
  Description of Artificial Sequence:  Enzymatic Nucleic Acid
cugugcaaagaagaauaaaccagagaaacacacguugugguacauuaccuggua

SEQ ID NO: 10902 - RNA, 54 nt, Artificial Sequence
  Description of Artificial Sequence:  Enzymatic Nucleic Acid
cuccucagagaagcauuuaccagagaaacacacguugugguacauuaccuggua

SEQ ID NO: 10903 - RNA, 54 nt, Artificial Sequence
  Description of Artificial Sequence:  Enzymatic Nucleic Acid
uuuccuccagaagcccucaccagagaaacacacguugugguacauuaccuggua

SEQ ID NO: 10904 - RNA, 54 nt, Artificial Sequence
  Description of Artificial Sequence:  Enzymatic Nucleic Acid
gguauagaagaagggucuaccagagaaacacacguugugguacauuaccuggua

SEQ ID NO: 10905 - RNA, 54 nt, Artificial Sequence
  Description of Artificial Sequence:  Enzymatic Nucleic Acid
ugggucccagaaguguugaccagagaaacacacguugugguacauuaccuggua

SEQ ID NO: 10906 - RNA, 54 nt, Artificial Sequence
  Description of Artificial Sequence:  Enzymatic Nucleic Acid
ugagucccagaaggagaaaccagagaaacacacguugugguacauuaccuggua

SEQ ID NO: 10907 - RNA, 54 nt, Artificial Sequence
  Description of Artificial Sequence:  Enzymatic Nucleic Acid
aguuucaaagaaguugaaaccagagaaacacacguugugguacauuaccuggua

SEQ ID NO: 10908 - RNA, 54 nt, Artificial Sequence
  Description of Artificial Sequence:  Enzymatic Nucleic Acid
uagcaucaagaagagccaaccagagaaacacacguugugguacauuaccuggua

SEQ ID NO: 10909 - RNA, 54 nt, Artificial Sequence
  Description of Artificial Sequence:  Enzymatic Nucleic Acid
ccccaagaagaagcaaucaccagagaaacacacguugugguacauuaccuggua

SEQ ID NO: 10910 - RNA, 54 nt, Artificial Sequence
  Description of Artificial Sequence:  Enzymatic Nucleic Acid
cacauaagagaagaggcaaccagagaaacacacguugugguacauuaccuggua

SEQ ID NO: 10911 - RNA, 54 nt, Artificial Sequence
  Description of Artificial Sequence:  Enzymatic Nucleic Acid
uccacaaaagaagcugccaccagagaaacacacguugugguacauuaccuggua

SEQ ID NO: 10912 - RNA, 54 nt, Artificial Sequence
  Description of Artificial Sequence:  Enzymatic Nucleic Acid
guggagagagaagucccaaccagagaaacacacguugugguacauuaccuggua

SEQ ID NO: 10913 - RNA, 54 nt, Artificial Sequence
  Description of Artificial Sequence:  Enzymatic Nucleic Acid
aaauugccagaagucacaaccagagaaacacacguugugguacauuaccuggua

SEQ ID NO: 10914 - RNA, 54 nt, Artificial Sequence
  Description of Artificial Sequence:  Enzymatic Nucleic Acid
aagacaugagaagcuaagaccagagaaacacacguugugguacauuaccuggua

SEQ ID NO: 10915 - RNA, 54 nt, Artificial Sequence
  Description of Artificial Sequence:  Enzymatic Nucleic Acid
uuugaaggagaagaguaaaccagagaaacacacguugugguacauuaccuggua

SEQ ID NO: 10916 - RNA, 54 nt, Artificial Sequence
  Description of Artificial Sequence:  Enzymatic Nucleic Acid
uccacccaagaaguuccaaccagagaaacacacguugugguacauuaccuggua

SEQ ID NO: 10917 - RNA, 54 nt, Artificial Sequence
  Description of Artificial Sequence:  Enzymatic Nucleic Acid
acuucuugagaagacaagaccagagaaacacacguugugguacauuaccuggua

SEQ ID NO: 10918 - RNA, 54 nt, Artificial Sequence
  Description of Artificial Sequence:  Enzymatic Nucleic Acid
aacauaaaagaaguugccaccagagaaacacacguugugguacauuaccuggua

SEQ ID NO: 10919 - RNA, 54 nt, Artificial Sequence
  Description of Artificial Sequence:  Enzymatic Nucleic Acid
uggaaggaagaagaacauaccagagaaacacacguugugguacauuaccuggua

SEQ ID NO: 10920 - RNA, 54 nt, Artificial Sequence
  Description of Artificial Sequence:  Enzymatic Nucleic Acid
cccauacaagaagcuaaaaccagagaaacacacguugugguacauuaccuggua

SEQ ID NO: 10921 - RNA, 54 nt, Artificial Sequence
  Description of Artificial Sequence:  Enzymatic Nucleic Acid
uuuucaugagaaggaauuaccagagaaacacacguugugguacauuaccuggua

SEQ ID NO: 10922 - RNA, 54 nt, Artificial Sequence
  Description of Artificial Sequence:  Enzymatic Nucleic Acid
gacauucaagaagaaaugaccagagaaacacacguugugguacauuaccuggua

SEQ ID NO: 10923 - RNA, 54 nt, Artificial Sequence
  Description of Artificial Sequence:  Enzymatic Nucleic Acid
aauauauaagaagacauuaccagagaaacacacguugugguacauuaccuggua

SEQ ID NO: 10924 - RNA, 54 nt, Artificial Sequence
  Description of Artificial Sequence:  Enzymatic Nucleic Acid
auacaaagagaagagaauaccagagaaacacacguugugguacauuaccuggua

SEQ ID NO: 10925 - RNA, 38 nt, Artificial Sequence
  Description of Artificial Sequence:  Enzymatic Nucleic Acid
cacagggccugaugaggccguuaggccgaaacggccag

SEQ ID NO: 10926 - RNA, 38 nt, Artificial Sequence
  Description of Artificial Sequence:  Enzymatic Nucleic Acid
uccacgcacugaugaggccguuaggccgaaagccacag

SEQ ID NO: 10927 - RNA, 38 nt, Artificial Sequence
  Description of Artificial Sequence:  Enzymatic Nucleic Acid
aacccacacugaugaggccguuaggccgaaaggcggcc

SEQ ID NO: 10928 - RNA, 38 nt, Artificial Sequence
  Description of Artificial Sequence:  Enzymatic Nucleic Acid
acuaggcacugaugaggccguuaggccgaaacccacag

SEQ ID NO: 10929 - RNA, 38 nt, Artificial Sequence
  Description of Artificial Sequence:  Enzymatic Nucleic Acid
cacuaggccugaugaggccguuaggccgaaaacccaca

SEQ ID NO: 10930 - RNA, 38 nt, Artificial Sequence
  Description of Artificial Sequence:  Enzymatic Nucleic Acid
agaaacaccugaugaggccguuaggccgaaaggcaaac

SEQ ID NO: 10931 - RNA, 38 nt, Artificial Sequence
  Description of Artificial Sequence:  Enzymatic Nucleic Acid
ucaagagacugaugaggccguuaggccgaaacacuagg

SEQ ID NO: 10932 - RNA, 38 nt, Artificial Sequence
  Description of Artificial Sequence:  Enzymatic Nucleic Acid
aucaagagcugaugaggccguuaggccgaaaacacuag

SEQ ID NO: 10933 - RNA, 38 nt, Artificial Sequence
  Description of Artificial Sequence:  Enzymatic Nucleic Acid
gaucaagacugaugaggccguuaggccgaaaaacacua

SEQ ID NO: 10934 - RNA, 38 nt, Artificial Sequence
  Description of Artificial Sequence:  Enzymatic Nucleic Acid
cagaucaacugaugaggccguuaggccgaaagaaacac

SEQ ID NO: 10935 - RNA, 38 nt, Artificial Sequence
  Description of Artificial Sequence:  Enzymatic Nucleic Acid
ggcagauccugaugaggccguuaggccgaaagagaaac

SEQ ID NO: 10936 - RNA, 38 nt, Artificial Sequence
  Description of Artificial Sequence:  Enzymatic Nucleic Acid
ccugggcacugaugaggccguuaggccgaaaucaagag

SEQ ID NO: 10937 - RNA, 38 nt, Artificial Sequence
  Description of Artificial Sequence:  Enzymatic Nucleic Acid
uguaugcucugaugaggccguuaggccgaaagccuggg

SEQ ID NO: 10938 - RNA, 38 nt, Artificial Sequence
  Description of Artificial Sequence:  Enzymatic Nucleic Acid
ucuuuuugcugaugaggccguuaggccgaaaugcugag

SEQ ID NO: 10939 - RNA, 38 nt, Artificial Sequence
  Description of Artificial Sequence:  Enzymatic Nucleic Acid
auuguaagcugaugaggccguuaggccgaaaugucuuu

SEQ ID NO: 10940 - RNA, 38 nt, Artificial Sequence
  Description of Artificial Sequence:  Enzymatic Nucleic Acid
uuaauugucugaugaggccguuaggccgaaaguauguc

SEQ ID NO: 10941 - RNA, 38 nt, Artificial Sequence
  Description of Artificial Sequence:  Enzymatic Nucleic Acid
cuuaauugcugaugaggccguuaggccgaaaaguaugu

SEQ ID NO: 10942 - RNA, 38 nt, Artificial Sequence
  Description of Artificial Sequence:  Enzymatic Nucleic Acid
uuagccuucugaugaggccguuaggccgaaauuguaag

SEQ ID NO: 10943 - RNA, 38 nt, Artificial Sequence
  Description of Artificial Sequence:  Enzymatic Nucleic Acid
auuagccucugaugaggccguuaggccgaaaauuguaa

SEQ ID NO: 10944 - RNA, 38 nt, Artificial Sequence
  Description of Artificial Sequence:  Enzymatic Nucleic Acid
aguuguaucugaugaggccguuaggccgaaagccuuaa

SEQ ID NO: 10945 - RNA, 38 nt, Artificial Sequence
  Description of Artificial Sequence:  Enzymatic Nucleic Acid
aagaguugcugaugaggccguuaggccgaaauuagccu

SEQ ID NO: 10946 - RNA, 38 nt, Artificial Sequence
  Description of Artificial Sequence:  Enzymatic Nucleic Acid
aauuugaacugaugaggccguuaggccgaaaguuguau

SEQ ID NO: 10947 - RNA, 38 nt, Artificial Sequence
  Description of Artificial Sequence:  Enzymatic Nucleic Acid
guaauuugcugaugaggccguuaggccgaaagaguugu

SEQ ID NO: 10948 - RNA, 38 nt, Artificial Sequence
  Description of Artificial Sequence:  Enzymatic Nucleic Acid
aguaauuucugaugaggccguuaggccgaaaagaguug

SEQ ID NO: 10949 - RNA, 38 nt, Artificial Sequence
  Description of Artificial Sequence:  Enzymatic Nucleic Acid
cugcaagucugaugaggccguuaggccgaaauuugaag

SEQ ID NO: 10950 - RNA, 38 nt, Artificial Sequence
  Description of Artificial Sequence:  Enzymatic Nucleic Acid
ccugcaagcugaugaggccguuaggccgaaaauuugaa

SEQ ID NO: 10951 - RNA, 38 nt, Artificial Sequence
  Description of Artificial Sequence:  Enzymatic Nucleic Acid
uccccugccugaugaggccguuaggccgaaaguaauuu

SEQ ID NO: 10952 - RNA, 38 nt, Artificial Sequence
  Description of Artificial Sequence:  Enzymatic Nucleic Acid
gccagucccugaugaggccguuaggccgaaagucccuc

SEQ ID NO: 10953 - RNA, 38 nt, Artificial Sequence
  Description of Artificial Sequence:  Enzymatic Nucleic Acid
uugggccacugaugaggccguuaggccgaaagccaguc

SEQ ID NO: 10954 - RNA, 38 nt, Artificial Sequence
  Description of Artificial Sequence:  Enzymatic Nucleic Acid
auugggcccugaugaggccguuaggccgaaaagccagu

SEQ ID NO: 10955 - RNA, 38 nt, Artificial Sequence
  Description of Artificial Sequence:  Enzymatic Nucleic Acid
acucugaucugaugaggccguuaggccgaaauugggcc

SEQ ID NO: 10956 - RNA, 38 nt, Artificial Sequence
  Description of Artificial Sequence:  Enzymatic Nucleic Acid
gccacucucugaugaggccguuaggccgaaauuauugg

SEQ ID NO: 10957 - RNA, 38 nt, Artificial Sequence
  Description of Artificial Sequence:  Enzymatic Nucleic Acid
uuacagaacugaugaggccguuaggccgaaaggccauc

SEQ ID NO: 10958 - RNA, 38 nt, Artificial Sequence
  Description of Artificial Sequence:  Enzymatic Nucleic Acid
ucuuacagcugaugaggccguuaggccgaaagaggcca

SEQ ID NO: 10959 - RNA, 38 nt, Artificial Sequence
  Description of Artificial Sequence:  Enzymatic Nucleic Acid
gucuuacacugaugaggccguuaggccgaaaagaggcc

SEQ ID NO: 10960 - RNA, 38 nt, Artificial Sequence
  Description of Artificial Sequence:  Enzymatic Nucleic Acid
gagugucucugaugaggccguuaggccgaaacagaaga

SEQ ID NO: 10961 - RNA, 38 nt, Artificial Sequence
  Description of Artificial Sequence:  Enzymatic Nucleic Acid
ggaauugucugaugaggccguuaggccgaaagugucuu

SEQ ID NO: 10962 - RNA, 38 nt, Artificial Sequence
  Description of Artificial Sequence:  Enzymatic Nucleic Acid
acuuuuggcugaugaggccguuaggccgaaauugugag

SEQ ID NO: 10963 - RNA, 38 nt, Artificial Sequence
  Description of Artificial Sequence:  Enzymatic Nucleic Acid
cacuuuugcugaugaggccguuaggccgaaaauuguga

SEQ ID NO: 10964 - RNA, 38 nt, Artificial Sequence
  Description of Artificial Sequence:  Enzymatic Nucleic Acid
ucauuucccugaugaggccguuaggccgaaaucacuuu

SEQ ID NO: 10965 - RNA, 38 nt, Artificial Sequence
  Description of Artificial Sequence:  Enzymatic Nucleic Acid
agcacuugcugaugaggccguuaggccgaaaggcucca

SEQ ID NO: 10966 - RNA, 38 nt, Artificial Sequence
  Description of Artificial Sequence:  Enzymatic Nucleic Acid
cccgguagcugaugaggccguuaggccgaaagcacuug

SEQ ID NO: 10967 - RNA, 38 nt, Artificial Sequence
  Description of Artificial Sequence:  Enzymatic Nucleic Acid
ucccgguacugaugaggccguuaggccgaaaagcacuu

SEQ ID NO: 10968 - RNA, 38 nt, Artificial Sequence
  Description of Artificial Sequence:  Enzymatic Nucleic Acid
uuucccggcugaugaggccguuaggccgaaagaagcac

SEQ ID NO: 10969 - RNA, 38 nt, Artificial Sequence
  Description of Artificial Sequence:  Enzymatic Nucleic Acid
ccgaggcccugaugaggccguuaggccgaaagucaguu

SEQ ID NO: 10970 - RNA, 38 nt, Artificial Sequence
  Description of Artificial Sequence:  Enzymatic Nucleic Acid
aaaugacccugaugaggccguuaggccgaaaggccaag

SEQ ID NO: 10971 - RNA, 38 nt, Artificial Sequence
  Description of Artificial Sequence:  Enzymatic Nucleic Acid
acauaaaucugaugaggccguuaggccgaaaccgaggc

SEQ ID NO: 10972 - RNA, 38 nt, Artificial Sequence
  Description of Artificial Sequence:  Enzymatic Nucleic Acid
uagacauacugaugaggccguuaggccgaaaugaccga

SEQ ID NO: 10973 - RNA, 38 nt, Artificial Sequence
  Description of Artificial Sequence:  Enzymatic Nucleic Acid
auagacaucugaugaggccguuaggccgaaaaugaccg

SEQ ID NO: 10974 - RNA, 38 nt, Artificial Sequence
  Description of Artificial Sequence:  Enzymatic Nucleic Acid
cauagacacugaugaggccguuaggccgaaaaaugacc

SEQ ID NO: 10975 - RNA, 38 nt, Artificial Sequence
  Description of Artificial Sequence:  Enzymatic Nucleic Acid
ugaacauacugaugaggccguuaggccgaaacauaaau

SEQ ID NO: 10976 - RNA, 38 nt, Artificial Sequence
  Description of Artificial Sequence:  Enzymatic Nucleic Acid
cuugaacacugaugaggccguuaggccgaaagacauaa

SEQ ID NO: 10977 - RNA, 38 nt, Artificial Sequence
  Description of Artificial Sequence:  Enzymatic Nucleic Acid
uaaucuugcugaugaggccguuaggccgaaacauagac

SEQ ID NO: 10978 - RNA, 38 nt, Artificial Sequence
  Description of Artificial Sequence:  Enzymatic Nucleic Acid
guaaucuucugaugaggccguuaggccgaaaacauaga

SEQ ID NO: 10979 - RNA, 38 nt, Artificial Sequence
  Description of Artificial Sequence:  Enzymatic Nucleic Acid
agaucugucugaugaggccguuaggccgaaaucuugaa

SEQ ID NO: 10980 - RNA, 38 nt, Artificial Sequence
  Description of Artificial Sequence:  Enzymatic Nucleic Acid
gagaucugcugaugaggccguuaggccgaaaaucuuga

SEQ ID NO: 10981 - RNA, 38 nt, Artificial Sequence
  Description of Artificial Sequence:  Enzymatic Nucleic Acid
uaaauggacugaugaggccguuaggccgaaaucuguaa

SEQ ID NO: 10982 - RNA, 38 nt, Artificial Sequence
  Description of Artificial Sequence:  Enzymatic Nucleic Acid
aauaaaugcugaugaggccguuaggccgaaagaucugu

SEQ ID NO: 10983 - RNA, 38 nt, Artificial Sequence
  Description of Artificial Sequence:  Enzymatic Nucleic Acid
aagcaauacugaugaggccguuaggccgaaauggagau

SEQ ID NO: 10984 - RNA, 38 nt, Artificial Sequence
  Description of Artificial Sequence:  Enzymatic Nucleic Acid
gaagcaaucugaugaggccguuaggccgaaaauggaga

SEQ ID NO: 10985 - RNA, 38 nt, Artificial Sequence
  Description of Artificial Sequence:  Enzymatic Nucleic Acid
agaagcaacugaugaggccguuaggccgaaaaauggag

SEQ ID NO: 10986 - RNA, 38 nt, Artificial Sequence
  Description of Artificial Sequence:  Enzymatic Nucleic Acid
acagaagccugaugaggccguuaggccgaaauaaaugg

SEQ ID NO: 10987 - RNA, 38 nt, Artificial Sequence
  Description of Artificial Sequence:  Enzymatic Nucleic Acid
acuaacagcugaugaggccguuaggccgaaagcaauaa

SEQ ID NO: 10988 - RNA, 38 nt, Artificial Sequence
  Description of Artificial Sequence:  Enzymatic Nucleic Acid
cacuaacacugaugaggccguuaggccgaaaagcaaua

SEQ ID NO: 10989 - RNA, 38 nt, Artificial Sequence
  Description of Artificial Sequence:  Enzymatic Nucleic Acid
uggucacucugaugaggccguuaggccgaaacagaagc

SEQ ID NO: 10990 - RNA, 38 nt, Artificial Sequence
  Description of Artificial Sequence:  Enzymatic Nucleic Acid
uuggucaccugaugaggccguuaggccgaaaacagaag

SEQ ID NO: 10991 - RNA, 38 nt, Artificial Sequence
  Description of Artificial Sequence:  Enzymatic Nucleic Acid
auguacaccugaugaggccguuaggccgaaacuccaug

SEQ ID NO: 10992 - RNA, 38 nt, Artificial Sequence
  Description of Artificial Sequence:  Enzymatic Nucleic Acid
caguaaugcugaugaggccguuaggccgaaacacgacu

SEQ ID NO: 10993 - RNA, 38 nt, Artificial Sequence
  Description of Artificial Sequence:  Enzymatic Nucleic Acid
uucucagucugaugaggccguuaggccgaaauguacac

SEQ ID NO: 10994 - RNA, 38 nt, Artificial Sequence
  Description of Artificial Sequence:  Enzymatic Nucleic Acid
guucucagcugaugaggccguuaggccgaaaauguaca

SEQ ID NO: 10995 - RNA, 38 nt, Artificial Sequence
  Description of Artificial Sequence:  Enzymatic Nucleic Acid
agacauggcugaugaggccguuaggccgaaaucaccac

SEQ ID NO: 10996 - RNA, 38 nt, Artificial Sequence
  Description of Artificial Sequence:  Enzymatic Nucleic Acid
gagacaugcugaugaggccguuaggccgaaaaucacca

SEQ ID NO: 10997 - RNA, 38 nt, Artificial Sequence
  Description of Artificial Sequence:  Enzymatic Nucleic Acid
ggacccgacugaugaggccguuaggccgaaacauggaa

SEQ ID NO: 10998 - RNA, 38 nt, Artificial Sequence
  Description of Artificial Sequence:  Enzymatic Nucleic Acid
auggaccccugaugaggccguuaggccgaaagacaugg

SEQ ID NO: 10999 - RNA, 38 nt, Artificial Sequence
  Description of Artificial Sequence:  Enzymatic Nucleic Acid
uugaaaugcugaugaggccguuaggccgaaacccgaga

SEQ ID NO: 11000 - RNA, 38 nt, Artificial Sequence
  Description of Artificial Sequence:  Enzymatic Nucleic Acid
agauuugacugaugaggccguuaggccgaaauggaccc

SEQ ID NO: 11001 - RNA, 38 nt, Artificial Sequence
  Description of Artificial Sequence:  Enzymatic Nucleic Acid
gagauuugcugaugaggccguuaggccgaaaauggacc

SEQ ID NO: 11002 - RNA, 38 nt, Artificial Sequence
  Description of Artificial Sequence:  Enzymatic Nucleic Acid
ugagauuucugaugaggccguuaggccgaaaaauggac

SEQ ID NO: 11003 - RNA, 38 nt, Artificial Sequence
  Description of Artificial Sequence:  Enzymatic Nucleic Acid
cacguugacugaugaggccguuaggccgaaauuugaaa

SEQ ID NO: 11004 - RNA, 38 nt, Artificial Sequence
  Description of Artificial Sequence:  Enzymatic Nucleic Acid
gacacguucugaugaggccguuaggccgaaagauuuga

SEQ ID NO: 11005 - RNA, 38 nt, Artificial Sequence
  Description of Artificial Sequence:  Enzymatic Nucleic Acid
cacaaagucugaugaggccguuaggccgaaacacguug

SEQ ID NO: 11006 - RNA, 38 nt, Artificial Sequence
  Description of Artificial Sequence:  Enzymatic Nucleic Acid
cuugcacacugaugaggccguuaggccgaaagugacac

SEQ ID NO: 11007 - RNA, 38 nt, Artificial Sequence
  Description of Artificial Sequence:  Enzymatic Nucleic Acid
ucuugcaccugaugaggccguuaggccgaaaagugaca

SEQ ID NO: 11008 - RNA, 38 nt, Artificial Sequence
  Description of Artificial Sequence:  Enzymatic Nucleic Acid
uuucugggcugaugaggccguuaggccgaaaucuugca

SEQ ID NO: 11009 - RNA, 38 nt, Artificial Sequence
  Description of Artificial Sequence:  Enzymatic Nucleic Acid
caggaacacugaugaggccguuaggccgaaaucucuuu

SEQ ID NO: 11010 - RNA, 38 nt, Artificial Sequence
  Description of Artificial Sequence:  Enzymatic Nucleic Acid
ucaggaaccugaugaggccguuaggccgaaaaucucuu

SEQ ID NO: 11011 - RNA, 38 nt, Artificial Sequence
  Description of Artificial Sequence:  Enzymatic Nucleic Acid
ccaucaggcugaugaggccguuaggccgaaacaaaucu

SEQ ID NO: 11012 - RNA, 38 nt, Artificial Sequence
  Description of Artificial Sequence:  Enzymatic Nucleic Acid
accaucagcugaugaggccguuaggccgaaaacaaauc

SEQ ID NO: 11013 - RNA, 38 nt, Artificial Sequence
  Description of Artificial Sequence:  Enzymatic Nucleic Acid
aauucugucugaugaggccguuaggccgaaaccaucag

SEQ ID NO: 11014 - RNA, 38 nt, Artificial Sequence
  Description of Artificial Sequence:  Enzymatic Nucleic Acid
ucccaggacugaugaggccguuaggccgaaauucuguu

SEQ ID NO: 11015 - RNA, 38 nt, Artificial Sequence
  Description of Artificial Sequence:  Enzymatic Nucleic Acid
gucccaggcugaugaggccguuaggccgaaaauucugu

SEQ ID NO: 11016 - RNA, 38 nt, Artificial Sequence
  Description of Artificial Sequence:  Enzymatic Nucleic Acid
ugucccagcugaugaggccguuaggccgaaaaauucug

SEQ ID NO: 11017 - RNA, 38 nt, Artificial Sequence
  Description of Artificial Sequence:  Enzymatic Nucleic Acid
gaauaguacugaugaggccguuaggccgaaagcccuuc

SEQ ID NO: 11018 - RNA, 38 nt, Artificial Sequence
  Description of Artificial Sequence:  Enzymatic Nucleic Acid
ggaauagucugaugaggccguuaggccgaaaagcccuu

SEQ ID NO: 11019 - RNA, 38 nt, Artificial Sequence
  Description of Artificial Sequence:  Enzymatic Nucleic Acid
gggaauagcugaugaggccguuaggccgaaaaagcccu

SEQ ID NO: 11020 - RNA, 38 nt, Artificial Sequence
  Description of Artificial Sequence:  Enzymatic Nucleic Acid
gcugggaacugaugaggccguuaggccgaaaguaaagc

SEQ ID NO: 11021 - RNA, 38 nt, Artificial Sequence
  Description of Artificial Sequence:  Enzymatic Nucleic Acid
uagcugggcugaugaggccguuaggccgaaauaguaaa

SEQ ID NO: 11022 - RNA, 38 nt, Artificial Sequence
  Description of Artificial Sequence:  Enzymatic Nucleic Acid
guagcuggcugaugaggccguuaggccgaaaauaguaa

SEQ ID NO: 11023 - RNA, 38 nt, Artificial Sequence
  Description of Artificial Sequence:  Enzymatic Nucleic Acid
ugaucaugcugaugaggccguuaggccgaaagcuggga

SEQ ID NO: 11024 - RNA, 38 nt, Artificial Sequence
  Description of Artificial Sequence:  Enzymatic Nucleic Acid
gcauagcucugaugaggccguuaggccgaaaucaugua

SEQ ID NO: 11025 - RNA, 38 nt, Artificial Sequence
  Description of Artificial Sequence:  Enzymatic Nucleic Acid
ugccagcacugaugaggccguuaggccgaaagcugauc

SEQ ID NO: 11026 - RNA, 38 nt, Artificial Sequence
  Description of Artificial Sequence:  Enzymatic Nucleic Acid
ucacagaacugaugaggccguuaggccgaaaccaugcc

SEQ ID NO: 11027 - RNA, 38 nt, Artificial Sequence
  Description of Artificial Sequence:  Enzymatic Nucleic Acid
cuucacagcugaugaggccguuaggccgaaagaccaug

SEQ ID NO: 11028 - RNA, 38 nt, Artificial Sequence
  Description of Artificial Sequence:  Enzymatic Nucleic Acid
gcuucacacugaugaggccguuaggccgaaaagaccau

SEQ ID NO: 11029 - RNA, 38 nt, Artificial Sequence
  Description of Artificial Sequence:  Enzymatic Nucleic Acid
ucaucauucugaugaggccguuaggccgaaauuuuugc

SEQ ID NO: 11030 - RNA, 38 nt, Artificial Sequence
  Description of Artificial Sequence:  Enzymatic Nucleic Acid
uucaucaucugaugaggccguuaggccgaaaauuuuug

SEQ ID NO: 11031 - RNA, 38 nt, Artificial Sequence
  Description of Artificial Sequence:  Enzymatic Nucleic Acid
agacuggucugaugaggccguuaggccgaaacuuucau

SEQ ID NO: 11032 - RNA, 38 nt, Artificial Sequence
  Description of Artificial Sequence:  Enzymatic Nucleic Acid
uagacuggcugaugaggccguuaggccgaaaacuuuca

SEQ ID NO: 11033 - RNA, 38 nt, Artificial Sequence
  Description of Artificial Sequence:  Enzymatic Nucleic Acid
acauaauacugaugaggccguuaggccgaaacugguaa

SEQ ID NO: 11034 - RNA, 38 nt, Artificial Sequence
  Description of Artificial Sequence:  Enzymatic Nucleic Acid
guacauaacugaugaggccguuaggccgaaagacuggu

SEQ ID NO: 11035 - RNA, 38 nt, Artificial Sequence
  Description of Artificial Sequence:  Enzymatic Nucleic Acid
auguacaucugaugaggccguuaggccgaaauagacug

SEQ ID NO: 11036 - RNA, 38 nt, Artificial Sequence
  Description of Artificial Sequence:  Enzymatic Nucleic Acid
uauguacacugaugaggccguuaggccgaaaauagacu

SEQ ID NO: 11037 - RNA, 38 nt, Artificial Sequence
  Description of Artificial Sequence:  Enzymatic Nucleic Acid
caacuaugcugaugaggccguuaggccgaaacauaaua

SEQ ID NO: 11038 - RNA, 38 nt, Artificial Sequence
  Description of Artificial Sequence:  Enzymatic Nucleic Acid
acgacaaccugaugaggccguuaggccgaaauguacau

SEQ ID NO: 11039 - RNA, 38 nt, Artificial Sequence
  Description of Artificial Sequence:  Enzymatic Nucleic Acid
acaacgaccugaugaggccguuaggccgaaacuaugua

SEQ ID NO: 11040 - RNA, 38 nt, Artificial Sequence
  Description of Artificial Sequence:  Enzymatic Nucleic Acid
ccuacaaccugaugaggccguuaggccgaaacaacuau

SEQ ID NO: 11041 - RNA, 38 nt, Artificial Sequence
  Description of Artificial Sequence:  Enzymatic Nucleic Acid
uacccuaccugaugaggccguuaggccgaaacgacaac

SEQ ID NO: 11042 - RNA, 38 nt, Artificial Sequence
  Description of Artificial Sequence:  Enzymatic Nucleic Acid
cuauaccccugaugaggccguuaggccgaaacaacgac

SEQ ID NO: 11043 - RNA, 38 nt, Artificial Sequence
  Description of Artificial Sequence:  Enzymatic Nucleic Acid
aaauccuacugaugaggccguuaggccgaaacccuaca

SEQ ID NO: 11044 - RNA, 38 nt, Artificial Sequence
  Description of Artificial Sequence:  Enzymatic Nucleic Acid
auaaaucccugaugaggccguuaggccgaaauacccua

SEQ ID NO: 11045 - RNA, 38 nt, Artificial Sequence
  Description of Artificial Sequence:  Enzymatic Nucleic Acid
acaucauacugaugaggccguuaggccgaaauccuaua

SEQ ID NO: 11046 - RNA, 38 nt, Artificial Sequence
  Description of Artificial Sequence:  Enzymatic Nucleic Acid
cacaucaucugaugaggccguuaggccgaaaauccuau

SEQ ID NO: 11047 - RNA, 38 nt, Artificial Sequence
  Description of Artificial Sequence:  Enzymatic Nucleic Acid
ccacaucacugaugaggccguuaggccgaaaaauccua

SEQ ID NO: 11048 - RNA, 38 nt, Artificial Sequence
  Description of Artificial Sequence:  Enzymatic Nucleic Acid
ggacucagcugaugaggccguuaggccgaaaccacauc

SEQ ID NO: 11049 - RNA, 38 nt, Artificial Sequence
  Description of Artificial Sequence:  Enzymatic Nucleic Acid
cggacucacugaugaggccguuaggccgaaaaccacau

SEQ ID NO: 11050 - RNA, 38 nt, Artificial Sequence
  Description of Artificial Sequence:  Enzymatic Nucleic Acid
augagacgcugaugaggccguuaggccgaaacucagaa

SEQ ID NO: 11051 - RNA, 38 nt, Artificial Sequence
  Description of Artificial Sequence:  Enzymatic Nucleic Acid
uuccaugacugaugaggccguuaggccgaaacggacuc

SEQ ID NO: 11052 - RNA, 38 nt, Artificial Sequence
  Description of Artificial Sequence:  Enzymatic Nucleic Acid
aauuccaucugaugaggccguuaggccgaaagacggac

SEQ ID NO: 11053 - RNA, 38 nt, Artificial Sequence
  Description of Artificial Sequence:  Enzymatic Nucleic Acid
gauaguuccugaugaggccguuaggccgaaauuccaug

SEQ ID NO: 11054 - RNA, 38 nt, Artificial Sequence
  Description of Artificial Sequence:  Enzymatic Nucleic Acid
ccaacagacugaugaggccguuaggccgaaaguucaau

SEQ ID NO: 11055 - RNA, 38 nt, Artificial Sequence
  Description of Artificial Sequence:  Enzymatic Nucleic Acid
cuccaacacugaugaggccguuaggccgaaauaguuca

SEQ ID NO: 11056 - RNA, 38 nt, Artificial Sequence
  Description of Artificial Sequence:  Enzymatic Nucleic Acid
uuuucucccugaugaggccguuaggccgaaacagauag

SEQ ID NO: 11057 - RNA, 38 nt, Artificial Sequence
  Description of Artificial Sequence:  Enzymatic Nucleic Acid
uuuaagaccugaugaggccguuaggccgaaagcuuuuc

SEQ ID NO: 11058 - RNA, 38 nt, Artificial Sequence
  Description of Artificial Sequence:  Enzymatic Nucleic Acid
caauuuaacugaugaggccguuaggccgaaacaagcuu

SEQ ID NO: 11059 - RNA, 38 nt, Artificial Sequence
  Description of Artificial Sequence:  Enzymatic Nucleic Acid
uacaauuucugaugaggccguuaggccgaaagacaagc

SEQ ID NO: 11060 - RNA, 38 nt, Artificial Sequence
  Description of Artificial Sequence:  Enzymatic Nucleic Acid
guacaauucugaugaggccguuaggccgaaaagacaag

SEQ ID NO: 11061 - RNA, 38 nt, Artificial Sequence
  Description of Artificial Sequence:  Enzymatic Nucleic Acid
ugcuguaccugaugaggccguuaggccgaaauuuaaga

SEQ ID NO: 11062 - RNA, 38 nt, Artificial Sequence
  Description of Artificial Sequence:  Enzymatic Nucleic Acid
ucuugcugcugaugaggccguuaggccgaaacaauuua

SEQ ID NO: 11063 - RNA, 38 nt, Artificial Sequence
  Description of Artificial Sequence:  Enzymatic Nucleic Acid
cccacauucugaugaggccguuaggccgaaaguucagu

SEQ ID NO: 11064 - RNA, 38 nt, Artificial Sequence
  Description of Artificial Sequence:  Enzymatic Nucleic Acid
uugaaguccugaugaggccguuaggccgaaauccccac

SEQ ID NO: 11065 - RNA, 38 nt, Artificial Sequence
  Description of Artificial Sequence:  Enzymatic Nucleic Acid
cccaguugcugaugaggccguuaggccgaaagucaauc

SEQ ID NO: 11066 - RNA, 38 nt, Artificial Sequence
  Description of Artificial Sequence:  Enzymatic Nucleic Acid
ucccaguucugaugaggccguuaggccgaaaagucaau

SEQ ID NO: 11067 - RNA, 38 nt, Artificial Sequence
  Description of Artificial Sequence:  Enzymatic Nucleic Acid
aagaagggcugaugaggccguuaggccgaaauucccag

SEQ ID NO: 11068 - RNA, 38 nt, Artificial Sequence
  Description of Artificial Sequence:  Enzymatic Nucleic Acid
cuucgaagcugaugaggccguuaggccgaaaggguauu

SEQ ID NO: 11069 - RNA, 38 nt, Artificial Sequence
  Description of Artificial Sequence:  Enzymatic Nucleic Acid
gcuucgaacugaugaggccguuaggccgaaaaggguau

SEQ ID NO: 11070 - RNA, 38 nt, Artificial Sequence
  Description of Artificial Sequence:  Enzymatic Nucleic Acid
augcuucgcugaugaggccguuaggccgaaagaagggu

SEQ ID NO: 11071 - RNA, 38 nt, Artificial Sequence
  Description of Artificial Sequence:  Enzymatic Nucleic Acid
gaugcuuccugaugaggccguuaggccgaaaagaaggg

SEQ ID NO: 11072 - RNA, 38 nt, Artificial Sequence
  Description of Artificial Sequence:  Enzymatic Nucleic Acid
cuuaugcucugaugaggccguuaggccgaaaugcuucg

SEQ ID NO: 11073 - RNA, 38 nt, Artificial Sequence
  Description of Artificial Sequence:  Enzymatic Nucleic Acid
aaguuucucugaugaggccguuaggccgaaaugcugau

SEQ ID NO: 11074 - RNA, 38 nt, Artificial Sequence
  Description of Artificial Sequence:  Enzymatic Nucleic Acid
cgguuuaccugaugaggccguuaggccgaaaguuucuu

SEQ ID NO: 11075 - RNA, 38 nt, Artificial Sequence
  Description of Artificial Sequence:  Enzymatic Nucleic Acid
ucucgguucugaugaggccguuaggccgaaacaaguuu

SEQ ID NO: 11076 - RNA, 38 nt, Artificial Sequence
  Description of Artificial Sequence:  Enzymatic Nucleic Acid
uggguuuucugaugaggccguuaggccgaaaggucucg

SEQ ID NO: 11077 - RNA, 38 nt, Artificial Sequence
  Description of Artificial Sequence:  Enzymatic Nucleic Acid
cacucccacugaugaggccguuaggccgaaacuggguu

SEQ ID NO: 11078 - RNA, 38 nt, Artificial Sequence
  Description of Artificial Sequence:  Enzymatic Nucleic Acid
ugcucaaacugaugaggccguuaggccgaaauuucuuc

SEQ ID NO: 11079 - RNA, 38 nt, Artificial Sequence
  Description of Artificial Sequence:  Enzymatic Nucleic Acid
gugcucaacugaugaggccguuaggccgaaaauuucuu

SEQ ID NO: 11080 - RNA, 38 nt, Artificial Sequence
  Description of Artificial Sequence:  Enzymatic Nucleic Acid
ggugcucacugaugaggccguuaggccgaaaaauuucu

SEQ ID NO: 11081 - RNA, 38 nt, Artificial Sequence
  Description of Artificial Sequence:  Enzymatic Nucleic Acid
aggugcuccugaugaggccguuaggccgaaaaaauuuc

SEQ ID NO: 11082 - RNA, 38 nt, Artificial Sequence
  Description of Artificial Sequence:  Enzymatic Nucleic Acid
cuauaguucugaugaggccguuaggccgaaaggugcuc

SEQ ID NO: 11083 - RNA, 38 nt, Artificial Sequence
  Description of Artificial Sequence:  Enzymatic Nucleic Acid
ucuauagucugaugaggccguuaggccgaaaaggugcu

SEQ ID NO: 11084 - RNA, 38 nt, Artificial Sequence
  Description of Artificial Sequence:  Enzymatic Nucleic Acid
accaucuacugaugaggccguuaggccgaaaguuaagg

SEQ ID NO: 11085 - RNA, 38 nt, Artificial Sequence
  Description of Artificial Sequence:  Enzymatic Nucleic Acid
acaccauccugaugaggccguuaggccgaaauaguuaa

SEQ ID NO: 11086 - RNA, 38 nt, Artificial Sequence
  Description of Artificial Sequence:  Enzymatic Nucleic Acid
cuccgggucugaugaggccguuaggccgaaacaccauc

SEQ ID NO: 11087 - RNA, 38 nt, Artificial Sequence
  Description of Artificial Sequence:  Enzymatic Nucleic Acid
agguguaccugaugaggccguuaggccgaaauccuugg

SEQ ID NO: 11088 - RNA, 38 nt, Artificial Sequence
  Description of Artificial Sequence:  Enzymatic Nucleic Acid
cacaggugcugaugaggccguuaggccgaaacaauccu

SEQ ID NO: 11089 - RNA, 38 nt, Artificial Sequence
  Description of Artificial Sequence:  Enzymatic Nucleic Acid
gcccacugcugaugaggccguuaggccgaaaugcugca

SEQ ID NO: 11090 - RNA, 38 nt, Artificial Sequence
  Description of Artificial Sequence:  Enzymatic Nucleic Acid
cccugacacugaugaggccguuaggccgaaaugugcug

SEQ ID NO: 11091 - RNA, 38 nt, Artificial Sequence
  Description of Artificial Sequence:  Enzymatic Nucleic Acid
acccugaccugaugaggccguuaggccgaaaaugugcu

SEQ ID NO: 11092 - RNA, 38 nt, Artificial Sequence
  Description of Artificial Sequence:  Enzymatic Nucleic Acid
uggacccucugaugaggccguuaggccgaaacaaaugu

SEQ ID NO: 11093 - RNA, 38 nt, Artificial Sequence
  Description of Artificial Sequence:  Enzymatic Nucleic Acid
uuuucaugcugaugaggccguuaggccgaaacccugac

SEQ ID NO: 11094 - RNA, 38 nt, Artificial Sequence
  Description of Artificial Sequence:  Enzymatic Nucleic Acid
agcaacaacugaugaggccguuaggccgaaagguuuuu

SEQ ID NO: 11095 - RNA, 38 nt, Artificial Sequence
  Description of Artificial Sequence:  Enzymatic Nucleic Acid
aagcaacacugaugaggccguuaggccgaaaagguuuu

SEQ ID NO: 11096 - RNA, 38 nt, Artificial Sequence
  Description of Artificial Sequence:  Enzymatic Nucleic Acid
aaagcaaccugaugaggccguuaggccgaaaaagguuu

SEQ ID NO: 11097 - RNA, 38 nt, Artificial Sequence
  Description of Artificial Sequence:  Enzymatic Nucleic Acid
ccaaaagccugaugaggccguuaggccgaaacaaaagg

SEQ ID NO: 11098 - RNA, 38 nt, Artificial Sequence
  Description of Artificial Sequence:  Enzymatic Nucleic Acid
acuuccaacugaugaggccguuaggccgaaagcaacaa

SEQ ID NO: 11099 - RNA, 38 nt, Artificial Sequence
  Description of Artificial Sequence:  Enzymatic Nucleic Acid
cacuuccacugaugaggccguuaggccgaaaagcaaca

SEQ ID NO: 11100 - RNA, 38 nt, Artificial Sequence
  Description of Artificial Sequence:  Enzymatic Nucleic Acid
ccacuucccugaugaggccguuaggccgaaaaagcaac

SEQ ID NO: 11101 - RNA, 38 nt, Artificial Sequence
  Description of Artificial Sequence:  Enzymatic Nucleic Acid
ccaccagacugaugaggccguuaggccgaaauuccaug

SEQ ID NO: 11102 - RNA, 38 nt, Artificial Sequence
  Description of Artificial Sequence:  Enzymatic Nucleic Acid
uuccaccacugaugaggccguuaggccgaaagauucca

SEQ ID NO: 11103 - RNA, 38 nt, Artificial Sequence
  Description of Artificial Sequence:  Enzymatic Nucleic Acid
gggauucucugaugaggccguuaggccgaaacacgcuc

SEQ ID NO: 11104 - RNA, 38 nt, Artificial Sequence
  Description of Artificial Sequence:  Enzymatic Nucleic Acid
uucgcaggcugaugaggccguuaggccgaaauucugac

SEQ ID NO: 11105 - RNA, 38 nt, Artificial Sequence
  Description of Artificial Sequence:  Enzymatic Nucleic Acid
aaccaaggcugaugaggccguuaggccgaaacuucgca

SEQ ID NO: 11106 - RNA, 38 nt, Artificial Sequence
  Description of Artificial Sequence:  Enzymatic Nucleic Acid
ggguaacccugaugaggccguuaggccgaaagguacuu

SEQ ID NO: 11107 - RNA, 38 nt, Artificial Sequence
  Description of Artificial Sequence:  Enzymatic Nucleic Acid
gggugggucugaugaggccguuaggccgaaaccaaggu

SEQ ID NO: 11108 - RNA, 38 nt, Artificial Sequence
  Description of Artificial Sequence:  Enzymatic Nucleic Acid
ggggugggcugaugaggccguuaggccgaaaaccaagg

SEQ ID NO: 11109 - RNA, 38 nt, Artificial Sequence
  Description of Artificial Sequence:  Enzymatic Nucleic Acid
uaccauuucugaugaggccguuaggccgaaauuucugg

SEQ ID NO: 11110 - RNA, 38 nt, Artificial Sequence
  Description of Artificial Sequence:  Enzymatic Nucleic Acid
cauuuuuacugaugaggccguuaggccgaaaccauuuu

SEQ ID NO: 11111 - RNA, 38 nt, Artificial Sequence
  Description of Artificial Sequence:  Enzymatic Nucleic Acid
uccauuuucugaugaggccguuaggccgaaauaccauu

SEQ ID NO: 11112 - RNA, 38 nt, Artificial Sequence
  Description of Artificial Sequence:  Enzymatic Nucleic Acid
ucaaggggcugaugaggccguuaggccgaaauuccauu

SEQ ID NO: 11113 - RNA, 38 nt, Artificial Sequence
  Description of Artificial Sequence:  Enzymatic Nucleic Acid
uuggacuccugaugaggccguuaggccgaaagggguau

SEQ ID NO: 11114 - RNA, 38 nt, Artificial Sequence
  Description of Artificial Sequence:  Enzymatic Nucleic Acid
ugugauugcugaugaggccguuaggccgaaacucaagg

SEQ ID NO: 11115 - RNA, 38 nt, Artificial Sequence
  Description of Artificial Sequence:  Enzymatic Nucleic Acid
aauugugucugaugaggccguuaggccgaaauuggacu

SEQ ID NO: 11116 - RNA, 38 nt, Artificial Sequence
  Description of Artificial Sequence:  Enzymatic Nucleic Acid
cccgcuuucugaugaggccguuaggccgaaauugugug

SEQ ID NO: 11117 - RNA, 38 nt, Artificial Sequence
  Description of Artificial Sequence:  Enzymatic Nucleic Acid
ccccgcuucugaugaggccguuaggccgaaaauugugu

SEQ ID NO: 11118 - RNA, 38 nt, Artificial Sequence
  Description of Artificial Sequence:  Enzymatic Nucleic Acid
aucgucagcugaugaggccguuaggccgaaacaugccc

SEQ ID NO: 11119 - RNA, 38 nt, Artificial Sequence
  Description of Artificial Sequence:  Enzymatic Nucleic Acid
acuuccaucugaugaggccguuaggccgaaaucgucag

SEQ ID NO: 11120 - RNA, 38 nt, Artificial Sequence
  Description of Artificial Sequence:  Enzymatic Nucleic Acid
cacuuccacugaugaggccguuaggccgaaaaucguca

SEQ ID NO: 11121 - RNA, 38 nt, Artificial Sequence
  Description of Artificial Sequence:  Enzymatic Nucleic Acid
gacagugucugaugaggccguuaggccgaaauuuccug

SEQ ID NO: 11122 - RNA, 38 nt, Artificial Sequence
  Description of Artificial Sequence:  Enzymatic Nucleic Acid
ugacagugcugaugaggccguuaggccgaaaauuuccu

SEQ ID NO: 11123 - RNA, 38 nt, Artificial Sequence
  Description of Artificial Sequence:  Enzymatic Nucleic Acid
guaaggaucugaugaggccguuaggccgaaacagugua

SEQ ID NO: 11124 - RNA, 38 nt, Artificial Sequence
  Description of Artificial Sequence:  Enzymatic Nucleic Acid
uugguaagcugaugaggccguuaggccgaaaugacagu

SEQ ID NO: 11125 - RNA, 38 nt, Artificial Sequence
  Description of Artificial Sequence:  Enzymatic Nucleic Acid
ggauuggucugaugaggccguuaggccgaaaggaugac

SEQ ID NO: 11126 - RNA, 38 nt, Artificial Sequence
  Description of Artificial Sequence:  Enzymatic Nucleic Acid
gggauuggcugaugaggccguuaggccgaaaaggauga

SEQ ID NO: 11127 - RNA, 38 nt, Artificial Sequence
  Description of Artificial Sequence:  Enzymatic Nucleic Acid
ugaaauggcugaugaggccguuaggccgaaauugguaa

SEQ ID NO: 11128 - RNA, 38 nt, Artificial Sequence
  Description of Artificial Sequence:  Enzymatic Nucleic Acid
uccuuugacugaugaggccguuaggccgaaaugggauu

SEQ ID NO: 11129 - RNA, 38 nt, Artificial Sequence
  Description of Artificial Sequence:  Enzymatic Nucleic Acid
cuccuuugcugaugaggccguuaggccgaaaaugggau

SEQ ID NO: 11130 - RNA, 38 nt, Artificial Sequence
  Description of Artificial Sequence:  Enzymatic Nucleic Acid
ucuccuuucugaugaggccguuaggccgaaaaauggga

SEQ ID NO: 11131 - RNA, 38 nt, Artificial Sequence
  Description of Artificial Sequence:  Enzymatic Nucleic Acid
accagagacugaugaggccguuaggccgaaaccacaug

SEQ ID NO: 11132 - RNA, 38 nt, Artificial Sequence
  Description of Artificial Sequence:  Enzymatic Nucleic Acid
caaccagacugaugaggccguuaggccgaaagaccaca

SEQ ID NO: 11133 - RNA, 38 nt, Artificial Sequence
  Description of Artificial Sequence:  Enzymatic Nucleic Acid
cacaaccacugaugaggccguuaggccgaaagagacca

SEQ ID NO: 11134 - RNA, 38 nt, Artificial Sequence
  Description of Artificial Sequence:  Enzymatic Nucleic Acid
acauacaccugaugaggccguuaggccgaaaccagaga

SEQ ID NO: 11135 - RNA, 38 nt, Artificial Sequence
  Description of Artificial Sequence:  Enzymatic Nucleic Acid
gugggacacugaugaggccguuaggccgaaacacaacc

SEQ ID NO: 11136 - RNA, 38 nt, Artificial Sequence
  Description of Artificial Sequence:  Enzymatic Nucleic Acid
ugggguggcugaugaggccguuaggccgaaacauacac

SEQ ID NO: 11137 - RNA, 38 nt, Artificial Sequence
  Description of Artificial Sequence:  Enzymatic Nucleic Acid
uucucacccugaugaggccguuaggccgaaaucugggg

SEQ ID NO: 11138 - RNA, 38 nt, Artificial Sequence
  Description of Artificial Sequence:  Enzymatic Nucleic Acid
agauuagacugaugaggccguuaggccgaaauuucuca

SEQ ID NO: 11139 - RNA, 38 nt, Artificial Sequence
  Description of Artificial Sequence:  Enzymatic Nucleic Acid
agagauuacugaugaggccguuaggccgaaagauuucu

SEQ ID NO: 11140 - RNA, 38 nt, Artificial Sequence
  Description of Artificial Sequence:  Enzymatic Nucleic Acid
ggagagaucugaugaggccguuaggccgaaagagauuu

SEQ ID NO: 11141 - RNA, 38 nt, Artificial Sequence
  Description of Artificial Sequence:  Enzymatic Nucleic Acid
acaggagacugaugaggccguuaggccgaaauuagaga

SEQ ID NO: 11142 - RNA, 38 nt, Artificial Sequence
  Description of Artificial Sequence:  Enzymatic Nucleic Acid
ccacaggacugaugaggccguuaggccgaaagauuaga

SEQ ID NO: 11143 - RNA, 38 nt, Artificial Sequence
  Description of Artificial Sequence:  Enzymatic Nucleic Acid
auccacagcugaugaggccguuaggccgaaagagauua

SEQ ID NO: 11144 - RNA, 38 nt, Artificial Sequence
  Description of Artificial Sequence:  Enzymatic Nucleic Acid
cugguaggcugaugaggccguuaggccgaaauccacag

SEQ ID NO: 11145 - RNA, 38 nt, Artificial Sequence
  Description of Artificial Sequence:  Enzymatic Nucleic Acid
acugguagcugaugaggccguuaggccgaaaauccaca

SEQ ID NO: 11146 - RNA, 38 nt, Artificial Sequence
  Description of Artificial Sequence:  Enzymatic Nucleic Acid
cguacuggcugaugaggccguuaggccgaaaggaaucc

SEQ ID NO: 11147 - RNA, 38 nt, Artificial Sequence
  Description of Artificial Sequence:  Enzymatic Nucleic Acid
uggugccgcugaugaggccguuaggccgaaacugguag

SEQ ID NO: 11148 - RNA, 38 nt, Artificial Sequence
  Description of Artificial Sequence:  Enzymatic Nucleic Acid
cagcguuucugaugaggccguuaggccgaaaguggugc

SEQ ID NO: 11149 - RNA, 38 nt, Artificial Sequence
  Description of Artificial Sequence:  Enzymatic Nucleic Acid
auagaccgcugaugaggccguuaggccgaaacauguca

SEQ ID NO: 11150 - RNA, 38 nt, Artificial Sequence
  Description of Artificial Sequence:  Enzymatic Nucleic Acid
auggcauacugaugaggccguuaggccgaaaccguaca

SEQ ID NO: 11151 - RNA, 38 nt, Artificial Sequence
  Description of Artificial Sequence:  Enzymatic Nucleic Acid
gaauggcacugaugaggccguuaggccgaaagaccgua

SEQ ID NO: 11152 - RNA, 38 nt, Artificial Sequence
  Description of Artificial Sequence:  Enzymatic Nucleic Acid
gggggaggcugaugaggccguuaggccgaaauggcaua

SEQ ID NO: 11153 - RNA, 38 nt, Artificial Sequence
  Description of Artificial Sequence:  Enzymatic Nucleic Acid
cgggggagcugaugaggccguuaggccgaaaauggcau

SEQ ID NO: 11154 - RNA, 38 nt, Artificial Sequence
  Description of Artificial Sequence:  Enzymatic Nucleic Acid
augcggggcugaugaggccguuaggccgaaaggaaugg

SEQ ID NO: 11155 - RNA, 38 nt, Artificial Sequence
  Description of Artificial Sequence:  Enzymatic Nucleic Acid
guggaugucugaugaggccguuaggccgaaaugcgggg

SEQ ID NO: 11156 - RNA, 38 nt, Artificial Sequence
  Description of Artificial Sequence:  Enzymatic Nucleic Acid
uaccagugcugaugaggccguuaggccgaaaugugaug

SEQ ID NO: 11157 - RNA, 38 nt, Artificial Sequence
  Description of Artificial Sequence:  Enzymatic Nucleic Acid
acugccaacugaugaggccguuaggccgaaaccagugg

SEQ ID NO: 11158 - RNA, 38 nt, Artificial Sequence
  Description of Artificial Sequence:  Enzymatic Nucleic Acid
caacugcccugaugaggccguuaggccgaaauaccagu

SEQ ID NO: 11159 - RNA, 38 nt, Artificial Sequence
  Description of Artificial Sequence:  Enzymatic Nucleic Acid
cuuccucccugaugaggccguuaggccgaaacugccaa

SEQ ID NO: 11160 - RNA, 38 nt, Artificial Sequence
  Description of Artificial Sequence:  Enzymatic Nucleic Acid
gucacugacugaugaggccguuaggccgaaacagcuug

SEQ ID NO: 11161 - RNA, 38 nt, Artificial Sequence
  Description of Artificial Sequence:  Enzymatic Nucleic Acid
uugucacucugaugaggccguuaggccgaaagacagcu

SEQ ID NO: 11162 - RNA, 38 nt, Artificial Sequence
  Description of Artificial Sequence:  Enzymatic Nucleic Acid
cacaagggcugaugaggccguuaggccgaaauggguuu

SEQ ID NO: 11163 - RNA, 38 nt, Artificial Sequence
  Description of Artificial Sequence:  Enzymatic Nucleic Acid
uucuucaccugaugaggccguuaggccgaaaggguaug

SEQ ID NO: 11164 - RNA, 38 nt, Artificial Sequence
  Description of Artificial Sequence:  Enzymatic Nucleic Acid
cucccuggcugaugaggccguuaggccgaaaguccucc

SEQ ID NO: 11165 - RNA, 38 nt, Artificial Sequence
  Description of Artificial Sequence:  Enzymatic Nucleic Acid
ccucccugcugaugaggccguuaggccgaaaaguccuc

SEQ ID NO: 11166 - RNA, 38 nt, Artificial Sequence
  Description of Artificial Sequence:  Enzymatic Nucleic Acid
uucaauuucugaugaggccguuaggccgaaauuuccuc

SEQ ID NO: 11167 - RNA, 38 nt, Artificial Sequence
  Description of Artificial Sequence:  Enzymatic Nucleic Acid
uuaacuuccugaugaggccguuaggccgaaauuuuauu

SEQ ID NO: 11168 - RNA, 38 nt, Artificial Sequence
  Description of Artificial Sequence:  Enzymatic Nucleic Acid
uuuuuauucugaugaggccguuaggccgaaacuucaau

SEQ ID NO: 11169 - RNA, 38 nt, Artificial Sequence
  Description of Artificial Sequence:  Enzymatic Nucleic Acid
auuuuuaucugaugaggccguuaggccgaaaacuucaa

SEQ ID NO: 11170 - RNA, 38 nt, Artificial Sequence
  Description of Artificial Sequence:  Enzymatic Nucleic Acid
uugauuuucugaugaggccguuaggccgaaauuaacuu

SEQ ID NO: 11171 - RNA, 38 nt, Artificial Sequence
  Description of Artificial Sequence:  Enzymatic Nucleic Acid
agcaaauucugaugaggccguuaggccgaaauuuuuau

SEQ ID NO: 11172 - RNA, 38 nt, Artificial Sequence
  Description of Artificial Sequence:  Enzymatic Nucleic Acid
uuagagcacugaugaggccguuaggccgaaauugauuu

SEQ ID NO: 11173 - RNA, 38 nt, Artificial Sequence
  Description of Artificial Sequence:  Enzymatic Nucleic Acid
auuagagccugaugaggccguuaggccgaaaauugauu

SEQ ID NO: 11174 - RNA, 38 nt, Artificial Sequence
  Description of Artificial Sequence:  Enzymatic Nucleic Acid
uucaauuacugaugaggccguuaggccgaaagcaaauu

SEQ ID NO: 11175 - RNA, 38 nt, Artificial Sequence
  Description of Artificial Sequence:  Enzymatic Nucleic Acid
ccuucaaucugaugaggccguuaggccgaaagagcaaa

SEQ ID NO: 11176 - RNA, 38 nt, Artificial Sequence
  Description of Artificial Sequence:  Enzymatic Nucleic Acid
uuuccuuccugaugaggccguuaggccgaaauuagagc

SEQ ID NO: 11177 - RNA, 38 nt, Artificial Sequence
  Description of Artificial Sequence:  Enzymatic Nucleic Acid
aggguacucugaugaggccguuaggccgaaacaguuuu

SEQ ID NO: 11178 - RNA, 38 nt, Artificial Sequence
  Description of Artificial Sequence:  Enzymatic Nucleic Acid
aacaagggcugaugaggccguuaggccgaaacuuacag

SEQ ID NO: 11179 - RNA, 38 nt, Artificial Sequence
  Description of Artificial Sequence:  Enzymatic Nucleic Acid
uggauaaccugaugaggccguuaggccgaaaggguacu

SEQ ID NO: 11180 - RNA, 38 nt, Artificial Sequence
  Description of Artificial Sequence:  Enzymatic Nucleic Acid
gcuuggaucugaugaggccguuaggccgaaacaagggu

SEQ ID NO: 11181 - RNA, 38 nt, Artificial Sequence
  Description of Artificial Sequence:  Enzymatic Nucleic Acid
cgcuuggacugaugaggccguuaggccgaaaacaaggg

SEQ ID NO: 11182 - RNA, 38 nt, Artificial Sequence
  Description of Artificial Sequence:  Enzymatic Nucleic Acid
gccgcuugcugaugaggccguuaggccgaaauaacaag

SEQ ID NO: 11183 - RNA, 38 nt, Artificial Sequence
  Description of Artificial Sequence:  Enzymatic Nucleic Acid
acaaagcucugaugaggccguuaggccgaaacacauuu

SEQ ID NO: 11184 - RNA, 38 nt, Artificial Sequence
  Description of Artificial Sequence:  Enzymatic Nucleic Acid
uuuguacacugaugaggccguuaggccgaaagcugaca

SEQ ID NO: 11185 - RNA, 38 nt, Artificial Sequence
  Description of Artificial Sequence:  Enzymatic Nucleic Acid
auuuguaccugaugaggccguuaggccgaaaagcugac

SEQ ID NO: 11186 - RNA, 38 nt, Artificial Sequence
  Description of Artificial Sequence:  Enzymatic Nucleic Acid
cacauuugcugaugaggccguuaggccgaaacaaagcu

SEQ ID NO: 11187 - RNA, 38 nt, Artificial Sequence
  Description of Artificial Sequence:  Enzymatic Nucleic Acid
acuuuguucugaugaggccguuaggccgaaaccgcuuc

SEQ ID NO: 11188 - RNA, 38 nt, Artificial Sequence
  Description of Artificial Sequence:  Enzymatic Nucleic Acid
ccucuccccugaugaggccguuaggccgaaacuuuguu

SEQ ID NO: 11189 - RNA, 38 nt, Artificial Sequence
  Description of Artificial Sequence:  Enzymatic Nucleic Acid
uggaaggacugaugaggccguuaggccgaaaucacccu

SEQ ID NO: 11190 - RNA, 38 nt, Artificial Sequence
  Description of Artificial Sequence:  Enzymatic Nucleic Acid
cguggaagcugaugaggccguuaggccgaaagaucacc

SEQ ID NO: 11191 - RNA, 38 nt, Artificial Sequence
  Description of Artificial Sequence:  Enzymatic Nucleic Acid
ucacguggcugaugaggccguuaggccgaaaggagauc

SEQ ID NO: 11192 - RNA, 38 nt, Artificial Sequence
  Description of Artificial Sequence:  Enzymatic Nucleic Acid
gucacgugcugaugaggccguuaggccgaaaaggagau

SEQ ID NO: 11193 - RNA, 38 nt, Artificial Sequence
  Description of Artificial Sequence:  Enzymatic Nucleic Acid
aauuucagcugaugaggccguuaggccgaaaccccugg

SEQ ID NO: 11194 - RNA, 38 nt, Artificial Sequence
  Description of Artificial Sequence:  Enzymatic Nucleic Acid
ugcaaagucugaugaggccguuaggccgaaauuucagg

SEQ ID NO: 11195 - RNA, 38 nt, Artificial Sequence
  Description of Artificial Sequence:  Enzymatic Nucleic Acid
uugcaaagcugaugaggccguuaggccgaaaauuucag

SEQ ID NO: 11196 - RNA, 38 nt, Artificial Sequence
  Description of Artificial Sequence:  Enzymatic Nucleic Acid
agguugcacugaugaggccguuaggccgaaaguaauuu

SEQ ID NO: 11197 - RNA, 38 nt, Artificial Sequence
  Description of Artificial Sequence:  Enzymatic Nucleic Acid
cagguugccugaugaggccguuaggccgaaaaguaauu

SEQ ID NO: 11198 - RNA, 38 nt, Artificial Sequence
  Description of Artificial Sequence:  Enzymatic Nucleic Acid
accacaaacugaugaggccguuaggccgaaacacgcuc

SEQ ID NO: 11199 - RNA, 38 nt, Artificial Sequence
  Description of Artificial Sequence:  Enzymatic Nucleic Acid
gcaccacacugaugaggccguuaggccgaaagacacgc

SEQ ID NO: 11200 - RNA, 38 nt, Artificial Sequence
  Description of Artificial Sequence:  Enzymatic Nucleic Acid
ugcaccaccugaugaggccguuaggccgaaaagacacg

SEQ ID NO: 11201 - RNA, 38 nt, Artificial Sequence
  Description of Artificial Sequence:  Enzymatic Nucleic Acid
caaacguacugaugaggccguuaggccgaaaucugucu

SEQ ID NO: 11202 - RNA, 38 nt, Artificial Sequence
  Description of Artificial Sequence:  Enzymatic Nucleic Acid
cucaaacgcugaugaggccguuaggccgaaagaucugu

SEQ ID NO: 11203 - RNA, 38 nt, Artificial Sequence
  Description of Artificial Sequence:  Enzymatic Nucleic Acid
gguucucacugaugaggccguuaggccgaaacguagau

SEQ ID NO: 11204 - RNA, 38 nt, Artificial Sequence
  Description of Artificial Sequence:  Enzymatic Nucleic Acid
agguucuccugaugaggccguuaggccgaaaacguaga

SEQ ID NO: 11205 - RNA, 38 nt, Artificial Sequence
  Description of Artificial Sequence:  Enzymatic Nucleic Acid
uaccaugucugaugaggccguuaggccgaaagguucuc

SEQ ID NO: 11206 - RNA, 38 nt, Artificial Sequence
  Description of Artificial Sequence:  Enzymatic Nucleic Acid
caagcuugcugaugaggccguuaggccgaaaccaugug

SEQ ID NO: 11207 - RNA, 38 nt, Artificial Sequence
  Description of Artificial Sequence:  Enzymatic Nucleic Acid
ugugggcccugaugaggccguuaggccgaaagcuugua

SEQ ID NO: 11208 - RNA, 38 nt, Artificial Sequence
  Description of Artificial Sequence:  Enzymatic Nucleic Acid
gauuggcacugaugaggccguuaggccgaaaggcugug

SEQ ID NO: 11209 - RNA, 38 nt, Artificial Sequence
  Description of Artificial Sequence:  Enzymatic Nucleic Acid
cccacaugcugaugaggccguuaggccgaaauuggcag

SEQ ID NO: 11210 - RNA, 38 nt, Artificial Sequence
  Description of Artificial Sequence:  Enzymatic Nucleic Acid
gugugggccugaugaggccguuaggccgaaacucuccc

SEQ ID NO: 11211 - RNA, 38 nt, Artificial Sequence
  Description of Artificial Sequence:  Enzymatic Nucleic Acid
uucuugcacugaugaggccguuaggccgaaacaggugu

SEQ ID NO: 11212 - RNA, 38 nt, Artificial Sequence
  Description of Artificial Sequence:  Enzymatic Nucleic Acid
guucuugccugaugaggccguuaggccgaaaacaggug

SEQ ID NO: 11213 - RNA, 38 nt, Artificial Sequence
  Description of Artificial Sequence:  Enzymatic Nucleic Acid
gaguaucccugaugaggccguuaggccgaaaguucuug

SEQ ID NO: 11214 - RNA, 38 nt, Artificial Sequence
  Description of Artificial Sequence:  Enzymatic Nucleic Acid
ccaaagagcugaugaggccguuaggccgaaauccaagu

SEQ ID NO: 11215 - RNA, 38 nt, Artificial Sequence
  Description of Artificial Sequence:  Enzymatic Nucleic Acid
uuuccaaacugaugaggccguuaggccgaaaguaucca

SEQ ID NO: 11216 - RNA, 38 nt, Artificial Sequence
  Description of Artificial Sequence:  Enzymatic Nucleic Acid
aauuuccacugaugaggccguuaggccgaaagaguauc

SEQ ID NO: 11217 - RNA, 38 nt, Artificial Sequence
  Description of Artificial Sequence:  Enzymatic Nucleic Acid
caauuucccugaugaggccguuaggccgaaaagaguau

SEQ ID NO: 11218 - RNA, 38 nt, Artificial Sequence
  Description of Artificial Sequence:  Enzymatic Nucleic Acid
uggcauuccugaugaggccguuaggccgaaauuuccaa

SEQ ID NO: 11219 - RNA, 38 nt, Artificial Sequence
  Description of Artificial Sequence:  Enzymatic Nucleic Acid
uauuagagcugaugaggccguuaggccgaaacauggug

SEQ ID NO: 11220 - RNA, 38 nt, Artificial Sequence
  Description of Artificial Sequence:  Enzymatic Nucleic Acid
cuauuagacugaugaggccguuaggccgaaaacauggu

SEQ ID NO: 11221 - RNA, 38 nt, Artificial Sequence
  Description of Artificial Sequence:  Enzymatic Nucleic Acid
ugcuauuacugaugaggccguuaggccgaaagaacaug

SEQ ID NO: 11222 - RNA, 38 nt, Artificial Sequence
  Description of Artificial Sequence:  Enzymatic Nucleic Acid
ugugcuaucugaugaggccguuaggccgaaagagaaca

SEQ ID NO: 11223 - RNA, 38 nt, Artificial Sequence
  Description of Artificial Sequence:  Enzymatic Nucleic Acid
auuugugccugaugaggccguuaggccgaaauuagaga

SEQ ID NO: 11224 - RNA, 38 nt, Artificial Sequence
  Description of Artificial Sequence:  Enzymatic Nucleic Acid
augaucaacugaugaggccguuaggccgaaaugucauu

SEQ ID NO: 11225 - RNA, 38 nt, Artificial Sequence
  Description of Artificial Sequence:  Enzymatic Nucleic Acid
caugaucacugaugaggccguuaggccgaaaaugucau

SEQ ID NO: 11226 - RNA, 38 nt, Artificial Sequence
  Description of Artificial Sequence:  Enzymatic Nucleic Acid
ccaugauccugaugaggccguuaggccgaaaaauguca

SEQ ID NO: 11227 - RNA, 38 nt, Artificial Sequence
  Description of Artificial Sequence:  Enzymatic Nucleic Acid
agcuccaucugaugaggccguuaggccgaaaucaaaau

SEQ ID NO: 11228 - RNA, 38 nt, Artificial Sequence
  Description of Artificial Sequence:  Enzymatic Nucleic Acid
gcauucuucugaugaggccguuaggccgaaagcuccau

SEQ ID NO: 11229 - RNA, 38 nt, Artificial Sequence
  Description of Artificial Sequence:  Enzymatic Nucleic Acid
ugcauucucugaugaggccguuaggccgaaaagcucca

SEQ ID NO: 11230 - RNA, 38 nt, Artificial Sequence
  Description of Artificial Sequence:  Enzymatic Nucleic Acid
ccugcaagcugaugaggccguuaggccgaaaugcauuc

SEQ ID NO: 11231 - RNA, 38 nt, Artificial Sequence
  Description of Artificial Sequence:  Enzymatic Nucleic Acid
gguccugccugaugaggccguuaggccgaaaggaugca

SEQ ID NO: 11232 - RNA, 38 nt, Artificial Sequence
  Description of Artificial Sequence:  Enzymatic Nucleic Acid
ggcagacacugaugaggccguuaggccgaaagucuccu

SEQ ID NO: 11233 - RNA, 38 nt, Artificial Sequence
  Description of Artificial Sequence:  Enzymatic Nucleic Acid
gcaaggcacugaugaggccguuaggccgaaacauaguc

SEQ ID NO: 11234 - RNA, 38 nt, Artificial Sequence
  Description of Artificial Sequence:  Enzymatic Nucleic Acid
ucuugagccugaugaggccguuaggccgaaaggcagac

SEQ ID NO: 11235 - RNA, 38 nt, Artificial Sequence
  Description of Artificial Sequence:  Enzymatic Nucleic Acid
ccugucuucugaugaggccguuaggccgaaagcaaggc

SEQ ID NO: 11236 - RNA, 38 nt, Artificial Sequence
  Description of Artificial Sequence:  Enzymatic Nucleic Acid
gaccacgccugaugaggccguuaggccgaaaugucuuu

SEQ ID NO: 11237 - RNA, 38 nt, Artificial Sequence
  Description of Artificial Sequence:  Enzymatic Nucleic Acid
agcugccucugaugaggccguuaggccgaaaccacgca

SEQ ID NO: 11238 - RNA, 38 nt, Artificial Sequence
  Description of Artificial Sequence:  Enzymatic Nucleic Acid
aggacugucugaugaggccguuaggccgaaagcugccu

SEQ ID NO: 11239 - RNA, 38 nt, Artificial Sequence
  Description of Artificial Sequence:  Enzymatic Nucleic Acid
cgcucuagcugaugaggccguuaggccgaaacugugag

SEQ ID NO: 11240 - RNA, 38 nt, Artificial Sequence
  Description of Artificial Sequence:  Enzymatic Nucleic Acid
acacgcuccugaugaggccguuaggccgaaaggacugu

SEQ ID NO: 11241 - RNA, 38 nt, Artificial Sequence
  Description of Artificial Sequence:  Enzymatic Nucleic Acid
uuuccugucugaugaggccguuaggccgaaaucguggg

SEQ ID NO: 11242 - RNA, 38 nt, Artificial Sequence
  Description of Artificial Sequence:  Enzymatic Nucleic Acid
ugucgucucugaugaggccguuaggccgaaauucucca

SEQ ID NO: 11243 - RNA, 38 nt, Artificial Sequence
  Description of Artificial Sequence:  Enzymatic Nucleic Acid
uuccccaacugaugaggccguuaggccgaaacuugucg

SEQ ID NO: 11244 - RNA, 38 nt, Artificial Sequence
  Description of Artificial Sequence:  Enzymatic Nucleic Acid
cuuucccccugaugaggccguuaggccgaaauacuugu

SEQ ID NO: 11245 - RNA, 38 nt, Artificial Sequence
  Description of Artificial Sequence:  Enzymatic Nucleic Acid
gagacuuccugaugaggccguuaggccgaaaugcuuuc

SEQ ID NO: 11246 - RNA, 38 nt, Artificial Sequence
  Description of Artificial Sequence:  Enzymatic Nucleic Acid
gugcaugacugaugaggccguuaggccgaaacuucgau

SEQ ID NO: 11247 - RNA, 38 nt, Artificial Sequence
  Description of Artificial Sequence:  Enzymatic Nucleic Acid
ccgugcaucugaugaggccguuaggccgaaagacuucg

SEQ ID NO: 11248 - RNA, 38 nt, Artificial Sequence
  Description of Artificial Sequence:  Enzymatic Nucleic Acid
gauucccacugaugaggccguuaggccgaaaugccgug

SEQ ID NO: 11249 - RNA, 38 nt, Artificial Sequence
  Description of Artificial Sequence:  Enzymatic Nucleic Acid
uggaggggcugaugaggccguuaggccgaaauucccag

SEQ ID NO: 11250 - RNA, 38 nt, Artificial Sequence
  Description of Artificial Sequence:  Enzymatic Nucleic Acid
gaucugugcugaugaggccguuaggccgaaagggggau

SEQ ID NO: 11251 - RNA, 38 nt, Artificial Sequence
  Description of Artificial Sequence:  Enzymatic Nucleic Acid
aaccacaucugaugaggccguuaggccgaaaucugugg

SEQ ID NO: 11252 - RNA, 38 nt, Artificial Sequence
  Description of Artificial Sequence:  Enzymatic Nucleic Acid
uaucuuuacugaugaggccguuaggccgaaaccacaug

SEQ ID NO: 11253 - RNA, 38 nt, Artificial Sequence
  Description of Artificial Sequence:  Enzymatic Nucleic Acid
uuaucuuucugaugaggccguuaggccgaaaaccacau

SEQ ID NO: 11254 - RNA, 38 nt, Artificial Sequence
  Description of Artificial Sequence:  Enzymatic Nucleic Acid
auuaucuucugaugaggccguuaggccgaaaaaccaca

SEQ ID NO: 11255 - RNA, 38 nt, Artificial Sequence
  Description of Artificial Sequence:  Enzymatic Nucleic Acid
ggucucaucugaugaggccguuaggccgaaaucuuuaa

SEQ ID NO: 11256 - RNA, 38 nt, Artificial Sequence
  Description of Artificial Sequence:  Enzymatic Nucleic Acid
ucuucuaccugaugaggccguuaggccgaaagggucuc

SEQ ID NO: 11257 - RNA, 38 nt, Artificial Sequence
  Description of Artificial Sequence:  Enzymatic Nucleic Acid
gagucuuccugaugaggccguuaggccgaaacaagggu

SEQ ID NO: 11258 - RNA, 38 nt, Artificial Sequence
  Description of Artificial Sequence:  Enzymatic Nucleic Acid
caaugccucugaugaggccguuaggccgaaagucuucu

SEQ ID NO: 11259 - RNA, 38 nt, Artificial Sequence
  Description of Artificial Sequence:  Enzymatic Nucleic Acid
uucaauaccugaugaggccguuaggccgaaaugccuga

SEQ ID NO: 11260 - RNA, 38 nt, Artificial Sequence
  Description of Artificial Sequence:  Enzymatic Nucleic Acid
uccuucaacugaugaggccguuaggccgaaacaaugcc

SEQ ID NO: 11261 - RNA, 38 nt, Artificial Sequence
  Description of Artificial Sequence:  Enzymatic Nucleic Acid
cauccuuccugaugaggccguuaggccgaaauacaaug

SEQ ID NO: 11262 - RNA, 38 nt, Artificial Sequence
  Description of Artificial Sequence:  Enzymatic Nucleic Acid
cggauagucugaugaggccguuaggccgaaagguuccg

SEQ ID NO: 11263 - RNA, 38 nt, Artificial Sequence
  Description of Artificial Sequence:  Enzymatic Nucleic Acid
ucugcggacugaugaggccguuaggccgaaagugaggu

SEQ ID NO: 11264 - RNA, 38 nt, Artificial Sequence
  Description of Artificial Sequence:  Enzymatic Nucleic Acid
acucugcgcugaugaggccguuaggccgaaauagugag

SEQ ID NO: 11265 - RNA, 38 nt, Artificial Sequence
  Description of Artificial Sequence:  Enzymatic Nucleic Acid
cagguguacugaugaggccguuaggccgaaaggccuuc

SEQ ID NO: 11266 - RNA, 38 nt, Artificial Sequence
  Description of Artificial Sequence:  Enzymatic Nucleic Acid
ggcaggugcugaugaggccguuaggccgaaagaggccu

SEQ ID NO: 11267 - RNA, 38 nt, Artificial Sequence
  Description of Artificial Sequence:  Enzymatic Nucleic Acid
cagccaagcugaugaggccguuaggccgaaacacugca

SEQ ID NO: 11268 - RNA, 38 nt, Artificial Sequence
  Description of Artificial Sequence:  Enzymatic Nucleic Acid
acagccaacugaugaggccguuaggccgaaaacacugc

SEQ ID NO: 11269 - RNA, 38 nt, Artificial Sequence
  Description of Artificial Sequence:  Enzymatic Nucleic Acid
gcacagcccugaugaggccguuaggccgaaagaacacu

SEQ ID NO: 11270 - RNA, 38 nt, Artificial Sequence
  Description of Artificial Sequence:  Enzymatic Nucleic Acid
uuaugaaacugaugaggccguuaggccgaaaugccucc

SEQ ID NO: 11271 - RNA, 38 nt, Artificial Sequence
  Description of Artificial Sequence:  Enzymatic Nucleic Acid
auuaugaacugaugaggccguuaggccgaaaaugccuc

SEQ ID NO: 11272 - RNA, 38 nt, Artificial Sequence
  Description of Artificial Sequence:  Enzymatic Nucleic Acid
uauuaugacugaugaggccguuaggccgaaaaaugccu

SEQ ID NO: 11273 - RNA, 38 nt, Artificial Sequence
  Description of Artificial Sequence:  Enzymatic Nucleic Acid
cuauuaugcugaugaggccguuaggccgaaaaaaugcc

SEQ ID NO: 11274 - RNA, 38 nt, Artificial Sequence
  Description of Artificial Sequence:  Enzymatic Nucleic Acid
ucuauuaucugaugaggccguuaggccgaaaaaaaugc

SEQ ID NO: 11275 - RNA, 38 nt, Artificial Sequence
  Description of Artificial Sequence:  Enzymatic Nucleic Acid
ccuucuaucugaugaggccguuaggccgaaaugaaaaa

SEQ ID NO: 11276 - RNA, 38 nt, Artificial Sequence
  Description of Artificial Sequence:  Enzymatic Nucleic Acid
gcaccuuccugaugaggccguuaggccgaaauuaugaa

SEQ ID NO: 11277 - RNA, 38 nt, Artificial Sequence
  Description of Artificial Sequence:  Enzymatic Nucleic Acid
ugauuucccugaugaggccguuaggccgaaaguucguc

SEQ ID NO: 11278 - RNA, 38 nt, Artificial Sequence
  Description of Artificial Sequence:  Enzymatic Nucleic Acid
agaauaaucugaugaggccguuaggccgaaauuuccaa

SEQ ID NO: 11279 - RNA, 38 nt, Artificial Sequence
  Description of Artificial Sequence:  Enzymatic Nucleic Acid
acuagaaucugaugaggccguuaggccgaaaugauuuc

SEQ ID NO: 11280 - RNA, 38 nt, Artificial Sequence
  Description of Artificial Sequence:  Enzymatic Nucleic Acid
uacuagaacugaugaggccguuaggccgaaaaugauuu

SEQ ID NO: 11281 - RNA, 38 nt, Artificial Sequence
  Description of Artificial Sequence:  Enzymatic Nucleic Acid
ccuacuagcugaugaggccguuaggccgaaauaaugau

SEQ ID NO: 11282 - RNA, 38 nt, Artificial Sequence
  Description of Artificial Sequence:  Enzymatic Nucleic Acid
gccuacuacugaugaggccguuaggccgaaaauaauga

SEQ ID NO: 11283 - RNA, 38 nt, Artificial Sequence
  Description of Artificial Sequence:  Enzymatic Nucleic Acid
gugccuaccugaugaggccguuaggccgaaagaauaau

SEQ ID NO: 11284 - RNA, 38 nt, Artificial Sequence
  Description of Artificial Sequence:  Enzymatic Nucleic Acid
gucgugcccugaugaggccguuaggccgaaacuagaau

SEQ ID NO: 11285 - RNA, 38 nt, Artificial Sequence
  Description of Artificial Sequence:  Enzymatic Nucleic Acid
aacauggccugaugaggccguuaggccgaaaucaccgu

SEQ ID NO: 11286 - RNA, 38 nt, Artificial Sequence
  Description of Artificial Sequence:  Enzymatic Nucleic Acid
gccagaagcugaugaggccguuaggccgaaacauggca

SEQ ID NO: 11287 - RNA, 38 nt, Artificial Sequence
  Description of Artificial Sequence:  Enzymatic Nucleic Acid
agccagaacugaugaggccguuaggccgaaaacauggc

SEQ ID NO: 11288 - RNA, 38 nt, Artificial Sequence
  Description of Artificial Sequence:  Enzymatic Nucleic Acid
guagccagcugaugaggccguuaggccgaaagaacaug

SEQ ID NO: 11289 - RNA, 38 nt, Artificial Sequence
  Description of Artificial Sequence:  Enzymatic Nucleic Acid
aguagccacugaugaggccguuaggccgaaaagaacau

SEQ ID NO: 11290 - RNA, 38 nt, Artificial Sequence
  Description of Artificial Sequence:  Enzymatic Nucleic Acid
acaagaagcugaugaggccguuaggccgaaagccagaa

SEQ ID NO: 11291 - RNA, 38 nt, Artificial Sequence
  Description of Artificial Sequence:  Enzymatic Nucleic Acid
augacaagcugaugaggccguuaggccgaaaguagcca

SEQ ID NO: 11292 - RNA, 38 nt, Artificial Sequence
  Description of Artificial Sequence:  Enzymatic Nucleic Acid
gaugacaacugaugaggccguuaggccgaaaaguagcc

SEQ ID NO: 11293 - RNA, 38 nt, Artificial Sequence
  Description of Artificial Sequence:  Enzymatic Nucleic Acid
augaugaccugaugaggccguuaggccgaaagaaguag

SEQ ID NO: 11294 - RNA, 38 nt, Artificial Sequence
  Description of Artificial Sequence:  Enzymatic Nucleic Acid
aggaugaucugaugaggccguuaggccgaaacaagaag

SEQ ID NO: 11295 - RNA, 38 nt, Artificial Sequence
  Description of Artificial Sequence:  Enzymatic Nucleic Acid
ccuaggaucugaugaggccguuaggccgaaaugacaag

SEQ ID NO: 11296 - RNA, 38 nt, Artificial Sequence
  Description of Artificial Sequence:  Enzymatic Nucleic Acid
gucccuagcugaugaggccguuaggccgaaaugaugac

SEQ ID NO: 11297 - RNA, 38 nt, Artificial Sequence
  Description of Artificial Sequence:  Enzymatic Nucleic Acid
acgguccccugaugaggccguuaggccgaaaggaugau

SEQ ID NO: 11298 - RNA, 38 nt, Artificial Sequence
  Description of Artificial Sequence:  Enzymatic Nucleic Acid
gcccgcuucugaugaggccguuaggccgaaacgguccc

SEQ ID NO: 11299 - RNA, 38 nt, Artificial Sequence
  Description of Artificial Sequence:  Enzymatic Nucleic Acid
ggcccgcucugaugaggccguuaggccgaaaacggucc

SEQ ID NO: 11300 - RNA, 38 nt, Artificial Sequence
  Description of Artificial Sequence:  Enzymatic Nucleic Acid
uggacaagcugaugaggccguuaggccgaaagccuguc

SEQ ID NO: 11301 - RNA, 38 nt, Artificial Sequence
  Description of Artificial Sequence:  Enzymatic Nucleic Acid
cgauggaccugaugaggccguuaggccgaaaguagccu

SEQ ID NO: 11302 - RNA, 38 nt, Artificial Sequence
  Description of Artificial Sequence:  Enzymatic Nucleic Acid
ugacgaugcugaugaggccguuaggccgaaacaaguag

SEQ ID NO: 11303 - RNA, 38 nt, Artificial Sequence
  Description of Artificial Sequence:  Enzymatic Nucleic Acid
uccaugaccugaugaggccguuaggccgaaauggacaa

SEQ ID NO: 11304 - RNA, 38 nt, Artificial Sequence
  Description of Artificial Sequence:  Enzymatic Nucleic Acid
ggauccaucugaugaggccguuaggccgaaacgaugga

SEQ ID NO: 11305 - RNA, 38 nt, Artificial Sequence
  Description of Artificial Sequence:  Enzymatic Nucleic Acid
uucaucugcugaugaggccguuaggccgaaauccauga

SEQ ID NO: 11306 - RNA, 38 nt, Artificial Sequence
  Description of Artificial Sequence:  Enzymatic Nucleic Acid
uccaauggcugaugaggccguuaggccgaaaguucauc

SEQ ID NO: 11307 - RNA, 38 nt, Artificial Sequence
  Description of Artificial Sequence:  Enzymatic Nucleic Acid
guucaucccugaugaggccguuaggccgaaaugggagu

SEQ ID NO: 11308 - RNA, 38 nt, Artificial Sequence
  Description of Artificial Sequence:  Enzymatic Nucleic Acid
ucguucaccugaugaggccguuaggccgaaauguucau

SEQ ID NO: 11309 - RNA, 38 nt, Artificial Sequence
  Description of Artificial Sequence:  Enzymatic Nucleic Acid
ggcaucaucugaugaggccguuaggccgaaaggcaguc

SEQ ID NO: 11310 - RNA, 38 nt, Artificial Sequence
  Description of Artificial Sequence:  Enzymatic Nucleic Acid
uggcaucacugaugaggccguuaggccgaaaaggcagu

SEQ ID NO: 11311 - RNA, 38 nt, Artificial Sequence
  Description of Artificial Sequence:  Enzymatic Nucleic Acid
cucuggggcugaugaggccguuaggccgaaauucccau

SEQ ID NO: 11312 - RNA, 38 nt, Artificial Sequence
  Description of Artificial Sequence:  Enzymatic Nucleic Acid
ucucugggcugaugaggccguuaggccgaaaauuccca

SEQ ID NO: 11313 - RNA, 38 nt, Artificial Sequence
  Description of Artificial Sequence:  Enzymatic Nucleic Acid
ggcuuacccugaugaggccguuaggccgaaagguucag

SEQ ID NO: 11314 - RNA, 38 nt, Artificial Sequence
  Description of Artificial Sequence:  Enzymatic Nucleic Acid
aagaggcucugaugaggccguuaggccgaaaccuaggu

SEQ ID NO: 11315 - RNA, 38 nt, Artificial Sequence
  Description of Artificial Sequence:  Enzymatic Nucleic Acid
acggccaacugaugaggccguuaggccgaaaggcuuac

SEQ ID NO: 11316 - RNA, 38 nt, Artificial Sequence
  Description of Artificial Sequence:  Enzymatic Nucleic Acid
ccacggcccugaugaggccguuaggccgaaagaggcuu

SEQ ID NO: 11317 - RNA, 38 nt, Artificial Sequence
  Description of Artificial Sequence:  Enzymatic Nucleic Acid
cuuggccacugaugaggccguuaggccgaaaggcacca

SEQ ID NO: 11318 - RNA, 38 nt, Artificial Sequence
  Description of Artificial Sequence:  Enzymatic Nucleic Acid
ucuuggcccugaugaggccguuaggccgaaaaggcacc

SEQ ID NO: 11319 - RNA, 38 nt, Artificial Sequence
  Description of Artificial Sequence:  Enzymatic Nucleic Acid
ucugcuuccugaugaggccguuaggccgaaaucucuug

SEQ ID NO: 11320 - RNA, 38 nt, Artificial Sequence
  Description of Artificial Sequence:  Enzymatic Nucleic Acid
caauuccacugaugaggccguuaggccgaaaggcaucu

SEQ ID NO: 11321 - RNA, 38 nt, Artificial Sequence
  Description of Artificial Sequence:  Enzymatic Nucleic Acid
ucaauucccugaugaggccguuaggccgaaaaggcauc

SEQ ID NO: 11322 - RNA, 38 nt, Artificial Sequence
  Description of Artificial Sequence:  Enzymatic Nucleic Acid
gucuuguccugaugaggccguuaggccgaaauuccaaa

SEQ ID NO: 11323 - RNA, 38 nt, Artificial Sequence
  Description of Artificial Sequence:  Enzymatic Nucleic Acid
uguccugccugaugaggccguuaggccgaaaguugcug

SEQ ID NO: 11324 - RNA, 38 nt, Artificial Sequence
  Description of Artificial Sequence:  Enzymatic Nucleic Acid
uugacugccugaugaggccguuaggccgaaacuguccu

SEQ ID NO: 11325 - RNA, 38 nt, Artificial Sequence
  Description of Artificial Sequence:  Enzymatic Nucleic Acid
aacauuuucugaugaggccguuaggccgaaacugcuac

SEQ ID NO: 11326 - RNA, 38 nt, Artificial Sequence
  Description of Artificial Sequence:  Enzymatic Nucleic Acid
cuucuuuccugaugaggccguuaggccgaaacauuuug

SEQ ID NO: 11327 - RNA, 38 nt, Artificial Sequence
  Description of Artificial Sequence:  Enzymatic Nucleic Acid
gagagcuccugaugaggccguuaggccgaaaugcucac

SEQ ID NO: 11328 - RNA, 38 nt, Artificial Sequence
  Description of Artificial Sequence:  Enzymatic Nucleic Acid
agacaugacugaugaggccguuaggccgaaagcucgau

SEQ ID NO: 11329 - RNA, 38 nt, Artificial Sequence
  Description of Artificial Sequence:  Enzymatic Nucleic Acid
ucagacaucugaugaggccguuaggccgaaagagcucg

SEQ ID NO: 11330 - RNA, 38 nt, Artificial Sequence
  Description of Artificial Sequence:  Enzymatic Nucleic Acid
ugaguucacugaugaggccguuaggccgaaacaugaga

SEQ ID NO: 11331 - RNA, 38 nt, Artificial Sequence
  Description of Artificial Sequence:  Enzymatic Nucleic Acid
aggaucuucugaugaggccguuaggccgaaaguucaga

SEQ ID NO: 11332 - RNA, 38 nt, Artificial Sequence
  Description of Artificial Sequence:  Enzymatic Nucleic Acid
ugaaugagcugaugaggccguuaggccgaaaucuugag

SEQ ID NO: 11333 - RNA, 38 nt, Artificial Sequence
  Description of Artificial Sequence:  Enzymatic Nucleic Acid
auaugaaucugaugaggccguuaggccgaaaggaucuu

SEQ ID NO: 11334 - RNA, 38 nt, Artificial Sequence
  Description of Artificial Sequence:  Enzymatic Nucleic Acid
ccaauaugcugaugaggccguuaggccgaaaugaggau

SEQ ID NO: 11335 - RNA, 38 nt, Artificial Sequence
  Description of Artificial Sequence:  Enzymatic Nucleic Acid
accaauaucugaugaggccguuaggccgaaaaugagga

SEQ ID NO: 11336 - RNA, 38 nt, Artificial Sequence
  Description of Artificial Sequence:  Enzymatic Nucleic Acid
gugaccaacugaugaggccguuaggccgaaaugaauga

SEQ ID NO: 11337 - RNA, 38 nt, Artificial Sequence
  Description of Artificial Sequence:  Enzymatic Nucleic Acid
uggugacccugaugaggccguuaggccgaaauaugaau

SEQ ID NO: 11338 - RNA, 38 nt, Artificial Sequence
  Description of Artificial Sequence:  Enzymatic Nucleic Acid
gagauggucugaugaggccguuaggccgaaaccaauau

SEQ ID NO: 11339 - RNA, 38 nt, Artificial Sequence
  Description of Artificial Sequence:  Enzymatic Nucleic Acid
cacauugacugaugaggccguuaggccgaaauggugac

SEQ ID NO: 11340 - RNA, 38 nt, Artificial Sequence
  Description of Artificial Sequence:  Enzymatic Nucleic Acid
accacauucugaugaggccguuaggccgaaagauggug

SEQ ID NO: 11341 - RNA, 38 nt, Artificial Sequence
  Description of Artificial Sequence:  Enzymatic Nucleic Acid
agaagguucugaugaggccguuaggccgaaaccacauu

SEQ ID NO: 11342 - RNA, 38 nt, Artificial Sequence
  Description of Artificial Sequence:  Enzymatic Nucleic Acid
gcaccuagcugaugaggccguuaggccgaaagguugac

SEQ ID NO: 11343 - RNA, 38 nt, Artificial Sequence
  Description of Artificial Sequence:  Enzymatic Nucleic Acid
ggcaccuacugaugaggccguuaggccgaaaagguuga

SEQ ID NO: 11344 - RNA, 38 nt, Artificial Sequence
  Description of Artificial Sequence:  Enzymatic Nucleic Acid
caggcacccugaugaggccguuaggccgaaagaagguu

SEQ ID NO: 11345 - RNA, 38 nt, Artificial Sequence
  Description of Artificial Sequence:  Enzymatic Nucleic Acid
uggcuuggcugaugaggccguuaggccgaaacaggcac

SEQ ID NO: 11346 - RNA, 38 nt, Artificial Sequence
  Description of Artificial Sequence:  Enzymatic Nucleic Acid
aucaccaucugaugaggccguuaggccgaaaguggccc

SEQ ID NO: 11347 - RNA, 38 nt, Artificial Sequence
  Description of Artificial Sequence:  Enzymatic Nucleic Acid
aauuccaccugaugaggccguuaggccgaaaucaccau

SEQ ID NO: 11348 - RNA, 38 nt, Artificial Sequence
  Description of Artificial Sequence:  Enzymatic Nucleic Acid
auuugcagcugaugaggccguuaggccgaaauuccaca

SEQ ID NO: 11349 - RNA, 38 nt, Artificial Sequence
  Description of Artificial Sequence:  Enzymatic Nucleic Acid
aauuugcacugaugaggccguuaggccgaaaauuccac

SEQ ID NO: 11350 - RNA, 38 nt, Artificial Sequence
  Description of Artificial Sequence:  Enzymatic Nucleic Acid
gguuuccacugaugaggccguuaggccgaaauuugcag

SEQ ID NO: 11351 - RNA, 38 nt, Artificial Sequence
  Description of Artificial Sequence:  Enzymatic Nucleic Acid
agguuucccugaugaggccguuaggccgaaaauuugca

SEQ ID NO: 11352 - RNA, 38 nt, Artificial Sequence
  Description of Artificial Sequence:  Enzymatic Nucleic Acid
gguaagugcugaugaggccguuaggccgaaacagguuu

SEQ ID NO: 11353 - RNA, 38 nt, Artificial Sequence
  Description of Artificial Sequence:  Enzymatic Nucleic Acid
ccucaggucugaugaggccguuaggccgaaaguggaca

SEQ ID NO: 11354 - RNA, 38 nt, Artificial Sequence
  Description of Artificial Sequence:  Enzymatic Nucleic Acid
uccucaggcugaugaggccguuaggccgaaaaguggac

SEQ ID NO: 11355 - RNA, 38 nt, Artificial Sequence
  Description of Artificial Sequence:  Enzymatic Nucleic Acid
aggggacacugaugaggccguuaggccgaaauucauuu

SEQ ID NO: 11356 - RNA, 38 nt, Artificial Sequence
  Description of Artificial Sequence:  Enzymatic Nucleic Acid
uaggggaccugaugaggccguuaggccgaaaauucauu

SEQ ID NO: 11357 - RNA, 38 nt, Artificial Sequence
  Description of Artificial Sequence:  Enzymatic Nucleic Acid
uuguagggcugaugaggccguuaggccgaaacaaauuc

SEQ ID NO: 11358 - RNA, 38 nt, Artificial Sequence
  Description of Artificial Sequence:  Enzymatic Nucleic Acid
uggucuugcugaugaggccguuaggccgaaaggggaca

SEQ ID NO: 11359 - RNA, 38 nt, Artificial Sequence
  Description of Artificial Sequence:  Enzymatic Nucleic Acid
cuugacggcugaugaggccguuaggccgaaaucgugcc

SEQ ID NO: 11360 - RNA, 38 nt, Artificial Sequence
  Description of Artificial Sequence:  Enzymatic Nucleic Acid
ccuugacgcugaugaggccguuaggccgaaaaucgugc

SEQ ID NO: 11361 - RNA, 38 nt, Artificial Sequence
  Description of Artificial Sequence:  Enzymatic Nucleic Acid
uuucccuucugaugaggccguuaggccgaaacggaauc

SEQ ID NO: 11362 - RNA, 38 nt, Artificial Sequence
  Description of Artificial Sequence:  Enzymatic Nucleic Acid
cuccaacgcugaugaggccguuaggccgaaagucuuuc

SEQ ID NO: 11363 - RNA, 38 nt, Artificial Sequence
  Description of Artificial Sequence:  Enzymatic Nucleic Acid
auugcucccugaugaggccguuaggccgaaacguaguc

SEQ ID NO: 11364 - RNA, 38 nt, Artificial Sequence
  Description of Artificial Sequence:  Enzymatic Nucleic Acid
uccacaggcugaugaggccguuaggccgaaauugcucc

SEQ ID NO: 11365 - RNA, 38 nt, Artificial Sequence
  Description of Artificial Sequence:  Enzymatic Nucleic Acid
ccguuucacugaugaggccguuaggccgaaauccacag

SEQ ID NO: 11366 - RNA, 38 nt, Artificial Sequence
  Description of Artificial Sequence:  Enzymatic Nucleic Acid
ugcugucccugaugaggccguuaggccgaaagcgccgu

SEQ ID NO: 11367 - RNA, 38 nt, Artificial Sequence
  Description of Artificial Sequence:  Enzymatic Nucleic Acid
cuacuggucugaugaggccguuaggccgaaaugcuguc

SEQ ID NO: 11368 - RNA, 38 nt, Artificial Sequence
  Description of Artificial Sequence:  Enzymatic Nucleic Acid
gcucuggccugaugaggccguuaggccgaaacugguga

SEQ ID NO: 11369 - RNA, 38 nt, Artificial Sequence
  Description of Artificial Sequence:  Enzymatic Nucleic Acid
agcuggcucugaugaggccguuaggccgaaagcucugg

SEQ ID NO: 11370 - RNA, 38 nt, Artificial Sequence
  Description of Artificial Sequence:  Enzymatic Nucleic Acid
caaauccacugaugaggccguuaggccgaaagcuggcu

SEQ ID NO: 11371 - RNA, 38 nt, Artificial Sequence
  Description of Artificial Sequence:  Enzymatic Nucleic Acid
ccuccacacugaugaggccguuaggccgaaauccagag

SEQ ID NO: 11372 - RNA, 38 nt, Artificial Sequence
  Description of Artificial Sequence:  Enzymatic Nucleic Acid
uccuccaccugaugaggccguuaggccgaaaauccaga

SEQ ID NO: 11373 - RNA, 38 nt, Artificial Sequence
  Description of Artificial Sequence:  Enzymatic Nucleic Acid
cacugaggcugaugaggccguuaggccgaaacuucucc

SEQ ID NO: 11374 - RNA, 38 nt, Artificial Sequence
  Description of Artificial Sequence:  Enzymatic Nucleic Acid
acaucacucugaugaggccguuaggccgaaagggacuu

SEQ ID NO: 11375 - RNA, 38 nt, Artificial Sequence
  Description of Artificial Sequence:  Enzymatic Nucleic Acid
ucuucuuccugaugaggccguuaggccgaaacaucacu

SEQ ID NO: 11376 - RNA, 38 nt, Artificial Sequence
  Description of Artificial Sequence:  Enzymatic Nucleic Acid
aucuucagcugaugaggccguuaggccgaaagcuuccu

SEQ ID NO: 11377 - RNA, 38 nt, Artificial Sequence
  Description of Artificial Sequence:  Enzymatic Nucleic Acid
cuuauacacugaugaggccguuaggccgaaaucuucag

SEQ ID NO: 11378 - RNA, 38 nt, Artificial Sequence
  Description of Artificial Sequence:  Enzymatic Nucleic Acid
aguccuuacugaugaggccguuaggccgaaacagaucu

SEQ ID NO: 11379 - RNA, 38 nt, Artificial Sequence
  Description of Artificial Sequence:  Enzymatic Nucleic Acid
gaaguccucugaugaggccguuaggccgaaauacagau

SEQ ID NO: 11380 - RNA, 38 nt, Artificial Sequence
  Description of Artificial Sequence:  Enzymatic Nucleic Acid
aggucaggcugaugaggccguuaggccgaaaguccuua

SEQ ID NO: 11381 - RNA, 38 nt, Artificial Sequence
  Description of Artificial Sequence:  Enzymatic Nucleic Acid
aaggucagcugaugaggccguuaggccgaaaaguccuu

SEQ ID NO: 11382 - RNA, 38 nt, Artificial Sequence
  Description of Artificial Sequence:  Enzymatic Nucleic Acid
gaugcucccugaugaggccguuaggccgaaaggucagg

SEQ ID NO: 11383 - RNA, 38 nt, Artificial Sequence
  Description of Artificial Sequence:  Enzymatic Nucleic Acid
acagaugacugaugaggccguuaggccgaaaugcucca

SEQ ID NO: 11384 - RNA, 38 nt, Artificial Sequence
  Description of Artificial Sequence:  Enzymatic Nucleic Acid
uaacagaucugaugaggccguuaggccgaaagaugcuc

SEQ ID NO: 11385 - RNA, 38 nt, Artificial Sequence
  Description of Artificial Sequence:  Enzymatic Nucleic Acid
cuguaacacugaugaggccguuaggccgaaaugagaug

SEQ ID NO: 11386 - RNA, 38 nt, Artificial Sequence
  Description of Artificial Sequence:  Enzymatic Nucleic Acid
gaagcugucugaugaggccguuaggccgaaacagauga

SEQ ID NO: 11387 - RNA, 38 nt, Artificial Sequence
  Description of Artificial Sequence:  Enzymatic Nucleic Acid
ggaagcugcugaugaggccguuaggccgaaaacagaug

SEQ ID NO: 11388 - RNA, 38 nt, Artificial Sequence
  Description of Artificial Sequence:  Enzymatic Nucleic Acid
ccacuuggcugaugaggccguuaggccgaaagcuguaa

SEQ ID NO: 11389 - RNA, 38 nt, Artificial Sequence
  Description of Artificial Sequence:  Enzymatic Nucleic Acid
gccacuugcugaugaggccguuaggccgaaaagcugua

SEQ ID NO: 11390 - RNA, 38 nt, Artificial Sequence
  Description of Artificial Sequence:  Enzymatic Nucleic Acid
caugcccucugaugaggccguuaggccgaaagccacuu

SEQ ID NO: 11391 - RNA, 38 nt, Artificial Sequence
  Description of Artificial Sequence:  Enzymatic Nucleic Acid
augccaagcugaugaggccguuaggccgaaacuccaug

SEQ ID NO: 11392 - RNA, 38 nt, Artificial Sequence
  Description of Artificial Sequence:  Enzymatic Nucleic Acid
gaugccaacugaugaggccguuaggccgaaaacuccau

SEQ ID NO: 11393 - RNA, 38 nt, Artificial Sequence
  Description of Artificial Sequence:  Enzymatic Nucleic Acid
gcgaugcccugaugaggccguuaggccgaaagaacucc

SEQ ID NO: 11394 - RNA, 38 nt, Artificial Sequence
  Description of Artificial Sequence:  Enzymatic Nucleic Acid
acuuucgccugaugaggccguuaggccgaaaugccaag

SEQ ID NO: 11395 - RNA, 38 nt, Artificial Sequence
  Description of Artificial Sequence:  Enzymatic Nucleic Acid
ccuguggacugaugaggccguuaggccgaaacacuuuc

SEQ ID NO: 11396 - RNA, 38 nt, Artificial Sequence
  Description of Artificial Sequence:  Enzymatic Nucleic Acid
ucccugugcugaugaggccguuaggccgaaauacacuu

SEQ ID NO: 11397 - RNA, 38 nt, Artificial Sequence
  Description of Artificial Sequence:  Enzymatic Nucleic Acid
uaagaggacugaugaggccguuaggccgaaauuucgug

SEQ ID NO: 11398 - RNA, 38 nt, Artificial Sequence
  Description of Artificial Sequence:  Enzymatic Nucleic Acid
gauaagagcugaugaggccguuaggccgaaauauuucg

SEQ ID NO: 11399 - RNA, 38 nt, Artificial Sequence
  Description of Artificial Sequence:  Enzymatic Nucleic Acid
uccgauaacugaugaggccguuaggccgaaaggauauu

SEQ ID NO: 11400 - RNA, 38 nt, Artificial Sequence
  Description of Artificial Sequence:  Enzymatic Nucleic Acid
ucuccgaucugaugaggccguuaggccgaaagaggaua

SEQ ID NO: 11401 - RNA, 38 nt, Artificial Sequence
  Description of Artificial Sequence:  Enzymatic Nucleic Acid
uucuccgacugaugaggccguuaggccgaaaagaggau

SEQ ID NO: 11402 - RNA, 38 nt, Artificial Sequence
  Description of Artificial Sequence:  Enzymatic Nucleic Acid
ucuucucccugaugaggccguuaggccgaaauaagagg

SEQ ID NO: 11403 - RNA, 38 nt, Artificial Sequence
  Description of Artificial Sequence:  Enzymatic Nucleic Acid
cagauuuucugaugaggccguuaggccgaaaccacguu

SEQ ID NO: 11404 - RNA, 38 nt, Artificial Sequence
  Description of Artificial Sequence:  Enzymatic Nucleic Acid
acagauuucugaugaggccguuaggccgaaaaccacgu

SEQ ID NO: 11405 - RNA, 38 nt, Artificial Sequence
  Description of Artificial Sequence:  Enzymatic Nucleic Acid
aagucacacugaugaggccguuaggccgaaauuuuaac

SEQ ID NO: 11406 - RNA, 38 nt, Artificial Sequence
  Description of Artificial Sequence:  Enzymatic Nucleic Acid
ccaagccacugaugaggccguuaggccgaaagucacag

SEQ ID NO: 11407 - RNA, 38 nt, Artificial Sequence
  Description of Artificial Sequence:  Enzymatic Nucleic Acid
gccaagcccugaugaggccguuaggccgaaaagucaca

SEQ ID NO: 11408 - RNA, 38 nt, Artificial Sequence
  Description of Artificial Sequence:  Enzymatic Nucleic Acid
cccgggcccugaugaggccguuaggccgaaagccaaag

SEQ ID NO: 11409 - RNA, 38 nt, Artificial Sequence
  Description of Artificial Sequence:  Enzymatic Nucleic Acid
uuuauaaacugaugaggccguuaggccgaaaucccggg

SEQ ID NO: 11410 - RNA, 38 nt, Artificial Sequence
  Description of Artificial Sequence:  Enzymatic Nucleic Acid
ucuuuauacugaugaggccguuaggccgaaauaucccg

SEQ ID NO: 11411 - RNA, 38 nt, Artificial Sequence
  Description of Artificial Sequence:  Enzymatic Nucleic Acid
aucuuuaucugaugaggccguuaggccgaaaauauccc

SEQ ID NO: 11412 - RNA, 38 nt, Artificial Sequence
  Description of Artificial Sequence:  Enzymatic Nucleic Acid
gaucuuuacugaugaggccguuaggccgaaaaauaucc

SEQ ID NO: 11413 - RNA, 38 nt, Artificial Sequence
  Description of Artificial Sequence:  Enzymatic Nucleic Acid
uggaucuucugaugaggccguuaggccgaaauaaauau

SEQ ID NO: 11414 - RNA, 38 nt, Artificial Sequence
  Description of Artificial Sequence:  Enzymatic Nucleic Acid
auaaucugcugaugaggccguuaggccgaaaucuuuau

SEQ ID NO: 11415 - RNA, 38 nt, Artificial Sequence
  Description of Artificial Sequence:  Enzymatic Nucleic Acid
ucugacaucugaugaggccguuaggccgaaaucuggau

SEQ ID NO: 11416 - RNA, 38 nt, Artificial Sequence
  Description of Artificial Sequence:  Enzymatic Nucleic Acid
uucugacacugaugaggccguuaggccgaaaaucugga

SEQ ID NO: 11417 - RNA, 38 nt, Artificial Sequence
  Description of Artificial Sequence:  Enzymatic Nucleic Acid
ccuuuucucugaugaggccguuaggccgaaacauaauc

SEQ ID NO: 11418 - RNA, 38 nt, Artificial Sequence
  Description of Artificial Sequence:  Enzymatic Nucleic Acid
agggaggccugaugaggccguuaggccgaaagcaucuc

SEQ ID NO: 11419 - RNA, 38 nt, Artificial Sequence
  Description of Artificial Sequence:  Enzymatic Nucleic Acid
uucaaaggcugaugaggccguuaggccgaaaggcgagc

SEQ ID NO: 11420 - RNA, 38 nt, Artificial Sequence
  Description of Artificial Sequence:  Enzymatic Nucleic Acid
ccauuucacugaugaggccguuaggccgaaagggaggc

SEQ ID NO: 11421 - RNA, 38 nt, Artificial Sequence
  Description of Artificial Sequence:  Enzymatic Nucleic Acid
uccauuuccugaugaggccguuaggccgaaaagggagg

SEQ ID NO: 11422 - RNA, 38 nt, Artificial Sequence
  Description of Artificial Sequence:  Enzymatic Nucleic Acid
cugucaaacugaugaggccguuaggccgaaauuguuuc

SEQ ID NO: 11423 - RNA, 38 nt, Artificial Sequence
  Description of Artificial Sequence:  Enzymatic Nucleic Acid
ucugucaacugaugaggccguuaggccgaaaauuguuu

SEQ ID NO: 11424 - RNA, 38 nt, Artificial Sequence
  Description of Artificial Sequence:  Enzymatic Nucleic Acid
cucugucacugaugaggccguuaggccgaaaaauuguu

SEQ ID NO: 11425 - RNA, 38 nt, Artificial Sequence
  Description of Artificial Sequence:  Enzymatic Nucleic Acid
acucuguccugaugaggccguuaggccgaaaaaauugu

SEQ ID NO: 11426 - RNA, 38 nt, Artificial Sequence
  Description of Artificial Sequence:  Enzymatic Nucleic Acid
ggauugugcugaugaggccguuaggccgaaacacucug

SEQ ID NO: 11427 - RNA, 38 nt, Artificial Sequence
  Description of Artificial Sequence:  Enzymatic Nucleic Acid
ucacucugcugaugaggccguuaggccgaaauugugua

SEQ ID NO: 11428 - RNA, 38 nt, Artificial Sequence
  Description of Artificial Sequence:  Enzymatic Nucleic Acid
aaagaccacugaugaggccguuaggccgaaacgucacu

SEQ ID NO: 11429 - RNA, 38 nt, Artificial Sequence
  Description of Artificial Sequence:  Enzymatic Nucleic Acid
caccaaaacugaugaggccguuaggccgaaaccagacg

SEQ ID NO: 11430 - RNA, 38 nt, Artificial Sequence
  Description of Artificial Sequence:  Enzymatic Nucleic Acid
aacaccaacugaugaggccguuaggccgaaagaccaga

SEQ ID NO: 11431 - RNA, 38 nt, Artificial Sequence
  Description of Artificial Sequence:  Enzymatic Nucleic Acid
aaacaccacugaugaggccguuaggccgaaaagaccag

SEQ ID NO: 11432 - RNA, 38 nt, Artificial Sequence
  Description of Artificial Sequence:  Enzymatic Nucleic Acid
aaaacacccugaugaggccguuaggccgaaaaagacca

SEQ ID NO: 11433 - RNA, 38 nt, Artificial Sequence
  Description of Artificial Sequence:  Enzymatic Nucleic Acid
cacagcaacugaugaggccguuaggccgaaacaccaaa

SEQ ID NO: 11434 - RNA, 38 nt, Artificial Sequence
  Description of Artificial Sequence:  Enzymatic Nucleic Acid
ccacagcacugaugaggccguuaggccgaaaacaccaa

SEQ ID NO: 11435 - RNA, 38 nt, Artificial Sequence
  Description of Artificial Sequence:  Enzymatic Nucleic Acid
cccacagccugaugaggccguuaggccgaaaaacacca

SEQ ID NO: 11436 - RNA, 38 nt, Artificial Sequence
  Description of Artificial Sequence:  Enzymatic Nucleic Acid
aaggaaaacugaugaggccguuaggccgaaauuuccca

SEQ ID NO: 11437 - RNA, 38 nt, Artificial Sequence
  Description of Artificial Sequence:  Enzymatic Nucleic Acid
cuaaggaacugaugaggccguuaggccgaaauauuucc

SEQ ID NO: 11438 - RNA, 38 nt, Artificial Sequence
  Description of Artificial Sequence:  Enzymatic Nucleic Acid
ccuaaggacugaugaggccguuaggccgaaaauauuuc

SEQ ID NO: 11439 - RNA, 38 nt, Artificial Sequence
  Description of Artificial Sequence:  Enzymatic Nucleic Acid
accuaaggcugaugaggccguuaggccgaaaaauauuu

SEQ ID NO: 11440 - RNA, 38 nt, Artificial Sequence
  Description of Artificial Sequence:  Enzymatic Nucleic Acid
caccuaagcugaugaggccguuaggccgaaaaaauauu

SEQ ID NO: 11441 - RNA, 38 nt, Artificial Sequence
  Description of Artificial Sequence:  Enzymatic Nucleic Acid
aagcaccucugaugaggccguuaggccgaaaggaaaau

SEQ ID NO: 11442 - RNA, 38 nt, Artificial Sequence
  Description of Artificial Sequence:  Enzymatic Nucleic Acid
gaagcacccugaugaggccguuaggccgaaaaggaaaa

SEQ ID NO: 11443 - RNA, 38 nt, Artificial Sequence
  Description of Artificial Sequence:  Enzymatic Nucleic Acid
auauggagcugaugaggccguuaggccgaaagcaccua

SEQ ID NO: 11444 - RNA, 38 nt, Artificial Sequence
  Description of Artificial Sequence:  Enzymatic Nucleic Acid
gauauggacugaugaggccguuaggccgaaaagcaccu

SEQ ID NO: 11445 - RNA, 38 nt, Artificial Sequence
  Description of Artificial Sequence:  Enzymatic Nucleic Acid
aggauaugcugaugaggccguuaggccgaaagaagcac

SEQ ID NO: 11446 - RNA, 38 nt, Artificial Sequence
  Description of Artificial Sequence:  Enzymatic Nucleic Acid
ccccaggacugaugaggccguuaggccgaaauggagaa

SEQ ID NO: 11447 - RNA, 38 nt, Artificial Sequence
  Description of Artificial Sequence:  Enzymatic Nucleic Acid
uaccccagcugaugaggccguuaggccgaaauauggag

SEQ ID NO: 11448 - RNA, 38 nt, Artificial Sequence
  Description of Artificial Sequence:  Enzymatic Nucleic Acid
ucaaucuucugaugaggccguuaggccgaaaccccagg

SEQ ID NO: 11449 - RNA, 38 nt, Artificial Sequence
  Description of Artificial Sequence:  Enzymatic Nucleic Acid
ucuucauccugaugaggccguuaggccgaaaucuuuac

SEQ ID NO: 11450 - RNA, 38 nt, Artificial Sequence
  Description of Artificial Sequence:  Enzymatic Nucleic Acid
gccuacaacugaugaggccguuaggccgaaauucuuca

SEQ ID NO: 11451 - RNA, 38 nt, Artificial Sequence
  Description of Artificial Sequence:  Enzymatic Nucleic Acid
cgccuacacugaugaggccguuaggccgaaaauucuuc

SEQ ID NO: 11452 - RNA, 38 nt, Artificial Sequence
  Description of Artificial Sequence:  Enzymatic Nucleic Acid
ucgccuaccugaugaggccguuaggccgaaaaauucuu

SEQ ID NO: 11453 - RNA, 38 nt, Artificial Sequence
  Description of Artificial Sequence:  Enzymatic Nucleic Acid
caaucgcccugaugaggccguuaggccgaaacaaaauu

SEQ ID NO: 11454 - RNA, 38 nt, Artificial Sequence
  Description of Artificial Sequence:  Enzymatic Nucleic Acid
cuucuuuccugaugaggccguuaggccgaaaucgccua

SEQ ID NO: 11455 - RNA, 38 nt, Artificial Sequence
  Description of Artificial Sequence:  Enzymatic Nucleic Acid
ccucauuccugaugaggccguuaggccgaaaguuccuu

SEQ ID NO: 11456 - RNA, 38 nt, Artificial Sequence
  Description of Artificial Sequence:  Enzymatic Nucleic Acid
uguaguaucugaugaggccguuaggccgaaaucagggg

SEQ ID NO: 11457 - RNA, 38 nt, Artificial Sequence
  Description of Artificial Sequence:  Enzymatic Nucleic Acid
guguaguacugaugaggccguuaggccgaaaaucaggg

SEQ ID NO: 11458 - RNA, 38 nt, Artificial Sequence
  Description of Artificial Sequence:  Enzymatic Nucleic Acid
ugguguagcugaugaggccguuaggccgaaauaaucag

SEQ ID NO: 11459 - RNA, 38 nt, Artificial Sequence
  Description of Artificial Sequence:  Enzymatic Nucleic Acid
uucuggugcugaugaggccguuaggccgaaaguauaau

SEQ ID NO: 11460 - RNA, 38 nt, Artificial Sequence
  Description of Artificial Sequence:  Enzymatic Nucleic Acid
uggucuggcugaugaggccguuaggccgaaacauuucu

SEQ ID NO: 11461 - RNA, 38 nt, Artificial Sequence
  Description of Artificial Sequence:  Enzymatic Nucleic Acid
gggucucucugaugaggccguuaggccgaaacugggcu

SEQ ID NO: 11462 - RNA, 38 nt, Artificial Sequence
  Description of Artificial Sequence:  Enzymatic Nucleic Acid
acucugaacugaugaggccguuaggccgaaacgugggu

SEQ ID NO: 11463 - RNA, 38 nt, Artificial Sequence
  Description of Artificial Sequence:  Enzymatic Nucleic Acid
aacucugacugaugaggccguuaggccgaaaacguggg

SEQ ID NO: 11464 - RNA, 38 nt, Artificial Sequence
  Description of Artificial Sequence:  Enzymatic Nucleic Acid
caacucugcugaugaggccguuaggccgaaaaacgugg

SEQ ID NO: 11465 - RNA, 38 nt, Artificial Sequence
  Description of Artificial Sequence:  Enzymatic Nucleic Acid
ccaacucucugaugaggccguuaggccgaaaaaacgug

SEQ ID NO: 11466 - RNA, 38 nt, Artificial Sequence
  Description of Artificial Sequence:  Enzymatic Nucleic Acid
guuccacccugaugaggccguuaggccgaaacucugaa

SEQ ID NO: 11467 - RNA, 38 nt, Artificial Sequence
  Description of Artificial Sequence:  Enzymatic Nucleic Acid
auuucccacugaugaggccguuaggccgaaauguucca

SEQ ID NO: 11468 - RNA, 38 nt, Artificial Sequence
  Description of Artificial Sequence:  Enzymatic Nucleic Acid
gauuuccccugaugaggccguuaggccgaaaauguucc

SEQ ID NO: 11469 - RNA, 38 nt, Artificial Sequence
  Description of Artificial Sequence:  Enzymatic Nucleic Acid
uugcaagacugaugaggccguuaggccgaaauuuccca

SEQ ID NO: 11470 - RNA, 38 nt, Artificial Sequence
  Description of Artificial Sequence:  Enzymatic Nucleic Acid
gcuugcaacugaugaggccguuaggccgaaagauuucc

SEQ ID NO: 11471 - RNA, 38 nt, Artificial Sequence
  Description of Artificial Sequence:  Enzymatic Nucleic Acid
uagcuugccugaugaggccguuaggccgaaagagauuu

SEQ ID NO: 11472 - RNA, 38 nt, Artificial Sequence
  Description of Artificial Sequence:  Enzymatic Nucleic Acid
cugagcaucugaugaggccguuaggccgaaagcuugca

SEQ ID NO: 11473 - RNA, 38 nt, Artificial Sequence
  Description of Artificial Sequence:  Enzymatic Nucleic Acid
auccugcucugaugaggccguuaggccgaaagcauuag

SEQ ID NO: 11474 - RNA, 38 nt, Artificial Sequence
  Description of Artificial Sequence:  Enzymatic Nucleic Acid
gaacaaugcugaugaggccguuaggccgaaagucuuug

SEQ ID NO: 11475 - RNA, 38 nt, Artificial Sequence
  Description of Artificial Sequence:  Enzymatic Nucleic Acid
ggaagaaccugaugaggccguuaggccgaaauguaguc

SEQ ID NO: 11476 - RNA, 38 nt, Artificial Sequence
  Description of Artificial Sequence:  Enzymatic Nucleic Acid
aucggaagcugaugaggccguuaggccgaaacaaugua

SEQ ID NO: 11477 - RNA, 38 nt, Artificial Sequence
  Description of Artificial Sequence:  Enzymatic Nucleic Acid
uaucggaacugaugaggccguuaggccgaaaacaaugu

SEQ ID NO: 11478 - RNA, 38 nt, Artificial Sequence
  Description of Artificial Sequence:  Enzymatic Nucleic Acid
gauaucggcugaugaggccguuaggccgaaagaacaau

SEQ ID NO: 11479 - RNA, 38 nt, Artificial Sequence
  Description of Artificial Sequence:  Enzymatic Nucleic Acid
ugauaucgcugaugaggccguuaggccgaaaagaacaa

SEQ ID NO: 11480 - RNA, 38 nt, Artificial Sequence
  Description of Artificial Sequence:  Enzymatic Nucleic Acid
gucucugacugaugaggccguuaggccgaaaucggaag

SEQ ID NO: 11481 - RNA, 38 nt, Artificial Sequence
  Description of Artificial Sequence:  Enzymatic Nucleic Acid
aagucucucugaugaggccguuaggccgaaauaucgga

SEQ ID NO: 11482 - RNA, 38 nt, Artificial Sequence
  Description of Artificial Sequence:  Enzymatic Nucleic Acid
caugcucacugaugaggccguuaggccgaaagucucug

SEQ ID NO: 11483 - RNA, 38 nt, Artificial Sequence
  Description of Artificial Sequence:  Enzymatic Nucleic Acid
ccaugcuccugaugaggccguuaggccgaaaagucucu

SEQ ID NO: 11484 - RNA, 38 nt, Artificial Sequence
  Description of Artificial Sequence:  Enzymatic Nucleic Acid
gaguccagcugaugaggccguuaggccgaaauccucuu

SEQ ID NO: 11485 - RNA, 38 nt, Artificial Sequence
  Description of Artificial Sequence:  Enzymatic Nucleic Acid
agaguccacugaugaggccguuaggccgaaaauccucu

SEQ ID NO: 11486 - RNA, 38 nt, Artificial Sequence
  Description of Artificial Sequence:  Enzymatic Nucleic Acid
ggcagagacugaugaggccguuaggccgaaaguccaga

SEQ ID NO: 11487 - RNA, 38 nt, Artificial Sequence
  Description of Artificial Sequence:  Enzymatic Nucleic Acid
uaggcagacugaugaggccguuaggccgaaagagucca

SEQ ID NO: 11488 - RNA, 38 nt, Artificial Sequence
  Description of Artificial Sequence:  Enzymatic Nucleic Acid
gguaggcacugaugaggccguuaggccgaaagagaguc

SEQ ID NO: 11489 - RNA, 38 nt, Artificial Sequence
  Description of Artificial Sequence:  Enzymatic Nucleic Acid
aggugaggcugaugaggccguuaggccgaaaggcagag

SEQ ID NO: 11490 - RNA, 38 nt, Artificial Sequence
  Description of Artificial Sequence:  Enzymatic Nucleic Acid
aaacaggucugaugaggccguuaggccgaaagguaggc

SEQ ID NO: 11491 - RNA, 38 nt, Artificial Sequence
  Description of Artificial Sequence:  Enzymatic Nucleic Acid
auacaggacugaugaggccguuaggccgaaacagguga

SEQ ID NO: 11492 - RNA, 38 nt, Artificial Sequence
  Description of Artificial Sequence:  Enzymatic Nucleic Acid
cauacaggcugaugaggccguuaggccgaaaacaggug

SEQ ID NO: 11493 - RNA, 38 nt, Artificial Sequence
  Description of Artificial Sequence:  Enzymatic Nucleic Acid
ccauacagcugaugaggccguuaggccgaaaaacaggu

SEQ ID NO: 11494 - RNA, 38 nt, Artificial Sequence
  Description of Artificial Sequence:  Enzymatic Nucleic Acid
cuccuccacugaugaggccguuaggccgaaacaggaaa

SEQ ID NO: 11495 - RNA, 38 nt, Artificial Sequence
  Description of Artificial Sequence:  Enzymatic Nucleic Acid
gggucacacugaugaggccguuaggccgaaacuuccuc

SEQ ID NO: 11496 - RNA, 38 nt, Artificial Sequence
  Description of Artificial Sequence:  Enzymatic Nucleic Acid
cauaauggcugaugaggccguuaggccgaaauuugggg

SEQ ID NO: 11497 - RNA, 38 nt, Artificial Sequence
  Description of Artificial Sequence:  Enzymatic Nucleic Acid
ucauaaugcugaugaggccguuaggccgaaaauuuggg

SEQ ID NO: 11498 - RNA, 38 nt, Artificial Sequence
  Description of Artificial Sequence:  Enzymatic Nucleic Acid
guugucaucugaugaggccguuaggccgaaauggaauu

SEQ ID NO: 11499 - RNA, 38 nt, Artificial Sequence
  Description of Artificial Sequence:  Enzymatic Nucleic Acid
uguugucacugaugaggccguuaggccgaaaauggaau

SEQ ID NO: 11500 - RNA, 38 nt, Artificial Sequence
  Description of Artificial Sequence:  Enzymatic Nucleic Acid
uacugacucugaugaggccguuaggccgaaauuccugc

SEQ ID NO: 11501 - RNA, 38 nt, Artificial Sequence
  Description of Artificial Sequence:  Enzymatic Nucleic Acid
cagauacucugaugaggccguuaggccgaaacugauuc

SEQ ID NO: 11502 - RNA, 38 nt, Artificial Sequence
  Description of Artificial Sequence:  Enzymatic Nucleic Acid
ucugcagacugaugaggccguuaggccgaaacugacug

SEQ ID NO: 11503 - RNA, 38 nt, Artificial Sequence
  Description of Artificial Sequence:  Enzymatic Nucleic Acid
guucugcacugaugaggccguuaggccgaaauacugac

SEQ ID NO: 11504 - RNA, 38 nt, Artificial Sequence
  Description of Artificial Sequence:  Enzymatic Nucleic Acid
cuuucgcucugaugaggccguuaggccgaaacuguucu

SEQ ID NO: 11505 - RNA, 38 nt, Artificial Sequence
  Description of Artificial Sequence:  Enzymatic Nucleic Acid
aauguuuucugaugaggccguuaggccgaaacacucac

SEQ ID NO: 11506 - RNA, 38 nt, Artificial Sequence
  Description of Artificial Sequence:  Enzymatic Nucleic Acid
uaucuucacugaugaggccguuaggccgaaauguuuuu

SEQ ID NO: 11507 - RNA, 38 nt, Artificial Sequence
  Description of Artificial Sequence:  Enzymatic Nucleic Acid
auaucuuccugaugaggccguuaggccgaaaauguuuu

SEQ ID NO: 11508 - RNA, 38 nt, Artificial Sequence
  Description of Artificial Sequence:  Enzymatic Nucleic Acid
uaacgggacugaugaggccguuaggccgaaaucuucaa

SEQ ID NO: 11509 - RNA, 38 nt, Artificial Sequence
  Description of Artificial Sequence:  Enzymatic Nucleic Acid
ucuaacggcugaugaggccguuaggccgaaauaucuuc

SEQ ID NO: 11510 - RNA, 38 nt, Artificial Sequence
  Description of Artificial Sequence:  Enzymatic Nucleic Acid
guucuucucugaugaggccguuaggccgaaacgggaua

SEQ ID NO: 11511 - RNA, 38 nt, Artificial Sequence
  Description of Artificial Sequence:  Enzymatic Nucleic Acid
gguucuuccugaugaggccguuaggccgaaaacgggau

SEQ ID NO: 11512 - RNA, 38 nt, Artificial Sequence
  Description of Artificial Sequence:  Enzymatic Nucleic Acid
auuacuuucugaugaggccguuaggccgaaacuucugg

SEQ ID NO: 11513 - RNA, 38 nt, Artificial Sequence
  Description of Artificial Sequence:  Enzymatic Nucleic Acid
ucugggaucugaugaggccguuaggccgaaacuuuuac

SEQ ID NO: 11514 - RNA, 38 nt, Artificial Sequence
  Description of Artificial Sequence:  Enzymatic Nucleic Acid
ucaucuggcugaugaggccguuaggccgaaauuacuuu

SEQ ID NO: 11515 - RNA, 38 nt, Artificial Sequence
  Description of Artificial Sequence:  Enzymatic Nucleic Acid
aagaaccacugaugaggccguuaggccgaaaccacugu

SEQ ID NO: 11516 - RNA, 38 nt, Artificial Sequence
  Description of Artificial Sequence:  Enzymatic Nucleic Acid
gaggcaagcugaugaggccguuaggccgaaaccauacc

SEQ ID NO: 11517 - RNA, 38 nt, Artificial Sequence
  Description of Artificial Sequence:  Enzymatic Nucleic Acid
ugaggcaacugaugaggccguuaggccgaaaaccauac

SEQ ID NO: 11518 - RNA, 38 nt, Artificial Sequence
  Description of Artificial Sequence:  Enzymatic Nucleic Acid
ucugaggccugaugaggccguuaggccgaaagaaccau

SEQ ID NO: 11519 - RNA, 38 nt, Artificial Sequence
  Description of Artificial Sequence:  Enzymatic Nucleic Acid
gcucuucucugaugaggccguuaggccgaaaggcaaga

SEQ ID NO: 11520 - RNA, 38 nt, Artificial Sequence
  Description of Artificial Sequence:  Enzymatic Nucleic Acid
gucuuccacugaugaggccguuaggccgaaaguuuuca

SEQ ID NO: 11521 - RNA, 38 nt, Artificial Sequence
  Description of Artificial Sequence:  Enzymatic Nucleic Acid
ugucuucccugaugaggccguuaggccgaaaaguuuuc

SEQ ID NO: 11522 - RNA, 38 nt, Artificial Sequence
  Description of Artificial Sequence:  Enzymatic Nucleic Acid
auggagaucugaugaggccguuaggccgaaauuugguu

SEQ ID NO: 11523 - RNA, 38 nt, Artificial Sequence
  Description of Artificial Sequence:  Enzymatic Nucleic Acid
gauggagacugaugaggccguuaggccgaaaauuuggu

SEQ ID NO: 11524 - RNA, 38 nt, Artificial Sequence
  Description of Artificial Sequence:  Enzymatic Nucleic Acid
aagauggacugaugaggccguuaggccgaaauaauuug

SEQ ID NO: 11525 - RNA, 38 nt, Artificial Sequence
  Description of Artificial Sequence:  Enzymatic Nucleic Acid
aaaagaugcugaugaggccguuaggccgaaagauaauu

SEQ ID NO: 11526 - RNA, 38 nt, Artificial Sequence
  Description of Artificial Sequence:  Enzymatic Nucleic Acid
caccaaaacugaugaggccguuaggccgaaauggagau

SEQ ID NO: 11527 - RNA, 38 nt, Artificial Sequence
  Description of Artificial Sequence:  Enzymatic Nucleic Acid
uccaccaacugaugaggccguuaggccgaaagauggag

SEQ ID NO: 11528 - RNA, 38 nt, Artificial Sequence
  Description of Artificial Sequence:  Enzymatic Nucleic Acid
uuccaccacugaugaggccguuaggccgaaaagaugga

SEQ ID NO: 11529 - RNA, 38 nt, Artificial Sequence
  Description of Artificial Sequence:  Enzymatic Nucleic Acid
auuccacccugaugaggccguuaggccgaaaaagaugg

SEQ ID NO: 11530 - RNA, 38 nt, Artificial Sequence
  Description of Artificial Sequence:  Enzymatic Nucleic Acid
augccacacugaugaggccguuaggccgaaacucccug

SEQ ID NO: 11531 - RNA, 38 nt, Artificial Sequence
  Description of Artificial Sequence:  Enzymatic Nucleic Acid
agccuucacugaugaggccguuaggccgaaaugccaca

SEQ ID NO: 11532 - RNA, 38 nt, Artificial Sequence
  Description of Artificial Sequence:  Enzymatic Nucleic Acid
ucugguuucugaugaggccguuaggccgaaagccuuca

SEQ ID NO: 11533 - RNA, 38 nt, Artificial Sequence
  Description of Artificial Sequence:  Enzymatic Nucleic Acid
cggacuggcugaugaggccguuaggccgaaagccgcuu

SEQ ID NO: 11534 - RNA, 38 nt, Artificial Sequence
  Description of Artificial Sequence:  Enzymatic Nucleic Acid
gauauccgcugaugaggccguuaggccgaaacugguag

SEQ ID NO: 11535 - RNA, 38 nt, Artificial Sequence
  Description of Artificial Sequence:  Enzymatic Nucleic Acid
cggagugacugaugaggccguuaggccgaaauccggac

SEQ ID NO: 11536 - RNA, 38 nt, Artificial Sequence
  Description of Artificial Sequence:  Enzymatic Nucleic Acid
aucggagucugaugaggccguuaggccgaaauauccgg

SEQ ID NO: 11537 - RNA, 38 nt, Artificial Sequence
  Description of Artificial Sequence:  Enzymatic Nucleic Acid
ugucaucgcugaugaggccguuaggccgaaagugauau

SEQ ID NO: 11538 - RNA, 38 nt, Artificial Sequence
  Description of Artificial Sequence:  Enzymatic Nucleic Acid
cacuggagcugaugaggccguuaggccgaaacacggug

SEQ ID NO: 11539 - RNA, 38 nt, Artificial Sequence
  Description of Artificial Sequence:  Enzymatic Nucleic Acid
ccucacugcugaugaggccguuaggccgaaaguacacg

SEQ ID NO: 11540 - RNA, 38 nt, Artificial Sequence
  Description of Artificial Sequence:  Enzymatic Nucleic Acid
agcuuuaacugaugaggccguuaggccgaaaguucugc

SEQ ID NO: 11541 - RNA, 38 nt, Artificial Sequence
  Description of Artificial Sequence:  Enzymatic Nucleic Acid
cagcuuuacugaugaggccguuaggccgaaaaguucug

SEQ ID NO: 11542 - RNA, 38 nt, Artificial Sequence
  Description of Artificial Sequence:  Enzymatic Nucleic Acid
ucagcuuucugaugaggccguuaggccgaaaaaguucu

SEQ ID NO: 11543 - RNA, 38 nt, Artificial Sequence
  Description of Artificial Sequence:  Enzymatic Nucleic Acid
aucagcuucugaugaggccguuaggccgaaaaaaguuc

SEQ ID NO: 11544 - RNA, 38 nt, Artificial Sequence
  Description of Artificial Sequence:  Enzymatic Nucleic Acid
ccaaucuccugaugaggccguuaggccgaaaucagcuu

SEQ ID NO: 11545 - RNA, 38 nt, Artificial Sequence
  Description of Artificial Sequence:  Enzymatic Nucleic Acid
ugcacucccugaugaggccguuaggccgaaaucucuau

SEQ ID NO: 11546 - RNA, 38 nt, Artificial Sequence
  Description of Artificial Sequence:  Enzymatic Nucleic Acid
ggcugugccugaugaggccguuaggccgaaaccgguuu

SEQ ID NO: 11547 - RNA, 38 nt, Artificial Sequence
  Description of Artificial Sequence:  Enzymatic Nucleic Acid
ggcuggagcugaugaggccguuaggccgaaaucugggc

SEQ ID NO: 11548 - RNA, 38 nt, Artificial Sequence
  Description of Artificial Sequence:  Enzymatic Nucleic Acid
aggcuggacugaugaggccguuaggccgaaaaucuggg

SEQ ID NO: 11549 - RNA, 38 nt, Artificial Sequence
  Description of Artificial Sequence:  Enzymatic Nucleic Acid
ucaggcugcugaugaggccguuaggccgaaagaaucug

SEQ ID NO: 11550 - RNA, 38 nt, Artificial Sequence
  Description of Artificial Sequence:  Enzymatic Nucleic Acid
caggaggacugaugaggccguuaggccgaaagcucagu

SEQ ID NO: 11551 - RNA, 38 nt, Artificial Sequence
  Description of Artificial Sequence:  Enzymatic Nucleic Acid
aacaggagcugaugaggccguuaggccgaaagagcuca

SEQ ID NO: 11552 - RNA, 38 nt, Artificial Sequence
  Description of Artificial Sequence:  Enzymatic Nucleic Acid
uuaaacagcugaugaggccguuaggccgaaaggagagc

SEQ ID NO: 11553 - RNA, 38 nt, Artificial Sequence
  Description of Artificial Sequence:  Enzymatic Nucleic Acid
uccuuuuacugaugaggccguuaggccgaaacaggagg

SEQ ID NO: 11554 - RNA, 38 nt, Artificial Sequence
  Description of Artificial Sequence:  Enzymatic Nucleic Acid
uuccuuuucugaugaggccguuaggccgaaaacaggag

SEQ ID NO: 11555 - RNA, 38 nt, Artificial Sequence
  Description of Artificial Sequence:  Enzymatic Nucleic Acid
cuuccuuucugaugaggccguuaggccgaaaaacagga

SEQ ID NO: 11556 - RNA, 38 nt, Artificial Sequence
  Description of Artificial Sequence:  Enzymatic Nucleic Acid
ggggugugcugaugaggccguuaggccgaaaugcuucc

SEQ ID NO: 11557 - RNA, 38 nt, Artificial Sequence
  Description of Artificial Sequence:  Enzymatic Nucleic Acid
auguccggcugaugaggccguuaggccgaaaguugggg

SEQ ID NO: 11558 - RNA, 38 nt, Artificial Sequence
  Description of Artificial Sequence:  Enzymatic Nucleic Acid
ucucaugucugaugaggccguuaggccgaaauguccgg

SEQ ID NO: 11559 - RNA, 38 nt, Artificial Sequence
  Description of Artificial Sequence:  Enzymatic Nucleic Acid
ucugagcacugaugaggccguuaggccgaaaccucuca

SEQ ID NO: 11560 - RNA, 38 nt, Artificial Sequence
  Description of Artificial Sequence:  Enzymatic Nucleic Acid
caaaaucucugaugaggccguuaggccgaaagcagacc

SEQ ID NO: 11561 - RNA, 38 nt, Artificial Sequence
  Description of Artificial Sequence:  Enzymatic Nucleic Acid
cacuucaacugaugaggccguuaggccgaaaucugagc

SEQ ID NO: 11562 - RNA, 38 nt, Artificial Sequence
  Description of Artificial Sequence:  Enzymatic Nucleic Acid
acacuucacugaugaggccguuaggccgaaaaucugag

SEQ ID NO: 11563 - RNA, 38 nt, Artificial Sequence
  Description of Artificial Sequence:  Enzymatic Nucleic Acid
aacacuuccugaugaggccguuaggccgaaaaaucuga

SEQ ID NO: 11564 - RNA, 38 nt, Artificial Sequence
  Description of Artificial Sequence:  Enzymatic Nucleic Acid
gaaagaaccugaugaggccguuaggccgaaacacuuca

SEQ ID NO: 11565 - RNA, 38 nt, Artificial Sequence
  Description of Artificial Sequence:  Enzymatic Nucleic Acid
guggaaagcugaugaggccguuaggccgaaacaacacu

SEQ ID NO: 11566 - RNA, 38 nt, Artificial Sequence
  Description of Artificial Sequence:  Enzymatic Nucleic Acid
gguggaaacugaugaggccguuaggccgaaaacaacac

SEQ ID NO: 11567 - RNA, 38 nt, Artificial Sequence
  Description of Artificial Sequence:  Enzymatic Nucleic Acid
cugguggacugaugaggccguuaggccgaaagaacaac

SEQ ID NO: 11568 - RNA, 38 nt, Artificial Sequence
  Description of Artificial Sequence:  Enzymatic Nucleic Acid
gcugguggcugaugaggccguuaggccgaaaagaacaa

SEQ ID NO: 11569 - RNA, 38 nt, Artificial Sequence
  Description of Artificial Sequence:  Enzymatic Nucleic Acid
ugcuggugcugaugaggccguuaggccgaaaaagaaca

SEQ ID NO: 11570 - RNA, 38 nt, Artificial Sequence
  Description of Artificial Sequence:  Enzymatic Nucleic Acid
aaugcggccugaugaggccguuaggccgaaacuuccug

SEQ ID NO: 11571 - RNA, 38 nt, Artificial Sequence
  Description of Artificial Sequence:  Enzymatic Nucleic Acid
gaaaaucacugaugaggccguuaggccgaaaugcggcu

SEQ ID NO: 11572 - RNA, 38 nt, Artificial Sequence
  Description of Artificial Sequence:  Enzymatic Nucleic Acid
ugaaaauccugaugaggccguuaggccgaaaaugcggc

SEQ ID NO: 11573 - RNA, 38 nt, Artificial Sequence
  Description of Artificial Sequence:  Enzymatic Nucleic Acid
gaaaugaacugaugaggccguuaggccgaaaucaaaug

SEQ ID NO: 11574 - RNA, 38 nt, Artificial Sequence
  Description of Artificial Sequence:  Enzymatic Nucleic Acid
cgaaaugacugaugaggccguuaggccgaaaaucaaau

SEQ ID NO: 11575 - RNA, 38 nt, Artificial Sequence
  Description of Artificial Sequence:  Enzymatic Nucleic Acid
ucgaaaugcugaugaggccguuaggccgaaaaaucaaa

SEQ ID NO: 11576 - RNA, 38 nt, Artificial Sequence
  Description of Artificial Sequence:  Enzymatic Nucleic Acid
gucgaaaucugaugaggccguuaggccgaaaaaaucaa

SEQ ID NO: 11577 - RNA, 38 nt, Artificial Sequence
  Description of Artificial Sequence:  Enzymatic Nucleic Acid
guugucgacugaugaggccguuaggccgaaaugaaaau

SEQ ID NO: 11578 - RNA, 38 nt, Artificial Sequence
  Description of Artificial Sequence:  Enzymatic Nucleic Acid
uguugucgcugaugaggccguuaggccgaaaaugaaaa

SEQ ID NO: 11579 - RNA, 38 nt, Artificial Sequence
  Description of Artificial Sequence:  Enzymatic Nucleic Acid
cuguuguccugaugaggccguuaggccgaaaaaugaaa

SEQ ID NO: 11580 - RNA, 38 nt, Artificial Sequence
  Description of Artificial Sequence:  Enzymatic Nucleic Acid
ugcagucccugaugaggccguuaggccgaaagguccuu

SEQ ID NO: 11581 - RNA, 38 nt, Artificial Sequence
  Description of Artificial Sequence:  Enzymatic Nucleic Acid
gccuagaacugaugaggccguuaggccgaaagcuggcu

SEQ ID NO: 11582 - RNA, 38 nt, Artificial Sequence
  Description of Artificial Sequence:  Enzymatic Nucleic Acid
aagccuagcugaugaggccguuaggccgaaagagcugg

SEQ ID NO: 11583 - RNA, 38 nt, Artificial Sequence
  Description of Artificial Sequence:  Enzymatic Nucleic Acid
caagccuacugaugaggccguuaggccgaaaagagcug

SEQ ID NO: 11584 - RNA, 38 nt, Artificial Sequence
  Description of Artificial Sequence:  Enzymatic Nucleic Acid
cacaagcccugaugaggccguuaggccgaaagaagagc

SEQ ID NO: 11585 - RNA, 54 nt, Artificial Sequence
  Description of Artificial Sequence:  Enzymatic Nucleic Acid
cgacggccagaagcaccuaccagagaaacacacguugugguacauuaccuggua

SEQ ID NO: 11586 - RNA, 54 nt, Artificial Sequence
  Description of Artificial Sequence:  Enzymatic Nucleic Acid
cacagggcagaagccagcaccagagaaacacacguugugguacauuaccuggua

SEQ ID NO: 11587 - RNA, 54 nt, Artificial Sequence
  Description of Artificial Sequence:  Enzymatic Nucleic Acid
cccacagaagaagcccggaccagagaaacacacguugugguacauuaccuggua

SEQ ID NO: 11588 - RNA, 54 nt, Artificial Sequence
  Description of Artificial Sequence:  Enzymatic Nucleic Acid
ugagccugagaagaucaaaccagagaaacacacguugugguacauuaccuggua

SEQ ID NO: 11589 - RNA, 54 nt, Artificial Sequence
  Description of Artificial Sequence:  Enzymatic Nucleic Acid
gaggccaaagaaguuuccaccagagaaacacacguugugguacauuaccuggua

SEQ ID NO: 11590 - RNA, 54 nt, Artificial Sequence
  Description of Artificial Sequence:  Enzymatic Nucleic Acid
aaauggagagaaguaaucaccagagaaacacacguugugguacauuaccuggua

SEQ ID NO: 11591 - RNA, 54 nt, Artificial Sequence
  Description of Artificial Sequence:  Enzymatic Nucleic Acid
cuguuaccagaaggaacaaccagagaaacacacguugugguacauuaccuggua

SEQ ID NO: 11592 - RNA, 54 nt, Artificial Sequence
  Description of Artificial Sequence:  Enzymatic Nucleic Acid
acauaauaagaagguaacaccagagaaacacacguugugguacauuaccuggua

SEQ ID NO: 11593 - RNA, 54 nt, Artificial Sequence
  Description of Artificial Sequence:  Enzymatic Nucleic Acid
uuccaugaagaagacucaaccagagaaacacacguugugguacauuaccuggua

SEQ ID NO: 11594 - RNA, 54 nt, Artificial Sequence
  Description of Artificial Sequence:  Enzymatic Nucleic Acid
uuuucuccagaagauaguaccagagaaacacacguugugguacauuaccuggua

SEQ ID NO: 11595 - RNA, 54 nt, Artificial Sequence
  Description of Artificial Sequence:  Enzymatic Nucleic Acid
cacucccaagaaggguuuaccagagaaacacacguugugguacauuaccuggua

SEQ ID NO: 11596 - RNA, 54 nt, Artificial Sequence
  Description of Artificial Sequence:  Enzymatic Nucleic Acid
ucuuggucagaagcccacaccagagaaacacacguugugguacauuaccuggua

SEQ ID NO: 11597 - RNA, 54 nt, Artificial Sequence
  Description of Artificial Sequence:  Enzymatic Nucleic Acid
ccauaaucagaaguacauaccagagaaacacacguugugguacauuaccuggua

SEQ ID NO: 11598 - RNA, 54 nt, Artificial Sequence
  Description of Artificial Sequence:  Enzymatic Nucleic Acid
ucucaccaagaaggggugaccagagaaacacacguugugguacauuaccuggua

SEQ ID NO: 11599 - RNA, 54 nt, Artificial Sequence
  Description of Artificial Sequence:  Enzymatic Nucleic Acid
auggcauaagaaguacauaccagagaaacacacguugugguacauuaccuggua

SEQ ID NO: 11600 - RNA, 54 nt, Artificial Sequence
  Description of Artificial Sequence:  Enzymatic Nucleic Acid
cuuccuccagaagccaauaccagagaaacacacguugugguacauuaccuggua

SEQ ID NO: 11601 - RNA, 54 nt, Artificial Sequence
  Description of Artificial Sequence:  Enzymatic Nucleic Acid
gucacugaagaagcuuggaccagagaaacacacguugugguacauuaccuggua

SEQ ID NO: 11602 - RNA, 54 nt, Artificial Sequence
  Description of Artificial Sequence:  Enzymatic Nucleic Acid
uuguacaaagaagacacaaccagagaaacacacguugugguacauuaccuggua

SEQ ID NO: 11603 - RNA, 54 nt, Artificial Sequence
  Description of Artificial Sequence:  Enzymatic Nucleic Acid
gcucagugagaagcauguaccagagaaacacacguugugguacauuaccuggua

SEQ ID NO: 11604 - RNA, 54 nt, Artificial Sequence
  Description of Artificial Sequence:  Enzymatic Nucleic Acid
aaacguagagaagucugcaccagagaaacacacguugugguacauuaccuggua

SEQ ID NO: 11605 - RNA, 54 nt, Artificial Sequence
  Description of Artificial Sequence:  Enzymatic Nucleic Acid
uuggcagaagaagugggcaccagagaaacacacguugugguacauuaccuggua

SEQ ID NO: 11606 - RNA, 54 nt, Artificial Sequence
  Description of Artificial Sequence:  Enzymatic Nucleic Acid
uucuugcaagaaggugugaccagagaaacacacguugugguacauuaccuggua

SEQ ID NO: 11607 - RNA, 54 nt, Artificial Sequence
  Description of Artificial Sequence:  Enzymatic Nucleic Acid
uugagcaaagaagacauaaccagagaaacacacguugugguacauuaccuggua

SEQ ID NO: 11608 - RNA, 54 nt, Artificial Sequence
  Description of Artificial Sequence:  Enzymatic Nucleic Acid
ggacugugagaagccugaaccagagaaacacacguugugguacauuaccuggua

SEQ ID NO: 11609 - RNA, 54 nt, Artificial Sequence
  Description of Artificial Sequence:  Enzymatic Nucleic Acid
cgcucuagagaagugagcaccagagaaacacacguugugguacauuaccuggua

SEQ ID NO: 11610 - RNA, 54 nt, Artificial Sequence
  Description of Artificial Sequence:  Enzymatic Nucleic Acid
uacuugucagaagauucuaccagagaaacacacguugugguacauuaccuggua

SEQ ID NO: 11611 - RNA, 54 nt, Artificial Sequence
  Description of Artificial Sequence:  Enzymatic Nucleic Acid
accacaugagaaguggagaccagagaaacacacguugugguacauuaccuggua

SEQ ID NO: 11612 - RNA, 54 nt, Artificial Sequence
  Description of Artificial Sequence:  Enzymatic Nucleic Acid
gggaguucagaaggauccaccagagaaacacacguugugguacauuaccuggua

SEQ ID NO: 11613 - RNA, 54 nt, Artificial Sequence
  Description of Artificial Sequence:  Enzymatic Nucleic Acid
caucauaaagaagucguuaccagagaaacacacguugugguacauuaccuggua

SEQ ID NO: 11614 - RNA, 54 nt, Artificial Sequence
  Description of Artificial Sequence:  Enzymatic Nucleic Acid
cuagguucagaaggucucaccagagaaacacacguugugguacauuaccuggua

SEQ ID NO: 11615 - RNA, 54 nt, Artificial Sequence
  Description of Artificial Sequence:  Enzymatic Nucleic Acid
ccaaaggcagaagcuucaaccagagaaacacacguugugguacauuaccuggua

SEQ ID NO: 11616 - RNA, 54 nt, Artificial Sequence
  Description of Artificial Sequence:  Enzymatic Nucleic Acid
gguaagugagaagguuucaccagagaaacacacguugugguacauuaccuggua

SEQ ID NO: 11617 - RNA, 54 nt, Artificial Sequence
  Description of Artificial Sequence:  Enzymatic Nucleic Acid
aaauccagagaaggcugaaccagagaaacacacguugugguacauuaccuggua

SEQ ID NO: 11618 - RNA, 54 nt, Artificial Sequence
  Description of Artificial Sequence:  Enzymatic Nucleic Acid
gcuccaagagaaggaaguaccagagaaacacacguugugguacauuaccuggua

SEQ ID NO: 11619 - RNA, 54 nt, Artificial Sequence
  Description of Artificial Sequence:  Enzymatic Nucleic Acid
cacuuggaagaaguaacaaccagagaaacacacguugugguacauuaccuggua

SEQ ID NO: 11620 - RNA, 54 nt, Artificial Sequence
  Description of Artificial Sequence:  Enzymatic Nucleic Acid
cugacauaagaaggaucuaccagagaaacacacguugugguacauuaccuggua

SEQ ID NO: 11621 - RNA, 54 nt, Artificial Sequence
  Description of Artificial Sequence:  Enzymatic Nucleic Acid
guaguauaagaaggggccaccagagaaacacacguugugguacauuaccuggua

SEQ ID NO: 11622 - RNA, 54 nt, Artificial Sequence
  Description of Artificial Sequence:  Enzymatic Nucleic Acid
ccagcaugagaagguacaaccagagaaacacacguugugguacauuaccuggua

SEQ ID NO: 11623 - RNA, 54 nt, Artificial Sequence
  Description of Artificial Sequence:  Enzymatic Nucleic Acid
cccgugccagaaguccagaccagagaaacacacguugugguacauuaccuggua

SEQ ID NO: 11624 - RNA, 54 nt, Artificial Sequence
  Description of Artificial Sequence:  Enzymatic Nucleic Acid
gugagguaagaagagagaaccagagaaacacacguugugguacauuaccuggua

SEQ ID NO: 11625 - RNA, 54 nt, Artificial Sequence
  Description of Artificial Sequence:  Enzymatic Nucleic Acid
auacaggaagaaggugagaccagagaaacacacguugugguacauuaccuggua

SEQ ID NO: 11626 - RNA, 54 nt, Artificial Sequence
  Description of Artificial Sequence:  Enzymatic Nucleic Acid
cacucacaagaaggcucuaccagagaaacacacguugugguacauuaccuggua

SEQ ID NO: 11627 - RNA, 54 nt, Artificial Sequence
  Description of Artificial Sequence:  Enzymatic Nucleic Acid
ugguugucagaagggauuaccagagaaacacacguugugguacauuaccuggua

SEQ ID NO: 11628 - RNA, 54 nt, Artificial Sequence
  Description of Artificial Sequence:  Enzymatic Nucleic Acid
cacuguccagaagguuguaccagagaaacacacguugugguacauuaccuggua

SEQ ID NO: 11629 - RNA, 54 nt, Artificial Sequence
  Description of Artificial Sequence:  Enzymatic Nucleic Acid
gauauccgagaagguagcaccagagaaacacacguugugguacauuaccuggua

SEQ ID NO: 11630 - RNA, 54 nt, Artificial Sequence
  Description of Artificial Sequence:  Enzymatic Nucleic Acid
ucugugucagaagagugaaccagagaaacacacguugugguacauuaccuggua

SEQ ID NO: 11631 - RNA, 54 nt, Artificial Sequence
  Description of Artificial Sequence:  Enzymatic Nucleic Acid
agaaucugagaagugcuaaccagagaaacacacguugugguacauuaccuggua

SEQ ID NO: 11632 - RNA, 54 nt, Artificial Sequence
  Description of Artificial Sequence:  Enzymatic Nucleic Acid
gcuggagaagaagggcugaccagagaaacacacguugugguacauuaccuggua

SEQ ID NO: 11633 - RNA, 54 nt, Artificial Sequence
  Description of Artificial Sequence:  Enzymatic Nucleic Acid
ccgugucaagaaggagaaaccagagaaacacacguugugguacauuaccuggua

SEQ ID NO: 11634 - RNA, 54 nt, Artificial Sequence
  Description of Artificial Sequence:  Enzymatic Nucleic Acid
uccuuuuaagaaggaggaaccagagaaacacacguugugguacauuaccuggua

SEQ ID NO: 11635 - RNA, 54 nt, Artificial Sequence
  Description of Artificial Sequence:  Enzymatic Nucleic Acid
aaaaucugagaagaccucaccagagaaacacacguugugguacauuaccuggua

SEQ ID NO: 11636 - RNA, 54 nt, Artificial Sequence
  Description of Artificial Sequence:  Enzymatic Nucleic Acid
acuucaaaagaagagcagaccagagaaacacacguugugguacauuaccuggua

SEQ ID NO: 11637 - RNA, 54 nt, Artificial Sequence
  Description of Artificial Sequence:  Enzymatic Nucleic Acid
ucccugcaagaagaggucaccagagaaacacacguugugguacauuaccuggua

SEQ ID NO: 11638 - RNA, 54 nt, Artificial Sequence
  Description of Artificial Sequence:  Enzymatic Nucleic Acid
ccuagaagagaaggcuccaccagagaaacacacguugugguacauuaccuggua

SEQ ID NO: 11639 - RNA, 38 nt, Artificial Sequence
  Description of Artificial Sequence:  Enzymatic Nucleic Acid
ccguaccccugaugaggccguuaggccgaaauucgccc

SEQ ID NO: 11640 - RNA, 38 nt, Artificial Sequence
  Description of Artificial Sequence:  Enzymatic Nucleic Acid
gggucccgcugaugaggccguuaggccgaaacccaauu

SEQ ID NO: 11641 - RNA, 38 nt, Artificial Sequence
  Description of Artificial Sequence:  Enzymatic Nucleic Acid
ucgaccuccugaugaggccguuaggccgaaaggggggu

SEQ ID NO: 11642 - RNA, 38 nt, Artificial Sequence
  Description of Artificial Sequence:  Enzymatic Nucleic Acid
auaccguccugaugaggccguuaggccgaaaccucgag

SEQ ID NO: 11643 - RNA, 38 nt, Artificial Sequence
  Description of Artificial Sequence:  Enzymatic Nucleic Acid
cuuaucgacugaugaggccguuaggccgaaaccgucga

SEQ ID NO: 11644 - RNA, 38 nt, Artificial Sequence
  Description of Artificial Sequence:  Enzymatic Nucleic Acid
agcuuauccugaugaggccguuaggccgaaauaccguc

SEQ ID NO: 11645 - RNA, 38 nt, Artificial Sequence
  Description of Artificial Sequence:  Enzymatic Nucleic Acid
aucaagcucugaugaggccguuaggccgaaaucgauac

SEQ ID NO: 11646 - RNA, 38 nt, Artificial Sequence
  Description of Artificial Sequence:  Enzymatic Nucleic Acid
ucgauauccugaugaggccguuaggccgaaagcuuauc

SEQ ID NO: 11647 - RNA, 38 nt, Artificial Sequence
  Description of Artificial Sequence:  Enzymatic Nucleic Acid
gaauucgacugaugaggccguuaggccgaaaucaagcu

SEQ ID NO: 11648 - RNA, 38 nt, Artificial Sequence
  Description of Artificial Sequence:  Enzymatic Nucleic Acid
ccgaauuccugaugaggccguuaggccgaaauaucaag

SEQ ID NO: 11649 - RNA, 38 nt, Artificial Sequence
  Description of Artificial Sequence:  Enzymatic Nucleic Acid
ugggcccgcugaugaggccguuaggccgaaauucgaua

SEQ ID NO: 11650 - RNA, 38 nt, Artificial Sequence
  Description of Artificial Sequence:  Enzymatic Nucleic Acid
cugggccccugaugaggccguuaggccgaaaauucgau

SEQ ID NO: 11651 - RNA, 38 nt, Artificial Sequence
  Description of Artificial Sequence:  Enzymatic Nucleic Acid
ggcugcggcugaugaggccguuaggccgaaacacaguc

SEQ ID NO: 11652 - RNA, 38 nt, Artificial Sequence
  Description of Artificial Sequence:  Enzymatic Nucleic Acid
agccaggucugaugaggccguuaggccgaaaucccggc

SEQ ID NO: 11653 - RNA, 38 nt, Artificial Sequence
  Description of Artificial Sequence:  Enzymatic Nucleic Acid
guccgcggcugaugaggccguuaggccgaaaucggguc

SEQ ID NO: 11654 - RNA, 38 nt, Artificial Sequence
  Description of Artificial Sequence:  Enzymatic Nucleic Acid
uguccgcgcugaugaggccguuaggccgaaaaucgggu

SEQ ID NO: 11655 - RNA, 38 nt, Artificial Sequence
  Description of Artificial Sequence:  Enzymatic Nucleic Acid
accggggacugaugaggccguuaggccgaaagcgcggg

SEQ ID NO: 11656 - RNA, 38 nt, Artificial Sequence
  Description of Artificial Sequence:  Enzymatic Nucleic Acid
agaccgggcugaugaggccguuaggccgaaagagcgcg

SEQ ID NO: 11657 - RNA, 38 nt, Artificial Sequence
  Description of Artificial Sequence:  Enzymatic Nucleic Acid
cagcgcaacugaugaggccguuaggccgaaaccgggga

SEQ ID NO: 11658 - RNA, 38 nt, Artificial Sequence
  Description of Artificial Sequence:  Enzymatic Nucleic Acid
cgcagcgccugaugaggccguuaggccgaaagaccggg

SEQ ID NO: 11659 - RNA, 38 nt, Artificial Sequence
  Description of Artificial Sequence:  Enzymatic Nucleic Acid
agaggcggcugaugaggccguuaggccgaaauggcccc

SEQ ID NO: 11660 - RNA, 38 nt, Artificial Sequence
  Description of Artificial Sequence:  Enzymatic Nucleic Acid
aagucacacugaugaggccguuaggccgaaaggcggua

SEQ ID NO: 11661 - RNA, 38 nt, Artificial Sequence
  Description of Artificial Sequence:  Enzymatic Nucleic Acid
ccgcaaagcugaugaggccguuaggccgaaagucacag

SEQ ID NO: 11662 - RNA, 38 nt, Artificial Sequence
  Description of Artificial Sequence:  Enzymatic Nucleic Acid
cccgcaaacugaugaggccguuaggccgaaaagucaca

SEQ ID NO: 11663 - RNA, 38 nt, Artificial Sequence
  Description of Artificial Sequence:  Enzymatic Nucleic Acid
ggcccgcacugaugaggccguuaggccgaaagaaguca

SEQ ID NO: 11664 - RNA, 38 nt, Artificial Sequence
  Description of Artificial Sequence:  Enzymatic Nucleic Acid
uggcccgccugaugaggccguuaggccgaaaagaaguc

SEQ ID NO: 11665 - RNA, 38 nt, Artificial Sequence
  Description of Artificial Sequence:  Enzymatic Nucleic Acid
caggcacacugaugaggccguuaggccgaaacuccuuc

SEQ ID NO: 11666 - RNA, 38 nt, Artificial Sequence
  Description of Artificial Sequence:  Enzymatic Nucleic Acid
ugggcacacugaugaggccguuaggccgaaagcccagu

SEQ ID NO: 11667 - RNA, 38 nt, Artificial Sequence
  Description of Artificial Sequence:  Enzymatic Nucleic Acid
gcgacagccugaugaggccguuaggccgaaagcagcgc

SEQ ID NO: 11668 - RNA, 38 nt, Artificial Sequence
  Description of Artificial Sequence:  Enzymatic Nucleic Acid
cacagagccugaugaggccguuaggccgaaacagcuag

SEQ ID NO: 11669 - RNA, 38 nt, Artificial Sequence
  Description of Artificial Sequence:  Enzymatic Nucleic Acid
gaaccacacugaugaggccguuaggccgaaagcgacag

SEQ ID NO: 11670 - RNA, 38 nt, Artificial Sequence
  Description of Artificial Sequence:  Enzymatic Nucleic Acid
ccacgcagcugaugaggccguuaggccgaaaccacaga

SEQ ID NO: 11671 - RNA, 38 nt, Artificial Sequence
  Description of Artificial Sequence:  Enzymatic Nucleic Acid
uccacgcacugaugaggccguuaggccgaaaaccacag

SEQ ID NO: 11672 - RNA, 38 nt, Artificial Sequence
  Description of Artificial Sequence:  Enzymatic Nucleic Acid
aacccacacugaugaggccguuaggccgaaaggcggcu

SEQ ID NO: 11673 - RNA, 38 nt, Artificial Sequence
  Description of Artificial Sequence:  Enzymatic Nucleic Acid
gccagucacugaugaggccguuaggccgaaacccacag

SEQ ID NO: 11674 - RNA, 38 nt, Artificial Sequence
  Description of Artificial Sequence:  Enzymatic Nucleic Acid
cgccaguccugaugaggccguuaggccgaaaacccaca

SEQ ID NO: 11675 - RNA, 38 nt, Artificial Sequence
  Description of Artificial Sequence:  Enzymatic Nucleic Acid
auggagaacugaugaggccguuaggccgaaaucgccag

SEQ ID NO: 11676 - RNA, 38 nt, Artificial Sequence
  Description of Artificial Sequence:  Enzymatic Nucleic Acid
gauggagacugaugaggccguuaggccgaaaaucgcca

SEQ ID NO: 11677 - RNA, 38 nt, Artificial Sequence
  Description of Artificial Sequence:  Enzymatic Nucleic Acid
ggauggagcugaugaggccguuaggccgaaaaaucgcc

SEQ ID NO: 11678 - RNA, 38 nt, Artificial Sequence
  Description of Artificial Sequence:  Enzymatic Nucleic Acid
gggauggacugaugaggccguuaggccgaaaaaaucgc

SEQ ID NO: 11679 - RNA, 38 nt, Artificial Sequence
  Description of Artificial Sequence:  Enzymatic Nucleic Acid
gggggaugcugaugaggccguuaggccgaaagaaaauc

SEQ ID NO: 11680 - RNA, 38 nt, Artificial Sequence
  Description of Artificial Sequence:  Enzymatic Nucleic Acid
cuugggggcugaugaggccguuaggccgaaauggagaa

SEQ ID NO: 11681 - RNA, 38 nt, Artificial Sequence
  Description of Artificial Sequence:  Enzymatic Nucleic Acid
ugugugcucugaugaggccguuaggccgaaagcuuggg

SEQ ID NO: 11682 - RNA, 38 nt, Artificial Sequence
  Description of Artificial Sequence:  Enzymatic Nucleic Acid
auugucagcugaugaggccguuaggccgaaaugucuuu

SEQ ID NO: 11683 - RNA, 38 nt, Artificial Sequence
  Description of Artificial Sequence:  Enzymatic Nucleic Acid
uuugccaacugaugaggccguuaggccgaaauugucag

SEQ ID NO: 11684 - RNA, 38 nt, Artificial Sequence
  Description of Artificial Sequence:  Enzymatic Nucleic Acid
auuugccacugaugaggccguuaggccgaaaauuguca

SEQ ID NO: 11685 - RNA, 38 nt, Artificial Sequence
  Description of Artificial Sequence:  Enzymatic Nucleic Acid
uauuugcccugaugaggccguuaggccgaaaaauuguc

SEQ ID NO: 11686 - RNA, 38 nt, Artificial Sequence
  Description of Artificial Sequence:  Enzymatic Nucleic Acid
aaggguugcugaugaggccguuaggccgaaauuugcca

SEQ ID NO: 11687 - RNA, 38 nt, Artificial Sequence
  Description of Artificial Sequence:  Enzymatic Nucleic Acid
guaaucugcugaugaggccguuaggccgaaaggguugu

SEQ ID NO: 11688 - RNA, 38 nt, Artificial Sequence
  Description of Artificial Sequence:  Enzymatic Nucleic Acid
aguaaucucugaugaggccguuaggccgaaaaggguug

SEQ ID NO: 11689 - RNA, 38 nt, Artificial Sequence
  Description of Artificial Sequence:  Enzymatic Nucleic Acid
cugcaagucugaugaggccguuaggccgaaaucugaag

SEQ ID NO: 11690 - RNA, 38 nt, Artificial Sequence
  Description of Artificial Sequence:  Enzymatic Nucleic Acid
ccugcaagcugaugaggccguuaggccgaaaaucugaa

SEQ ID NO: 11691 - RNA, 38 nt, Artificial Sequence
  Description of Artificial Sequence:  Enzymatic Nucleic Acid
uccccugccugaugaggccguuaggccgaaaguaaucu

SEQ ID NO: 11692 - RNA, 38 nt, Artificial Sequence
  Description of Artificial Sequence:  Enzymatic Nucleic Acid
aucacgcucugaugaggccguuaggccgaaagcauugg

SEQ ID NO: 11693 - RNA, 38 nt, Artificial Sequence
  Description of Artificial Sequence:  Enzymatic Nucleic Acid
uuccucagcugaugaggccguuaggccgaaaucacgcu

SEQ ID NO: 11694 - RNA, 38 nt, Artificial Sequence
  Description of Artificial Sequence:  Enzymatic Nucleic Acid
uuuccucacugaugaggccguuaggccgaaaaucacgc

SEQ ID NO: 11695 - RNA, 38 nt, Artificial Sequence
  Description of Artificial Sequence:  Enzymatic Nucleic Acid
gucaccaacugaugaggccguuaggccgaaacccuuuc

SEQ ID NO: 11696 - RNA, 38 nt, Artificial Sequence
  Description of Artificial Sequence:  Enzymatic Nucleic Acid
cagucacccugaugaggccguuaggccgaaauacccuu

SEQ ID NO: 11697 - RNA, 38 nt, Artificial Sequence
  Description of Artificial Sequence:  Enzymatic Nucleic Acid
gcagaagacugaugaggccguuaggccgaaacugucac

SEQ ID NO: 11698 - RNA, 38 nt, Artificial Sequence
  Description of Artificial Sequence:  Enzymatic Nucleic Acid
uugcagaacugaugaggccguuaggccgaaauacuguc

SEQ ID NO: 11699 - RNA, 38 nt, Artificial Sequence
  Description of Artificial Sequence:  Enzymatic Nucleic Acid
uuuugcagcugaugaggccguuaggccgaaagauacug

SEQ ID NO: 11700 - RNA, 38 nt, Artificial Sequence
  Description of Artificial Sequence:  Enzymatic Nucleic Acid
guuuugcacugaugaggccguuaggccgaaaagauacu

SEQ ID NO: 11701 - RNA, 38 nt, Artificial Sequence
  Description of Artificial Sequence:  Enzymatic Nucleic Acid
ggaauggucugaugaggccguuaggccgaaaguguuuu

SEQ ID NO: 11702 - RNA, 38 nt, Artificial Sequence
  Description of Artificial Sequence:  Enzymatic Nucleic Acid
acccugggcugaugaggccguuaggccgaaauggugag

SEQ ID NO: 11703 - RNA, 38 nt, Artificial Sequence
  Description of Artificial Sequence:  Enzymatic Nucleic Acid
cacccuggcugaugaggccguuaggccgaaaaugguga

SEQ ID NO: 11704 - RNA, 38 nt, Artificial Sequence
  Description of Artificial Sequence:  Enzymatic Nucleic Acid
ucauuucccugaugaggccguuaggccgaaaccacccu

SEQ ID NO: 11705 - RNA, 38 nt, Artificial Sequence
  Description of Artificial Sequence:  Enzymatic Nucleic Acid
ggcuccagcugaugaggccguuaggccgaaaucauuuc

SEQ ID NO: 11706 - RNA, 38 nt, Artificial Sequence
  Description of Artificial Sequence:  Enzymatic Nucleic Acid
cccgguaccugaugaggccguuaggccgaaagcacuug

SEQ ID NO: 11707 - RNA, 38 nt, Artificial Sequence
  Description of Artificial Sequence:  Enzymatic Nucleic Acid
cgucccggcugaugaggccguuaggccgaaacgagcac

SEQ ID NO: 11708 - RNA, 38 nt, Artificial Sequence
  Description of Artificial Sequence:  Enzymatic Nucleic Acid
gcuauguccugaugaggccguuaggccgaaacgucccg

SEQ ID NO: 11709 - RNA, 38 nt, Artificial Sequence
  Description of Artificial Sequence:  Enzymatic Nucleic Acid
guggaggccugaugaggccguuaggccgaaaugucgac

SEQ ID NO: 11710 - RNA, 38 nt, Artificial Sequence
  Description of Artificial Sequence:  Enzymatic Nucleic Acid
aaacagugcugaugaggccguuaggccgaaaggcuaug

SEQ ID NO: 11711 - RNA, 38 nt, Artificial Sequence
  Description of Artificial Sequence:  Enzymatic Nucleic Acid
uagacauacugaugaggccguuaggccgaaacagugga

SEQ ID NO: 11712 - RNA, 38 nt, Artificial Sequence
  Description of Artificial Sequence:  Enzymatic Nucleic Acid
auagacaucugaugaggccguuaggccgaaaacagugg

SEQ ID NO: 11713 - RNA, 38 nt, Artificial Sequence
  Description of Artificial Sequence:  Enzymatic Nucleic Acid
cauagacacugaugaggccguuaggccgaaaaacagug

SEQ ID NO: 11714 - RNA, 38 nt, Artificial Sequence
  Description of Artificial Sequence:  Enzymatic Nucleic Acid
cgaacauacugaugaggccguuaggccgaaacauaaac

SEQ ID NO: 11715 - RNA, 38 nt, Artificial Sequence
  Description of Artificial Sequence:  Enzymatic Nucleic Acid
cucgaacacugaugaggccguuaggccgaaagacauaa

SEQ ID NO: 11716 - RNA, 38 nt, Artificial Sequence
  Description of Artificial Sequence:  Enzymatic Nucleic Acid
uaaucucgcugaugaggccguuaggccgaaacauagac

SEQ ID NO: 11717 - RNA, 38 nt, Artificial Sequence
  Description of Artificial Sequence:  Enzymatic Nucleic Acid
guaaucuccugaugaggccguuaggccgaaaacauaga

SEQ ID NO: 11718 - RNA, 38 nt, Artificial Sequence
  Description of Artificial Sequence:  Enzymatic Nucleic Acid
ugaucugucugaugaggccguuaggccgaaaucucgaa

SEQ ID NO: 11719 - RNA, 38 nt, Artificial Sequence
  Description of Artificial Sequence:  Enzymatic Nucleic Acid
gugaucugcugaugaggccguuaggccgaaaaucucga

SEQ ID NO: 11720 - RNA, 38 nt, Artificial Sequence
  Description of Artificial Sequence:  Enzymatic Nucleic Acid
ugaauggucugaugaggccguuaggccgaaaucuguaa

SEQ ID NO: 11721 - RNA, 38 nt, Artificial Sequence
  Description of Artificial Sequence:  Enzymatic Nucleic Acid
aggcgaugcugaugaggccguuaggccgaaauggugau

SEQ ID NO: 11722 - RNA, 38 nt, Artificial Sequence
  Description of Artificial Sequence:  Enzymatic Nucleic Acid
gaggcgaucugaugaggccguuaggccgaaaaugguga

SEQ ID NO: 11723 - RNA, 38 nt, Artificial Sequence
  Description of Artificial Sequence:  Enzymatic Nucleic Acid
acagaggccugaugaggccguuaggccgaaaugaaugg

SEQ ID NO: 11724 - RNA, 38 nt, Artificial Sequence
  Description of Artificial Sequence:  Enzymatic Nucleic Acid
cacugacacugaugaggccguuaggccgaaaggcgaug

SEQ ID NO: 11725 - RNA, 38 nt, Artificial Sequence
  Description of Artificial Sequence:  Enzymatic Nucleic Acid
uggucacucugaugaggccguuaggccgaaacagaggc

SEQ ID NO: 11726 - RNA, 38 nt, Artificial Sequence
  Description of Artificial Sequence:  Enzymatic Nucleic Acid
auguacaccugaugaggccguuaggccgaaaugccaug

SEQ ID NO: 11727 - RNA, 38 nt, Artificial Sequence
  Description of Artificial Sequence:  Enzymatic Nucleic Acid
cggugaugcugaugaggccguuaggccgaaacacgaug

SEQ ID NO: 11728 - RNA, 38 nt, Artificial Sequence
  Description of Artificial Sequence:  Enzymatic Nucleic Acid
uucucggucugaugaggccguuaggccgaaauguacac

SEQ ID NO: 11729 - RNA, 38 nt, Artificial Sequence
  Description of Artificial Sequence:  Enzymatic Nucleic Acid
cggcagggcugaugaggccguuaggccgaaaucaccac

SEQ ID NO: 11730 - RNA, 38 nt, Artificial Sequence
  Description of Artificial Sequence:  Enzymatic Nucleic Acid
uugaaauccugaugaggccguuaggccgaaacccucgg

SEQ ID NO: 11731 - RNA, 38 nt, Artificial Sequence
  Description of Artificial Sequence:  Enzymatic Nucleic Acid
agguuugacugaugaggccguuaggccgaaaucgaccc

SEQ ID NO: 11732 - RNA, 38 nt, Artificial Sequence
  Description of Artificial Sequence:  Enzymatic Nucleic Acid
gagguuugcugaugaggccguuaggccgaaaaucgacc

SEQ ID NO: 11733 - RNA, 38 nt, Artificial Sequence
  Description of Artificial Sequence:  Enzymatic Nucleic Acid
ugagguuucugaugaggccguuaggccgaaaaaucgac

SEQ ID NO: 11734 - RNA, 38 nt, Artificial Sequence
  Description of Artificial Sequence:  Enzymatic Nucleic Acid
gacacauucugaugaggccguuaggccgaaagguuuga

SEQ ID NO: 11735 - RNA, 38 nt, Artificial Sequence
  Description of Artificial Sequence:  Enzymatic Nucleic Acid
cgcaaagacugaugaggccguuaggccgaaacacauug

SEQ ID NO: 11736 - RNA, 38 nt, Artificial Sequence
  Description of Artificial Sequence:  Enzymatic Nucleic Acid
agcgcaaacugaugaggccguuaggccgaaagacacau

SEQ ID NO: 11737 - RNA, 38 nt, Artificial Sequence
  Description of Artificial Sequence:  Enzymatic Nucleic Acid
cuagcgcacugaugaggccguuaggccgaaagagacac

SEQ ID NO: 11738 - RNA, 38 nt, Artificial Sequence
  Description of Artificial Sequence:  Enzymatic Nucleic Acid
ccuagcgccugaugaggccguuaggccgaaaagagaca

SEQ ID NO: 11739 - RNA, 38 nt, Artificial Sequence
  Description of Artificial Sequence:  Enzymatic Nucleic Acid
uggauacccugaugaggccguuaggccgaaagcgcaaa

SEQ ID NO: 11740 - RNA, 38 nt, Artificial Sequence
  Description of Artificial Sequence:  Enzymatic Nucleic Acid
uuucuggacugaugaggccguuaggccgaaaccuagcg

SEQ ID NO: 11741 - RNA, 38 nt, Artificial Sequence
  Description of Artificial Sequence:  Enzymatic Nucleic Acid
cuuuucugcugaugaggccguuaggccgaaauaccuag

SEQ ID NO: 11742 - RNA, 38 nt, Artificial Sequence
  Description of Artificial Sequence:  Enzymatic Nucleic Acid
ccggaacacugaugaggccguuaggccgaaaucucuuu

SEQ ID NO: 11743 - RNA, 38 nt, Artificial Sequence
  Description of Artificial Sequence:  Enzymatic Nucleic Acid
uccggaaccugaugaggccguuaggccgaaaaucucuu

SEQ ID NO: 11744 - RNA, 38 nt, Artificial Sequence
  Description of Artificial Sequence:  Enzymatic Nucleic Acid
ccauccggcugaugaggccguuaggccgaaacaaaucu

SEQ ID NO: 11745 - RNA, 38 nt, Artificial Sequence
  Description of Artificial Sequence:  Enzymatic Nucleic Acid
uccauccgcugaugaggccguuaggccgaaaacaaauc

SEQ ID NO: 11746 - RNA, 38 nt, Artificial Sequence
  Description of Artificial Sequence:  Enzymatic Nucleic Acid
guaaagcccugaugaggccguuaggccgaaaucucgcu

SEQ ID NO: 11747 - RNA, 38 nt, Artificial Sequence
  Description of Artificial Sequence:  Enzymatic Nucleic Acid
ggagaguacugaugaggccguuaggccgaaagccuauc

SEQ ID NO: 11748 - RNA, 38 nt, Artificial Sequence
  Description of Artificial Sequence:  Enzymatic Nucleic Acid
gggagagucugaugaggccguuaggccgaaaagccuau

SEQ ID NO: 11749 - RNA, 38 nt, Artificial Sequence
  Description of Artificial Sequence:  Enzymatic Nucleic Acid
ggggagagcugaugaggccguuaggccgaaaaagccua

SEQ ID NO: 11750 - RNA, 38 nt, Artificial Sequence
  Description of Artificial Sequence:  Enzymatic Nucleic Acid
acuggggacugaugaggccguuaggccgaaaguaaagc

SEQ ID NO: 11751 - RNA, 38 nt, Artificial Sequence
  Description of Artificial Sequence:  Enzymatic Nucleic Acid
uaacugggcugaugaggccguuaggccgaaagaguaaa

SEQ ID NO: 11752 - RNA, 38 nt, Artificial Sequence
  Description of Artificial Sequence:  Enzymatic Nucleic Acid
gaucaugucugaugaggccguuaggccgaaacugggga

SEQ ID NO: 11753 - RNA, 38 nt, Artificial Sequence
  Description of Artificial Sequence:  Enzymatic Nucleic Acid
ugaucaugcugaugaggccguuaggccgaaaacugggg

SEQ ID NO: 11754 - RNA, 38 nt, Artificial Sequence
  Description of Artificial Sequence:  Enzymatic Nucleic Acid
ugccggcacugaugaggccguuaggccgaaagcugauc

SEQ ID NO: 11755 - RNA, 38 nt, Artificial Sequence
  Description of Artificial Sequence:  Enzymatic Nucleic Acid
ccucacagcugaugaggccguuaggccgaaagaccaug

SEQ ID NO: 11756 - RNA, 38 nt, Artificial Sequence
  Description of Artificial Sequence:  Enzymatic Nucleic Acid
gccucacacugaugaggccguuaggccgaaaagaccau

SEQ ID NO: 11757 - RNA, 38 nt, Artificial Sequence
  Description of Artificial Sequence:  Enzymatic Nucleic Acid
ucaucauucugaugaggccguuaggccgaaaucuuugc

SEQ ID NO: 11758 - RNA, 38 nt, Artificial Sequence
  Description of Artificial Sequence:  Enzymatic Nucleic Acid
uagacugacugaugaggccguuaggccgaaagguuuca

SEQ ID NO: 11759 - RNA, 38 nt, Artificial Sequence
  Description of Artificial Sequence:  Enzymatic Nucleic Acid
gauagacucugaugaggccguuaggccgaaauagguuu

SEQ ID NO: 11760 - RNA, 38 nt, Artificial Sequence
  Description of Artificial Sequence:  Enzymatic Nucleic Acid
acaugauacugaugaggccguuaggccgaaacugauag

SEQ ID NO: 11761 - RNA, 38 nt, Artificial Sequence
  Description of Artificial Sequence:  Enzymatic Nucleic Acid
guacaugacugaugaggccguuaggccgaaagacugau

SEQ ID NO: 11762 - RNA, 38 nt, Artificial Sequence
  Description of Artificial Sequence:  Enzymatic Nucleic Acid
caacuaugcugaugaggccguuaggccgaaacaugaua

SEQ ID NO: 11763 - RNA, 38 nt, Artificial Sequence
  Description of Artificial Sequence:  Enzymatic Nucleic Acid
accacaaccugaugaggccguuaggccgaaauguacau

SEQ ID NO: 11764 - RNA, 38 nt, Artificial Sequence
  Description of Artificial Sequence:  Enzymatic Nucleic Acid
acaaccaccugaugaggccguuaggccgaaacuaugua

SEQ ID NO: 11765 - RNA, 38 nt, Artificial Sequence
  Description of Artificial Sequence:  Enzymatic Nucleic Acid
uauccuaccugaugaggccguuaggccgaaaccacaac

SEQ ID NO: 11766 - RNA, 38 nt, Artificial Sequence
  Description of Artificial Sequence:  Enzymatic Nucleic Acid
cuauaucccugaugaggccguuaggccgaaacaaccac

SEQ ID NO: 11767 - RNA, 38 nt, Artificial Sequence
  Description of Artificial Sequence:  Enzymatic Nucleic Acid
aaauccuacugaugaggccguuaggccgaaauccuaca

SEQ ID NO: 11768 - RNA, 38 nt, Artificial Sequence
  Description of Artificial Sequence:  Enzymatic Nucleic Acid
auaaaucccugaugaggccguuaggccgaaauauccua

SEQ ID NO: 11769 - RNA, 38 nt, Artificial Sequence
  Description of Artificial Sequence:  Enzymatic Nucleic Acid
ucacaucacugaugaggccguuaggccgaaaaauccua

SEQ ID NO: 11770 - RNA, 38 nt, Artificial Sequence
  Description of Artificial Sequence:  Enzymatic Nucleic Acid
gggcucagcugaugaggccguuaggccgaaaucacauc

SEQ ID NO: 11771 - RNA, 38 nt, Artificial Sequence
  Description of Artificial Sequence:  Enzymatic Nucleic Acid
ggggcucacugaugaggccguuaggccgaaaaucacau

SEQ ID NO: 11772 - RNA, 38 nt, Artificial Sequence
  Description of Artificial Sequence:  Enzymatic Nucleic Acid
gauagcuccugaugaggccguuaggccgaaauuucaug

SEQ ID NO: 11773 - RNA, 38 nt, Artificial Sequence
  Description of Artificial Sequence:  Enzymatic Nucleic Acid
ccggcagacugaugaggccguuaggccgaaagcucaau

SEQ ID NO: 11774 - RNA, 38 nt, Artificial Sequence
  Description of Artificial Sequence:  Enzymatic Nucleic Acid
cuccggcacugaugaggccguuaggccgaaauagcuca

SEQ ID NO: 11775 - RNA, 38 nt, Artificial Sequence
  Description of Artificial Sequence:  Enzymatic Nucleic Acid
uuuaagaccugaugaggccguuaggccgaaaguuuuuc

SEQ ID NO: 11776 - RNA, 38 nt, Artificial Sequence
  Description of Artificial Sequence:  Enzymatic Nucleic Acid
caauuuaacugaugaggccguuaggccgaaacaaguuu

SEQ ID NO: 11777 - RNA, 38 nt, Artificial Sequence
  Description of Artificial Sequence:  Enzymatic Nucleic Acid
uacaauuucugaugaggccguuaggccgaaagacaagu

SEQ ID NO: 11778 - RNA, 38 nt, Artificial Sequence
  Description of Artificial Sequence:  Enzymatic Nucleic Acid
cgcuguaccugaugaggccguuaggccgaaauuuaaga

SEQ ID NO: 11779 - RNA, 38 nt, Artificial Sequence
  Description of Artificial Sequence:  Enzymatic Nucleic Acid
ucucgcugcugaugaggccguuaggccgaaacaauuua

SEQ ID NO: 11780 - RNA, 38 nt, Artificial Sequence
  Description of Artificial Sequence:  Enzymatic Nucleic Acid
cccacauucugaugaggccguuaggccgaaagcucugu

SEQ ID NO: 11781 - RNA, 38 nt, Artificial Sequence
  Description of Artificial Sequence:  Enzymatic Nucleic Acid
gugaaauccugaugaggccguuaggccgaaagccccac

SEQ ID NO: 11782 - RNA, 38 nt, Artificial Sequence
  Description of Artificial Sequence:  Enzymatic Nucleic Acid
ccaggugacugaugaggccguuaggccgaaaucaagcc

SEQ ID NO: 11783 - RNA, 38 nt, Artificial Sequence
  Description of Artificial Sequence:  Enzymatic Nucleic Acid
gccaggugcugaugaggccguuaggccgaaaaucaagc

SEQ ID NO: 11784 - RNA, 38 nt, Artificial Sequence
  Description of Artificial Sequence:  Enzymatic Nucleic Acid
ugccaggucugaugaggccguuaggccgaaaaaucaag

SEQ ID NO: 11785 - RNA, 38 nt, Artificial Sequence
  Description of Artificial Sequence:  Enzymatic Nucleic Acid
aagguggacugaugaggccguuaggccgaaagugccag

SEQ ID NO: 11786 - RNA, 38 nt, Artificial Sequence
  Description of Artificial Sequence:  Enzymatic Nucleic Acid
ugaaggugcugaugaggccguuaggccgaaagagugcc

SEQ ID NO: 11787 - RNA, 38 nt, Artificial Sequence
  Description of Artificial Sequence:  Enzymatic Nucleic Acid
agacuuugcugaugaggccguuaggccgaaagguggag

SEQ ID NO: 11788 - RNA, 38 nt, Artificial Sequence
  Description of Artificial Sequence:  Enzymatic Nucleic Acid
gagacuuucugaugaggccguuaggccgaaaaggugga

SEQ ID NO: 11789 - RNA, 38 nt, Artificial Sequence
  Description of Artificial Sequence:  Enzymatic Nucleic Acid
uaugaugacugaugaggccguuaggccgaaacuuugaa

SEQ ID NO: 11790 - RNA, 38 nt, Artificial Sequence
  Description of Artificial Sequence:  Enzymatic Nucleic Acid
cuuaugaucugaugaggccguuaggccgaaagacuuug

SEQ ID NO: 11791 - RNA, 38 nt, Artificial Sequence
  Description of Artificial Sequence:  Enzymatic Nucleic Acid
cuucuuaucugaugaggccguuaggccgaaaugagacu

SEQ ID NO: 11792 - RNA, 38 nt, Artificial Sequence
  Description of Artificial Sequence:  Enzymatic Nucleic Acid
aaucuucucugaugaggccguuaggccgaaaugaugag

SEQ ID NO: 11793 - RNA, 38 nt, Artificial Sequence
  Description of Artificial Sequence:  Enzymatic Nucleic Acid
cgguuuaccugaugaggccguuaggccgaaaucuucuu

SEQ ID NO: 11794 - RNA, 38 nt, Artificial Sequence
  Description of Artificial Sequence:  Enzymatic Nucleic Acid
ucccgguucugaugaggccguuaggccgaaacaaucuu

SEQ ID NO: 11795 - RNA, 38 nt, Artificial Sequence
  Description of Artificial Sequence:  Enzymatic Nucleic Acid
ucccaggacugaugaggccguuaggccgaaaggguuuc

SEQ ID NO: 11796 - RNA, 38 nt, Artificial Sequence
  Description of Artificial Sequence:  Enzymatic Nucleic Acid
gucccaggcugaugaggccguuaggccgaaaaggguuu

SEQ ID NO: 11797 - RNA, 38 nt, Artificial Sequence
  Description of Artificial Sequence:  Enzymatic Nucleic Acid
agucccagcugaugaggccguuaggccgaaaaaggguu

SEQ ID NO: 11798 - RNA, 38 nt, Artificial Sequence
  Description of Artificial Sequence:  Enzymatic Nucleic Acid
ugcucaaacugaugaggccguuaggccgaaacaucuuc

SEQ ID NO: 11799 - RNA, 38 nt, Artificial Sequence
  Description of Artificial Sequence:  Enzymatic Nucleic Acid
gugcucaacugaugaggccguuaggccgaaaacaucuu

SEQ ID NO: 11800 - RNA, 38 nt, Artificial Sequence
  Description of Artificial Sequence:  Enzymatic Nucleic Acid
ggugcucacugaugaggccguuaggccgaaaaacaucu

SEQ ID NO: 11801 - RNA, 38 nt, Artificial Sequence
  Description of Artificial Sequence:  Enzymatic Nucleic Acid
aggugcuccugaugaggccguuaggccgaaaaaacauc

SEQ ID NO: 11802 - RNA, 38 nt, Artificial Sequence
  Description of Artificial Sequence:  Enzymatic Nucleic Acid
cuauuguccugaugaggccguuaggccgaaaggugcuc

SEQ ID NO: 11803 - RNA, 38 nt, Artificial Sequence
  Description of Artificial Sequence:  Enzymatic Nucleic Acid
acacuuuccugaugaggccguuaggccgaaauugucaa

SEQ ID NO: 11804 - RNA, 38 nt, Artificial Sequence
  Description of Artificial Sequence:  Enzymatic Nucleic Acid
cacaggugcugaugaggccguuaggccgaaauuccccu

SEQ ID NO: 11805 - RNA, 38 nt, Artificial Sequence
  Description of Artificial Sequence:  Enzymatic Nucleic Acid
cuggacgccugaugaggccguuaggccgaaacacaggu

SEQ ID NO: 11806 - RNA, 38 nt, Artificial Sequence
  Description of Artificial Sequence:  Enzymatic Nucleic Acid
guccacugcugaugaggccguuaggccgaaacgcuaca

SEQ ID NO: 11807 - RNA, 38 nt, Artificial Sequence
  Description of Artificial Sequence:  Enzymatic Nucleic Acid
uuucucuucugaugaggccguuaggccgaaaucauccg

SEQ ID NO: 11808 - RNA, 38 nt, Artificial Sequence
  Description of Artificial Sequence:  Enzymatic Nucleic Acid
aaauguuccugaugaggccguuaggccgaaauuucucu

SEQ ID NO: 11809 - RNA, 38 nt, Artificial Sequence
  Description of Artificial Sequence:  Enzymatic Nucleic Acid
cucggacacugaugaggccguuaggccgaaauguucua

SEQ ID NO: 11810 - RNA, 38 nt, Artificial Sequence
  Description of Artificial Sequence:  Enzymatic Nucleic Acid
acucggaccugaugaggccguuaggccgaaaauguucu

SEQ ID NO: 11811 - RNA, 38 nt, Artificial Sequence
  Description of Artificial Sequence:  Enzymatic Nucleic Acid
ugaacucgcugaugaggccguuaggccgaaacaaaugu

SEQ ID NO: 11812 - RNA, 38 nt, Artificial Sequence
  Description of Artificial Sequence:  Enzymatic Nucleic Acid
uuugugugcugaugaggccguuaggccgaaacucggac

SEQ ID NO: 11813 - RNA, 38 nt, Artificial Sequence
  Description of Artificial Sequence:  Enzymatic Nucleic Acid
cuuugugucugaugaggccguuaggccgaaaacucgga

SEQ ID NO: 11814 - RNA, 38 nt, Artificial Sequence
  Description of Artificial Sequence:  Enzymatic Nucleic Acid
agcaauaacugaugaggccguuaggccgaaaggcuuug

SEQ ID NO: 11815 - RNA, 38 nt, Artificial Sequence
  Description of Artificial Sequence:  Enzymatic Nucleic Acid
aagcaauacugaugaggccguuaggccgaaaaggcuuu

SEQ ID NO: 11816 - RNA, 38 nt, Artificial Sequence
  Description of Artificial Sequence:  Enzymatic Nucleic Acid
aaagcaaucugaugaggccguuaggccgaaaaaggcuu

SEQ ID NO: 11817 - RNA, 38 nt, Artificial Sequence
  Description of Artificial Sequence:  Enzymatic Nucleic Acid
gaaagcaacugaugaggccguuaggccgaaaaaaggcu

SEQ ID NO: 11818 - RNA, 38 nt, Artificial Sequence
  Description of Artificial Sequence:  Enzymatic Nucleic Acid
ccgaaagccugaugaggccguuaggccgaaauaaaagg

SEQ ID NO: 11819 - RNA, 38 nt, Artificial Sequence
  Description of Artificial Sequence:  Enzymatic Nucleic Acid
acuaccgacugaugaggccguuaggccgaaagcaauaa

SEQ ID NO: 11820 - RNA, 38 nt, Artificial Sequence
  Description of Artificial Sequence:  Enzymatic Nucleic Acid
cacuaccgcugaugaggccguuaggccgaaaagcaaua

SEQ ID NO: 11821 - RNA, 38 nt, Artificial Sequence
  Description of Artificial Sequence:  Enzymatic Nucleic Acid
ccacuacccugaugaggccguuaggccgaaaaagcaau

SEQ ID NO: 11822 - RNA, 38 nt, Artificial Sequence
  Description of Artificial Sequence:  Enzymatic Nucleic Acid
caucccaccugaugaggccguuaggccgaaaccgaaag

SEQ ID NO: 11823 - RNA, 38 nt, Artificial Sequence
  Description of Artificial Sequence:  Enzymatic Nucleic Acid
ccaccaaacugaugaggccguuaggccgaaauuucauc

SEQ ID NO: 11824 - RNA, 38 nt, Artificial Sequence
  Description of Artificial Sequence:  Enzymatic Nucleic Acid
uuccaccacugaugaggccguuaggccgaaagauuuca

SEQ ID NO: 11825 - RNA, 38 nt, Artificial Sequence
  Description of Artificial Sequence:  Enzymatic Nucleic Acid
cuuccacccugaugaggccguuaggccgaaaagauuuc

SEQ ID NO: 11826 - RNA, 38 nt, Artificial Sequence
  Description of Artificial Sequence:  Enzymatic Nucleic Acid
ucggacuucugaugaggccguuaggccgaaacugccca

SEQ ID NO: 11827 - RNA, 38 nt, Artificial Sequence
  Description of Artificial Sequence:  Enzymatic Nucleic Acid
gggauucgcugaugaggccguuaggccgaaacuugacu

SEQ ID NO: 11828 - RNA, 38 nt, Artificial Sequence
  Description of Artificial Sequence:  Enzymatic Nucleic Acid
uucacaggcugaugaggccguuaggccgaaauucggac

SEQ ID NO: 11829 - RNA, 38 nt, Artificial Sequence
  Description of Artificial Sequence:  Enzymatic Nucleic Acid
aacugagacugaugaggccguuaggccgaaacuucaca

SEQ ID NO: 11830 - RNA, 38 nt, Artificial Sequence
  Description of Artificial Sequence:  Enzymatic Nucleic Acid
guaacugacugaugaggccguuaggccgaaauacuuca

SEQ ID NO: 11831 - RNA, 38 nt, Artificial Sequence
  Description of Artificial Sequence:  Enzymatic Nucleic Acid
ggguaacucugaugaggccguuaggccgaaagauacuu

SEQ ID NO: 11832 - RNA, 38 nt, Artificial Sequence
  Description of Artificial Sequence:  Enzymatic Nucleic Acid
agcugggucugaugaggccguuaggccgaaacugagau

SEQ ID NO: 11833 - RNA, 38 nt, Artificial Sequence
  Description of Artificial Sequence:  Enzymatic Nucleic Acid
gagcugggcugaugaggccguuaggccgaaaacugaga

SEQ ID NO: 11834 - RNA, 38 nt, Artificial Sequence
  Description of Artificial Sequence:  Enzymatic Nucleic Acid
gauaucagcugaugaggccguuaggccgaaagcugggu

SEQ ID NO: 11835 - RNA, 38 nt, Artificial Sequence
  Description of Artificial Sequence:  Enzymatic Nucleic Acid
ccauuugacugaugaggccguuaggccgaaaucaggag

SEQ ID NO: 11836 - RNA, 38 nt, Artificial Sequence
  Description of Artificial Sequence:  Enzymatic Nucleic Acid
uaccauuucugaugaggccguuaggccgaaauaucagg

SEQ ID NO: 11837 - RNA, 38 nt, Artificial Sequence
  Description of Artificial Sequence:  Enzymatic Nucleic Acid
cauuucugcugaugaggccguuaggccgaaaccauuug

SEQ ID NO: 11838 - RNA, 38 nt, Artificial Sequence
  Description of Artificial Sequence:  Enzymatic Nucleic Acid
uuggacuccugaugaggccguuaggccgaaaugggccu

SEQ ID NO: 11839 - RNA, 38 nt, Artificial Sequence
  Description of Artificial Sequence:  Enzymatic Nucleic Acid
uguaguugcugaugaggccguuaggccgaaacucaaug

SEQ ID NO: 11840 - RNA, 38 nt, Artificial Sequence
  Description of Artificial Sequence:  Enzymatic Nucleic Acid
ucauugugcugaugaggccguuaggccgaaaguuggac

SEQ ID NO: 11841 - RNA, 38 nt, Artificial Sequence
  Description of Artificial Sequence:  Enzymatic Nucleic Acid
ucgccaaccugaugaggccguuaggccgaaaucauugu

SEQ ID NO: 11842 - RNA, 38 nt, Artificial Sequence
  Description of Artificial Sequence:  Enzymatic Nucleic Acid
ucaucgcccugaugaggccguuaggccgaaacaaucau

SEQ ID NO: 11843 - RNA, 38 nt, Artificial Sequence
  Description of Artificial Sequence:  Enzymatic Nucleic Acid
augauggucugaugaggccguuaggccgaaaguucauc

SEQ ID NO: 11844 - RNA, 38 nt, Artificial Sequence
  Description of Artificial Sequence:  Enzymatic Nucleic Acid
acuuccaucugaugaggccguuaggccgaaauggugag

SEQ ID NO: 11845 - RNA, 38 nt, Artificial Sequence
  Description of Artificial Sequence:  Enzymatic Nucleic Acid
ugaccgugcugaugaggccguuaggccgaaaguuuccu

SEQ ID NO: 11846 - RNA, 38 nt, Artificial Sequence
  Description of Artificial Sequence:  Enzymatic Nucleic Acid
gugaggaucugaugaggccguuaggccgaaaccgugua

SEQ ID NO: 11847 - RNA, 38 nt, Artificial Sequence
  Description of Artificial Sequence:  Enzymatic Nucleic Acid
uuggugagcugaugaggccguuaggccgaaaugaccgu

SEQ ID NO: 11848 - RNA, 38 nt, Artificial Sequence
  Description of Artificial Sequence:  Enzymatic Nucleic Acid
ggguuggucugaugaggccguuaggccgaaaggaugac

SEQ ID NO: 11849 - RNA, 38 nt, Artificial Sequence
  Description of Artificial Sequence:  Enzymatic Nucleic Acid
uccauugacugaugaggccguuaggccgaaaugggguu

SEQ ID NO: 11850 - RNA, 38 nt, Artificial Sequence
  Description of Artificial Sequence:  Enzymatic Nucleic Acid
cuccauugcugaugaggccguuaggccgaaaauggggu

SEQ ID NO: 11851 - RNA, 38 nt, Artificial Sequence
  Description of Artificial Sequence:  Enzymatic Nucleic Acid
ucuccauucugaugaggccguuaggccgaaaaaugggg

SEQ ID NO: 11852 - RNA, 38 nt, Artificial Sequence
  Description of Artificial Sequence:  Enzymatic Nucleic Acid
accagagacugaugaggccguuaggccgaaaccaugug

SEQ ID NO: 11853 - RNA, 38 nt, Artificial Sequence
  Description of Artificial Sequence:  Enzymatic Nucleic Acid
caaccagacugaugaggccguuaggccgaaagaccaug

SEQ ID NO: 11854 - RNA, 38 nt, Artificial Sequence
  Description of Artificial Sequence:  Enzymatic Nucleic Acid
acauucaccugaugaggccguuaggccgaaaccagaga

SEQ ID NO: 11855 - RNA, 38 nt, Artificial Sequence
  Description of Artificial Sequence:  Enzymatic Nucleic Acid
ugggguggcugaugaggccguuaggccgaaacauucac

SEQ ID NO: 11856 - RNA, 38 nt, Artificial Sequence
  Description of Artificial Sequence:  Enzymatic Nucleic Acid
gcgagauccugaugaggccguuaggccgaaaggcuuuc

SEQ ID NO: 11857 - RNA, 38 nt, Artificial Sequence
  Description of Artificial Sequence:  Enzymatic Nucleic Acid
auaggcgacugaugaggccguuaggccgaaaucaaggc

SEQ ID NO: 11858 - RNA, 38 nt, Artificial Sequence
  Description of Artificial Sequence:  Enzymatic Nucleic Acid
ccauaggccugaugaggccguuaggccgaaagaucaag

SEQ ID NO: 11859 - RNA, 38 nt, Artificial Sequence
  Description of Artificial Sequence:  Enzymatic Nucleic Acid
ggaauccacugaugaggccguuaggccgaaaggcgaga

SEQ ID NO: 11860 - RNA, 38 nt, Artificial Sequence
  Description of Artificial Sequence:  Enzymatic Nucleic Acid
cugguaggcugaugaggccguuaggccgaaauccauag

SEQ ID NO: 11861 - RNA, 38 nt, Artificial Sequence
  Description of Artificial Sequence:  Enzymatic Nucleic Acid
acugguagcugaugaggccguuaggccgaaaauccaua

SEQ ID NO: 11862 - RNA, 38 nt, Artificial Sequence
  Description of Artificial Sequence:  Enzymatic Nucleic Acid
cauacuggcugaugaggccguuaggccgaaaggaaucc

SEQ ID NO: 11863 - RNA, 38 nt, Artificial Sequence
  Description of Artificial Sequence:  Enzymatic Nucleic Acid
uggucccacugaugaggccguuaggccgaaacugguag

SEQ ID NO: 11864 - RNA, 38 nt, Artificial Sequence
  Description of Artificial Sequence:  Enzymatic Nucleic Acid
ugcauguccugaugaggccguuaggccgaaaugucugc

SEQ ID NO: 11865 - RNA, 38 nt, Artificial Sequence
  Description of Artificial Sequence:  Enzymatic Nucleic Acid
uuggcguacugaugaggccguuaggccgaaacugugca

SEQ ID NO: 11866 - RNA, 38 nt, Artificial Sequence
  Description of Artificial Sequence:  Enzymatic Nucleic Acid
gguuggcgcugaugaggccguuaggccgaaagacugug

SEQ ID NO: 11867 - RNA, 38 nt, Artificial Sequence
  Description of Artificial Sequence:  Enzymatic Nucleic Acid
gugcagggcugaugaggccguuaggccgaaaggguugg

SEQ ID NO: 11868 - RNA, 38 nt, Artificial Sequence
  Description of Artificial Sequence:  Enzymatic Nucleic Acid
uaccacugcugaugaggccguuaggccgaaauguggug

SEQ ID NO: 11869 - RNA, 38 nt, Artificial Sequence
  Description of Artificial Sequence:  Enzymatic Nucleic Acid
gcugccagcugaugaggccguuaggccgaaaccacugg

SEQ ID NO: 11870 - RNA, 38 nt, Artificial Sequence
  Description of Artificial Sequence:  Enzymatic Nucleic Acid
gcuucuuccugaugaggccguuaggccgaaagcugcca

SEQ ID NO: 11871 - RNA, 38 nt, Artificial Sequence
  Description of Artificial Sequence:  Enzymatic Nucleic Acid
gucuguagcugaugaggccguuaggccgaaagcaggcu

SEQ ID NO: 11872 - RNA, 38 nt, Artificial Sequence
  Description of Artificial Sequence:  Enzymatic Nucleic Acid
cgggucugcugaugaggccguuaggccgaaaggagcag

SEQ ID NO: 11873 - RNA, 38 nt, Artificial Sequence
  Description of Artificial Sequence:  Enzymatic Nucleic Acid
uacaagcacugaugaggccguuaggccgaaacgggcuu

SEQ ID NO: 11874 - RNA, 38 nt, Artificial Sequence
  Description of Artificial Sequence:  Enzymatic Nucleic Acid
uucuuuaccugaugaggccguuaggccgaaagcauacg

SEQ ID NO: 11875 - RNA, 38 nt, Artificial Sequence
  Description of Artificial Sequence:  Enzymatic Nucleic Acid
ccauucuucugaugaggccguuaggccgaaacaagcau

SEQ ID NO: 11876 - RNA, 38 nt, Artificial Sequence
  Description of Artificial Sequence:  Enzymatic Nucleic Acid
ccccuggacugaugaggccguuaggccgaaauccucca

SEQ ID NO: 11877 - RNA, 38 nt, Artificial Sequence
  Description of Artificial Sequence:  Enzymatic Nucleic Acid
cccccuggcugaugaggccguuaggccgaaaauccucc

SEQ ID NO: 11878 - RNA, 38 nt, Artificial Sequence
  Description of Artificial Sequence:  Enzymatic Nucleic Acid
ccccccugcugaugaggccguuaggccgaaaaauccuc

SEQ ID NO: 11879 - RNA, 38 nt, Artificial Sequence
  Description of Artificial Sequence:  Enzymatic Nucleic Acid
gugacuuccugaugaggccguuaggccgaaaucuuguu

SEQ ID NO: 11880 - RNA, 38 nt, Artificial Sequence
  Description of Artificial Sequence:  Enzymatic Nucleic Acid
uuuuuggucugaugaggccguuaggccgaaacuucgau

SEQ ID NO: 11881 - RNA, 38 nt, Artificial Sequence
  Description of Artificial Sequence:  Enzymatic Nucleic Acid
ucagggcacugaugaggccguuaggccgaaauugguuu

SEQ ID NO: 11882 - RNA, 38 nt, Artificial Sequence
  Description of Artificial Sequence:  Enzymatic Nucleic Acid
uuuccuuccugaugaggccguuaggccgaaaucagggc

SEQ ID NO: 11883 - RNA, 38 nt, Artificial Sequence
  Description of Artificial Sequence:  Enzymatic Nucleic Acid
agcguacucugaugaggccguuaggccgaaacaguuuu

SEQ ID NO: 11884 - RNA, 38 nt, Artificial Sequence
  Description of Artificial Sequence:  Enzymatic Nucleic Acid
gaccagcgcugaugaggccguuaggccgaaacuuacag

SEQ ID NO: 11885 - RNA, 38 nt, Artificial Sequence
  Description of Artificial Sequence:  Enzymatic Nucleic Acid
gcuuggaucugaugaggccguuaggccgaaaccagcgu

SEQ ID NO: 11886 - RNA, 38 nt, Artificial Sequence
  Description of Artificial Sequence:  Enzymatic Nucleic Acid
gcagcuugcugaugaggccguuaggccgaaaugaccag

SEQ ID NO: 11887 - RNA, 38 nt, Artificial Sequence
  Description of Artificial Sequence:  Enzymatic Nucleic Acid
acaacgcucugaugaggccguuaggccgaaacacguug

SEQ ID NO: 11888 - RNA, 38 nt, Artificial Sequence
  Description of Artificial Sequence:  Enzymatic Nucleic Acid
auuuguaccugaugaggccguuaggccgaaacgcugac

SEQ ID NO: 11889 - RNA, 38 nt, Artificial Sequence
  Description of Artificial Sequence:  Enzymatic Nucleic Acid
cacauuugcugaugaggccguuaggccgaaacaacgcu

SEQ ID NO: 11890 - RNA, 38 nt, Artificial Sequence
  Description of Artificial Sequence:  Enzymatic Nucleic Acid
gcuuuguucugaugaggccguuaggccgaaauggcuuc

SEQ ID NO: 11891 - RNA, 38 nt, Artificial Sequence
  Description of Artificial Sequence:  Enzymatic Nucleic Acid
aaggagaucugaugaggccguuaggccgaaacccucuc

SEQ ID NO: 11892 - RNA, 38 nt, Artificial Sequence
  Description of Artificial Sequence:  Enzymatic Nucleic Acid
uggaaggacugaugaggccguuaggccgaaaugacccu

SEQ ID NO: 11893 - RNA, 38 nt, Artificial Sequence
  Description of Artificial Sequence:  Enzymatic Nucleic Acid
cauggaagcugaugaggccguuaggccgaaagaugacc

SEQ ID NO: 11894 - RNA, 38 nt, Artificial Sequence
  Description of Artificial Sequence:  Enzymatic Nucleic Acid
ucacauggcugaugaggccguuaggccgaaaggagaug

SEQ ID NO: 11895 - RNA, 38 nt, Artificial Sequence
  Description of Artificial Sequence:  Enzymatic Nucleic Acid
aucacaugcugaugaggccguuaggccgaaaaggagau

SEQ ID NO: 11896 - RNA, 38 nt, Artificial Sequence
  Description of Artificial Sequence:  Enzymatic Nucleic Acid
ggaccccucugaugaggccguuaggccgaaaucacaug

SEQ ID NO: 11897 - RNA, 38 nt, Artificial Sequence
  Description of Artificial Sequence:  Enzymatic Nucleic Acid
aauuucagcugaugaggccguuaggccgaaaccccuga

SEQ ID NO: 11898 - RNA, 38 nt, Artificial Sequence
  Description of Artificial Sequence:  Enzymatic Nucleic Acid
ugcacagucugaugaggccguuaggccgaaauuucagg

SEQ ID NO: 11899 - RNA, 38 nt, Artificial Sequence
  Description of Artificial Sequence:  Enzymatic Nucleic Acid
uugcacagcugaugaggccguuaggccgaaaauuucag

SEQ ID NO: 11900 - RNA, 38 nt, Artificial Sequence
  Description of Artificial Sequence:  Enzymatic Nucleic Acid
acaacaggcugaugaggccguuaggccgaaacacacuc

SEQ ID NO: 11901 - RNA, 38 nt, Artificial Sequence
  Description of Artificial Sequence:  Enzymatic Nucleic Acid
cagugcaccugaugaggccguuaggccgaaacagggac

SEQ ID NO: 11902 - RNA, 38 nt, Artificial Sequence
  Description of Artificial Sequence:  Enzymatic Nucleic Acid
cucaaacgcugaugaggccguuaggccgaaauuucugu

SEQ ID NO: 11903 - RNA, 38 nt, Artificial Sequence
  Description of Artificial Sequence:  Enzymatic Nucleic Acid
gguucucacugaugaggccguuaggccgaaacguauuu

SEQ ID NO: 11904 - RNA, 38 nt, Artificial Sequence
  Description of Artificial Sequence:  Enzymatic Nucleic Acid
agguucuccugaugaggccguuaggccgaaaacguauu

SEQ ID NO: 11905 - RNA, 38 nt, Artificial Sequence
  Description of Artificial Sequence:  Enzymatic Nucleic Acid
uaccacgucugaugaggccguuaggccgaaagguucuc

SEQ ID NO: 11906 - RNA, 38 nt, Artificial Sequence
  Description of Artificial Sequence:  Enzymatic Nucleic Acid
caagcuugcugaugaggccguuaggccgaaaccacgug

SEQ ID NO: 11907 - RNA, 38 nt, Artificial Sequence
  Description of Artificial Sequence:  Enzymatic Nucleic Acid
ugugagcccugaugaggccguuaggccgaaagcuugua

SEQ ID NO: 11908 - RNA, 38 nt, Artificial Sequence
  Description of Artificial Sequence:  Enzymatic Nucleic Acid
uugccugucugaugaggccguuaggccgaaagccaagc

SEQ ID NO: 11909 - RNA, 38 nt, Artificial Sequence
  Description of Artificial Sequence:  Enzymatic Nucleic Acid
uguggacccugaugaggccguuaggccgaaauguugcc

SEQ ID NO: 11910 - RNA, 38 nt, Artificial Sequence
  Description of Artificial Sequence:  Enzymatic Nucleic Acid
cccaugugcugaugaggccguuaggccgaaaccgaugu

SEQ ID NO: 11911 - RNA, 38 nt, Artificial Sequence
  Description of Artificial Sequence:  Enzymatic Nucleic Acid
gugugagucugaugaggccguuaggccgaaauucgccc

SEQ ID NO: 11912 - RNA, 38 nt, Artificial Sequence
  Description of Artificial Sequence:  Enzymatic Nucleic Acid
acuggugucugaugaggccguuaggccgaaagugauuc

SEQ ID NO: 11913 - RNA, 38 nt, Artificial Sequence
  Description of Artificial Sequence:  Enzymatic Nucleic Acid
uucuugcacugaugaggccguuaggccgaaacuggugu

SEQ ID NO: 11914 - RNA, 38 nt, Artificial Sequence
  Description of Artificial Sequence:  Enzymatic Nucleic Acid
guucuugccugaugaggccguuaggccgaaaacuggug

SEQ ID NO: 11915 - RNA, 38 nt, Artificial Sequence
  Description of Artificial Sequence:  Enzymatic Nucleic Acid
gagcaucccugaugaggccguuaggccgaaaguucuug

SEQ ID NO: 11916 - RNA, 38 nt, Artificial Sequence
  Description of Artificial Sequence:  Enzymatic Nucleic Acid
uuuccaaacugaugaggccguuaggccgaaagcaucca

SEQ ID NO: 11917 - RNA, 38 nt, Artificial Sequence
  Description of Artificial Sequence:  Enzymatic Nucleic Acid
aguuuccacugaugaggccguuaggccgaaagagcauc

SEQ ID NO: 11918 - RNA, 38 nt, Artificial Sequence
  Description of Artificial Sequence:  Enzymatic Nucleic Acid
caguuucccugaugaggccguuaggccgaaaagagcau

SEQ ID NO: 11919 - RNA, 38 nt, Artificial Sequence
  Description of Artificial Sequence:  Enzymatic Nucleic Acid
uguuagaacugaugaggccguuaggccgaaacauggug

SEQ ID NO: 11920 - RNA, 38 nt, Artificial Sequence
  Description of Artificial Sequence:  Enzymatic Nucleic Acid
cuguuagacugaugaggccguuaggccgaaaacauggu

SEQ ID NO: 11921 - RNA, 38 nt, Artificial Sequence
  Description of Artificial Sequence:  Enzymatic Nucleic Acid
gcuguuagcugaugaggccguuaggccgaaaaacaugg

SEQ ID NO: 11922 - RNA, 38 nt, Artificial Sequence
  Description of Artificial Sequence:  Enzymatic Nucleic Acid
ugcuguuacugaugaggccguuaggccgaaaaaacaug

SEQ ID NO: 11923 - RNA, 38 nt, Artificial Sequence
  Description of Artificial Sequence:  Enzymatic Nucleic Acid
ugugcugucugaugaggccguuaggccgaaagaaaaca

SEQ ID NO: 11924 - RNA, 38 nt, Artificial Sequence
  Description of Artificial Sequence:  Enzymatic Nucleic Acid
acaaucaacugaugaggccguuaggccgaaaugucauu

SEQ ID NO: 11925 - RNA, 38 nt, Artificial Sequence
  Description of Artificial Sequence:  Enzymatic Nucleic Acid
ccacaauccugaugaggccguuaggccgaaagauguca

SEQ ID NO: 11926 - RNA, 38 nt, Artificial Sequence
  Description of Artificial Sequence:  Enzymatic Nucleic Acid
aaugccaccugaugaggccguuaggccgaaaucaagau

SEQ ID NO: 11927 - RNA, 38 nt, Artificial Sequence
  Description of Artificial Sequence:  Enzymatic Nucleic Acid
cauucugacugaugaggccguuaggccgaaaugccaca

SEQ ID NO: 11928 - RNA, 38 nt, Artificial Sequence
  Description of Artificial Sequence:  Enzymatic Nucleic Acid
gcauucugcugaugaggccguuaggccgaaaaugccac

SEQ ID NO: 11929 - RNA, 38 nt, Artificial Sequence
  Description of Artificial Sequence:  Enzymatic Nucleic Acid
ggcauucucugaugaggccguuaggccgaaaaaugcca

SEQ ID NO: 11930 - RNA, 38 nt, Artificial Sequence
  Description of Artificial Sequence:  Enzymatic Nucleic Acid
ccugcagacugaugaggccguuaggccgaaaggcauuc

SEQ ID NO: 11931 - RNA, 38 nt, Artificial Sequence
  Description of Artificial Sequence:  Enzymatic Nucleic Acid
guccugcacugaugaggccguuaggccgaaagaggcau

SEQ ID NO: 11932 - RNA, 38 nt, Artificial Sequence
  Description of Artificial Sequence:  Enzymatic Nucleic Acid
agcaaacacugaugaggccguuaggccgaaagucgccu

SEQ ID NO: 11933 - RNA, 38 nt, Artificial Sequence
  Description of Artificial Sequence:  Enzymatic Nucleic Acid
gcagagcacugaugaggccguuaggccgaaacauaguc

SEQ ID NO: 11934 - RNA, 38 nt, Artificial Sequence
  Description of Artificial Sequence:  Enzymatic Nucleic Acid
agcagagccugaugaggccguuaggccgaaaacauagu

SEQ ID NO: 11935 - RNA, 38 nt, Artificial Sequence
  Description of Artificial Sequence:  Enzymatic Nucleic Acid
cuugagcacugaugaggccguuaggccgaaagcaaaca

SEQ ID NO: 11936 - RNA, 38 nt, Artificial Sequence
  Description of Artificial Sequence:  Enzymatic Nucleic Acid
cuuaucuucugaugaggccguuaggccgaaagcagagc

SEQ ID NO: 11937 - RNA, 38 nt, Artificial Sequence
  Description of Artificial Sequence:  Enzymatic Nucleic Acid
ggucuucucugaugaggccguuaggccgaaaucuugag

SEQ ID NO: 11938 - RNA, 38 nt, Artificial Sequence
  Description of Artificial Sequence:  Enzymatic Nucleic Acid
gaccaggccugaugaggccguuaggccgaaaugucuuu

SEQ ID NO: 11939 - RNA, 38 nt, Artificial Sequence
  Description of Artificial Sequence:  Enzymatic Nucleic Acid
agcuguuucugaugaggccguuaggccgaaaccaggca

SEQ ID NO: 11940 - RNA, 38 nt, Artificial Sequence
  Description of Artificial Sequence:  Enzymatic Nucleic Acid
aggaugaucugaugaggccguuaggccgaaagcuguuu

SEQ ID NO: 11941 - RNA, 38 nt, Artificial Sequence
  Description of Artificial Sequence:  Enzymatic Nucleic Acid
ucuaggaucugaugaggccguuaggccgaaaugagcug

SEQ ID NO: 11942 - RNA, 38 nt, Artificial Sequence
  Description of Artificial Sequence:  Enzymatic Nucleic Acid
cgcucuagcugaugaggccguuaggccgaaaugaugag

SEQ ID NO: 11943 - RNA, 38 nt, Artificial Sequence
  Description of Artificial Sequence:  Enzymatic Nucleic Acid
augcgcuccugaugaggccguuaggccgaaaggaugau

SEQ ID NO: 11944 - RNA, 38 nt, Artificial Sequence
  Description of Artificial Sequence:  Enzymatic Nucleic Acid
uuuccggucugaugaggccguuaggccgaaaucauggg

SEQ ID NO: 11945 - RNA, 38 nt, Artificial Sequence
  Description of Artificial Sequence:  Enzymatic Nucleic Acid
auucuccacugaugaggccguuaggccgaaauuuccgg

SEQ ID NO: 11946 - RNA, 38 nt, Artificial Sequence
  Description of Artificial Sequence:  Enzymatic Nucleic Acid
uguugucucugaugaggccguuaggccgaaauucucca

SEQ ID NO: 11947 - RNA, 38 nt, Artificial Sequence
  Description of Artificial Sequence:  Enzymatic Nucleic Acid
gucucgcccugaugaggccguuaggccgaaaugguugu

SEQ ID NO: 11948 - RNA, 38 nt, Artificial Sequence
  Description of Artificial Sequence:  Enzymatic Nucleic Acid
gucacuuccugaugaggccguuaggccgaaauggucuc

SEQ ID NO: 11949 - RNA, 38 nt, Artificial Sequence
  Description of Artificial Sequence:  Enzymatic Nucleic Acid
ugcugggccugaugaggccguuaggccgaaagucacuu

SEQ ID NO: 11950 - RNA, 38 nt, Artificial Sequence
  Description of Artificial Sequence:  Enzymatic Nucleic Acid
gauuuccacugaugaggccguuaggccgaaaugcuggg

SEQ ID NO: 11951 - RNA, 38 nt, Artificial Sequence
  Description of Artificial Sequence:  Enzymatic Nucleic Acid
ugggguagcugaugaggccguuaggccgaaauuuccag

SEQ ID NO: 11952 - RNA, 38 nt, Artificial Sequence
  Description of Artificial Sequence:  Enzymatic Nucleic Acid
guguggggcugaugaggccguuaggccgaaaggauuuc

SEQ ID NO: 11953 - RNA, 38 nt, Artificial Sequence
  Description of Artificial Sequence:  Enzymatic Nucleic Acid
aaccaugucugaugaggccguuaggccgaaaugugugg

SEQ ID NO: 11954 - RNA, 38 nt, Artificial Sequence
  Description of Artificial Sequence:  Enzymatic Nucleic Acid
gaaccaugcugaugaggccguuaggccgaaaaugugug

SEQ ID NO: 11955 - RNA, 38 nt, Artificial Sequence
  Description of Artificial Sequence:  Enzymatic Nucleic Acid
ugucuuugcugaugaggccguuaggccgaaaccaugua

SEQ ID NO: 11956 - RNA, 38 nt, Artificial Sequence
  Description of Artificial Sequence:  Enzymatic Nucleic Acid
uugucuuucugaugaggccguuaggccgaaaaccaugu

SEQ ID NO: 11957 - RNA, 38 nt, Artificial Sequence
  Description of Artificial Sequence:  Enzymatic Nucleic Acid
gaaucuuccugaugaggccguuaggccgaaaccagggu

SEQ ID NO: 11958 - RNA, 38 nt, Artificial Sequence
  Description of Artificial Sequence:  Enzymatic Nucleic Acid
aaugccugcugaugaggccguuaggccgaaaucuucua

SEQ ID NO: 11959 - RNA, 38 nt, Artificial Sequence
  Description of Artificial Sequence:  Enzymatic Nucleic Acid
caaugccucugaugaggccguuaggccgaaaaucuucu

SEQ ID NO: 11960 - RNA, 38 nt, Artificial Sequence
  Description of Artificial Sequence:  Enzymatic Nucleic Acid
cucaguaccugaugaggccguuaggccgaaaugccuga

SEQ ID NO: 11961 - RNA, 38 nt, Artificial Sequence
  Description of Artificial Sequence:  Enzymatic Nucleic Acid
ucucucagcugaugaggccguuaggccgaaacaaugcc

SEQ ID NO: 11962 - RNA, 38 nt, Artificial Sequence
  Description of Artificial Sequence:  Enzymatic Nucleic Acid
ccugcggacugaugaggccguuaggccgaaagucaggu

SEQ ID NO: 11963 - RNA, 38 nt, Artificial Sequence
  Description of Artificial Sequence:  Enzymatic Nucleic Acid
acccugcgcugaugaggccguuaggccgaaauagucag

SEQ ID NO: 11964 - RNA, 38 nt, Artificial Sequence
  Description of Artificial Sequence:  Enzymatic Nucleic Acid
cagguguacugaugaggccguuaggccgaaaggccucc

SEQ ID NO: 11965 - RNA, 38 nt, Artificial Sequence
  Description of Artificial Sequence:  Enzymatic Nucleic Acid
cagccaagcugaugaggccguuaggccgaaacauugca

SEQ ID NO: 11966 - RNA, 38 nt, Artificial Sequence
  Description of Artificial Sequence:  Enzymatic Nucleic Acid
gcacagcccugaugaggccguuaggccgaaaggacauu

SEQ ID NO: 11967 - RNA, 38 nt, Artificial Sequence
  Description of Artificial Sequence:  Enzymatic Nucleic Acid
auuaugaacugaugaggccguuaggccgaaagcgucuc

SEQ ID NO: 11968 - RNA, 38 nt, Artificial Sequence
  Description of Artificial Sequence:  Enzymatic Nucleic Acid
cuauuaugcugaugaggccguuaggccgaaagagcguc

SEQ ID NO: 11969 - RNA, 38 nt, Artificial Sequence
  Description of Artificial Sequence:  Enzymatic Nucleic Acid
ucuauuaucugaugaggccguuaggccgaaaagagcgu

SEQ ID NO: 11970 - RNA, 38 nt, Artificial Sequence
  Description of Artificial Sequence:  Enzymatic Nucleic Acid
ccuucuaucugaugaggccguuaggccgaaaugaagag

SEQ ID NO: 11971 - RNA, 38 nt, Artificial Sequence
  Description of Artificial Sequence:  Enzymatic Nucleic Acid
ugacuucccugaugaggccguuaggccgaaaguugguc

SEQ ID NO: 11972 - RNA, 38 nt, Artificial Sequence
  Description of Artificial Sequence:  Enzymatic Nucleic Acid
aggauaaucugaugaggccguuaggccgaaacuuccaa

SEQ ID NO: 11973 - RNA, 38 nt, Artificial Sequence
  Description of Artificial Sequence:  Enzymatic Nucleic Acid
acgaggaucugaugaggccguuaggccgaaaugacuuc

SEQ ID NO: 11974 - RNA, 38 nt, Artificial Sequence
  Description of Artificial Sequence:  Enzymatic Nucleic Acid
gacgaggacugaugaggccguuaggccgaaaaugacuu

SEQ ID NO: 11975 - RNA, 38 nt, Artificial Sequence
  Description of Artificial Sequence:  Enzymatic Nucleic Acid
ccgacgagcugaugaggccguuaggccgaaauaaugac

SEQ ID NO: 11976 - RNA, 38 nt, Artificial Sequence
  Description of Artificial Sequence:  Enzymatic Nucleic Acid
gugccgaccugaugaggccguuaggccgaaaggauaau

SEQ ID NO: 11977 - RNA, 38 nt, Artificial Sequence
  Description of Artificial Sequence:  Enzymatic Nucleic Acid
gcagugcccugaugaggccguuaggccgaaacgaggau

SEQ ID NO: 11978 - RNA, 38 nt, Artificial Sequence
  Description of Artificial Sequence:  Enzymatic Nucleic Acid
aacauggccugaugaggccguuaggccgaaaucacugc

SEQ ID NO: 11979 - RNA, 38 nt, Artificial Sequence
  Description of Artificial Sequence:  Enzymatic Nucleic Acid
ggagccagcugaugaggccguuaggccgaaagaacaug

SEQ ID NO: 11980 - RNA, 38 nt, Artificial Sequence
  Description of Artificial Sequence:  Enzymatic Nucleic Acid
aggagccacugaugaggccguuaggccgaaaagaacau

SEQ ID NO: 11981 - RNA, 38 nt, Artificial Sequence
  Description of Artificial Sequence:  Enzymatic Nucleic Acid
augacaagcugaugaggccguuaggccgaaaggagcca

SEQ ID NO: 11982 - RNA, 38 nt, Artificial Sequence
  Description of Artificial Sequence:  Enzymatic Nucleic Acid
aaugacaacugaugaggccguuaggccgaaaaggagcc

SEQ ID NO: 11983 - RNA, 38 nt, Artificial Sequence
  Description of Artificial Sequence:  Enzymatic Nucleic Acid
acaaugaccugaugaggccguuaggccgaaagaaggag

SEQ ID NO: 11984 - RNA, 38 nt, Artificial Sequence
  Description of Artificial Sequence:  Enzymatic Nucleic Acid
aggacaaucugaugaggccguuaggccgaaacaagaag

SEQ ID NO: 11985 - RNA, 38 nt, Artificial Sequence
  Description of Artificial Sequence:  Enzymatic Nucleic Acid
cguaggaccugaugaggccguuaggccgaaaugacaag

SEQ ID NO: 11986 - RNA, 38 nt, Artificial Sequence
  Description of Artificial Sequence:  Enzymatic Nucleic Acid
guccguagcugaugaggccguuaggccgaaacaaugac

SEQ ID NO: 11987 - RNA, 38 nt, Artificial Sequence
  Description of Artificial Sequence:  Enzymatic Nucleic Acid
acgguccgcugaugaggccguuaggccgaaaggacaau

SEQ ID NO: 11988 - RNA, 38 nt, Artificial Sequence
  Description of Artificial Sequence:  Enzymatic Nucleic Acid
gcccgcuucugaugaggccguuaggccgaaacgguccg

SEQ ID NO: 11989 - RNA, 38 nt, Artificial Sequence
  Description of Artificial Sequence:  Enzymatic Nucleic Acid
uagacaagcugaugaggccguuaggccgaaagccuguc

SEQ ID NO: 11990 - RNA, 38 nt, Artificial Sequence
  Description of Artificial Sequence:  Enzymatic Nucleic Acid
caauagaccugaugaggccguuaggccgaaaguagccu

SEQ ID NO: 11991 - RNA, 38 nt, Artificial Sequence
  Description of Artificial Sequence:  Enzymatic Nucleic Acid
ugacaauacugaugaggccguuaggccgaaacaaguag

SEQ ID NO: 11992 - RNA, 38 nt, Artificial Sequence
  Description of Artificial Sequence:  Enzymatic Nucleic Acid
caugacaacugaugaggccguuaggccgaaagacaagu

SEQ ID NO: 11993 - RNA, 38 nt, Artificial Sequence
  Description of Artificial Sequence:  Enzymatic Nucleic Acid
uccaugaccugaugaggccguuaggccgaaauagacaa

SEQ ID NO: 11994 - RNA, 38 nt, Artificial Sequence
  Description of Artificial Sequence:  Enzymatic Nucleic Acid
ggauccaucugaugaggccguuaggccgaaacaauaga

SEQ ID NO: 11995 - RNA, 38 nt, Artificial Sequence
  Description of Artificial Sequence:  Enzymatic Nucleic Acid
ccaagggccugaugaggccguuaggccgaaauucaucu

SEQ ID NO: 11996 - RNA, 38 nt, Artificial Sequence
  Description of Artificial Sequence:  Enzymatic Nucleic Acid
gcucaucccugaugaggccguuaggccgaaagggcaau

SEQ ID NO: 11997 - RNA, 38 nt, Artificial Sequence
  Description of Artificial Sequence:  Enzymatic Nucleic Acid
cauaaggccugaugaggccguuaggccgaaagcguuca

SEQ ID NO: 11998 - RNA, 38 nt, Artificial Sequence
  Description of Artificial Sequence:  Enzymatic Nucleic Acid
ggcaucaucugaugaggccguuaggccgaaaggcaagc

SEQ ID NO: 11999 - RNA, 38 nt, Artificial Sequence
  Description of Artificial Sequence:  Enzymatic Nucleic Acid
uggcaucacugaugaggccguuaggccgaaaaggcaag

SEQ ID NO: 12000 - RNA, 38 nt, Artificial Sequence
  Description of Artificial Sequence:  Enzymatic Nucleic Acid
cccuggggcugaugaggccguuaggccgaaauucccac

SEQ ID NO: 12001 - RNA, 38 nt, Artificial Sequence
  Description of Artificial Sequence:  Enzymatic Nucleic Acid
ucccugggcugaugaggccguuaggccgaaaauuccca

SEQ ID NO: 12002 - RNA, 38 nt, Artificial Sequence
  Description of Artificial Sequence:  Enzymatic Nucleic Acid
gguuuucccugaugaggccguuaggccgaaaguuucag

SEQ ID NO: 12003 - RNA, 38 nt, Artificial Sequence
  Description of Artificial Sequence:  Enzymatic Nucleic Acid
gcggccaacugaugaggccguuaggccgaaagguuuuc

SEQ ID NO: 12004 - RNA, 38 nt, Artificial Sequence
  Description of Artificial Sequence:  Enzymatic Nucleic Acid
ccgcggcccugaugaggccguuaggccgaaagagguuu

SEQ ID NO: 12005 - RNA, 38 nt, Artificial Sequence
  Description of Artificial Sequence:  Enzymatic Nucleic Acid
cuuggccgcugaugaggccguuaggccgaaaggcaccg

SEQ ID NO: 12006 - RNA, 38 nt, Artificial Sequence
  Description of Artificial Sequence:  Enzymatic Nucleic Acid
acuuggcccugaugaggccguuaggccgaaaaggcacc

SEQ ID NO: 12007 - RNA, 38 nt, Artificial Sequence
  Description of Artificial Sequence:  Enzymatic Nucleic Acid
ucugccuccugaugaggccguuaggccgaaaucacuug

SEQ ID NO: 12008 - RNA, 38 nt, Artificial Sequence
  Description of Artificial Sequence:  Enzymatic Nucleic Acid
aauuccaacugaugaggccguuaggccgaaagcgucug

SEQ ID NO: 12009 - RNA, 38 nt, Artificial Sequence
  Description of Artificial Sequence:  Enzymatic Nucleic Acid
caauuccacugaugaggccguuaggccgaaaagcgucu

SEQ ID NO: 12010 - RNA, 38 nt, Artificial Sequence
  Description of Artificial Sequence:  Enzymatic Nucleic Acid
ucaauucccugaugaggccguuaggccgaaaaagcguc

SEQ ID NO: 12011 - RNA, 38 nt, Artificial Sequence
  Description of Artificial Sequence:  Enzymatic Nucleic Acid
uguuuugccugaugaggccguuaggccgaaagucgcug

SEQ ID NO: 12012 - RNA, 38 nt, Artificial Sequence
  Description of Artificial Sequence:  Enzymatic Nucleic Acid
uugacggccugaugaggccguuaggccgaaacuguuuu

SEQ ID NO: 12013 - RNA, 38 nt, Artificial Sequence
  Description of Artificial Sequence:  Enzymatic Nucleic Acid
aacaucuucugaugaggccguuaggccgaaacggcuac

SEQ ID NO: 12014 - RNA, 38 nt, Artificial Sequence
  Description of Artificial Sequence:  Enzymatic Nucleic Acid
cuucuuuccugaugaggccguuaggccgaaacaucuug

SEQ ID NO: 12015 - RNA, 38 nt, Artificial Sequence
  Description of Artificial Sequence:  Enzymatic Nucleic Acid
gagggcuccugaugaggccguuaggccgaaaugcucgc

SEQ ID NO: 12016 - RNA, 38 nt, Artificial Sequence
  Description of Artificial Sequence:  Enzymatic Nucleic Acid
ucagacaucugaugaggccguuaggccgaaagggcucg

SEQ ID NO: 12017 - RNA, 38 nt, Artificial Sequence
  Description of Artificial Sequence:  Enzymatic Nucleic Acid
ugaguucacugaugaggccguuaggccgaaacaugagg

SEQ ID NO: 12018 - RNA, 38 nt, Artificial Sequence
  Description of Artificial Sequence:  Enzymatic Nucleic Acid
uggaugagcugaugaggccguuaggccgaaaucuugag

SEQ ID NO: 12019 - RNA, 38 nt, Artificial Sequence
  Description of Artificial Sequence:  Enzymatic Nucleic Acid
auguggaucugaugaggccguuaggccgaaaggaucuu

SEQ ID NO: 12020 - RNA, 38 nt, Artificial Sequence
  Description of Artificial Sequence:  Enzymatic Nucleic Acid
ccaaugugcugaugaggccguuaggccgaaaugaggau

SEQ ID NO: 12021 - RNA, 38 nt, Artificial Sequence
  Description of Artificial Sequence:  Enzymatic Nucleic Acid
uggugacccugaugaggccguuaggccgaaauguggau

SEQ ID NO: 12022 - RNA, 38 nt, Artificial Sequence
  Description of Artificial Sequence:  Enzymatic Nucleic Acid
gagauggucugaugaggccguuaggccgaaaccaaugu

SEQ ID NO: 12023 - RNA, 38 nt, Artificial Sequence
  Description of Artificial Sequence:  Enzymatic Nucleic Acid
gcgccuagcugaugaggccguuaggccgaaagguucac

SEQ ID NO: 12024 - RNA, 38 nt, Artificial Sequence
  Description of Artificial Sequence:  Enzymatic Nucleic Acid
caggcgcccugaugaggccguuaggccgaaaggagguu

SEQ ID NO: 12025 - RNA, 38 nt, Artificial Sequence
  Description of Artificial Sequence:  Enzymatic Nucleic Acid
caccaugacugaugaggccguuaggccgaaaggcccuc

SEQ ID NO: 12026 - RNA, 38 nt, Artificial Sequence
  Description of Artificial Sequence:  Enzymatic Nucleic Acid
aucaccaucugaugaggccguuaggccgaaagaggccc

SEQ ID NO: 12027 - RNA, 38 nt, Artificial Sequence
  Description of Artificial Sequence:  Enzymatic Nucleic Acid
acuugcagcugaugaggccguuaggccgaaauuccaca

SEQ ID NO: 12028 - RNA, 38 nt, Artificial Sequence
  Description of Artificial Sequence:  Enzymatic Nucleic Acid
aacuugcacugaugaggccguuaggccgaaaauuccac

SEQ ID NO: 12029 - RNA, 38 nt, Artificial Sequence
  Description of Artificial Sequence:  Enzymatic Nucleic Acid
gguuuccacugaugaggccguuaggccgaaacuugcag

SEQ ID NO: 12030 - RNA, 38 nt, Artificial Sequence
  Description of Artificial Sequence:  Enzymatic Nucleic Acid
agguuucccugaugaggccguuaggccgaaaacuugca

SEQ ID NO: 12031 - RNA, 38 nt, Artificial Sequence
  Description of Artificial Sequence:  Enzymatic Nucleic Acid
uaaguugacugaugaggccguuaggccgaaagguuucc

SEQ ID NO: 12032 - RNA, 38 nt, Artificial Sequence
  Description of Artificial Sequence:  Enzymatic Nucleic Acid
aguaaguucugaugaggccguuaggccgaaauagguuu

SEQ ID NO: 12033 - RNA, 38 nt, Artificial Sequence
  Description of Artificial Sequence:  Enzymatic Nucleic Acid
ccguaagucugaugaggccguuaggccgaaaguugaua

SEQ ID NO: 12034 - RNA, 38 nt, Artificial Sequence
  Description of Artificial Sequence:  Enzymatic Nucleic Acid
cccguaagcugaugaggccguuaggccgaaaaguugau

SEQ ID NO: 12035 - RNA, 38 nt, Artificial Sequence
  Description of Artificial Sequence:  Enzymatic Nucleic Acid
ugccccgucugaugaggccguuaggccgaaaguaaguu

SEQ ID NO: 12036 - RNA, 38 nt, Artificial Sequence
  Description of Artificial Sequence:  Enzymatic Nucleic Acid
uugccccgcugaugaggccguuaggccgaaaaguaagu

SEQ ID NO: 12037 - RNA, 38 nt, Artificial Sequence
  Description of Artificial Sequence:  Enzymatic Nucleic Acid
agggaacacugaugaggccguuaggccgaaauucauuu

SEQ ID NO: 12038 - RNA, 38 nt, Artificial Sequence
  Description of Artificial Sequence:  Enzymatic Nucleic Acid
uagggaaccugaugaggccguuaggccgaaaauucauu

SEQ ID NO: 12039 - RNA, 38 nt, Artificial Sequence
  Description of Artificial Sequence:  Enzymatic Nucleic Acid
uuauagggcugaugaggccguuaggccgaaacaaauuc

SEQ ID NO: 12040 - RNA, 38 nt, Artificial Sequence
  Description of Artificial Sequence:  Enzymatic Nucleic Acid
cuuauaggcugaugaggccguuaggccgaaaacaaauu

SEQ ID NO: 12041 - RNA, 38 nt, Artificial Sequence
  Description of Artificial Sequence:  Enzymatic Nucleic Acid
ugcucuuacugaugaggccguuaggccgaaagggaaca

SEQ ID NO: 12042 - RNA, 38 nt, Artificial Sequence
  Description of Artificial Sequence:  Enzymatic Nucleic Acid
uuugcucucugaugaggccguuaggccgaaauagggaa

SEQ ID NO: 12043 - RNA, 38 nt, Artificial Sequence
  Description of Artificial Sequence:  Enzymatic Nucleic Acid
ccuggcggcugaugaggccguuaggccgaaagcgugcc

SEQ ID NO: 12044 - RNA, 38 nt, Artificial Sequence
  Description of Artificial Sequence:  Enzymatic Nucleic Acid
cccuggcgcugaugaggccguuaggccgaaaagcgugc

SEQ ID NO: 12045 - RNA, 38 nt, Artificial Sequence
  Description of Artificial Sequence:  Enzymatic Nucleic Acid
ccccaacgcugaugaggccguuaggccgaaaguccuug

SEQ ID NO: 12046 - RNA, 38 nt, Artificial Sequence
  Description of Artificial Sequence:  Enzymatic Nucleic Acid
agcucccccugaugaggccguuaggccgaaacguaguc

SEQ ID NO: 12047 - RNA, 38 nt, Artificial Sequence
  Description of Artificial Sequence:  Enzymatic Nucleic Acid
uccacggacugaugaggccguuaggccgaaagcucccc

SEQ ID NO: 12048 - RNA, 38 nt, Artificial Sequence
  Description of Artificial Sequence:  Enzymatic Nucleic Acid
gauccacgcugaugaggccguuaggccgaaagagcucc

SEQ ID NO: 12049 - RNA, 38 nt, Artificial Sequence
  Description of Artificial Sequence:  Enzymatic Nucleic Acid
ucuuuucacugaugaggccguuaggccgaaauccacgg

SEQ ID NO: 12050 - RNA, 38 nt, Artificial Sequence
  Description of Artificial Sequence:  Enzymatic Nucleic Acid
ugcugucccugaugaggccguuaggccgaaagcgucuu

SEQ ID NO: 12051 - RNA, 38 nt, Artificial Sequence
  Description of Artificial Sequence:  Enzymatic Nucleic Acid
cugcuggucugaugaggccguuaggccgaaaugcuguc

SEQ ID NO: 12052 - RNA, 38 nt, Artificial Sequence
  Description of Artificial Sequence:  Enzymatic Nucleic Acid
agcuggcacugaugaggccguuaggccgaaagcucugg

SEQ ID NO: 12053 - RNA, 38 nt, Artificial Sequence
  Description of Artificial Sequence:  Enzymatic Nucleic Acid
caaagccucugaugaggccguuaggccgaaagcuggca

SEQ ID NO: 12054 - RNA, 38 nt, Artificial Sequence
  Description of Artificial Sequence:  Enzymatic Nucleic Acid
ccucaacacugaugaggccguuaggccgaaagccugag

SEQ ID NO: 12055 - RNA, 38 nt, Artificial Sequence
  Description of Artificial Sequence:  Enzymatic Nucleic Acid
uccucaaccugaugaggccguuaggccgaaaagccuga

SEQ ID NO: 12056 - RNA, 38 nt, Artificial Sequence
  Description of Artificial Sequence:  Enzymatic Nucleic Acid
uucuccuccugaugaggccguuaggccgaaacaaagcc

SEQ ID NO: 12057 - RNA, 38 nt, Artificial Sequence
  Description of Artificial Sequence:  Enzymatic Nucleic Acid
cacugagccugaugaggccguuaggccgaaauuucucc

SEQ ID NO: 12058 - RNA, 38 nt, Artificial Sequence
  Description of Artificial Sequence:  Enzymatic Nucleic Acid
acaucacucugaugaggccguuaggccgaaagcgauuu

SEQ ID NO: 12059 - RNA, 38 nt, Artificial Sequence
  Description of Artificial Sequence:  Enzymatic Nucleic Acid
uucuucagcugaugaggccguuaggccgaaagcuucuu

SEQ ID NO: 12060 - RNA, 38 nt, Artificial Sequence
  Description of Artificial Sequence:  Enzymatic Nucleic Acid
guucuucacugaugaggccguuaggccgaaaagcuucu

SEQ ID NO: 12061 - RNA, 38 nt, Artificial Sequence
  Description of Artificial Sequence:  Enzymatic Nucleic Acid
aguccuugcugaugaggccguuaggccgaaacaguucu

SEQ ID NO: 12062 - RNA, 38 nt, Artificial Sequence
  Description of Artificial Sequence:  Enzymatic Nucleic Acid
aggucaggcugaugaggccguuaggccgaaaguccuug

SEQ ID NO: 12063 - RNA, 38 nt, Artificial Sequence
  Description of Artificial Sequence:  Enzymatic Nucleic Acid
uugaugcccugaugaggccguuaggccgaaagaacucc

SEQ ID NO: 12064 - RNA, 38 nt, Artificial Sequence
  Description of Artificial Sequence:  Enzymatic Nucleic Acid
acuuccuucugaugaggccguuaggccgaaaugccaag

SEQ ID NO: 12065 - RNA, 38 nt, Artificial Sequence
  Description of Artificial Sequence:  Enzymatic Nucleic Acid
ccuguggacugaugaggccguuaggccgaaacacuucc

SEQ ID NO: 12066 - RNA, 38 nt, Artificial Sequence
  Description of Artificial Sequence:  Enzymatic Nucleic Acid
gauaggagcugaugaggccguuaggccgaaauguuucg

SEQ ID NO: 12067 - RNA, 38 nt, Artificial Sequence
  Description of Artificial Sequence:  Enzymatic Nucleic Acid
cgauaggacugaugaggccguuaggccgaaaauguuuc

SEQ ID NO: 12068 - RNA, 38 nt, Artificial Sequence
  Description of Artificial Sequence:  Enzymatic Nucleic Acid
uccgauagcugaugaggccguuaggccgaaagaauguu

SEQ ID NO: 12069 - RNA, 38 nt, Artificial Sequence
  Description of Artificial Sequence:  Enzymatic Nucleic Acid
uucuccgacugaugaggccguuaggccgaaaggagaau

SEQ ID NO: 12070 - RNA, 38 nt, Artificial Sequence
  Description of Artificial Sequence:  Enzymatic Nucleic Acid
ucuucucccugaugaggccguuaggccgaaauaggaga

SEQ ID NO: 12071 - RNA, 38 nt, Artificial Sequence
  Description of Artificial Sequence:  Enzymatic Nucleic Acid
cagaucuucugaugaggccguuaggccgaaaccacauu

SEQ ID NO: 12072 - RNA, 38 nt, Artificial Sequence
  Description of Artificial Sequence:  Enzymatic Nucleic Acid
acagaucucugaugaggccguuaggccgaaaaccacau

SEQ ID NO: 12073 - RNA, 38 nt, Artificial Sequence
  Description of Artificial Sequence:  Enzymatic Nucleic Acid
aagucacacugaugaggccguuaggccgaaaucuuaac

SEQ ID NO: 12074 - RNA, 38 nt, Artificial Sequence
  Description of Artificial Sequence:  Enzymatic Nucleic Acid
ccaagccgcugaugaggccguuaggccgaaagucacag

SEQ ID NO: 12075 - RNA, 38 nt, Artificial Sequence
  Description of Artificial Sequence:  Enzymatic Nucleic Acid
cccgggcccugaugaggccguuaggccgaaagccgaag

SEQ ID NO: 12076 - RNA, 38 nt, Artificial Sequence
  Description of Artificial Sequence:  Enzymatic Nucleic Acid
ucuuuauacugaugaggccguuaggccgaaaugucccg

SEQ ID NO: 12077 - RNA, 38 nt, Artificial Sequence
  Description of Artificial Sequence:  Enzymatic Nucleic Acid
gucuuuaucugaugaggccguuaggccgaaaauguccc

SEQ ID NO: 12078 - RNA, 38 nt, Artificial Sequence
  Description of Artificial Sequence:  Enzymatic Nucleic Acid
ggucuuuacugaugaggccguuaggccgaaaaaugucc

SEQ ID NO: 12079 - RNA, 38 nt, Artificial Sequence
  Description of Artificial Sequence:  Enzymatic Nucleic Acid
cgggucuucugaugaggccguuaggccgaaauaaaugu

SEQ ID NO: 12080 - RNA, 38 nt, Artificial Sequence
  Description of Artificial Sequence:  Enzymatic Nucleic Acid
ucugacaucugaugaggccguuaggccgaaauccgggu

SEQ ID NO: 12081 - RNA, 38 nt, Artificial Sequence
  Description of Artificial Sequence:  Enzymatic Nucleic Acid
uucugacacugaugaggccguuaggccgaaaauccggg

SEQ ID NO: 12082 - RNA, 38 nt, Artificial Sequence
  Description of Artificial Sequence:  Enzymatic Nucleic Acid
uucaaaggcugaugaggccguuaggccgaaagucgggc

SEQ ID NO: 12083 - RNA, 38 nt, Artificial Sequence
  Description of Artificial Sequence:  Enzymatic Nucleic Acid
ccacuucacugaugaggccguuaggccgaaagggaguc

SEQ ID NO: 12084 - RNA, 38 nt, Artificial Sequence
  Description of Artificial Sequence:  Enzymatic Nucleic Acid
uccacuuccugaugaggccguuaggccgaaaagggagu

SEQ ID NO: 12085 - RNA, 38 nt, Artificial Sequence
  Description of Artificial Sequence:  Enzymatic Nucleic Acid
cugucaaacugaugaggccguuaggccgaaaugguuuc

SEQ ID NO: 12086 - RNA, 38 nt, Artificial Sequence
  Description of Artificial Sequence:  Enzymatic Nucleic Acid
ucugucaacugaugaggccguuaggccgaaaaugguuu

SEQ ID NO: 12087 - RNA, 38 nt, Artificial Sequence
  Description of Artificial Sequence:  Enzymatic Nucleic Acid
cucugucacugaugaggccguuaggccgaaaaaugguu

SEQ ID NO: 12088 - RNA, 38 nt, Artificial Sequence
  Description of Artificial Sequence:  Enzymatic Nucleic Acid
acucuguccugaugaggccguuaggccgaaaaaauggu

SEQ ID NO: 12089 - RNA, 38 nt, Artificial Sequence
  Description of Artificial Sequence:  Enzymatic Nucleic Acid
auuguguacugaugaggccguuaggccgaaacucuguc

SEQ ID NO: 12090 - RNA, 38 nt, Artificial Sequence
  Description of Artificial Sequence:  Enzymatic Nucleic Acid
gaauugugcugaugaggccguuaggccgaaauacucug

SEQ ID NO: 12091 - RNA, 38 nt, Artificial Sequence
  Description of Artificial Sequence:  Enzymatic Nucleic Acid
ucgcucugcugaugaggccguuaggccgaaauugugua

SEQ ID NO: 12092 - RNA, 38 nt, Artificial Sequence
  Description of Artificial Sequence:  Enzymatic Nucleic Acid
aucgcucucugaugaggccguuaggccgaaaauugugu

SEQ ID NO: 12093 - RNA, 38 nt, Artificial Sequence
  Description of Artificial Sequence:  Enzymatic Nucleic Acid
caccgaaacugaugaggccguuaggccgaaaccacaca

SEQ ID NO: 12094 - RNA, 38 nt, Artificial Sequence
  Description of Artificial Sequence:  Enzymatic Nucleic Acid
cacaccgacugaugaggccguuaggccgaaagaccaca

SEQ ID NO: 12095 - RNA, 38 nt, Artificial Sequence
  Description of Artificial Sequence:  Enzymatic Nucleic Acid
acacaccgcugaugaggccguuaggccgaaaagaccac

SEQ ID NO: 12096 - RNA, 38 nt, Artificial Sequence
  Description of Artificial Sequence:  Enzymatic Nucleic Acid
aacacacccugaugaggccguuaggccgaaaaagacca

SEQ ID NO: 12097 - RNA, 38 nt, Artificial Sequence
  Description of Artificial Sequence:  Enzymatic Nucleic Acid
cccagagccugaugaggccguuaggccgaaacacaccg

SEQ ID NO: 12098 - RNA, 38 nt, Artificial Sequence
  Description of Artificial Sequence:  Enzymatic Nucleic Acid
auuucccacugaugaggccguuaggccgaaagcaacac

SEQ ID NO: 12099 - RNA, 38 nt, Artificial Sequence
  Description of Artificial Sequence:  Enzymatic Nucleic Acid
aggcaccucugaugaggccguuaggccgaaaggaaaau

SEQ ID NO: 12100 - RNA, 38 nt, Artificial Sequence
  Description of Artificial Sequence:  Enzymatic Nucleic Acid
gaggcacccugaugaggccguuaggccgaaaaggaaaa

SEQ ID NO: 12101 - RNA, 38 nt, Artificial Sequence
  Description of Artificial Sequence:  Enzymatic Nucleic Acid
gguaugggcugaugaggccguuaggccgaaaggcaccu

SEQ ID NO: 12102 - RNA, 38 nt, Artificial Sequence
  Description of Artificial Sequence:  Enzymatic Nucleic Acid
ccccagggcugaugaggccguuaggccgaaauggggag

SEQ ID NO: 12103 - RNA, 38 nt, Artificial Sequence
  Description of Artificial Sequence:  Enzymatic Nucleic Acid
ucuucauccugaugaggccguuaggccgaaaucuugac

SEQ ID NO: 12104 - RNA, 38 nt, Artificial Sequence
  Description of Artificial Sequence:  Enzymatic Nucleic Acid
uccuacaacugaugaggccguuaggccgaaauucuuca

SEQ ID NO: 12105 - RNA, 38 nt, Artificial Sequence
  Description of Artificial Sequence:  Enzymatic Nucleic Acid
cuccuacacugaugaggccguuaggccgaaaauucuuc

SEQ ID NO: 12106 - RNA, 38 nt, Artificial Sequence
  Description of Artificial Sequence:  Enzymatic Nucleic Acid
ucuccuaccugaugaggccguuaggccgaaaaauucuu

SEQ ID NO: 12107 - RNA, 38 nt, Artificial Sequence
  Description of Artificial Sequence:  Enzymatic Nucleic Acid
caaucucccugaugaggccguuaggccgaaacaaaauu

SEQ ID NO: 12108 - RNA, 38 nt, Artificial Sequence
  Description of Artificial Sequence:  Enzymatic Nucleic Acid
cuucuuuccugaugaggccguuaggccgaaaucuccua

SEQ ID NO: 12109 - RNA, 38 nt, Artificial Sequence
  Description of Artificial Sequence:  Enzymatic Nucleic Acid
ccgcauuccugaugaggccguuaggccgaaaguuccuu

SEQ ID NO: 12110 - RNA, 38 nt, Artificial Sequence
  Description of Artificial Sequence:  Enzymatic Nucleic Acid
guagucagcugaugaggccguuaggccgaaagcccgca

SEQ ID NO: 12111 - RNA, 38 nt, Artificial Sequence
  Description of Artificial Sequence:  Enzymatic Nucleic Acid
ggguagugcugaugaggccguuaggccgaaagucagga

SEQ ID NO: 12112 - RNA, 38 nt, Artificial Sequence
  Description of Artificial Sequence:  Enzymatic Nucleic Acid
uucuggggcugaugaggccguuaggccgaaaguguagu

SEQ ID NO: 12113 - RNA, 38 nt, Artificial Sequence
  Description of Artificial Sequence:  Enzymatic Nucleic Acid
cugaaaaccugaugaggccguuaggccgaaagggucuc

SEQ ID NO: 12114 - RNA, 38 nt, Artificial Sequence
  Description of Artificial Sequence:  Enzymatic Nucleic Acid
acucugaacugaugaggccguuaggccgaaacgagggu

SEQ ID NO: 12115 - RNA, 38 nt, Artificial Sequence
  Description of Artificial Sequence:  Enzymatic Nucleic Acid
aacucugacugaugaggccguuaggccgaaaacgaggg

SEQ ID NO: 12116 - RNA, 38 nt, Artificial Sequence
  Description of Artificial Sequence:  Enzymatic Nucleic Acid
caacucugcugaugaggccguuaggccgaaaaacgagg

SEQ ID NO: 12117 - RNA, 38 nt, Artificial Sequence
  Description of Artificial Sequence:  Enzymatic Nucleic Acid
ccaacucucugaugaggccguuaggccgaaaaaacgag

SEQ ID NO: 12118 - RNA, 38 nt, Artificial Sequence
  Description of Artificial Sequence:  Enzymatic Nucleic Acid
gcuccacccugaugaggccguuaggccgaaacucugaa

SEQ ID NO: 12119 - RNA, 38 nt, Artificial Sequence
  Description of Artificial Sequence:  Enzymatic Nucleic Acid
guuucccacugaugaggccguuaggccgaaaugcucca

SEQ ID NO: 12120 - RNA, 38 nt, Artificial Sequence
  Description of Artificial Sequence:  Enzymatic Nucleic Acid
gguuuccccugaugaggccguuaggccgaaaaugcucc

SEQ ID NO: 12121 - RNA, 38 nt, Artificial Sequence
  Description of Artificial Sequence:  Enzymatic Nucleic Acid
gcuugcagcugaugaggccguuaggccgaaagguuucc

SEQ ID NO: 12122 - RNA, 38 nt, Artificial Sequence
  Description of Artificial Sequence:  Enzymatic Nucleic Acid
gaacaauacugaugaggccguuaggccgaaagucuuug

SEQ ID NO: 12123 - RNA, 38 nt, Artificial Sequence
  Description of Artificial Sequence:  Enzymatic Nucleic Acid
aagaacaacugaugaggccguuaggccgaaauagucuu

SEQ ID NO: 12124 - RNA, 38 nt, Artificial Sequence
  Description of Artificial Sequence:  Enzymatic Nucleic Acid
ggaagaaccugaugaggccguuaggccgaaauauaguc

SEQ ID NO: 12125 - RNA, 38 nt, Artificial Sequence
  Description of Artificial Sequence:  Enzymatic Nucleic Acid
auuggaagcugaugaggccguuaggccgaaacaauaua

SEQ ID NO: 12126 - RNA, 38 nt, Artificial Sequence
  Description of Artificial Sequence:  Enzymatic Nucleic Acid
cauuggaacugaugaggccguuaggccgaaaacaauau

SEQ ID NO: 12127 - RNA, 38 nt, Artificial Sequence
  Description of Artificial Sequence:  Enzymatic Nucleic Acid
gacauuggcugaugaggccguuaggccgaaagaacaau

SEQ ID NO: 12128 - RNA, 38 nt, Artificial Sequence
  Description of Artificial Sequence:  Enzymatic Nucleic Acid
ugacauugcugaugaggccguuaggccgaaaagaacaa

SEQ ID NO: 12129 - RNA, 38 nt, Artificial Sequence
  Description of Artificial Sequence:  Enzymatic Nucleic Acid
gugucucucugaugaggccguuaggccgaaacauugga

SEQ ID NO: 12130 - RNA, 38 nt, Artificial Sequence
  Description of Artificial Sequence:  Enzymatic Nucleic Acid
ggcagggacugaugaggccguuaggccgaaaguccaga

SEQ ID NO: 12131 - RNA, 38 nt, Artificial Sequence
  Description of Artificial Sequence:  Enzymatic Nucleic Acid
uaggcaggcugaugaggccguuaggccgaaagagucca

SEQ ID NO: 12132 - RNA, 38 nt, Artificial Sequence
  Description of Artificial Sequence:  Enzymatic Nucleic Acid
aggugaggcugaugaggccguuaggccgaaaggcaggg

SEQ ID NO: 12133 - RNA, 38 nt, Artificial Sequence
  Description of Artificial Sequence:  Enzymatic Nucleic Acid
uuccuccacugaugaggccguuaggccgaaacaggaaa

SEQ ID NO: 12134 - RNA, 38 nt, Artificial Sequence
  Description of Artificial Sequence:  Enzymatic Nucleic Acid
uaaugacucugaugaggccguuaggccgaaauuccugc

SEQ ID NO: 12135 - RNA, 38 nt, Artificial Sequence
  Description of Artificial Sequence:  Enzymatic Nucleic Acid
gagauaaucugaugaggccguuaggccgaaacugauuc

SEQ ID NO: 12136 - RNA, 38 nt, Artificial Sequence
  Description of Artificial Sequence:  Enzymatic Nucleic Acid
cuggagaucugaugaggccguuaggccgaaaugacuga

SEQ ID NO: 12137 - RNA, 38 nt, Artificial Sequence
  Description of Artificial Sequence:  Enzymatic Nucleic Acid
ucuggagacugaugaggccguuaggccgaaaaugacug

SEQ ID NO: 12138 - RNA, 38 nt, Artificial Sequence
  Description of Artificial Sequence:  Enzymatic Nucleic Acid
guucuggacugaugaggccguuaggccgaaauaaugac

SEQ ID NO: 12139 - RNA, 38 nt, Artificial Sequence
  Description of Artificial Sequence:  Enzymatic Nucleic Acid
cuguucugcugaugaggccguuaggccgaaagauaaug

SEQ ID NO: 12140 - RNA, 38 nt, Artificial Sequence
  Description of Artificial Sequence:  Enzymatic Nucleic Acid
caaugggacugaugaggccguuaggccgaaaucuucaa

SEQ ID NO: 12141 - RNA, 38 nt, Artificial Sequence
  Description of Artificial Sequence:  Enzymatic Nucleic Acid
uccaauggcugaugaggccguuaggccgaaauaucuuc

SEQ ID NO: 12142 - RNA, 38 nt, Artificial Sequence
  Description of Artificial Sequence:  Enzymatic Nucleic Acid
guuccucccugaugaggccguuaggccgaaaugggaua

SEQ ID NO: 12143 - RNA, 38 nt, Artificial Sequence
  Description of Artificial Sequence:  Enzymatic Nucleic Acid
aucacuuucugaugaggccguuaggccgaaacuucugg

SEQ ID NO: 12144 - RNA, 38 nt, Artificial Sequence
  Description of Artificial Sequence:  Enzymatic Nucleic Acid
ucaucuggcugaugaggccguuaggccgaaaucacuuu

SEQ ID NO: 12145 - RNA, 38 nt, Artificial Sequence
  Description of Artificial Sequence:  Enzymatic Nucleic Acid
gaugcaagcugaugaggccguuaggccgaaaccauccc

SEQ ID NO: 12146 - RNA, 38 nt, Artificial Sequence
  Description of Artificial Sequence:  Enzymatic Nucleic Acid
ucugaugccugaugaggccguuaggccgaaaggaccau

SEQ ID NO: 12147 - RNA, 38 nt, Artificial Sequence
  Description of Artificial Sequence:  Enzymatic Nucleic Acid
gcucuucucugaugaggccguuaggccgaaaugcaagg

SEQ ID NO: 12148 - RNA, 38 nt, Artificial Sequence
  Description of Artificial Sequence:  Enzymatic Nucleic Acid
auggagaucugaugaggccguuaggccgaaauuuguuc

SEQ ID NO: 12149 - RNA, 38 nt, Artificial Sequence
  Description of Artificial Sequence:  Enzymatic Nucleic Acid
gauggagacugaugaggccguuaggccgaaaauuuguu

SEQ ID NO: 12150 - RNA, 38 nt, Artificial Sequence
  Description of Artificial Sequence:  Enzymatic Nucleic Acid
ccugcuuucugaugaggccguuaggccgaaacugggca

SEQ ID NO: 12151 - RNA, 38 nt, Artificial Sequence
  Description of Artificial Sequence:  Enzymatic Nucleic Acid
aggccacacugaugaggccguuaggccgaaacucccug

SEQ ID NO: 12152 - RNA, 38 nt, Artificial Sequence
  Description of Artificial Sequence:  Enzymatic Nucleic Acid
agccuucccugaugaggccguuaggccgaaaggccaca

SEQ ID NO: 12153 - RNA, 38 nt, Artificial Sequence
  Description of Artificial Sequence:  Enzymatic Nucleic Acid
ucugguugcugaugaggccguuaggccgaaagccuucc

SEQ ID NO: 12154 - RNA, 38 nt, Artificial Sequence
  Description of Artificial Sequence:  Enzymatic Nucleic Acid
cagacuggcugaugaggccguuaggccgaaagccacug

SEQ ID NO: 12155 - RNA, 38 nt, Artificial Sequence
  Description of Artificial Sequence:  Enzymatic Nucleic Acid
gauacccacugaugaggccguuaggccgaaacugguag

SEQ ID NO: 12156 - RNA, 38 nt, Artificial Sequence
  Description of Artificial Sequence:  Enzymatic Nucleic Acid
cugagugacugaugaggccguuaggccgaaacccagac

SEQ ID NO: 12157 - RNA, 38 nt, Artificial Sequence
  Description of Artificial Sequence:  Enzymatic Nucleic Acid
aucugagucugaugaggccguuaggccgaaauacccag

SEQ ID NO: 12158 - RNA, 38 nt, Artificial Sequence
  Description of Artificial Sequence:  Enzymatic Nucleic Acid
ugucaucucugaugaggccguuaggccgaaagugauac

SEQ ID NO: 12159 - RNA, 38 nt, Artificial Sequence
  Description of Artificial Sequence:  Enzymatic Nucleic Acid
cgcuggagcugaugaggccguuaggccgaaacacggug

SEQ ID NO: 12160 - RNA, 38 nt, Artificial Sequence
  Description of Artificial Sequence:  Enzymatic Nucleic Acid
cgucgcugcugaugaggccguuaggccgaaaguacacg

SEQ ID NO: 12161 - RNA, 38 nt, Artificial Sequence
  Description of Artificial Sequence:  Enzymatic Nucleic Acid
aucuuuaacugaugaggccguuaggccgaaaguccugc

SEQ ID NO: 12162 - RNA, 38 nt, Artificial Sequence
  Description of Artificial Sequence:  Enzymatic Nucleic Acid
caucuuuacugaugaggccguuaggccgaaaaguccug

SEQ ID NO: 12163 - RNA, 38 nt, Artificial Sequence
  Description of Artificial Sequence:  Enzymatic Nucleic Acid
ccaucuuucugaugaggccguuaggccgaaaaaguccu

SEQ ID NO: 12164 - RNA, 38 nt, Artificial Sequence
  Description of Artificial Sequence:  Enzymatic Nucleic Acid
accaucuucugaugaggccguuaggccgaaaaaagucc

SEQ ID NO: 12165 - RNA, 38 nt, Artificial Sequence
  Description of Artificial Sequence:  Enzymatic Nucleic Acid
ucagcgugcugaugaggccguuaggccgaaacugcagc

SEQ ID NO: 12166 - RNA, 38 nt, Artificial Sequence
  Description of Artificial Sequence:  Enzymatic Nucleic Acid
gucagcgucugaugaggccguuaggccgaaaacugcag

SEQ ID NO: 12167 - RNA, 38 nt, Artificial Sequence
  Description of Artificial Sequence:  Enzymatic Nucleic Acid
uggucccucugaugaggccguuaggccgaaagucagcg

SEQ ID NO: 12168 - RNA, 38 nt, Artificial Sequence
  Description of Artificial Sequence:  Enzymatic Nucleic Acid
caggaggucugaugaggccguuaggccgaaagcugcag

SEQ ID NO: 12169 - RNA, 38 nt, Artificial Sequence
  Description of Artificial Sequence:  Enzymatic Nucleic Acid
uuaaacagcugaugaggccguuaggccgaaaggugagc

SEQ ID NO: 12170 - RNA, 38 nt, Artificial Sequence
  Description of Artificial Sequence:  Enzymatic Nucleic Acid
uccauuuacugaugaggccguuaggccgaaacaggagg

SEQ ID NO: 12171 - RNA, 38 nt, Artificial Sequence
  Description of Artificial Sequence:  Enzymatic Nucleic Acid
uuccauuucugaugaggccguuaggccgaaaacaggag

SEQ ID NO: 12172 - RNA, 38 nt, Artificial Sequence
  Description of Artificial Sequence:  Enzymatic Nucleic Acid
cuuccauucugaugaggccguuaggccgaaaaacagga

SEQ ID NO: 12173 - RNA, 38 nt, Artificial Sequence
  Description of Artificial Sequence:  Enzymatic Nucleic Acid
cgggacagcugaugaggccguuaggccgaaaccacuuc

SEQ ID NO: 12174 - RNA, 38 nt, Artificial Sequence
  Description of Artificial Sequence:  Enzymatic Nucleic Acid
ggagccggcugaugaggccguuaggccgaaacaggacc

SEQ ID NO: 12175 - RNA, 38 nt, Artificial Sequence
  Description of Artificial Sequence:  Enzymatic Nucleic Acid
ugggggcgcugaugaggccguuaggccgaaagccggga

SEQ ID NO: 12176 - RNA, 38 nt, Artificial Sequence
  Description of Artificial Sequence:  Enzymatic Nucleic Acid
auuuccagcugaugaggccguuaggccgaaaguugggg

SEQ ID NO: 12177 - RNA, 38 nt, Artificial Sequence
  Description of Artificial Sequence:  Enzymatic Nucleic Acid
ucucucgucugaugaggccguuaggccgaaauuuccag

SEQ ID NO: 12178 - RNA, 38 nt, Artificial Sequence
  Description of Artificial Sequence:  Enzymatic Nucleic Acid
gaaaaucucugaugaggccguuaggccgaaagcagcac

SEQ ID NO: 12179 - RNA, 38 nt, Artificial Sequence
  Description of Artificial Sequence:  Enzymatic Nucleic Acid
ugaaaauccugaugaggccguuaggccgaaaagcagca

SEQ ID NO: 12180 - RNA, 38 nt, Artificial Sequence
  Description of Artificial Sequence:  Enzymatic Nucleic Acid
cacuugaacugaugaggccguuaggccgaaaucuaagc

SEQ ID NO: 12181 - RNA, 38 nt, Artificial Sequence
  Description of Artificial Sequence:  Enzymatic Nucleic Acid
acacuugacugaugaggccguuaggccgaaaaucuaag

SEQ ID NO: 12182 - RNA, 38 nt, Artificial Sequence
  Description of Artificial Sequence:  Enzymatic Nucleic Acid
aacacuugcugaugaggccguuaggccgaaaaaucuaa

SEQ ID NO: 12183 - RNA, 38 nt, Artificial Sequence
  Description of Artificial Sequence:  Enzymatic Nucleic Acid
caacacuucugaugaggccguuaggccgaaaaaaucua

SEQ ID NO: 12184 - RNA, 38 nt, Artificial Sequence
  Description of Artificial Sequence:  Enzymatic Nucleic Acid
gaaagaaccugaugaggccguuaggccgaaacacuuga

SEQ ID NO: 12185 - RNA, 38 nt, Artificial Sequence
  Description of Artificial Sequence:  Enzymatic Nucleic Acid
gugguggacugaugaggccguuaggccgaaagaacaac

SEQ ID NO: 12186 - RNA, 38 nt, Artificial Sequence
  Description of Artificial Sequence:  Enzymatic Nucleic Acid
ggugguggcugaugaggccguuaggccgaaaagaacaa

SEQ ID NO: 12187 - RNA, 38 nt, Artificial Sequence
  Description of Artificial Sequence:  Enzymatic Nucleic Acid
ggguggugcugaugaggccguuaggccgaaaaagaaca

SEQ ID NO: 12188 - RNA, 38 nt, Artificial Sequence
  Description of Artificial Sequence:  Enzymatic Nucleic Acid
aauguggccugaugaggccguuaggccgaaacuuccgg

SEQ ID NO: 12189 - RNA, 38 nt, Artificial Sequence
  Description of Artificial Sequence:  Enzymatic Nucleic Acid
gaaaaucacugaugaggccguuaggccgaaauguggcu

SEQ ID NO: 12190 - RNA, 38 nt, Artificial Sequence
  Description of Artificial Sequence:  Enzymatic Nucleic Acid
ugaaaauccugaugaggccguuaggccgaaaauguggc

SEQ ID NO: 12191 - RNA, 38 nt, Artificial Sequence
  Description of Artificial Sequence:  Enzymatic Nucleic Acid
aaaaugaacugaugaggccguuaggccgaaaucaaaug

SEQ ID NO: 12192 - RNA, 38 nt, Artificial Sequence
  Description of Artificial Sequence:  Enzymatic Nucleic Acid
aaaaaugacugaugaggccguuaggccgaaaaucaaau

SEQ ID NO: 12193 - RNA, 38 nt, Artificial Sequence
  Description of Artificial Sequence:  Enzymatic Nucleic Acid
caaaaaugcugaugaggccguuaggccgaaaaaucaaa

SEQ ID NO: 12194 - RNA, 38 nt, Artificial Sequence
  Description of Artificial Sequence:  Enzymatic Nucleic Acid
ccaaaaaucugaugaggccguuaggccgaaaaaaucaa

SEQ ID NO: 12195 - RNA, 38 nt, Artificial Sequence
  Description of Artificial Sequence:  Enzymatic Nucleic Acid
ccuccaaacugaugaggccguuaggccgaaaugaaaau

SEQ ID NO: 12196 - RNA, 38 nt, Artificial Sequence
  Description of Artificial Sequence:  Enzymatic Nucleic Acid
uccuccaacugaugaggccguuaggccgaaaaugaaaa

SEQ ID NO: 12197 - RNA, 38 nt, Artificial Sequence
  Description of Artificial Sequence:  Enzymatic Nucleic Acid
cuccuccacugaugaggccguuaggccgaaaaaugaaa

SEQ ID NO: 12198 - RNA, 38 nt, Artificial Sequence
  Description of Artificial Sequence:  Enzymatic Nucleic Acid
ccuccucccugaugaggccguuaggccgaaaaaaugaa

SEQ ID NO: 12199 - RNA, 38 nt, Artificial Sequence
  Description of Artificial Sequence:  Enzymatic Nucleic Acid
ugcagucucugaugaggccguuaggccgaaaggucccu

SEQ ID NO: 12200 - RNA, 38 nt, Artificial Sequence
  Description of Artificial Sequence:  Enzymatic Nucleic Acid
cugaggaccugaugaggccguuaggccgaaagcuccuu

SEQ ID NO: 12201 - RNA, 38 nt, Artificial Sequence
  Description of Artificial Sequence:  Enzymatic Nucleic Acid
gcccugagcugaugaggccguuaggccgaaacaagcuc

SEQ ID NO: 12202 - RNA, 38 nt, Artificial Sequence
  Description of Artificial Sequence:  Enzymatic Nucleic Acid
aaugcccucugaugaggccguuaggccgaaaggacaag

SEQ ID NO: 12203 - RNA, 38 nt, Artificial Sequence
  Description of Artificial Sequence:  Enzymatic Nucleic Acid
ucucuggacugaugaggccguuaggccgaaaugcccug

SEQ ID NO: 12204 - RNA, 38 nt, Artificial Sequence
  Description of Artificial Sequence:  Enzymatic Nucleic Acid
uucucuggcugaugaggccguuaggccgaaaaugcccu

SEQ ID NO: 12205 - RNA, 38 nt, Artificial Sequence
  Description of Artificial Sequence:  Enzymatic Nucleic Acid
cuucucugcugaugaggccguuaggccgaaaaaugccc

SEQ ID NO: 12206 - RNA, 38 nt, Artificial Sequence
  Description of Artificial Sequence:  Enzymatic Nucleic Acid
guagaguccugaugaggccguuaggccgaaacacauuc

SEQ ID NO: 12207 - RNA, 38 nt, Artificial Sequence
  Description of Artificial Sequence:  Enzymatic Nucleic Acid
agagaguacugaugaggccguuaggccgaaagucaaca

SEQ ID NO: 12208 - RNA, 38 nt, Artificial Sequence
  Description of Artificial Sequence:  Enzymatic Nucleic Acid
aaagagagcugaugaggccguuaggccgaaagagucaa

SEQ ID NO: 12209 - RNA, 38 nt, Artificial Sequence
  Description of Artificial Sequence:  Enzymatic Nucleic Acid
ggaaaagacugaugaggccguuaggccgaaaguagagu

SEQ ID NO: 12210 - RNA, 38 nt, Artificial Sequence
  Description of Artificial Sequence:  Enzymatic Nucleic Acid
auggaaaacugaugaggccguuaggccgaaagaguaga

SEQ ID NO: 12211 - RNA, 38 nt, Artificial Sequence
  Description of Artificial Sequence:  Enzymatic Nucleic Acid
gaauggaacugaugaggccguuaggccgaaagagagua

SEQ ID NO: 12212 - RNA, 38 nt, Artificial Sequence
  Description of Artificial Sequence:  Enzymatic Nucleic Acid
ugaauggacugaugaggccguuaggccgaaaagagagu

SEQ ID NO: 12213 - RNA, 38 nt, Artificial Sequence
  Description of Artificial Sequence:  Enzymatic Nucleic Acid
augaauggcugaugaggccguuaggccgaaaaagagag

SEQ ID NO: 12214 - RNA, 38 nt, Artificial Sequence
  Description of Artificial Sequence:  Enzymatic Nucleic Acid
aaugaaugcugaugaggccguuaggccgaaaaaagaga

SEQ ID NO: 12215 - RNA, 38 nt, Artificial Sequence
  Description of Artificial Sequence:  Enzymatic Nucleic Acid
uuuaaaugcugaugaggccguuaggccgaaauggaaaa

SEQ ID NO: 12216 - RNA, 38 nt, Artificial Sequence
  Description of Artificial Sequence:  Enzymatic Nucleic Acid
uuuuaaaucugaugaggccguuaggccgaaaauggaaa

SEQ ID NO: 12217 - RNA, 38 nt, Artificial Sequence
  Description of Artificial Sequence:  Enzymatic Nucleic Acid
gacuuuuacugaugaggccguuaggccgaaaugaaugg

SEQ ID NO: 12218 - RNA, 38 nt, Artificial Sequence
  Description of Artificial Sequence:  Enzymatic Nucleic Acid
ggacuuuucugaugaggccguuaggccgaaaaugaaug

SEQ ID NO: 12219 - RNA, 38 nt, Artificial Sequence
  Description of Artificial Sequence:  Enzymatic Nucleic Acid
aggacuuucugaugaggccguuaggccgaaaaaugaau

SEQ ID NO: 12220 - RNA, 38 nt, Artificial Sequence
  Description of Artificial Sequence:  Enzymatic Nucleic Acid
uuauauagcugaugaggccguuaggccgaaacuuuuaa

SEQ ID NO: 12221 - RNA, 38 nt, Artificial Sequence
  Description of Artificial Sequence:  Enzymatic Nucleic Acid
acauuauacugaugaggccguuaggccgaaaggacuuu

SEQ ID NO: 12222 - RNA, 38 nt, Artificial Sequence
  Description of Artificial Sequence:  Enzymatic Nucleic Acid
gcacauuacugaugaggccguuaggccgaaauaggacu

SEQ ID NO: 12223 - RNA, 38 nt, Artificial Sequence
  Description of Artificial Sequence:  Enzymatic Nucleic Acid
gggcacaucugaugaggccguuaggccgaaauauagga

SEQ ID NO: 12224 - RNA, 38 nt, Artificial Sequence
  Description of Artificial Sequence:  Enzymatic Nucleic Acid
gguagugacugaugaggccguuaggccgaaaccacagc

SEQ ID NO: 12225 - RNA, 38 nt, Artificial Sequence
  Description of Artificial Sequence:  Enzymatic Nucleic Acid
cugguagucugaugaggccguuaggccgaaagaccaca

SEQ ID NO: 12226 - RNA, 38 nt, Artificial Sequence
  Description of Artificial Sequence:  Enzymatic Nucleic Acid
uuaacuggcugaugaggccguuaggccgaaagugagac

SEQ ID NO: 12227 - RNA, 38 nt, Artificial Sequence
  Description of Artificial Sequence:  Enzymatic Nucleic Acid
uuugcuuucugaugaggccguuaggccgaaacugguag

SEQ ID NO: 12228 - RNA, 38 nt, Artificial Sequence
  Description of Artificial Sequence:  Enzymatic Nucleic Acid
uuuugcuucugaugaggccguuaggccgaaaacuggua

SEQ ID NO: 12229 - RNA, 38 nt, Artificial Sequence
  Description of Artificial Sequence:  Enzymatic Nucleic Acid
guguuugacugaugaggccguuaggccgaaagucuuuu

SEQ ID NO: 12230 - RNA, 38 nt, Artificial Sequence
  Description of Artificial Sequence:  Enzymatic Nucleic Acid
cguguuugcugaugaggccguuaggccgaaaagucuuu

SEQ ID NO: 12231 - RNA, 38 nt, Artificial Sequence
  Description of Artificial Sequence:  Enzymatic Nucleic Acid
acguguuucugaugaggccguuaggccgaaaaagucuu

SEQ ID NO: 12232 - RNA, 38 nt, Artificial Sequence
  Description of Artificial Sequence:  Enzymatic Nucleic Acid
ggaggacacugaugaggccguuaggccgaaaguccacg

SEQ ID NO: 12233 - RNA, 38 nt, Artificial Sequence
  Description of Artificial Sequence:  Enzymatic Nucleic Acid
ucuuggagcugaugaggccguuaggccgaaacagaguc

SEQ ID NO: 12234 - RNA, 38 nt, Artificial Sequence
  Description of Artificial Sequence:  Enzymatic Nucleic Acid
acuucuugcugaugaggccguuaggccgaaaggacaga

SEQ ID NO: 12235 - RNA, 38 nt, Artificial Sequence
  Description of Artificial Sequence:  Enzymatic Nucleic Acid
guuucacacugaugaggccguuaggccgaaaggugccg

SEQ ID NO: 12236 - RNA, 38 nt, Artificial Sequence
  Description of Artificial Sequence:  Enzymatic Nucleic Acid
gcccauuccugaugaggccguuaggccgaaauccaguu

SEQ ID NO: 12237 - RNA, 38 nt, Artificial Sequence
  Description of Artificial Sequence:  Enzymatic Nucleic Acid
aacacacacugaugaggccguuaggccgaaagcauugc

SEQ ID NO: 12238 - RNA, 38 nt, Artificial Sequence
  Description of Artificial Sequence:  Enzymatic Nucleic Acid
caacacaccugaugaggccguuaggccgaaaagcauug

SEQ ID NO: 12239 - RNA, 38 nt, Artificial Sequence
  Description of Artificial Sequence:  Enzymatic Nucleic Acid
ccauccuccugaugaggccguuaggccgaaacacacaa

SEQ ID NO: 12240 - RNA, 38 nt, Artificial Sequence
  Description of Artificial Sequence:  Enzymatic Nucleic Acid
ggcccuggcugaugaggccguuaggccgaaacaucuca

SEQ ID NO: 12241 - RNA, 38 nt, Artificial Sequence
  Description of Artificial Sequence:  Enzymatic Nucleic Acid
gguagacacugaugaggccguuaggccgaaacucggcc

SEQ ID NO: 12242 - RNA, 38 nt, Artificial Sequence
  Description of Artificial Sequence:  Enzymatic Nucleic Acid
ccaagguacugaugaggccguuaggccgaaacagacuc

SEQ ID NO: 12243 - RNA, 38 nt, Artificial Sequence
  Description of Artificial Sequence:  Enzymatic Nucleic Acid
cuccaaggcugaugaggccguuaggccgaaagacagac

SEQ ID NO: 12244 - RNA, 38 nt, Artificial Sequence
  Description of Artificial Sequence:  Enzymatic Nucleic Acid
aagccucccugaugaggccguuaggccgaaagguagac

SEQ ID NO: 12245 - RNA, 38 nt, Artificial Sequence
  Description of Artificial Sequence:  Enzymatic Nucleic Acid
ccuccacacugaugaggccguuaggccgaaagccucca

SEQ ID NO: 12246 - RNA, 38 nt, Artificial Sequence
  Description of Artificial Sequence:  Enzymatic Nucleic Acid
uccuccaccugaugaggccguuaggccgaaaagccucc

SEQ ID NO: 12247 - RNA, 38 nt, Artificial Sequence
  Description of Artificial Sequence:  Enzymatic Nucleic Acid
uuggcucacugaugaggccguuaggccgaaagcccgca

SEQ ID NO: 12248 - RNA, 38 nt, Artificial Sequence
  Description of Artificial Sequence:  Enzymatic Nucleic Acid
ccacacuucugaugaggccguuaggccgaaacacuugg

SEQ ID NO: 12249 - RNA, 38 nt, Artificial Sequence
  Description of Artificial Sequence:  Enzymatic Nucleic Acid
cccacacucugaugaggccguuaggccgaaaacacuug

SEQ ID NO: 12250 - RNA, 38 nt, Artificial Sequence
  Description of Artificial Sequence:  Enzymatic Nucleic Acid
cuccgagccugaugaggccguuaggccgaaacuugcgc

SEQ ID NO: 12251 - RNA, 38 nt, Artificial Sequence
  Description of Artificial Sequence:  Enzymatic Nucleic Acid
cgcucucccugaugaggccguuaggccgaaagcgacuu

SEQ ID NO: 12252 - RNA, 38 nt, Artificial Sequence
  Description of Artificial Sequence:  Enzymatic Nucleic Acid
caggcucccugaugaggccguuaggccgaaaccgcucu

SEQ ID NO: 12253 - RNA, 38 nt, Artificial Sequence
  Description of Artificial Sequence:  Enzymatic Nucleic Acid
gccagcaccugaugaggccguuaggccgaaaugcaucu

SEQ ID NO: 12254 - RNA, 38 nt, Artificial Sequence
  Description of Artificial Sequence:  Enzymatic Nucleic Acid
cuccaccacugaugaggccguuaggccgaaagccagca

SEQ ID NO: 12255 - RNA, 38 nt, Artificial Sequence
  Description of Artificial Sequence:  Enzymatic Nucleic Acid
caggccaccugaugaggccguuaggccgaaagcccacc

SEQ ID NO: 12256 - RNA, 38 nt, Artificial Sequence
  Description of Artificial Sequence:  Enzymatic Nucleic Acid
cguuuccucugaugaggccguuaggccgaaacaggcca

SEQ ID NO: 12257 - RNA, 38 nt, Artificial Sequence
  Description of Artificial Sequence:  Enzymatic Nucleic Acid
caaaaccacugaugaggccguuaggccgaaacccugcc

SEQ ID NO: 12258 - RNA, 38 nt, Artificial Sequence
  Description of Artificial Sequence:  Enzymatic Nucleic Acid
ccaaaacccugaugaggccguuaggccgaaaacccugc

SEQ ID NO: 12259 - RNA, 38 nt, Artificial Sequence
  Description of Artificial Sequence:  Enzymatic Nucleic Acid
ccuuccaacugaugaggccguuaggccgaaaccaaacc

SEQ ID NO: 12260 - RNA, 38 nt, Artificial Sequence
  Description of Artificial Sequence:  Enzymatic Nucleic Acid
accuuccacugaugaggccguuaggccgaaaaccaaac

SEQ ID NO: 12261 - RNA, 38 nt, Artificial Sequence
  Description of Artificial Sequence:  Enzymatic Nucleic Acid
aaccuucccugaugaggccguuaggccgaaaaaccaaa

SEQ ID NO: 12262 - RNA, 38 nt, Artificial Sequence
  Description of Artificial Sequence:  Enzymatic Nucleic Acid
agcacgcacugaugaggccguuaggccgaaaccuucca

SEQ ID NO: 12263 - RNA, 38 nt, Artificial Sequence
  Description of Artificial Sequence:  Enzymatic Nucleic Acid
gagcacgccugaugaggccguuaggccgaaaaccuucc

SEQ ID NO: 12264 - RNA, 38 nt, Artificial Sequence
  Description of Artificial Sequence:  Enzymatic Nucleic Acid
acugugaacugaugaggccguuaggccgaaagcacgca

SEQ ID NO: 12265 - RNA, 38 nt, Artificial Sequence
  Description of Artificial Sequence:  Enzymatic Nucleic Acid
cgacugugcugaugaggccguuaggccgaaagagcacg

SEQ ID NO: 12266 - RNA, 38 nt, Artificial Sequence
  Description of Artificial Sequence:  Enzymatic Nucleic Acid
ccgacugucugaugaggccguuaggccgaaaagagcac

SEQ ID NO: 12267 - RNA, 38 nt, Artificial Sequence
  Description of Artificial Sequence:  Enzymatic Nucleic Acid
uguaaccccugaugaggccguuaggccgaaacugugaa

SEQ ID NO: 12268 - RNA, 38 nt, Artificial Sequence
  Description of Artificial Sequence:  Enzymatic Nucleic Acid
ucgccugucugaugaggccguuaggccgaaacccgacu

SEQ ID NO: 12269 - RNA, 38 nt, Artificial Sequence
  Description of Artificial Sequence:  Enzymatic Nucleic Acid
cucgccugcugaugaggccguuaggccgaaaacccgac

SEQ ID NO: 12270 - RNA, 38 nt, Artificial Sequence
  Description of Artificial Sequence:  Enzymatic Nucleic Acid
ccacagggcugaugaggccguuaggccgaaacucgccu

SEQ ID NO: 12271 - RNA, 38 nt, Artificial Sequence
  Description of Artificial Sequence:  Enzymatic Nucleic Acid
gccacaggcugaugaggccguuaggccgaaaacucgcc

SEQ ID NO: 12272 - RNA, 38 nt, Artificial Sequence
  Description of Artificial Sequence:  Enzymatic Nucleic Acid
gaguaggacugaugaggccguuaggccgaaacgccaca

SEQ ID NO: 12273 - RNA, 38 nt, Artificial Sequence
  Description of Artificial Sequence:  Enzymatic Nucleic Acid
ggaguaggcugaugaggccguuaggccgaaaacgccac

SEQ ID NO: 12274 - RNA, 38 nt, Artificial Sequence
  Description of Artificial Sequence:  Enzymatic Nucleic Acid
aggaguagcugaugaggccguuaggccgaaaaacgcca

SEQ ID NO: 12275 - RNA, 38 nt, Artificial Sequence
  Description of Artificial Sequence:  Enzymatic Nucleic Acid
auuaggagcugaugaggccguuaggccgaaaggaaacg

SEQ ID NO: 12276 - RNA, 38 nt, Artificial Sequence
  Description of Artificial Sequence:  Enzymatic Nucleic Acid
cucauuagcugaugaggccguuaggccgaaaguaggaa

SEQ ID NO: 12277 - RNA, 38 nt, Artificial Sequence
  Description of Artificial Sequence:  Enzymatic Nucleic Acid
acucucaucugaugaggccguuaggccgaaaggaguag

SEQ ID NO: 12278 - RNA, 38 nt, Artificial Sequence
  Description of Artificial Sequence:  Enzymatic Nucleic Acid
ccggaaggcugaugaggccguuaggccgaaacucucau

SEQ ID NO: 12279 - RNA, 38 nt, Artificial Sequence
  Description of Artificial Sequence:  Enzymatic Nucleic Acid
uccggaagcugaugaggccguuaggccgaaaacucuca

SEQ ID NO: 12280 - RNA, 38 nt, Artificial Sequence
  Description of Artificial Sequence:  Enzymatic Nucleic Acid
gaguccggcugaugaggccguuaggccgaaaggaacuc

SEQ ID NO: 12281 - RNA, 38 nt, Artificial Sequence
  Description of Artificial Sequence:  Enzymatic Nucleic Acid
agaguccgcugaugaggccguuaggccgaaaaggaacu

SEQ ID NO: 12282 - RNA, 38 nt, Artificial Sequence
  Description of Artificial Sequence:  Enzymatic Nucleic Acid
acacguaacugaugaggccguuaggccgaaaguccgga

SEQ ID NO: 12283 - RNA, 38 nt, Artificial Sequence
  Description of Artificial Sequence:  Enzymatic Nucleic Acid
agacacgucugaugaggccguuaggccgaaagaguccg

SEQ ID NO: 12284 - RNA, 38 nt, Artificial Sequence
  Description of Artificial Sequence:  Enzymatic Nucleic Acid
gagacacgcugaugaggccguuaggccgaaaagagucc

SEQ ID NO: 12285 - RNA, 38 nt, Artificial Sequence
  Description of Artificial Sequence:  Enzymatic Nucleic Acid
ggccaggacugaugaggccguuaggccgaaacacguaa

SEQ ID NO: 12286 - RNA, 38 nt, Artificial Sequence
  Description of Artificial Sequence:  Enzymatic Nucleic Acid
caggccagcugaugaggccguuaggccgaaagacacgu

SEQ ID NO: 12287 - RNA, 38 nt, Artificial Sequence
  Description of Artificial Sequence:  Enzymatic Nucleic Acid
gaaggagccugaugaggccguuaggccgaaagcugcau

SEQ ID NO: 12288 - RNA, 38 nt, Artificial Sequence
  Description of Artificial Sequence:  Enzymatic Nucleic Acid
ugaggaagcugaugaggccguuaggccgaaagcaagcu

SEQ ID NO: 12289 - RNA, 38 nt, Artificial Sequence
  Description of Artificial Sequence:  Enzymatic Nucleic Acid
agaugaggcugaugaggccguuaggccgaaaggagcaa

SEQ ID NO: 12290 - RNA, 38 nt, Artificial Sequence
  Description of Artificial Sequence:  Enzymatic Nucleic Acid
gagaugagcugaugaggccguuaggccgaaaaggagca

SEQ ID NO: 12291 - RNA, 38 nt, Artificial Sequence
  Description of Artificial Sequence:  Enzymatic Nucleic Acid
ugagagaucugaugaggccguuaggccgaaaggaagga

SEQ ID NO: 12292 - RNA, 38 nt, Artificial Sequence
  Description of Artificial Sequence:  Enzymatic Nucleic Acid
gccugagacugaugaggccguuaggccgaaaugaggaa

SEQ ID NO: 12293 - RNA, 38 nt, Artificial Sequence
  Description of Artificial Sequence:  Enzymatic Nucleic Acid
cagccugacugaugaggccguuaggccgaaagaugagg

SEQ ID NO: 12294 - RNA, 38 nt, Artificial Sequence
  Description of Artificial Sequence:  Enzymatic Nucleic Acid
cacagccucugaugaggccguuaggccgaaagagauga

SEQ ID NO: 12295 - RNA, 38 nt, Artificial Sequence
  Description of Artificial Sequence:  Enzymatic Nucleic Acid
ucugaauucugaugaggccguuaggccgaaaggcacag

SEQ ID NO: 12296 - RNA, 38 nt, Artificial Sequence
  Description of Artificial Sequence:  Enzymatic Nucleic Acid
uucugaaucugaugaggccguuaggccgaaaaggcaca

SEQ ID NO: 12297 - RNA, 38 nt, Artificial Sequence
  Description of Artificial Sequence:  Enzymatic Nucleic Acid
guguucugcugaugaggccguuaggccgaaauuaaggc

SEQ ID NO: 12298 - RNA, 38 nt, Artificial Sequence
  Description of Artificial Sequence:  Enzymatic Nucleic Acid
gguguucucugaugaggccguuaggccgaaaauuaagg

SEQ ID NO: 12299 - RNA, 38 nt, Artificial Sequence
  Description of Artificial Sequence:  Enzymatic Nucleic Acid
ccucugcccugaugaggccguuaggccgaaacguuccu

SEQ ID NO: 12300 - RNA, 38 nt, Artificial Sequence
  Description of Artificial Sequence:  Enzymatic Nucleic Acid
cccgucagcugaugaggccguuaggccgaaagccucug

SEQ ID NO: 12301 - RNA, 38 nt, Artificial Sequence
  Description of Artificial Sequence:  Enzymatic Nucleic Acid
guucucaccugaugaggccguuaggccgaaauucuucg

SEQ ID NO: 12302 - RNA, 38 nt, Artificial Sequence
  Description of Artificial Sequence:  Enzymatic Nucleic Acid
gaaacccucugaugaggccguuaggccgaaaguuucug

SEQ ID NO: 12303 - RNA, 38 nt, Artificial Sequence
  Description of Artificial Sequence:  Enzymatic Nucleic Acid
ccagcagacugaugaggccguuaggccgaaacccugag

SEQ ID NO: 12304 - RNA, 38 nt, Artificial Sequence
  Description of Artificial Sequence:  Enzymatic Nucleic Acid
cccagcagcugaugaggccguuaggccgaaaacccuga

SEQ ID NO: 12305 - RNA, 38 nt, Artificial Sequence
  Description of Artificial Sequence:  Enzymatic Nucleic Acid
acccagcacugaugaggccguuaggccgaaaaacccug

SEQ ID NO: 12306 - RNA, 38 nt, Artificial Sequence
  Description of Artificial Sequence:  Enzymatic Nucleic Acid
aacccucacugaugaggccguuaggccgaaaccugcca

SEQ ID NO: 12307 - RNA, 38 nt, Artificial Sequence
  Description of Artificial Sequence:  Enzymatic Nucleic Acid
ugacagagcugaugaggccguuaggccgaaacccucag

SEQ ID NO: 12308 - RNA, 38 nt, Artificial Sequence
  Description of Artificial Sequence:  Enzymatic Nucleic Acid
uugacagacugaugaggccguuaggccgaaaacccuca

SEQ ID NO: 12309 - RNA, 38 nt, Artificial Sequence
  Description of Artificial Sequence:  Enzymatic Nucleic Acid
acuugacacugaugaggccguuaggccgaaagaacccu

SEQ ID NO: 12310 - RNA, 38 nt, Artificial Sequence
  Description of Artificial Sequence:  Enzymatic Nucleic Acid
cgccacuucugaugaggccguuaggccgaaacagagaa

SEQ ID NO: 12311 - RNA, 38 nt, Artificial Sequence
  Description of Artificial Sequence:  Enzymatic Nucleic Acid
ugagccuucugaugaggccguuaggccgaaaccgccac

SEQ ID NO: 12312 - RNA, 38 nt, Artificial Sequence
  Description of Artificial Sequence:  Enzymatic Nucleic Acid
accagccucugaugaggccguuaggccgaaagccuuua

SEQ ID NO: 12313 - RNA, 38 nt, Artificial Sequence
  Description of Artificial Sequence:  Enzymatic Nucleic Acid
agaggaagcugaugaggccguuaggccgaaacaccagc

SEQ ID NO: 12314 - RNA, 38 nt, Artificial Sequence
  Description of Artificial Sequence:  Enzymatic Nucleic Acid
uagaggaacugaugaggccguuaggccgaaaacaccag

SEQ ID NO: 12315 - RNA, 38 nt, Artificial Sequence
  Description of Artificial Sequence:  Enzymatic Nucleic Acid
gauagaggcugaugaggccguuaggccgaaagaacacc

SEQ ID NO: 12316 - RNA, 38 nt, Artificial Sequence
  Description of Artificial Sequence:  Enzymatic Nucleic Acid
agauagagcugaugaggccguuaggccgaaaagaacac

SEQ ID NO: 12317 - RNA, 38 nt, Artificial Sequence
  Description of Artificial Sequence:  Enzymatic Nucleic Acid
uggagauacugaugaggccguuaggccgaaaggaagaa

SEQ ID NO: 12318 - RNA, 38 nt, Artificial Sequence
  Description of Artificial Sequence:  Enzymatic Nucleic Acid
aguggagacugaugaggccguuaggccgaaagaggaag

SEQ ID NO: 12319 - RNA, 38 nt, Artificial Sequence
  Description of Artificial Sequence:  Enzymatic Nucleic Acid
ggaguggacugaugaggccguuaggccgaaauagagga

SEQ ID NO: 12320 - RNA, 38 nt, Artificial Sequence
  Description of Artificial Sequence:  Enzymatic Nucleic Acid
caggagugcugaugaggccguuaggccgaaagauagag

SEQ ID NO: 12321 - RNA, 38 nt, Artificial Sequence
  Description of Artificial Sequence:  Enzymatic Nucleic Acid
ccugacagcugaugaggccguuaggccgaaaguggaga

SEQ ID NO: 12322 - RNA, 38 nt, Artificial Sequence
  Description of Artificial Sequence:  Enzymatic Nucleic Acid
gggggccucugaugaggccguuaggccgaaacaggagu

SEQ ID NO: 12323 - RNA, 38 nt, Artificial Sequence
  Description of Artificial Sequence:  Enzymatic Nucleic Acid
auacugagcugaugaggccguuaggccgaaacuugggg

SEQ ID NO: 12324 - RNA, 38 nt, Artificial Sequence
  Description of Artificial Sequence:  Enzymatic Nucleic Acid
aaaauacucugaugaggccguuaggccgaaaggacuug

SEQ ID NO: 12325 - RNA, 38 nt, Artificial Sequence
  Description of Artificial Sequence:  Enzymatic Nucleic Acid
agcuaaaacugaugaggccguuaggccgaaacugagga

SEQ ID NO: 12326 - RNA, 38 nt, Artificial Sequence
  Description of Artificial Sequence:  Enzymatic Nucleic Acid
aaagcuaacugaugaggccguuaggccgaaauacugag

SEQ ID NO: 12327 - RNA, 38 nt, Artificial Sequence
  Description of Artificial Sequence:  Enzymatic Nucleic Acid
caaagcuacugaugaggccguuaggccgaaaauacuga

SEQ ID NO: 12328 - RNA, 38 nt, Artificial Sequence
  Description of Artificial Sequence:  Enzymatic Nucleic Acid
acaaagcucugaugaggccguuaggccgaaaaauacug

SEQ ID NO: 12329 - RNA, 38 nt, Artificial Sequence
  Description of Artificial Sequence:  Enzymatic Nucleic Acid
cacaaagccugaugaggccguuaggccgaaaaaauacu

SEQ ID NO: 12330 - RNA, 38 nt, Artificial Sequence
  Description of Artificial Sequence:  Enzymatic Nucleic Acid
aagccacacugaugaggccguuaggccgaaagcuaaaa

SEQ ID NO: 12331 - RNA, 38 nt, Artificial Sequence
  Description of Artificial Sequence:  Enzymatic Nucleic Acid
gaagccaccugaugaggccguuaggccgaaaagcuaaa

SEQ ID NO: 12332 - RNA, 38 nt, Artificial Sequence
  Description of Artificial Sequence:  Enzymatic Nucleic Acid
ccaucaggcugaugaggccguuaggccgaaagccacaa

SEQ ID NO: 12333 - RNA, 38 nt, Artificial Sequence
  Description of Artificial Sequence:  Enzymatic Nucleic Acid
gccaucagcugaugaggccguuaggccgaaaagccaca

SEQ ID NO: 12334 - RNA, 38 nt, Artificial Sequence
  Description of Artificial Sequence:  Enzymatic Nucleic Acid
ccaauuaacugaugaggccguuaggccgaaauuuuucu

SEQ ID NO: 12335 - RNA, 38 nt, Artificial Sequence
  Description of Artificial Sequence:  Enzymatic Nucleic Acid
aaccaauucugaugaggccguuaggccgaaagauuuuu

SEQ ID NO: 12336 - RNA, 38 nt, Artificial Sequence
  Description of Artificial Sequence:  Enzymatic Nucleic Acid
caaccaaucugaugaggccguuaggccgaaaagauuuu

SEQ ID NO: 12337 - RNA, 38 nt, Artificial Sequence
  Description of Artificial Sequence:  Enzymatic Nucleic Acid
aaccaacccugaugaggccguuaggccgaaauuaagau

SEQ ID NO: 12338 - RNA, 38 nt, Artificial Sequence
  Description of Artificial Sequence:  Enzymatic Nucleic Acid
agcaaacccugaugaggccguuaggccgaaaccaauua

SEQ ID NO: 12339 - RNA, 38 nt, Artificial Sequence
  Description of Artificial Sequence:  Enzymatic Nucleic Acid
ggagagcacugaugaggccguuaggccgaaaccaacca

SEQ ID NO: 12340 - RNA, 38 nt, Artificial Sequence
  Description of Artificial Sequence:  Enzymatic Nucleic Acid
uggagagccugaugaggccguuaggccgaaaaccaacc

SEQ ID NO: 12341 - RNA, 38 nt, Artificial Sequence
  Description of Artificial Sequence:  Enzymatic Nucleic Acid
uaucuggacugaugaggccguuaggccgaaagcaaacc

SEQ ID NO: 12342 - RNA, 38 nt, Artificial Sequence
  Description of Artificial Sequence:  Enzymatic Nucleic Acid
auuaucugcugaugaggccguuaggccgaaagagcaaa

SEQ ID NO: 12343 - RNA, 38 nt, Artificial Sequence
  Description of Artificial Sequence:  Enzymatic Nucleic Acid
cuagugaucugaugaggccguuaggccgaaaucuggag

SEQ ID NO: 12344 - RNA, 38 nt, Artificial Sequence
  Description of Artificial Sequence:  Enzymatic Nucleic Acid
uggcuagucugaugaggccguuaggccgaaauuaucug

SEQ ID NO: 12345 - RNA, 38 nt, Artificial Sequence
  Description of Artificial Sequence:  Enzymatic Nucleic Acid
aaucuggccugaugaggccguuaggccgaaagugauua

SEQ ID NO: 12346 - RNA, 38 nt, Artificial Sequence
  Description of Artificial Sequence:  Enzymatic Nucleic Acid
aauuucgacugaugaggccguuaggccgaaaucuggcu

SEQ ID NO: 12347 - RNA, 38 nt, Artificial Sequence
  Description of Artificial Sequence:  Enzymatic Nucleic Acid
uaauuucgcugaugaggccguuaggccgaaaaucuggc

SEQ ID NO: 12348 - RNA, 38 nt, Artificial Sequence
  Description of Artificial Sequence:  Enzymatic Nucleic Acid
guaauuuccugaugaggccguuaggccgaaaaaucugg

SEQ ID NO: 12349 - RNA, 38 nt, Artificial Sequence
  Description of Artificial Sequence:  Enzymatic Nucleic Acid
uaaaaagucugaugaggccguuaggccgaaauuucgaa

SEQ ID NO: 12350 - RNA, 38 nt, Artificial Sequence
  Description of Artificial Sequence:  Enzymatic Nucleic Acid
cuaaaaagcugaugaggccguuaggccgaaaauuucga

SEQ ID NO: 12351 - RNA, 38 nt, Artificial Sequence
  Description of Artificial Sequence:  Enzymatic Nucleic Acid
cggcuaaacugaugaggccguuaggccgaaaguaauuu

SEQ ID NO: 12352 - RNA, 38 nt, Artificial Sequence
  Description of Artificial Sequence:  Enzymatic Nucleic Acid
ucggcuaacugaugaggccguuaggccgaaaaguaauu

SEQ ID NO: 12353 - RNA, 38 nt, Artificial Sequence
  Description of Artificial Sequence:  Enzymatic Nucleic Acid
cucggcuacugaugaggccguuaggccgaaaaaguaau

SEQ ID NO: 12354 - RNA, 38 nt, Artificial Sequence
  Description of Artificial Sequence:  Enzymatic Nucleic Acid
ccucggcucugaugaggccguuaggccgaaaaaaguaa

SEQ ID NO: 12355 - RNA, 38 nt, Artificial Sequence
  Description of Artificial Sequence:  Enzymatic Nucleic Acid
accucggccugaugaggccguuaggccgaaaaaaagua

SEQ ID NO: 12356 - RNA, 38 nt, Artificial Sequence
  Description of Artificial Sequence:  Enzymatic Nucleic Acid
guuaucaucugaugaggccguuaggccgaaaccucggc

SEQ ID NO: 12357 - RNA, 38 nt, Artificial Sequence
  Description of Artificial Sequence:  Enzymatic Nucleic Acid
uguuaucacugaugaggccguuaggccgaaaaccucgg

SEQ ID NO: 12358 - RNA, 38 nt, Artificial Sequence
  Description of Artificial Sequence:  Enzymatic Nucleic Acid
guagaugucugaugaggccguuaggccgaaaucauaac

SEQ ID NO: 12359 - RNA, 38 nt, Artificial Sequence
  Description of Artificial Sequence:  Enzymatic Nucleic Acid
auacaguacugaugaggccguuaggccgaaauguuauc

SEQ ID NO: 12360 - RNA, 38 nt, Artificial Sequence
  Description of Artificial Sequence:  Enzymatic Nucleic Acid
ggauacagcugaugaggccguuaggccgaaagauguua

SEQ ID NO: 12361 - RNA, 38 nt, Artificial Sequence
  Description of Artificial Sequence:  Enzymatic Nucleic Acid
cuaaaggacugaugaggccguuaggccgaaacaguaga

SEQ ID NO: 12362 - RNA, 38 nt, Artificial Sequence
  Description of Artificial Sequence:  Enzymatic Nucleic Acid
uucuaaagcugaugaggccguuaggccgaaauacagua

SEQ ID NO: 12363 - RNA, 38 nt, Artificial Sequence
  Description of Artificial Sequence:  Enzymatic Nucleic Acid
aaauucuacugaugaggccguuaggccgaaaggauaca

SEQ ID NO: 12364 - RNA, 38 nt, Artificial Sequence
  Description of Artificial Sequence:  Enzymatic Nucleic Acid
aaaauucucugaugaggccguuaggccgaaaaggauac

SEQ ID NO: 12365 - RNA, 38 nt, Artificial Sequence
  Description of Artificial Sequence:  Enzymatic Nucleic Acid
uaaaauuccugaugaggccguuaggccgaaaaaggaua

SEQ ID NO: 12366 - RNA, 38 nt, Artificial Sequence
  Description of Artificial Sequence:  Enzymatic Nucleic Acid
uagguuaacugaugaggccguuaggccgaaauucuaaa

SEQ ID NO: 12367 - RNA, 38 nt, Artificial Sequence
  Description of Artificial Sequence:  Enzymatic Nucleic Acid
auagguuacugaugaggccguuaggccgaaaauucuaa

SEQ ID NO: 12368 - RNA, 38 nt, Artificial Sequence
  Description of Artificial Sequence:  Enzymatic Nucleic Acid
uauagguucugaugaggccguuaggccgaaaaauucua

SEQ ID NO: 12369 - RNA, 38 nt, Artificial Sequence
  Description of Artificial Sequence:  Enzymatic Nucleic Acid
uuauaggucugaugaggccguuaggccgaaaaaauucu

SEQ ID NO: 12370 - RNA, 38 nt, Artificial Sequence
  Description of Artificial Sequence:  Enzymatic Nucleic Acid
uaguuuuacugaugaggccguuaggccgaaagguuaaa

SEQ ID NO: 12371 - RNA, 38 nt, Artificial Sequence
  Description of Artificial Sequence:  Enzymatic Nucleic Acid
cauaguuucugaugaggccguuaggccgaaauagguua

SEQ ID NO: 12372 - RNA, 38 nt, Artificial Sequence
  Description of Artificial Sequence:  Enzymatic Nucleic Acid
aguagacacugaugaggccguuaggccgaaaguuuuau

SEQ ID NO: 12373 - RNA, 38 nt, Artificial Sequence
  Description of Artificial Sequence:  Enzymatic Nucleic Acid
aaccaguacugaugaggccguuaggccgaaacauaguu

SEQ ID NO: 12374 - RNA, 38 nt, Artificial Sequence
  Description of Artificial Sequence:  Enzymatic Nucleic Acid
gaaaccagcugaugaggccguuaggccgaaagacauag

SEQ ID NO: 12375 - RNA, 38 nt, Artificial Sequence
  Description of Artificial Sequence:  Enzymatic Nucleic Acid
caggcagacugaugaggccguuaggccgaaaccaguag

SEQ ID NO: 12376 - RNA, 38 nt, Artificial Sequence
  Description of Artificial Sequence:  Enzymatic Nucleic Acid
acaggcagcugaugaggccguuaggccgaaaaccagua

SEQ ID NO: 12377 - RNA, 38 nt, Artificial Sequence
  Description of Artificial Sequence:  Enzymatic Nucleic Acid
cacaggcacugaugaggccguuaggccgaaaaaccagu

SEQ ID NO: 12378 - RNA, 54 nt, Artificial Sequence
  Description of Artificial Sequence:  Enzymatic Nucleic Acid
gggacacaagaagggcccaccagagaaacacacguugugguacauuaccuggua

SEQ ID NO: 12379 - RNA, 54 nt, Artificial Sequence
  Description of Artificial Sequence:  Enzymatic Nucleic Acid
guuaucccagaagcgggaaccagagaaacacacguugugguacauuaccuggua

SEQ ID NO: 12380 - RNA, 54 nt, Artificial Sequence
  Description of Artificial Sequence:  Enzymatic Nucleic Acid
ggaaucggagaagccaggaccagagaaacacacguugugguacauuaccuggua

SEQ ID NO: 12381 - RNA, 54 nt, Artificial Sequence
  Description of Artificial Sequence:  Enzymatic Nucleic Acid
uccgcggaagaaggucagaccagagaaacacacguugugguacauuaccuggua

SEQ ID NO: 12382 - RNA, 54 nt, Artificial Sequence
  Description of Artificial Sequence:  Enzymatic Nucleic Acid
cggcugucagaaguguccaccagagaaacacacguugugguacauuaccuggua

SEQ ID NO: 12383 - RNA, 54 nt, Artificial Sequence
  Description of Artificial Sequence:  Enzymatic Nucleic Acid
ccagccgcagaagucagcaccagagaaacacacguugugguacauuaccuggua

SEQ ID NO: 12384 - RNA, 54 nt, Artificial Sequence
  Description of Artificial Sequence:  Enzymatic Nucleic Acid
cuggcuccagaagcggcuaccagagaaacacacguugugguacauuaccuggua

SEQ ID NO: 12385 - RNA, 54 nt, Artificial Sequence
  Description of Artificial Sequence:  Enzymatic Nucleic Acid
cagcgcaaagaaggggagaccagagaaacacacguugugguacauuaccuggua

SEQ ID NO: 12386 - RNA, 54 nt, Artificial Sequence
  Description of Artificial Sequence:  Enzymatic Nucleic Acid
gucacagaagaaguauggaccagagaaacacacguugugguacauuaccuggua

SEQ ID NO: 12387 - RNA, 54 nt, Artificial Sequence
  Description of Artificial Sequence:  Enzymatic Nucleic Acid
cacagagcagaagcuagcaccagagaaacacacguugugguacauuaccuggua

SEQ ID NO: 12388 - RNA, 54 nt, Artificial Sequence
  Description of Artificial Sequence:  Enzymatic Nucleic Acid
cccacagaagaagcucggaccagagaaacacacguugugguacauuaccuggua

SEQ ID NO: 12389 - RNA, 54 nt, Artificial Sequence
  Description of Artificial Sequence:  Enzymatic Nucleic Acid
ugcaaguaagaagaagggaccagagaaacacacguugugguacauuaccuggua

SEQ ID NO: 12390 - RNA, 54 nt, Artificial Sequence
  Description of Artificial Sequence:  Enzymatic Nucleic Acid
uagacauaagaaguggagaccagagaaacacacguugugguacauuaccuggua

SEQ ID NO: 12391 - RNA, 54 nt, Artificial Sequence
  Description of Artificial Sequence:  Enzymatic Nucleic Acid
gaauggugagaaguaaucaccagagaaacacacguugugguacauuaccuggua

SEQ ID NO: 12392 - RNA, 54 nt, Artificial Sequence
  Description of Artificial Sequence:  Enzymatic Nucleic Acid
cgacccucagaaggggauaccagagaaacacacguugugguacauuaccuggua

SEQ ID NO: 12393 - RNA, 54 nt, Artificial Sequence
  Description of Artificial Sequence:  Enzymatic Nucleic Acid
cuguuuccagaaggaacaaccagagaaacacacguugugguacauuaccuggua

SEQ ID NO: 12394 - RNA, 54 nt, Artificial Sequence
  Description of Artificial Sequence:  Enzymatic Nucleic Acid
acaugauaagaagauaggaccagagaaacacacguugugguacauuaccuggua

SEQ ID NO: 12395 - RNA, 54 nt, Artificial Sequence
  Description of Artificial Sequence:  Enzymatic Nucleic Acid
uuuucuccagaagauagcaccagagaaacacacguugugguacauuaccuggua

SEQ ID NO: 12396 - RNA, 54 nt, Artificial Sequence
  Description of Artificial Sequence:  Enzymatic Nucleic Acid
ucuugaucagaaguccacaccagagaaacacacguugugguacauuaccuggua

SEQ ID NO: 12397 - RNA, 54 nt, Artificial Sequence
  Description of Artificial Sequence:  Enzymatic Nucleic Acid
auaucaggagaaggguaaaccagagaaacacacguugugguacauuaccuggua

SEQ ID NO: 12398 - RNA, 54 nt, Artificial Sequence
  Description of Artificial Sequence:  Enzymatic Nucleic Acid
ucucaccgagaaggggugaccagagaaacacacguugugguacauuaccuggua

SEQ ID NO: 12399 - RNA, 54 nt, Artificial Sequence
  Description of Artificial Sequence:  Enzymatic Nucleic Acid
uuggcguaagaagugcauaccagagaaacacacguugugguacauuaccuggua

SEQ ID NO: 12400 - RNA, 54 nt, Artificial Sequence
  Description of Artificial Sequence:  Enzymatic Nucleic Acid
ucuguaggagaaggcuucaccagagaaacacacguugugguacauuaccuggua

SEQ ID NO: 12401 - RNA, 54 nt, Artificial Sequence
  Description of Artificial Sequence:  Enzymatic Nucleic Acid
uuggccggagaaguaggaaccagagaaacacacguugugguacauuaccuggua

SEQ ID NO: 12402 - RNA, 54 nt, Artificial Sequence
  Description of Artificial Sequence:  Enzymatic Nucleic Acid
uuccuucaagaagggcauaccagagaaacacacguugugguacauuaccuggua

SEQ ID NO: 12403 - RNA, 54 nt, Artificial Sequence
  Description of Artificial Sequence:  Enzymatic Nucleic Acid
ggcugggcagaagguugcaccagagaaacacacguugugguacauuaccuggua

SEQ ID NO: 12404 - RNA, 54 nt, Artificial Sequence
  Description of Artificial Sequence:  Enzymatic Nucleic Acid
guuggcugagaagcagguaccagagaaacacacguugugguacauuaccuggua

SEQ ID NO: 12405 - RNA, 54 nt, Artificial Sequence
  Description of Artificial Sequence:  Enzymatic Nucleic Acid
cagugcacagaagggacaaccagagaaacacacguugugguacauuaccuggua

SEQ ID NO: 12406 - RNA, 54 nt, Artificial Sequence
  Description of Artificial Sequence:  Enzymatic Nucleic Acid
cccaugugagaagauguuaccagagaaacacacguugugguacauuaccuggua

SEQ ID NO: 12407 - RNA, 54 nt, Artificial Sequence
  Description of Artificial Sequence:  Enzymatic Nucleic Acid
uuaucuugagaagagcaaaccagagaaacacacguugugguacauuaccuggua

SEQ ID NO: 12408 - RNA, 54 nt, Artificial Sequence
  Description of Artificial Sequence:  Enzymatic Nucleic Acid
ggaugaugagaaguuugaaccagagaaacacacguugugguacauuaccuggua

SEQ ID NO: 12409 - RNA, 54 nt, Artificial Sequence
  Description of Artificial Sequence:  Enzymatic Nucleic Acid
ugcggauaagaagguuccaccagagaaacacacguugugguacauuaccuggua

SEQ ID NO: 12410 - RNA, 54 nt, Artificial Sequence
  Description of Artificial Sequence:  Enzymatic Nucleic Acid
gcuuaacgagaaguaggaaccagagaaacacacguugugguacauuaccuggua

SEQ ID NO: 12411 - RNA, 54 nt, Artificial Sequence
  Description of Artificial Sequence:  Enzymatic Nucleic Acid
ggcaauucagaaggauccaccagagaaacacacguugugguacauuaccuggua

SEQ ID NO: 12412 - RNA, 54 nt, Artificial Sequence
  Description of Artificial Sequence:  Enzymatic Nucleic Acid
cuaguuucagaaggucccaccagagaaacacacguugugguacauuaccuggua

SEQ ID NO: 12413 - RNA, 54 nt, Artificial Sequence
  Description of Artificial Sequence:  Enzymatic Nucleic Acid
ccaaaagcagaagccucaaccagagaaacacacguugugguacauuaccuggua

SEQ ID NO: 12414 - RNA, 54 nt, Artificial Sequence
  Description of Artificial Sequence:  Enzymatic Nucleic Acid
aaagccugagaaggcagaaccagagaaacacacguugugguacauuaccuggua

SEQ ID NO: 12415 - RNA, 54 nt, Artificial Sequence
  Description of Artificial Sequence:  Enzymatic Nucleic Acid
ccgggccaagaagaagucaccagagaaacacacguugugguacauuaccuggua

SEQ ID NO: 12416 - RNA, 54 nt, Artificial Sequence
  Description of Artificial Sequence:  Enzymatic Nucleic Acid
cugacauaagaagggucuaccagagaaacacacguugugguacauuaccuggua

SEQ ID NO: 12417 - RNA, 54 nt, Artificial Sequence
  Description of Artificial Sequence:  Enzymatic Nucleic Acid
caaagggaagaaggcaucaccagagaaacacacguugugguacauuaccuggua

SEQ ID NO: 12418 - RNA, 54 nt, Artificial Sequence
  Description of Artificial Sequence:  Enzymatic Nucleic Acid
guaguguaagaaggagccaccagagaaacacacguugugguacauuaccuggua

SEQ ID NO: 12419 - RNA, 54 nt, Artificial Sequence
  Description of Artificial Sequence:  Enzymatic Nucleic Acid
cucaugccagaaguccagaccagagaaacacacguugugguacauuaccuggua

SEQ ID NO: 12420 - RNA, 54 nt, Artificial Sequence
  Description of Artificial Sequence:  Enzymatic Nucleic Acid
gugagguaagaagggagaaccagagaaacacacguugugguacauuaccuggua

SEQ ID NO: 12421 - RNA, 54 nt, Artificial Sequence
  Description of Artificial Sequence:  Enzymatic Nucleic Acid
uggcugucagaagggaucaccagagaaacacacguugugguacauuaccuggua

SEQ ID NO: 12422 - RNA, 54 nt, Artificial Sequence
  Description of Artificial Sequence:  Enzymatic Nucleic Acid
agccacugagaagguuggaccagagaaacacacguugugguacauuaccuggua

SEQ ID NO: 12423 - RNA, 54 nt, Artificial Sequence
  Description of Artificial Sequence:  Enzymatic Nucleic Acid
gauacccaagaagguagcaccagagaaacacacguugugguacauuaccuggua

SEQ ID NO: 12424 - RNA, 54 nt, Artificial Sequence
  Description of Artificial Sequence:  Enzymatic Nucleic Acid
ucagcgugagaagcagcaaccagagaaacacacguugugguacauuaccuggua

SEQ ID NO: 12425 - RNA, 54 nt, Artificial Sequence
  Description of Artificial Sequence:  Enzymatic Nucleic Acid
gucccugaagaagcgugaaccagagaaacacacguugugguacauuaccuggua

SEQ ID NO: 12426 - RNA, 54 nt, Artificial Sequence
  Description of Artificial Sequence:  Enzymatic Nucleic Acid
aggaggugagaagcagugaccagagaaacacacguugugguacauuaccuggua

SEQ ID NO: 12427 - RNA, 54 nt, Artificial Sequence
  Description of Artificial Sequence:  Enzymatic Nucleic Acid
uccauuuaagaaggagguaccagagaaacacacguugugguacauuaccuggua

SEQ ID NO: 12428 - RNA, 54 nt, Artificial Sequence
  Description of Artificial Sequence:  Enzymatic Nucleic Acid
ggagccggagaaggaccaaccagagaaacacacguugugguacauuaccuggua

SEQ ID NO: 12429 - RNA, 54 nt, Artificial Sequence
  Description of Artificial Sequence:  Enzymatic Nucleic Acid
gggggcggagaagggacaaccagagaaacacacguugugguacauuaccuggua

SEQ ID NO: 12430 - RNA, 54 nt, Artificial Sequence
  Description of Artificial Sequence:  Enzymatic Nucleic Acid
gaguugggagaagagccgaccagagaaacacacguugugguacauuaccuggua

SEQ ID NO: 12431 - RNA, 54 nt, Artificial Sequence
  Description of Artificial Sequence:  Enzymatic Nucleic Acid
aaaaucuaagaagcaccuaccagagaaacacacguugugguacauuaccuggua

SEQ ID NO: 12432 - RNA, 54 nt, Artificial Sequence
  Description of Artificial Sequence:  Enzymatic Nucleic Acid
uccuugcaagaagaggucaccagagaaacacacguugugguacauuaccuggua

SEQ ID NO: 12433 - RNA, 54 nt, Artificial Sequence
  Description of Artificial Sequence:  Enzymatic Nucleic Acid
gagaccacagaagggcacaccagagaaacacacguugugguacauuaccuggua

SEQ ID NO: 12434 - RNA, 54 nt, Artificial Sequence
  Description of Artificial Sequence:  Enzymatic Nucleic Acid
ucuuggagagaagaguccaccagagaaacacacguugugguacauuaccuggua

SEQ ID NO: 12435 - RNA, 54 nt, Artificial Sequence
  Description of Artificial Sequence:  Enzymatic Nucleic Acid
ccaagguaagaagacucgaccagagaaacacacguugugguacauuaccuggua

SEQ ID NO: 12436 - RNA, 54 nt, Artificial Sequence
  Description of Artificial Sequence:  Enzymatic Nucleic Acid
caggcuccagaagcucucaccagagaaacacacguugugguacauuaccuggua

SEQ ID NO: 12437 - RNA, 54 nt, Artificial Sequence
  Description of Artificial Sequence:  Enzymatic Nucleic Acid
cacaaugcagaagcaggcaccagagaaacacacguugugguacauuaccuggua

SEQ ID NO: 12438 - RNA, 54 nt, Artificial Sequence
  Description of Artificial Sequence:  Enzymatic Nucleic Acid
acccugccagaagccuuuaccagagaaacacacguugugguacauuaccuggua

SEQ ID NO: 12439 - RNA, 54 nt, Artificial Sequence
  Description of Artificial Sequence:  Enzymatic Nucleic Acid
uguaacccagaagugaagaccagagaaacacacguugugguacauuaccuggua

SEQ ID NO: 12440 - RNA, 54 nt, Artificial Sequence
  Description of Artificial Sequence:  Enzymatic Nucleic Acid
acguaagaagaaggaaggaccagagaaacacacguugugguacauuaccuggua

SEQ ID NO: 12441 - RNA, 54 nt, Artificial Sequence
  Description of Artificial Sequence:  Enzymatic Nucleic Acid
aaggagcaagaagcaucaaccagagaaacacacguugugguacauuaccuggua

SEQ ID NO: 12442 - RNA, 54 nt, Artificial Sequence
  Description of Artificial Sequence:  Enzymatic Nucleic Acid
ucggccccagaaggagccaccagagaaacacacguugugguacauuaccuggua

SEQ ID NO: 12443 - RNA, 54 nt, Artificial Sequence
  Description of Artificial Sequence:  Enzymatic Nucleic Acid
cuccacccagaagaaaccaccagagaaacacacguugugguacauuaccuggua

SEQ ID NO: 12444 - RNA, 54 nt, Artificial Sequence
  Description of Artificial Sequence:  Enzymatic Nucleic Acid
uuucugccagaaggaagcaccagagaaacacacguugugguacauuaccuggua

SEQ ID NO: 12445 - RNA, 54 nt, Artificial Sequence
  Description of Artificial Sequence:  Enzymatic Nucleic Acid
auuucgaaagaaggcuagaccagagaaacacacguugugguacauuaccuggua

SEQ ID NO: 12446 - RNA, 54 nt, Artificial Sequence
  Description of Artificial Sequence:  Enzymatic Nucleic Acid
agcacacaagaagaaaccaccagagaaacacacguugugguacauuaccuggua

SEQ ID NO: 12447 - RNA, 38 nt, Artificial Sequence
  Description of Artificial Sequence:  Enzymatic Nucleic Acid
gugagcaacugaugaggccguuaggccgaaacgcggcc

SEQ ID NO: 12448 - RNA, 38 nt, Artificial Sequence
  Description of Artificial Sequence:  Enzymatic Nucleic Acid
uggugagccugaugaggccguuaggccgaaagacgcgg

SEQ ID NO: 12449 - RNA, 38 nt, Artificial Sequence
  Description of Artificial Sequence:  Enzymatic Nucleic Acid
accauggucugaugaggccguuaggccgaaagcaagac

SEQ ID NO: 12450 - RNA, 38 nt, Artificial Sequence
  Description of Artificial Sequence:  Enzymatic Nucleic Acid
cagcagcucugaugaggccguuaggccgaaaccauggu

SEQ ID NO: 12451 - RNA, 38 nt, Artificial Sequence
  Description of Artificial Sequence:  Enzymatic Nucleic Acid
uaaggcaacugaugaggccguuaggccgaaaccgcggu

SEQ ID NO: 12452 - RNA, 38 nt, Artificial Sequence
  Description of Artificial Sequence:  Enzymatic Nucleic Acid
cguaaggccugaugaggccguuaggccgaaagaccgcg

SEQ ID NO: 12453 - RNA, 38 nt, Artificial Sequence
  Description of Artificial Sequence:  Enzymatic Nucleic Acid
cagcgcgucugaugaggccguuaggccgaaaggcaaga

SEQ ID NO: 12454 - RNA, 38 nt, Artificial Sequence
  Description of Artificial Sequence:  Enzymatic Nucleic Acid
gcagcgcgcugaugaggccguuaggccgaaaaggcaag

SEQ ID NO: 12455 - RNA, 38 nt, Artificial Sequence
  Description of Artificial Sequence:  Enzymatic Nucleic Acid
agacaccccugaugaggccguuaggccgaaagcagcgc

SEQ ID NO: 12456 - RNA, 38 nt, Artificial Sequence
  Description of Artificial Sequence:  Enzymatic Nucleic Acid
gagaagcacugaugaggccguuaggccgaaacacccga

SEQ ID NO: 12457 - RNA, 38 nt, Artificial Sequence
  Description of Artificial Sequence:  Enzymatic Nucleic Acid
uauccugucugaugaggccguuaggccgaaagaagcag

SEQ ID NO: 12458 - RNA, 38 nt, Artificial Sequence
  Description of Artificial Sequence:  Enzymatic Nucleic Acid
cugagccacugaugaggccguuaggccgaaauccugug

SEQ ID NO: 12459 - RNA, 38 nt, Artificial Sequence
  Description of Artificial Sequence:  Enzymatic Nucleic Acid
ucgacccucugaugaggccguuaggccgaaagccauau

SEQ ID NO: 12460 - RNA, 38 nt, Artificial Sequence
  Description of Artificial Sequence:  Enzymatic Nucleic Acid
uuaacuuccugaugaggccguuaggccgaaacccugag

SEQ ID NO: 12461 - RNA, 38 nt, Artificial Sequence
  Description of Artificial Sequence:  Enzymatic Nucleic Acid
gcacuuuucugaugaggccguuaggccgaaacuucgac

SEQ ID NO: 12462 - RNA, 38 nt, Artificial Sequence
  Description of Artificial Sequence:  Enzymatic Nucleic Acid
ggcacuuucugaugaggccguuaggccgaaaacuucga

SEQ ID NO: 12463 - RNA, 38 nt, Artificial Sequence
  Description of Artificial Sequence:  Enzymatic Nucleic Acid
gcuugcaucugaugaggccguuaggccgaaacaugcug

SEQ ID NO: 12464 - RNA, 38 nt, Artificial Sequence
  Description of Artificial Sequence:  Enzymatic Nucleic Acid
gagaaagacugaugaggccguuaggccgaaagucuggc

SEQ ID NO: 12465 - RNA, 38 nt, Artificial Sequence
  Description of Artificial Sequence:  Enzymatic Nucleic Acid
uugagaaacugaugaggccguuaggccgaaagagucug

SEQ ID NO: 12466 - RNA, 38 nt, Artificial Sequence
  Description of Artificial Sequence:  Enzymatic Nucleic Acid
acuugagacugaugaggccguuaggccgaaagagaguc

SEQ ID NO: 12467 - RNA, 38 nt, Artificial Sequence
  Description of Artificial Sequence:  Enzymatic Nucleic Acid
cacuugagcugaugaggccguuaggccgaaaagagagu

SEQ ID NO: 12468 - RNA, 38 nt, Artificial Sequence
  Description of Artificial Sequence:  Enzymatic Nucleic Acid
gcacuugacugaugaggccguuaggccgaaaaagagag

SEQ ID NO: 12469 - RNA, 38 nt, Artificial Sequence
  Description of Artificial Sequence:  Enzymatic Nucleic Acid
cugcacuucugaugaggccguuaggccgaaagaaagag

SEQ ID NO: 12470 - RNA, 38 nt, Artificial Sequence
  Description of Artificial Sequence:  Enzymatic Nucleic Acid
gagaccaucugaugaggccguuaggccgaaagugggcu

SEQ ID NO: 12471 - RNA, 38 nt, Artificial Sequence
  Description of Artificial Sequence:  Enzymatic Nucleic Acid
ugggcagacugaugaggccguuaggccgaaaccaugag

SEQ ID NO: 12472 - RNA, 38 nt, Artificial Sequence
  Description of Artificial Sequence:  Enzymatic Nucleic Acid
cgugggcacugaugaggccguuaggccgaaagaccaug

SEQ ID NO: 12473 - RNA, 38 nt, Artificial Sequence
  Description of Artificial Sequence:  Enzymatic Nucleic Acid
gggggagucugaugaggccguuaggccgaaaugcucag

SEQ ID NO: 12474 - RNA, 38 nt, Artificial Sequence
  Description of Artificial Sequence:  Enzymatic Nucleic Acid
cgauggggcugaugaggccguuaggccgaaagugaugc

SEQ ID NO: 12475 - RNA, 38 nt, Artificial Sequence
  Description of Artificial Sequence:  Enzymatic Nucleic Acid
cacaggcccugaugaggccguuaggccgaaauggggga

SEQ ID NO: 12476 - RNA, 38 nt, Artificial Sequence
  Description of Artificial Sequence:  Enzymatic Nucleic Acid
uugccugucugaugaggccguuaggccgaaaucccucc

SEQ ID NO: 12477 - RNA, 38 nt, Artificial Sequence
  Description of Artificial Sequence:  Enzymatic Nucleic Acid
ugcugcagcugaugaggccguuaggccgaaauugccug

SEQ ID NO: 12478 - RNA, 38 nt, Artificial Sequence
  Description of Artificial Sequence:  Enzymatic Nucleic Acid
gugcugcacugaugaggccguuaggccgaaaauugccu

SEQ ID NO: 12479 - RNA, 38 nt, Artificial Sequence
  Description of Artificial Sequence:  Enzymatic Nucleic Acid
ccaagguccugaugaggccguuaggccgaaaggugcug

SEQ ID NO: 12480 - RNA, 38 nt, Artificial Sequence
  Description of Artificial Sequence:  Enzymatic Nucleic Acid
ccgugucccugaugaggccguuaggccgaaaggucaag

SEQ ID NO: 12481 - RNA, 38 nt, Artificial Sequence
  Description of Artificial Sequence:  Enzymatic Nucleic Acid
cagguguacugaugaggccguuaggccgaaaggcccgu

SEQ ID NO: 12482 - RNA, 38 nt, Artificial Sequence
  Description of Artificial Sequence:  Enzymatic Nucleic Acid
uacaggugcugaugaggccguuaggccgaaagaggccc

SEQ ID NO: 12483 - RNA, 38 nt, Artificial Sequence
  Description of Artificial Sequence:  Enzymatic Nucleic Acid
gagguauccugaugaggccguuaggccgaaacaggugu

SEQ ID NO: 12484 - RNA, 38 nt, Artificial Sequence
  Description of Artificial Sequence:  Enzymatic Nucleic Acid
uagggaggcugaugaggccguuaggccgaaaucuacag

SEQ ID NO: 12485 - RNA, 38 nt, Artificial Sequence
  Description of Artificial Sequence:  Enzymatic Nucleic Acid
gauguaggcugaugaggccguuaggccgaaagguaucu

SEQ ID NO: 12486 - RNA, 38 nt, Artificial Sequence
  Description of Artificial Sequence:  Enzymatic Nucleic Acid
aguagaugcugaugaggccguuaggccgaaagggaggu

SEQ ID NO: 12487 - RNA, 38 nt, Artificial Sequence
  Description of Artificial Sequence:  Enzymatic Nucleic Acid
ucgaaguacugaugaggccguuaggccgaaauguaggg

SEQ ID NO: 12488 - RNA, 38 nt, Artificial Sequence
  Description of Artificial Sequence:  Enzymatic Nucleic Acid
cuucgaagcugaugaggccguuaggccgaaagauguag

SEQ ID NO: 12489 - RNA, 38 nt, Artificial Sequence
  Description of Artificial Sequence:  Enzymatic Nucleic Acid
uuucuucgcugaugaggccguuaggccgaaaguagaug

SEQ ID NO: 12490 - RNA, 38 nt, Artificial Sequence
  Description of Artificial Sequence:  Enzymatic Nucleic Acid
uuuucuuccugaugaggccguuaggccgaaaaguagau

SEQ ID NO: 12491 - RNA, 38 nt, Artificial Sequence
  Description of Artificial Sequence:  Enzymatic Nucleic Acid
agauugaacugaugaggccguuaggccgaaauuccgcu

SEQ ID NO: 12492 - RNA, 38 nt, Artificial Sequence
  Description of Artificial Sequence:  Enzymatic Nucleic Acid
guagauugcugaugaggccguuaggccgaaagauuccg

SEQ ID NO: 12493 - RNA, 38 nt, Artificial Sequence
  Description of Artificial Sequence:  Enzymatic Nucleic Acid
uguagauucugaugaggccguuaggccgaaaagauucc

SEQ ID NO: 12494 - RNA, 38 nt, Artificial Sequence
  Description of Artificial Sequence:  Enzymatic Nucleic Acid
aauauguacugaugaggccguuaggccgaaauugaaga

SEQ ID NO: 12495 - RNA, 38 nt, Artificial Sequence
  Description of Artificial Sequence:  Enzymatic Nucleic Acid
caaauaugcugaugaggccguuaggccgaaagauugaa

SEQ ID NO: 12496 - RNA, 38 nt, Artificial Sequence
  Description of Artificial Sequence:  Enzymatic Nucleic Acid
cuaacaaacugaugaggccguuaggccgaaauguagau

SEQ ID NO: 12497 - RNA, 38 nt, Artificial Sequence
  Description of Artificial Sequence:  Enzymatic Nucleic Acid
cacuaacacugaugaggccguuaggccgaaauauguag

SEQ ID NO: 12498 - RNA, 38 nt, Artificial Sequence
  Description of Artificial Sequence:  Enzymatic Nucleic Acid
ucacuaaccugaugaggccguuaggccgaaaauaugua

SEQ ID NO: 12499 - RNA, 38 nt, Artificial Sequence
  Description of Artificial Sequence:  Enzymatic Nucleic Acid
gcaucacucugaugaggccguuaggccgaaacaaauau

SEQ ID NO: 12500 - RNA, 38 nt, Artificial Sequence
  Description of Artificial Sequence:  Enzymatic Nucleic Acid
ugcaucaccugaugaggccguuaggccgaaaacaaaua

SEQ ID NO: 12501 - RNA, 38 nt, Artificial Sequence
  Description of Artificial Sequence:  Enzymatic Nucleic Acid
uaugaaagcugaugaggccguuaggccgaaacucccug

SEQ ID NO: 12502 - RNA, 38 nt, Artificial Sequence
  Description of Artificial Sequence:  Enzymatic Nucleic Acid
cucuaugacugaugaggccguuaggccgaaaggacucc

SEQ ID NO: 12503 - RNA, 38 nt, Artificial Sequence
  Description of Artificial Sequence:  Enzymatic Nucleic Acid
ucucuaugcugaugaggccguuaggccgaaaaggacuc

SEQ ID NO: 12504 - RNA, 38 nt, Artificial Sequence
  Description of Artificial Sequence:  Enzymatic Nucleic Acid
aucucuaucugaugaggccguuaggccgaaaaaggacu

SEQ ID NO: 12505 - RNA, 38 nt, Artificial Sequence
  Description of Artificial Sequence:  Enzymatic Nucleic Acid
ugcaucuccugaugaggccguuaggccgaaaugaaagg

SEQ ID NO: 12506 - RNA, 38 nt, Artificial Sequence
  Description of Artificial Sequence:  Enzymatic Nucleic Acid
aguuugggcugaugaggccguuaggccgaaaugucagu

SEQ ID NO: 12507 - RNA, 38 nt, Artificial Sequence
  Description of Artificial Sequence:  Enzymatic Nucleic Acid
augugcaccugaugaggccguuaggccgaaaguuuggg

SEQ ID NO: 12508 - RNA, 38 nt, Artificial Sequence
  Description of Artificial Sequence:  Enzymatic Nucleic Acid
gggaugaucugaugaggccguuaggccgaaagcugucu

SEQ ID NO: 12509 - RNA, 38 nt, Artificial Sequence
  Description of Artificial Sequence:  Enzymatic Nucleic Acid
caggggaucugaugaggccguuaggccgaaaugagcug

SEQ ID NO: 12510 - RNA, 38 nt, Artificial Sequence
  Description of Artificial Sequence:  Enzymatic Nucleic Acid
cggcagggcugaugaggccguuaggccgaaaugaugag

SEQ ID NO: 12511 - RNA, 38 nt, Artificial Sequence
  Description of Artificial Sequence:  Enzymatic Nucleic Acid
cguugggucugaugaggccguuaggccgaaacgucacc

SEQ ID NO: 12512 - RNA, 38 nt, Artificial Sequence
  Description of Artificial Sequence:  Enzymatic Nucleic Acid
gugacugucugaugaggccguuaggccgaaacguuggg

SEQ ID NO: 12513 - RNA, 38 nt, Artificial Sequence
  Description of Artificial Sequence:  Enzymatic Nucleic Acid
uuuagggucugaugaggccguuaggccgaaacugugac

SEQ ID NO: 12514 - RNA, 38 nt, Artificial Sequence
  Description of Artificial Sequence:  Enzymatic Nucleic Acid
aacuuuuucugaugaggccguuaggccgaaagggugac

SEQ ID NO: 12515 - RNA, 38 nt, Artificial Sequence
  Description of Artificial Sequence:  Enzymatic Nucleic Acid
caaauggacugaugaggccguuaggccgaaacuuuuuu

SEQ ID NO: 12516 - RNA, 38 nt, Artificial Sequence
  Description of Artificial Sequence:  Enzymatic Nucleic Acid
ucaaauggcugaugaggccguuaggccgaaaacuuuuu

SEQ ID NO: 12517 - RNA, 38 nt, Artificial Sequence
  Description of Artificial Sequence:  Enzymatic Nucleic Acid
aucaaaugcugaugaggccguuaggccgaaaaacuuuu

SEQ ID NO: 12518 - RNA, 38 nt, Artificial Sequence
  Description of Artificial Sequence:  Enzymatic Nucleic Acid
gaguaucacugaugaggccguuaggccgaaauggaaac

SEQ ID NO: 12519 - RNA, 38 nt, Artificial Sequence
  Description of Artificial Sequence:  Enzymatic Nucleic Acid
agaguauccugaugaggccguuaggccgaaaauggaaa

SEQ ID NO: 12520 - RNA, 38 nt, Artificial Sequence
  Description of Artificial Sequence:  Enzymatic Nucleic Acid
gguaagagcugaugaggccguuaggccgaaaucaaaug

SEQ ID NO: 12521 - RNA, 38 nt, Artificial Sequence
  Description of Artificial Sequence:  Enzymatic Nucleic Acid
agggguaacugaugaggccguuaggccgaaaguaucaa

SEQ ID NO: 12522 - RNA, 38 nt, Artificial Sequence
  Description of Artificial Sequence:  Enzymatic Nucleic Acid
ucaggggucugaugaggccguuaggccgaaagaguauc

SEQ ID NO: 12523 - RNA, 38 nt, Artificial Sequence
  Description of Artificial Sequence:  Enzymatic Nucleic Acid
aucaggggcugaugaggccguuaggccgaaaagaguau

SEQ ID NO: 12524 - RNA, 38 nt, Artificial Sequence
  Description of Artificial Sequence:  Enzymatic Nucleic Acid
ucccaugucugaugaggccguuaggccgaaauucuuug

SEQ ID NO: 12525 - RNA, 38 nt, Artificial Sequence
  Description of Artificial Sequence:  Enzymatic Nucleic Acid
gccucucccugaugaggccguuaggccgaaacuguccc

SEQ ID NO: 12526 - RNA, 38 nt, Artificial Sequence
  Description of Artificial Sequence:  Enzymatic Nucleic Acid
cuauuauacugaugaggccguuaggccgaaagccucuc

SEQ ID NO: 12527 - RNA, 38 nt, Artificial Sequence
  Description of Artificial Sequence:  Enzymatic Nucleic Acid
gcuauuaucugaugaggccguuaggccgaaaagccucu

SEQ ID NO: 12528 - RNA, 38 nt, Artificial Sequence
  Description of Artificial Sequence:  Enzymatic Nucleic Acid
ugcuauuacugaugaggccguuaggccgaaaaagccuc

SEQ ID NO: 12529 - RNA, 38 nt, Artificial Sequence
  Description of Artificial Sequence:  Enzymatic Nucleic Acid
uuugcuaucugaugaggccguuaggccgaaauaaagcc

SEQ ID NO: 12530 - RNA, 38 nt, Artificial Sequence
  Description of Artificial Sequence:  Enzymatic Nucleic Acid
gcauuugccugaugaggccguuaggccgaaauuauaaa

SEQ ID NO: 12531 - RNA, 38 nt, Artificial Sequence
  Description of Artificial Sequence:  Enzymatic Nucleic Acid
ucucuuugcugaugaggccguuaggccgaaacguugca

SEQ ID NO: 12532 - RNA, 38 nt, Artificial Sequence
  Description of Artificial Sequence:  Enzymatic Nucleic Acid
agcagucccugaugaggccguuaggccgaaaucucuuu

SEQ ID NO: 12533 - RNA, 38 nt, Artificial Sequence
  Description of Artificial Sequence:  Enzymatic Nucleic Acid
ugcccguucugaugaggccguuaggccgaaacgguggc

SEQ ID NO: 12534 - RNA, 38 nt, Artificial Sequence
  Description of Artificial Sequence:  Enzymatic Nucleic Acid
uugucuggcugaugaggccguuaggccgaaacaggugc

SEQ ID NO: 12535 - RNA, 38 nt, Artificial Sequence
  Description of Artificial Sequence:  Enzymatic Nucleic Acid
gggucagacugaugaggccguuaggccgaaaguuuguc

SEQ ID NO: 12536 - RNA, 38 nt, Artificial Sequence
  Description of Artificial Sequence:  Enzymatic Nucleic Acid
augggucacugaugaggccguuaggccgaaauaguuug

SEQ ID NO: 12537 - RNA, 38 nt, Artificial Sequence
  Description of Artificial Sequence:  Enzymatic Nucleic Acid
ggucugcccugaugaggccguuaggccgaaauggguca

SEQ ID NO: 12538 - RNA, 38 nt, Artificial Sequence
  Description of Artificial Sequence:  Enzymatic Nucleic Acid
uaggauugcugaugaggccguuaggccgaaauuggucu

SEQ ID NO: 12539 - RNA, 38 nt, Artificial Sequence
  Description of Artificial Sequence:  Enzymatic Nucleic Acid
acaucuagcugaugaggccguuaggccgaaauuguauu

SEQ ID NO: 12540 - RNA, 38 nt, Artificial Sequence
  Description of Artificial Sequence:  Enzymatic Nucleic Acid
uggacauccugaugaggccguuaggccgaaaggauugu

SEQ ID NO: 12541 - RNA, 38 nt, Artificial Sequence
  Description of Artificial Sequence:  Enzymatic Nucleic Acid
cguauuugcugaugaggccguuaggccgaaacaucuag

SEQ ID NO: 12542 - RNA, 38 nt, Artificial Sequence
  Description of Artificial Sequence:  Enzymatic Nucleic Acid
ggcgggcgcugaugaggccguuaggccgaaauuuggac

SEQ ID NO: 12543 - RNA, 38 nt, Artificial Sequence
  Description of Artificial Sequence:  Enzymatic Nucleic Acid
ugcccgugcugaugaggccguuaggccgaaagcagucu

SEQ ID NO: 12544 - RNA, 38 nt, Artificial Sequence
  Description of Artificial Sequence:  Enzymatic Nucleic Acid
gaggacaacugaugaggccguuaggccgaaagucugcc

SEQ ID NO: 12545 - RNA, 38 nt, Artificial Sequence
  Description of Artificial Sequence:  Enzymatic Nucleic Acid
uugaggaccugaugaggccguuaggccgaaagagucug

SEQ ID NO: 12546 - RNA, 38 nt, Artificial Sequence
  Description of Artificial Sequence:  Enzymatic Nucleic Acid
caguugagcugaugaggccguuaggccgaaacaagagu

SEQ ID NO: 12547 - RNA, 38 nt, Artificial Sequence
  Description of Artificial Sequence:  Enzymatic Nucleic Acid
gugcaguucugaugaggccguuaggccgaaaggacaag

SEQ ID NO: 12548 - RNA, 38 nt, Artificial Sequence
  Description of Artificial Sequence:  Enzymatic Nucleic Acid
cucguauucugaugaggccguuaggccgaaagcuccgu

SEQ ID NO: 12549 - RNA, 38 nt, Artificial Sequence
  Description of Artificial Sequence:  Enzymatic Nucleic Acid
cacccucgcugaugaggccguuaggccgaaauugagcu

SEQ ID NO: 12550 - RNA, 38 nt, Artificial Sequence
  Description of Artificial Sequence:  Enzymatic Nucleic Acid
accagggucugaugaggccguuaggccgaaauuccagc

SEQ ID NO: 12551 - RNA, 38 nt, Artificial Sequence
  Description of Artificial Sequence:  Enzymatic Nucleic Acid
uaccagggcugaugaggccguuaggccgaaaauuccag

SEQ ID NO: 12552 - RNA, 38 nt, Artificial Sequence
  Description of Artificial Sequence:  Enzymatic Nucleic Acid
aguugcuucugaugaggccguuaggccgaaaccagggu

SEQ ID NO: 12553 - RNA, 38 nt, Artificial Sequence
  Description of Artificial Sequence:  Enzymatic Nucleic Acid
ugcucucucugaugaggccguuaggccgaaaguugcuu

SEQ ID NO: 12554 - RNA, 38 nt, Artificial Sequence
  Description of Artificial Sequence:  Enzymatic Nucleic Acid
gccuuauacugaugaggccguuaggccgaaaugcucuc

SEQ ID NO: 12555 - RNA, 38 nt, Artificial Sequence
  Description of Artificial Sequence:  Enzymatic Nucleic Acid
cugccuuacugaugaggccguuaggccgaaagaugcuc

SEQ ID NO: 12556 - RNA, 38 nt, Artificial Sequence
  Description of Artificial Sequence:  Enzymatic Nucleic Acid
cgcugccucugaugaggccguuaggccgaaauagaugc

SEQ ID NO: 12557 - RNA, 38 nt, Artificial Sequence
  Description of Artificial Sequence:  Enzymatic Nucleic Acid
cuccgguccugaugaggccguuaggccgaaauccgcug

SEQ ID NO: 12558 - RNA, 38 nt, Artificial Sequence
  Description of Artificial Sequence:  Enzymatic Nucleic Acid
guugugggcugaugaggccguuaggccgaaauggcucc

SEQ ID NO: 12559 - RNA, 38 nt, Artificial Sequence
  Description of Artificial Sequence:  Enzymatic Nucleic Acid
uguuguggcugaugaggccguuaggccgaaaauggcuc

SEQ ID NO: 12560 - RNA, 38 nt, Artificial Sequence
  Description of Artificial Sequence:  Enzymatic Nucleic Acid
cacuguggcugaugaggccguuaggccgaaacacauug

SEQ ID NO: 12561 - RNA, 38 nt, Artificial Sequence
  Description of Artificial Sequence:  Enzymatic Nucleic Acid
acacugugcugaugaggccguuaggccgaaaacacauu

SEQ ID NO: 12562 - RNA, 38 nt, Artificial Sequence
  Description of Artificial Sequence:  Enzymatic Nucleic Acid
aucuuaagcugaugaggccguuaggccgaaacacugug

SEQ ID NO: 12563 - RNA, 38 nt, Artificial Sequence
  Description of Artificial Sequence:  Enzymatic Nucleic Acid
gaucuuaacugaugaggccguuaggccgaaaacacugu

SEQ ID NO: 12564 - RNA, 38 nt, Artificial Sequence
  Description of Artificial Sequence:  Enzymatic Nucleic Acid
uugaucuucugaugaggccguuaggccgaaagaacacu

SEQ ID NO: 12565 - RNA, 38 nt, Artificial Sequence
  Description of Artificial Sequence:  Enzymatic Nucleic Acid
guugaucucugaugaggccguuaggccgaaaagaacac

SEQ ID NO: 12566 - RNA, 38 nt, Artificial Sequence
  Description of Artificial Sequence:  Enzymatic Nucleic Acid
acauuguucugaugaggccguuaggccgaaaucuuaag

SEQ ID NO: 12567 - RNA, 38 nt, Artificial Sequence
  Description of Artificial Sequence:  Enzymatic Nucleic Acid
cagguguacugaugaggccguuaggccgaaagccccuu

SEQ ID NO: 12568 - RNA, 38 nt, Artificial Sequence
  Description of Artificial Sequence:  Enzymatic Nucleic Acid
gacaggugcugaugaggccguuaggccgaaagagcccc

SEQ ID NO: 12569 - RNA, 38 nt, Artificial Sequence
  Description of Artificial Sequence:  Enzymatic Nucleic Acid
cuucacgccugaugaggccguuaggccgaaacaggugu

SEQ ID NO: 12570 - RNA, 38 nt, Artificial Sequence
  Description of Artificial Sequence:  Enzymatic Nucleic Acid
ggaacgagcugaugaggccguuaggccgaaacccacuc

SEQ ID NO: 12571 - RNA, 38 nt, Artificial Sequence
  Description of Artificial Sequence:  Enzymatic Nucleic Acid
acuggaaccugaugaggccguuaggccgaaaggaccca

SEQ ID NO: 12572 - RNA, 38 nt, Artificial Sequence
  Description of Artificial Sequence:  Enzymatic Nucleic Acid
aagacuggcugaugaggccguuaggccgaaacgaggac

SEQ ID NO: 12573 - RNA, 38 nt, Artificial Sequence
  Description of Artificial Sequence:  Enzymatic Nucleic Acid
aaagacugcugaugaggccguuaggccgaaaacgagga

SEQ ID NO: 12574 - RNA, 38 nt, Artificial Sequence
  Description of Artificial Sequence:  Enzymatic Nucleic Acid
uguugaaacugaugaggccguuaggccgaaacuggaac

SEQ ID NO: 12575 - RNA, 38 nt, Artificial Sequence
  Description of Artificial Sequence:  Enzymatic Nucleic Acid
gguguugacugaugaggccguuaggccgaaagacugga

SEQ ID NO: 12576 - RNA, 38 nt, Artificial Sequence
  Description of Artificial Sequence:  Enzymatic Nucleic Acid
agguguugcugaugaggccguuaggccgaaaagacugg

SEQ ID NO: 12577 - RNA, 38 nt, Artificial Sequence
  Description of Artificial Sequence:  Enzymatic Nucleic Acid
gagguguucugaugaggccguuaggccgaaaaagacug

SEQ ID NO: 12578 - RNA, 38 nt, Artificial Sequence
  Description of Artificial Sequence:  Enzymatic Nucleic Acid
caugcacgcugaugaggccguuaggccgaaagguguug

SEQ ID NO: 12579 - RNA, 38 nt, Artificial Sequence
  Description of Artificial Sequence:  Enzymatic Nucleic Acid
cuuuuucacugaugaggccguuaggccgaaacacaugc

SEQ ID NO: 12580 - RNA, 38 nt, Artificial Sequence
  Description of Artificial Sequence:  Enzymatic Nucleic Acid
cacugaugcugaugaggccguuaggccgaaauccuuuu

SEQ ID NO: 12581 - RNA, 38 nt, Artificial Sequence
  Description of Artificial Sequence:  Enzymatic Nucleic Acid
acacugaucugaugaggccguuaggccgaaaauccuuu

SEQ ID NO: 12582 - RNA, 38 nt, Artificial Sequence
  Description of Artificial Sequence:  Enzymatic Nucleic Acid
uucacacucugaugaggccguuaggccgaaaugaaucc

SEQ ID NO: 12583 - RNA, 38 nt, Artificial Sequence
  Description of Artificial Sequence:  Enzymatic Nucleic Acid
cugcuucccugaugaggccguuaggccgaaauguuuca

SEQ ID NO: 12584 - RNA, 38 nt, Artificial Sequence
  Description of Artificial Sequence:  Enzymatic Nucleic Acid
gccgauagcugaugaggccguuaggccgaaaccgucuu

SEQ ID NO: 12585 - RNA, 38 nt, Artificial Sequence
  Description of Artificial Sequence:  Enzymatic Nucleic Acid
acagccgacugaugaggccguuaggccgaaaggaccgu

SEQ ID NO: 12586 - RNA, 38 nt, Artificial Sequence
  Description of Artificial Sequence:  Enzymatic Nucleic Acid
ggacagcccugaugaggccguuaggccgaaauaggacc

SEQ ID NO: 12587 - RNA, 38 nt, Artificial Sequence
  Description of Artificial Sequence:  Enzymatic Nucleic Acid
cuuucaugcugaugaggccguuaggccgaaacagccga

SEQ ID NO: 12588 - RNA, 38 nt, Artificial Sequence
  Description of Artificial Sequence:  Enzymatic Nucleic Acid
gggaggggcugaugaggccguuaggccgaaaggccuuc

SEQ ID NO: 12589 - RNA, 38 nt, Artificial Sequence
  Description of Artificial Sequence:  Enzymatic Nucleic Acid
ggggagggcugaugaggccguuaggccgaaaaggccuu

SEQ ID NO: 12590 - RNA, 38 nt, Artificial Sequence
  Description of Artificial Sequence:  Enzymatic Nucleic Acid
uuucugggcugaugaggccguuaggccgaaaggggaag

SEQ ID NO: 12591 - RNA, 38 nt, Artificial Sequence
  Description of Artificial Sequence:  Enzymatic Nucleic Acid
aaccauaccugaugaggccguuaggccgaaauuucugg

SEQ ID NO: 12592 - RNA, 38 nt, Artificial Sequence
  Description of Artificial Sequence:  Enzymatic Nucleic Acid
uuuaaccacugaugaggccguuaggccgaaacgauuuc

SEQ ID NO: 12593 - RNA, 38 nt, Artificial Sequence
  Description of Artificial Sequence:  Enzymatic Nucleic Acid
caucuuuucugaugaggccguuaggccgaaaccauacg

SEQ ID NO: 12594 - RNA, 38 nt, Artificial Sequence
  Description of Artificial Sequence:  Enzymatic Nucleic Acid
uugcaggccugaugaggccguuaggccgaaagccaucu

SEQ ID NO: 12595 - RNA, 38 nt, Artificial Sequence
  Description of Artificial Sequence:  Enzymatic Nucleic Acid
cagacuuccugaugaggccguuaggccgaaauguugca

SEQ ID NO: 12596 - RNA, 38 nt, Artificial Sequence
  Description of Artificial Sequence:  Enzymatic Nucleic Acid
agcgagcacugaugaggccguuaggccgaaacuucaau

SEQ ID NO: 12597 - RNA, 38 nt, Artificial Sequence
  Description of Artificial Sequence:  Enzymatic Nucleic Acid
caaauagccugaugaggccguuaggccgaaagcagacu

SEQ ID NO: 12598 - RNA, 38 nt, Artificial Sequence
  Description of Artificial Sequence:  Enzymatic Nucleic Acid
guaccaaacugaugaggccguuaggccgaaagcgagca

SEQ ID NO: 12599 - RNA, 38 nt, Artificial Sequence
  Description of Artificial Sequence:  Enzymatic Nucleic Acid
auguaccacugaugaggccguuaggccgaaauagcgag

SEQ ID NO: 12600 - RNA, 38 nt, Artificial Sequence
  Description of Artificial Sequence:  Enzymatic Nucleic Acid
cauguacccugaugaggccguuaggccgaaaauagcga

SEQ ID NO: 12601 - RNA, 38 nt, Artificial Sequence
  Description of Artificial Sequence:  Enzymatic Nucleic Acid
uagccaugcugaugaggccguuaggccgaaaccaaaua

SEQ ID NO: 12602 - RNA, 38 nt, Artificial Sequence
  Description of Artificial Sequence:  Enzymatic Nucleic Acid
uuaaugagcugaugaggccguuaggccgaaagccaugu

SEQ ID NO: 12603 - RNA, 38 nt, Artificial Sequence
  Description of Artificial Sequence:  Enzymatic Nucleic Acid
uaauuaaucugaugaggccguuaggccgaaaguagcca

SEQ ID NO: 12604 - RNA, 38 nt, Artificial Sequence
  Description of Artificial Sequence:  Enzymatic Nucleic Acid
ugauaauucugaugaggccguuaggccgaaaugaguag

SEQ ID NO: 12605 - RNA, 38 nt, Artificial Sequence
  Description of Artificial Sequence:  Enzymatic Nucleic Acid
uugauaaucugaugaggccguuaggccgaaaaugagua

SEQ ID NO: 12606 - RNA, 38 nt, Artificial Sequence
  Description of Artificial Sequence:  Enzymatic Nucleic Acid
ucuuugaucugaugaggccguuaggccgaaauuaauga

SEQ ID NO: 12607 - RNA, 38 nt, Artificial Sequence
  Description of Artificial Sequence:  Enzymatic Nucleic Acid
aucuuugacugaugaggccguuaggccgaaaauuaaug

SEQ ID NO: 12608 - RNA, 38 nt, Artificial Sequence
  Description of Artificial Sequence:  Enzymatic Nucleic Acid
acaucuuucugaugaggccguuaggccgaaauaauuaa

SEQ ID NO: 12609 - RNA, 38 nt, Artificial Sequence
  Description of Artificial Sequence:  Enzymatic Nucleic Acid
agaucguacugaugaggccguuaggccgaaaguccccu

SEQ ID NO: 12610 - RNA, 38 nt, Artificial Sequence
  Description of Artificial Sequence:  Enzymatic Nucleic Acid
caagaucgcugaugaggccguuaggccgaaauaguccc

SEQ ID NO: 12611 - RNA, 38 nt, Artificial Sequence
  Description of Artificial Sequence:  Enzymatic Nucleic Acid
cccagcaacugaugaggccguuaggccgaaaucguaua

SEQ ID NO: 12612 - RNA, 38 nt, Artificial Sequence
  Description of Artificial Sequence:  Enzymatic Nucleic Acid
ugcccagccugaugaggccguuaggccgaaagaucgua

SEQ ID NO: 12613 - RNA, 38 nt, Artificial Sequence
  Description of Artificial Sequence:  Enzymatic Nucleic Acid
gacugcuucugaugaggccguuaggccgaaaugcccag

SEQ ID NO: 12614 - RNA, 38 nt, Artificial Sequence
  Description of Artificial Sequence:  Enzymatic Nucleic Acid
auagccuucugaugaggccguuaggccgaaacugcuuu

SEQ ID NO: 12615 - RNA, 38 nt, Artificial Sequence
  Description of Artificial Sequence:  Enzymatic Nucleic Acid
uuuuuaaacugaugaggccguuaggccgaaagccuuga

SEQ ID NO: 12616 - RNA, 38 nt, Artificial Sequence
  Description of Artificial Sequence:  Enzymatic Nucleic Acid
gguuuuuacugaugaggccguuaggccgaaauagccuu

SEQ ID NO: 12617 - RNA, 38 nt, Artificial Sequence
  Description of Artificial Sequence:  Enzymatic Nucleic Acid
agguuuuucugaugaggccguuaggccgaaaauagccu

SEQ ID NO: 12618 - RNA, 38 nt, Artificial Sequence
  Description of Artificial Sequence:  Enzymatic Nucleic Acid
gagguuuucugaugaggccguuaggccgaaaaauagcc

SEQ ID NO: 12619 - RNA, 38 nt, Artificial Sequence
  Description of Artificial Sequence:  Enzymatic Nucleic Acid
uacaaugacugaugaggccguuaggccgaaaguggcag

SEQ ID NO: 12620 - RNA, 38 nt, Artificial Sequence
  Description of Artificial Sequence:  Enzymatic Nucleic Acid
uuuacaaucugaugaggccguuaggccgaaagaguggc

SEQ ID NO: 12621 - RNA, 38 nt, Artificial Sequence
  Description of Artificial Sequence:  Enzymatic Nucleic Acid
acguuuaccugaugaggccguuaggccgaaaugagagu

SEQ ID NO: 12622 - RNA, 38 nt, Artificial Sequence
  Description of Artificial Sequence:  Enzymatic Nucleic Acid
uucacguucugaugaggccguuaggccgaaacaaugag

SEQ ID NO: 12623 - RNA, 38 nt, Artificial Sequence
  Description of Artificial Sequence:  Enzymatic Nucleic Acid
guagaucucugaugaggccguuaggccgaaagguuuca

SEQ ID NO: 12624 - RNA, 38 nt, Artificial Sequence
  Description of Artificial Sequence:  Enzymatic Nucleic Acid
uuuucguacugaugaggccguuaggccgaaaucugagg

SEQ ID NO: 12625 - RNA, 38 nt, Artificial Sequence
  Description of Artificial Sequence:  Enzymatic Nucleic Acid
acuuuucgcugaugaggccguuaggccgaaagaucuga

SEQ ID NO: 12626 - RNA, 38 nt, Artificial Sequence
  Description of Artificial Sequence:  Enzymatic Nucleic Acid
aggacacgcugaugaggccguuaggccgaaacuuuucg

SEQ ID NO: 12627 - RNA, 38 nt, Artificial Sequence
  Description of Artificial Sequence:  Enzymatic Nucleic Acid
gaagcgagcugaugaggccguuaggccgaaacacggac

SEQ ID NO: 12628 - RNA, 38 nt, Artificial Sequence
  Description of Artificial Sequence:  Enzymatic Nucleic Acid
uuggaagccugaugaggccguuaggccgaaaggacacg

SEQ ID NO: 12629 - RNA, 38 nt, Artificial Sequence
  Description of Artificial Sequence:  Enzymatic Nucleic Acid
gggcuuggcugaugaggccguuaggccgaaagcgagga

SEQ ID NO: 12630 - RNA, 38 nt, Artificial Sequence
  Description of Artificial Sequence:  Enzymatic Nucleic Acid
ugggcuugcugaugaggccguuaggccgaaaagcgagg

SEQ ID NO: 12631 - RNA, 38 nt, Artificial Sequence
  Description of Artificial Sequence:  Enzymatic Nucleic Acid
cggauagacugaugaggccguuaggccgaaaggugggc

SEQ ID NO: 12632 - RNA, 38 nt, Artificial Sequence
  Description of Artificial Sequence:  Enzymatic Nucleic Acid
agcggauacugaugaggccguuaggccgaaagaggugg

SEQ ID NO: 12633 - RNA, 38 nt, Artificial Sequence
  Description of Artificial Sequence:  Enzymatic Nucleic Acid
ccagcggacugaugaggccguuaggccgaaagagaggu

SEQ ID NO: 12634 - RNA, 38 nt, Artificial Sequence
  Description of Artificial Sequence:  Enzymatic Nucleic Acid
gcccagcgcugaugaggccguuaggccgaaauagagag

SEQ ID NO: 12635 - RNA, 38 nt, Artificial Sequence
  Description of Artificial Sequence:  Enzymatic Nucleic Acid
caagugagcugaugaggccguuaggccgaaacuugucu

SEQ ID NO: 12636 - RNA, 38 nt, Artificial Sequence
  Description of Artificial Sequence:  Enzymatic Nucleic Acid
gugcaagucugaugaggccguuaggccgaaaggacuug

SEQ ID NO: 12637 - RNA, 38 nt, Artificial Sequence
  Description of Artificial Sequence:  Enzymatic Nucleic Acid
cacggugccugaugaggccguuaggccgaaagugagga

SEQ ID NO: 12638 - RNA, 38 nt, Artificial Sequence
  Description of Artificial Sequence:  Enzymatic Nucleic Acid
ggaugccacugaugaggccguuaggccgaaacacggug

SEQ ID NO: 12639 - RNA, 38 nt, Artificial Sequence
  Description of Artificial Sequence:  Enzymatic Nucleic Acid
ggccgaggcugaugaggccguuaggccgaaaugccaua

SEQ ID NO: 12640 - RNA, 38 nt, Artificial Sequence
  Description of Artificial Sequence:  Enzymatic Nucleic Acid
uguuggcccugaugaggccguuaggccgaaagggaugc

SEQ ID NO: 12641 - RNA, 38 nt, Artificial Sequence
  Description of Artificial Sequence:  Enzymatic Nucleic Acid
agccacgucugaugaggccguuaggccgaaauuguugg

SEQ ID NO: 12642 - RNA, 38 nt, Artificial Sequence
  Description of Artificial Sequence:  Enzymatic Nucleic Acid
gggugccacugaugaggccguuaggccgaaagccacgu

SEQ ID NO: 12643 - RNA, 38 nt, Artificial Sequence
  Description of Artificial Sequence:  Enzymatic Nucleic Acid
auuguggucugaugaggccguuaggccgaaacaggggu

SEQ ID NO: 12644 - RNA, 38 nt, Artificial Sequence
  Description of Artificial Sequence:  Enzymatic Nucleic Acid
uuuggagucugaugaggccguuaggccgaaauuguggu

SEQ ID NO: 12645 - RNA, 38 nt, Artificial Sequence
  Description of Artificial Sequence:  Enzymatic Nucleic Acid
uuucuuugcugaugaggccguuaggccgaaagugauug

SEQ ID NO: 12646 - RNA, 38 nt, Artificial Sequence
  Description of Artificial Sequence:  Enzymatic Nucleic Acid
agaagucacugaugaggccguuaggccgaaaccuuucu

SEQ ID NO: 12647 - RNA, 38 nt, Artificial Sequence
  Description of Artificial Sequence:  Enzymatic Nucleic Acid
cagugcagcugaugaggccguuaggccgaaagucauac

SEQ ID NO: 12648 - RNA, 38 nt, Artificial Sequence
  Description of Artificial Sequence:  Enzymatic Nucleic Acid
ucagugcacugaugaggccguuaggccgaaaagucaua

SEQ ID NO: 12649 - RNA, 38 nt, Artificial Sequence
  Description of Artificial Sequence:  Enzymatic Nucleic Acid
ggauaaagcugaugaggccguuaggccgaaauucuuca

SEQ ID NO: 12650 - RNA, 38 nt, Artificial Sequence
  Description of Artificial Sequence:  Enzymatic Nucleic Acid
ccaggauacugaugaggccguuaggccgaaaggauucu

SEQ ID NO: 12651 - RNA, 38 nt, Artificial Sequence
  Description of Artificial Sequence:  Enzymatic Nucleic Acid
uccaggaucugaugaggccguuaggccgaaaaggauuc

SEQ ID NO: 12652 - RNA, 38 nt, Artificial Sequence
  Description of Artificial Sequence:  Enzymatic Nucleic Acid
auccaggacugaugaggccguuaggccgaaaaaggauu

SEQ ID NO: 12653 - RNA, 38 nt, Artificial Sequence
  Description of Artificial Sequence:  Enzymatic Nucleic Acid
ggauccagcugaugaggccguuaggccgaaauaaagga

SEQ ID NO: 12654 - RNA, 38 nt, Artificial Sequence
  Description of Artificial Sequence:  Enzymatic Nucleic Acid
gcugcuggcugaugaggccguuaggccgaaauccagga

SEQ ID NO: 12655 - RNA, 38 nt, Artificial Sequence
  Description of Artificial Sequence:  Enzymatic Nucleic Acid
uguuuccucugaugaggccguuaggccgaaaguugcug

SEQ ID NO: 12656 - RNA, 38 nt, Artificial Sequence
  Description of Artificial Sequence:  Enzymatic Nucleic Acid
cuguuucccugaugaggccguuaggccgaaaaguugcu

SEQ ID NO: 12657 - RNA, 38 nt, Artificial Sequence
  Description of Artificial Sequence:  Enzymatic Nucleic Acid
cgcugagacugaugaggccguuaggccgaaaugcucuc

SEQ ID NO: 12658 - RNA, 38 nt, Artificial Sequence
  Description of Artificial Sequence:  Enzymatic Nucleic Acid
ugcgcugacugaugaggccguuaggccgaaagaugcuc

SEQ ID NO: 12659 - RNA, 38 nt, Artificial Sequence
  Description of Artificial Sequence:  Enzymatic Nucleic Acid
caugcgcucugaugaggccguuaggccgaaagagaugc

SEQ ID NO: 12660 - RNA, 38 nt, Artificial Sequence
  Description of Artificial Sequence:  Enzymatic Nucleic Acid
ccuucuaucugaugaggccguuaggccgaaaccgucau

SEQ ID NO: 12661 - RNA, 38 nt, Artificial Sequence
  Description of Artificial Sequence:  Enzymatic Nucleic Acid
guuccuuccugaugaggccguuaggccgaaaugaccgu

SEQ ID NO: 12662 - RNA, 38 nt, Artificial Sequence
  Description of Artificial Sequence:  Enzymatic Nucleic Acid
aaccgucucugaugaggccguuaggccgaaauuuguuc

SEQ ID NO: 12663 - RNA, 38 nt, Artificial Sequence
  Description of Artificial Sequence:  Enzymatic Nucleic Acid
aaugugcucugaugaggccguuaggccgaaaccgucuu

SEQ ID NO: 12664 - RNA, 38 nt, Artificial Sequence
  Description of Artificial Sequence:  Enzymatic Nucleic Acid
caaugugccugaugaggccguuaggccgaaaaccgucu

SEQ ID NO: 12665 - RNA, 38 nt, Artificial Sequence
  Description of Artificial Sequence:  Enzymatic Nucleic Acid
ccaccacccugaugaggccguuaggccgaaaugugcua

SEQ ID NO: 12666 - RNA, 38 nt, Artificial Sequence
  Description of Artificial Sequence:  Enzymatic Nucleic Acid
gggucugacugaugaggccguuaggccgaaagucagcc

SEQ ID NO: 12667 - RNA, 38 nt, Artificial Sequence
  Description of Artificial Sequence:  Enzymatic Nucleic Acid
aggggucucugaugaggccguuaggccgaaagagucag

SEQ ID NO: 12668 - RNA, 38 nt, Artificial Sequence
  Description of Artificial Sequence:  Enzymatic Nucleic Acid
cagcuguacugaugaggccguuaggccgaaauuccagg

SEQ ID NO: 12669 - RNA, 38 nt, Artificial Sequence
  Description of Artificial Sequence:  Enzymatic Nucleic Acid
ggcagcugcugaugaggccguuaggccgaaagauucca

SEQ ID NO: 12670 - RNA, 38 nt, Artificial Sequence
  Description of Artificial Sequence:  Enzymatic Nucleic Acid
uuuuauugcugaugaggccguuaggccgaaaggcccgg

SEQ ID NO: 12671 - RNA, 38 nt, Artificial Sequence
  Description of Artificial Sequence:  Enzymatic Nucleic Acid
auuuuauucugaugaggccguuaggccgaaaaggcccg

SEQ ID NO: 12672 - RNA, 38 nt, Artificial Sequence
  Description of Artificial Sequence:  Enzymatic Nucleic Acid
cccuauuucugaugaggccguuaggccgaaauugaagg

SEQ ID NO: 12673 - RNA, 38 nt, Artificial Sequence
  Description of Artificial Sequence:  Enzymatic Nucleic Acid
acaguccccugaugaggccguuaggccgaaauuuuauu

SEQ ID NO: 12674 - RNA, 38 nt, Artificial Sequence
  Description of Artificial Sequence:  Enzymatic Nucleic Acid
uaaaauuucugaugaggccguuaggccgaaauguuucu

SEQ ID NO: 12675 - RNA, 38 nt, Artificial Sequence
  Description of Artificial Sequence:  Enzymatic Nucleic Acid
ugacauaacugaugaggccguuaggccgaaauuuuaug

SEQ ID NO: 12676 - RNA, 38 nt, Artificial Sequence
  Description of Artificial Sequence:  Enzymatic Nucleic Acid
gugacauacugaugaggccguuaggccgaaaauuuuau

SEQ ID NO: 12677 - RNA, 38 nt, Artificial Sequence
  Description of Artificial Sequence:  Enzymatic Nucleic Acid
ugugacaucugaugaggccguuaggccgaaaaauuuua

SEQ ID NO: 12678 - RNA, 38 nt, Artificial Sequence
  Description of Artificial Sequence:  Enzymatic Nucleic Acid
cugugacacugaugaggccguuaggccgaaaaaauuuu

SEQ ID NO: 12679 - RNA, 38 nt, Artificial Sequence
  Description of Artificial Sequence:  Enzymatic Nucleic Acid
acaucugucugaugaggccguuaggccgaaacauaaaa

SEQ ID NO: 12680 - RNA, 38 nt, Artificial Sequence
  Description of Artificial Sequence:  Enzymatic Nucleic Acid
aaacgugacugaugaggccguuaggccgaaagccauuc

SEQ ID NO: 12681 - RNA, 38 nt, Artificial Sequence
  Description of Artificial Sequence:  Enzymatic Nucleic Acid
gaaacgugcugaugaggccguuaggccgaaaagccauu

SEQ ID NO: 12682 - RNA, 38 nt, Artificial Sequence
  Description of Artificial Sequence:  Enzymatic Nucleic Acid
ggaaacgucugaugaggccguuaggccgaaaaagccau

SEQ ID NO: 12683 - RNA, 38 nt, Artificial Sequence
  Description of Artificial Sequence:  Enzymatic Nucleic Acid
uccaaggacugaugaggccguuaggccgaaacgugaaa

SEQ ID NO: 12684 - RNA, 38 nt, Artificial Sequence
  Description of Artificial Sequence:  Enzymatic Nucleic Acid
uuccaaggcugaugaggccguuaggccgaaaacgugaa

SEQ ID NO: 12685 - RNA, 38 nt, Artificial Sequence
  Description of Artificial Sequence:  Enzymatic Nucleic Acid
uuuccaagcugaugaggccguuaggccgaaaaacguga

SEQ ID NO: 12686 - RNA, 38 nt, Artificial Sequence
  Description of Artificial Sequence:  Enzymatic Nucleic Acid
ucuuuucccugaugaggccguuaggccgaaaggaaacg

SEQ ID NO: 12687 - RNA, 38 nt, Artificial Sequence
  Description of Artificial Sequence:  Enzymatic Nucleic Acid
ccacacagcugaugaggccguuaggccgaaacaguuuc

SEQ ID NO: 12688 - RNA, 38 nt, Artificial Sequence
  Description of Artificial Sequence:  Enzymatic Nucleic Acid
aauuuauucugaugaggccguuaggccgaaaccacaca

SEQ ID NO: 12689 - RNA, 38 nt, Artificial Sequence
  Description of Artificial Sequence:  Enzymatic Nucleic Acid
caggaauucugaugaggccguuaggccgaaauugacca

SEQ ID NO: 12690 - RNA, 38 nt, Artificial Sequence
  Description of Artificial Sequence:  Enzymatic Nucleic Acid
uguacaggcugaugaggccguuaggccgaaauuuauug

SEQ ID NO: 12691 - RNA, 38 nt, Artificial Sequence
  Description of Artificial Sequence:  Enzymatic Nucleic Acid
cuguacagcugaugaggccguuaggccgaaaauuuauu

SEQ ID NO: 12692 - RNA, 38 nt, Artificial Sequence
  Description of Artificial Sequence:  Enzymatic Nucleic Acid
ugucucugcugaugaggccguuaggccgaaacaggaau

SEQ ID NO: 12693 - RNA, 38 nt, Artificial Sequence
  Description of Artificial Sequence:  Enzymatic Nucleic Acid
auccaggucugaugaggccguuaggccgaaaugucucu

SEQ ID NO: 12694 - RNA, 38 nt, Artificial Sequence
  Description of Artificial Sequence:  Enzymatic Nucleic Acid
aauccaggcugaugaggccguuaggccgaaaaugucuc

SEQ ID NO: 12695 - RNA, 38 nt, Artificial Sequence
  Description of Artificial Sequence:  Enzymatic Nucleic Acid
cguagcagcugaugaggccguuaggccgaaauccaggu

SEQ ID NO: 12696 - RNA, 38 nt, Artificial Sequence
  Description of Artificial Sequence:  Enzymatic Nucleic Acid
ccguagcacugaugaggccguuaggccgaaaauccagg

SEQ ID NO: 12697 - RNA, 38 nt, Artificial Sequence
  Description of Artificial Sequence:  Enzymatic Nucleic Acid
acuguccgcugaugaggccguuaggccgaaagcagaau

SEQ ID NO: 12698 - RNA, 38 nt, Artificial Sequence
  Description of Artificial Sequence:  Enzymatic Nucleic Acid
cuguuguucugaugaggccguuaggccgaaacuguccg

SEQ ID NO: 12699 - RNA, 38 nt, Artificial Sequence
  Description of Artificial Sequence:  Enzymatic Nucleic Acid
ucuguugucugaugaggccguuaggccgaaaacugucc

SEQ ID NO: 12700 - RNA, 38 nt, Artificial Sequence
  Description of Artificial Sequence:  Enzymatic Nucleic Acid
gcugauaccugaugaggccguuaggccgaaauggugca

SEQ ID NO: 12701 - RNA, 38 nt, Artificial Sequence
  Description of Artificial Sequence:  Enzymatic Nucleic Acid
cuugcugacugaugaggccguuaggccgaaacuauggu

SEQ ID NO: 12702 - RNA, 38 nt, Artificial Sequence
  Description of Artificial Sequence:  Enzymatic Nucleic Acid
ugcuugcucugaugaggccguuaggccgaaauacuaug

SEQ ID NO: 12703 - RNA, 38 nt, Artificial Sequence
  Description of Artificial Sequence:  Enzymatic Nucleic Acid
guaaucuucugaugaggccguuaggccgaaaguggugg

SEQ ID NO: 12704 - RNA, 38 nt, Artificial Sequence
  Description of Artificial Sequence:  Enzymatic Nucleic Acid
gauggagucugaugaggccguuaggccgaaaucuugag

SEQ ID NO: 12705 - RNA, 38 nt, Artificial Sequence
  Description of Artificial Sequence:  Enzymatic Nucleic Acid
ugauggagcugaugaggccguuaggccgaaaaucuuga

SEQ ID NO: 12706 - RNA, 38 nt, Artificial Sequence
  Description of Artificial Sequence:  Enzymatic Nucleic Acid
gagugaugcugaugaggccguuaggccgaaaguaaucu

SEQ ID NO: 12707 - RNA, 38 nt, Artificial Sequence
  Description of Artificial Sequence:  Enzymatic Nucleic Acid
uucagagucugaugaggccguuaggccgaaauggagua

SEQ ID NO: 12708 - RNA, 38 nt, Artificial Sequence
  Description of Artificial Sequence:  Enzymatic Nucleic Acid
aagguucacugaugaggccguuaggccgaaagugaugg

SEQ ID NO: 12709 - RNA, 38 nt, Artificial Sequence
  Description of Artificial Sequence:  Enzymatic Nucleic Acid
uugaugaccugaugaggccguuaggccgaaagguucag

SEQ ID NO: 12710 - RNA, 38 nt, Artificial Sequence
  Description of Artificial Sequence:  Enzymatic Nucleic Acid
uucuugaucugaugaggccguuaggccgaaacaagguu

SEQ ID NO: 12711 - RNA, 38 nt, Artificial Sequence
  Description of Artificial Sequence:  Enzymatic Nucleic Acid
acguucuucugaugaggccguuaggccgaaaugacaag

SEQ ID NO: 12712 - RNA, 38 nt, Artificial Sequence
  Description of Artificial Sequence:  Enzymatic Nucleic Acid
cuucuagacugaugaggccguuaggccgaaacacguuc

SEQ ID NO: 12713 - RNA, 38 nt, Artificial Sequence
  Description of Artificial Sequence:  Enzymatic Nucleic Acid
gucuucuacugaugaggccguuaggccgaaagacacgu

SEQ ID NO: 12714 - RNA, 38 nt, Artificial Sequence
  Description of Artificial Sequence:  Enzymatic Nucleic Acid
gagucuuccugaugaggccguuaggccgaaagagacac

SEQ ID NO: 12715 - RNA, 38 nt, Artificial Sequence
  Description of Artificial Sequence:  Enzymatic Nucleic Acid
aggugccccugaugaggccguuaggccgaaagucuucu

SEQ ID NO: 12716 - RNA, 38 nt, Artificial Sequence
  Description of Artificial Sequence:  Enzymatic Nucleic Acid
ugcacgcacugaugaggccguuaggccgaaaggugccc

SEQ ID NO: 12717 - RNA, 38 nt, Artificial Sequence
  Description of Artificial Sequence:  Enzymatic Nucleic Acid
ccuguguacugaugaggccguuaggccgaaauguuccu

SEQ ID NO: 12718 - RNA, 38 nt, Artificial Sequence
  Description of Artificial Sequence:  Enzymatic Nucleic Acid
ccccugugcugaugaggccguuaggccgaaauauguuc

SEQ ID NO: 12719 - RNA, 38 nt, Artificial Sequence
  Description of Artificial Sequence:  Enzymatic Nucleic Acid
uuccgaagcugaugaggccguuaggccgaaaugucuuc

SEQ ID NO: 12720 - RNA, 38 nt, Artificial Sequence
  Description of Artificial Sequence:  Enzymatic Nucleic Acid
gucuuccgcugaugaggccguuaggccgaaaggauguc

SEQ ID NO: 12721 - RNA, 38 nt, Artificial Sequence
  Description of Artificial Sequence:  Enzymatic Nucleic Acid
ugucuucccugaugaggccguuaggccgaaaaggaugu

SEQ ID NO: 12722 - RNA, 38 nt, Artificial Sequence
  Description of Artificial Sequence:  Enzymatic Nucleic Acid
cuaacgagcugaugaggccguuaggccgaaacuucugu

SEQ ID NO: 12723 - RNA, 38 nt, Artificial Sequence
  Description of Artificial Sequence:  Enzymatic Nucleic Acid
ucuaacgacugaugaggccguuaggccgaaaacuucug

SEQ ID NO: 12724 - RNA, 38 nt, Artificial Sequence
  Description of Artificial Sequence:  Enzymatic Nucleic Acid
ucucuaaccugaugaggccguuaggccgaaagaacuuc

SEQ ID NO: 12725 - RNA, 38 nt, Artificial Sequence
  Description of Artificial Sequence:  Enzymatic Nucleic Acid
gaaucucucugaugaggccguuaggccgaaacgagaac

SEQ ID NO: 12726 - RNA, 38 nt, Artificial Sequence
  Description of Artificial Sequence:  Enzymatic Nucleic Acid
cgaaucuccugaugaggccguuaggccgaaaacgagaa

SEQ ID NO: 12727 - RNA, 38 nt, Artificial Sequence
  Description of Artificial Sequence:  Enzymatic Nucleic Acid
cgcuuccgcugaugaggccguuaggccgaaaucucuaa

SEQ ID NO: 12728 - RNA, 38 nt, Artificial Sequence
  Description of Artificial Sequence:  Enzymatic Nucleic Acid
gcgcuucccugaugaggccguuaggccgaaaaucucua

SEQ ID NO: 12729 - RNA, 38 nt, Artificial Sequence
  Description of Artificial Sequence:  Enzymatic Nucleic Acid
agguuuugcugaugaggccguuaggccgaaagcaggug

SEQ ID NO: 12730 - RNA, 38 nt, Artificial Sequence
  Description of Artificial Sequence:  Enzymatic Nucleic Acid
gagguuuucugaugaggccguuaggccgaaaagcaggu

SEQ ID NO: 12731 - RNA, 38 nt, Artificial Sequence
  Description of Artificial Sequence:  Enzymatic Nucleic Acid
uagucacucugaugaggccguuaggccgaaagguuuug

SEQ ID NO: 12732 - RNA, 38 nt, Artificial Sequence
  Description of Artificial Sequence:  Enzymatic Nucleic Acid
agaccucgcugaugaggccguuaggccgaaagucacug

SEQ ID NO: 12733 - RNA, 38 nt, Artificial Sequence
  Description of Artificial Sequence:  Enzymatic Nucleic Acid
cugauggacugaugaggccguuaggccgaaaccucgua

SEQ ID NO: 12734 - RNA, 38 nt, Artificial Sequence
  Description of Artificial Sequence:  Enzymatic Nucleic Acid
cacugaugcugaugaggccguuaggccgaaagaccucg

SEQ ID NO: 12735 - RNA, 38 nt, Artificial Sequence
  Description of Artificial Sequence:  Enzymatic Nucleic Acid
gagccacucugaugaggccguuaggccgaaauggagac

SEQ ID NO: 12736 - RNA, 38 nt, Artificial Sequence
  Description of Artificial Sequence:  Enzymatic Nucleic Acid
aggucguacugaugaggccguuaggccgaaagccacug

SEQ ID NO: 12737 - RNA, 38 nt, Artificial Sequence
  Description of Artificial Sequence:  Enzymatic Nucleic Acid
uaaggucgcugaugaggccguuaggccgaaagagccac

SEQ ID NO: 12738 - RNA, 38 nt, Artificial Sequence
  Description of Artificial Sequence:  Enzymatic Nucleic Acid
gacagucucugaugaggccguuaggccgaaaggucgua

SEQ ID NO: 12739 - RNA, 38 nt, Artificial Sequence
  Description of Artificial Sequence:  Enzymatic Nucleic Acid
ugacaguccugaugaggccguuaggccgaaaaggucgu

SEQ ID NO: 12740 - RNA, 38 nt, Artificial Sequence
  Description of Artificial Sequence:  Enzymatic Nucleic Acid
ucuagcuucugaugaggccguuaggccgaaacagucua

SEQ ID NO: 12741 - RNA, 38 nt, Artificial Sequence
  Description of Artificial Sequence:  Enzymatic Nucleic Acid
gacaccuccugaugaggccguuaggccgaaagcuugac

SEQ ID NO: 12742 - RNA, 38 nt, Artificial Sequence
  Description of Artificial Sequence:  Enzymatic Nucleic Acid
ggcgcgggcugaugaggccguuaggccgaaacaccucu

SEQ ID NO: 12743 - RNA, 38 nt, Artificial Sequence
  Description of Artificial Sequence:  Enzymatic Nucleic Acid
agugaucucugaugaggccguuaggccgaaaggcgcgg

SEQ ID NO: 12744 - RNA, 38 nt, Artificial Sequence
  Description of Artificial Sequence:  Enzymatic Nucleic Acid
uuugaacccugaugaggccguuaggccgaaagugaucu

SEQ ID NO: 12745 - RNA, 38 nt, Artificial Sequence
  Description of Artificial Sequence:  Enzymatic Nucleic Acid
uguuuuugcugaugaggccguuaggccgaaaccaagug

SEQ ID NO: 12746 - RNA, 38 nt, Artificial Sequence
  Description of Artificial Sequence:  Enzymatic Nucleic Acid
ccuaaaaucugaugaggccguuaggccgaaauucccgg

SEQ ID NO: 12747 - RNA, 38 nt, Artificial Sequence
  Description of Artificial Sequence:  Enzymatic Nucleic Acid
uccuaaaacugaugaggccguuaggccgaaaauucccg

SEQ ID NO: 12748 - RNA, 38 nt, Artificial Sequence
  Description of Artificial Sequence:  Enzymatic Nucleic Acid
uccucugucugaugaggccguuaggccgaaacucuuuc

SEQ ID NO: 12749 - RNA, 38 nt, Artificial Sequence
  Description of Artificial Sequence:  Enzymatic Nucleic Acid
caccuauacugaugaggccguuaggccgaaacacccuc

SEQ ID NO: 12750 - RNA, 38 nt, Artificial Sequence
  Description of Artificial Sequence:  Enzymatic Nucleic Acid
ggcaccuacugaugaggccguuaggccgaaagacaccc

SEQ ID NO: 12751 - RNA, 38 nt, Artificial Sequence
  Description of Artificial Sequence:  Enzymatic Nucleic Acid
ucggcacccugaugaggccguuaggccgaaauagacac

SEQ ID NO: 12752 - RNA, 38 nt, Artificial Sequence
  Description of Artificial Sequence:  Enzymatic Nucleic Acid
cggugaggcugaugaggccguuaggccgaaaggcugcg

SEQ ID NO: 12753 - RNA, 38 nt, Artificial Sequence
  Description of Artificial Sequence:  Enzymatic Nucleic Acid
ugcacggucugaugaggccguuaggccgaaagguaggc

SEQ ID NO: 12754 - RNA, 38 nt, Artificial Sequence
  Description of Artificial Sequence:  Enzymatic Nucleic Acid
acuugucucugaugaggccguuaggccgaaagguuccu

SEQ ID NO: 12755 - RNA, 38 nt, Artificial Sequence
  Description of Artificial Sequence:  Enzymatic Nucleic Acid
ccagguuucugaugaggccguuaggccgaaacuugucu

SEQ ID NO: 12756 - RNA, 38 nt, Artificial Sequence
  Description of Artificial Sequence:  Enzymatic Nucleic Acid
gugagcgucugaugaggccguuaggccgaaaucagcuc

SEQ ID NO: 12757 - RNA, 38 nt, Artificial Sequence
  Description of Artificial Sequence:  Enzymatic Nucleic Acid
gugcacgucugaugaggccguuaggccgaaagcgugau

SEQ ID NO: 12758 - RNA, 38 nt, Artificial Sequence
  Description of Artificial Sequence:  Enzymatic Nucleic Acid
agccaaaacugaugaggccguuaggccgaaagggucgc

SEQ ID NO: 12759 - RNA, 38 nt, Artificial Sequence
  Description of Artificial Sequence:  Enzymatic Nucleic Acid
ggagccaacugaugaggccguuaggccgaaagaggguc

SEQ ID NO: 12760 - RNA, 38 nt, Artificial Sequence
  Description of Artificial Sequence:  Enzymatic Nucleic Acid
aggagccacugaugaggccguuaggccgaaaagagggu

SEQ ID NO: 12761 - RNA, 38 nt, Artificial Sequence
  Description of Artificial Sequence:  Enzymatic Nucleic Acid
aaggagcccugaugaggccguuaggccgaaaaagaggg

SEQ ID NO: 12762 - RNA, 38 nt, Artificial Sequence
  Description of Artificial Sequence:  Enzymatic Nucleic Acid
guuagaagcugaugaggccguuaggccgaaagccaaaa

SEQ ID NO: 12763 - RNA, 38 nt, Artificial Sequence
  Description of Artificial Sequence:  Enzymatic Nucleic Acid
agaguuagcugaugaggccguuaggccgaaaggagcca

SEQ ID NO: 12764 - RNA, 38 nt, Artificial Sequence
  Description of Artificial Sequence:  Enzymatic Nucleic Acid
gagaguuacugaugaggccguuaggccgaaaaggagcc

SEQ ID NO: 12765 - RNA, 38 nt, Artificial Sequence
  Description of Artificial Sequence:  Enzymatic Nucleic Acid
aagagagucugaugaggccguuaggccgaaagaaggag

SEQ ID NO: 12766 - RNA, 38 nt, Artificial Sequence
  Description of Artificial Sequence:  Enzymatic Nucleic Acid
gaugaagacugaugaggccguuaggccgaaaguuagaa

SEQ ID NO: 12767 - RNA, 38 nt, Artificial Sequence
  Description of Artificial Sequence:  Enzymatic Nucleic Acid
cugaugaacugaugaggccguuaggccgaaagaguuag

SEQ ID NO: 12768 - RNA, 38 nt, Artificial Sequence
  Description of Artificial Sequence:  Enzymatic Nucleic Acid
uucugaugcugaugaggccguuaggccgaaagagaguu

SEQ ID NO: 12769 - RNA, 38 nt, Artificial Sequence
  Description of Artificial Sequence:  Enzymatic Nucleic Acid
uuucugaucugaugaggccguuaggccgaaaagagagu

SEQ ID NO: 12770 - RNA, 38 nt, Artificial Sequence
  Description of Artificial Sequence:  Enzymatic Nucleic Acid
aguuuucucugaugaggccguuaggccgaaaugaagag

SEQ ID NO: 12771 - RNA, 38 nt, Artificial Sequence
  Description of Artificial Sequence:  Enzymatic Nucleic Acid
cggaagaacugaugaggccguuaggccgaaaccgcuuc

SEQ ID NO: 12772 - RNA, 38 nt, Artificial Sequence
  Description of Artificial Sequence:  Enzymatic Nucleic Acid
uucggaagcugaugaggccguuaggccgaaagaccgcu

SEQ ID NO: 12773 - RNA, 38 nt, Artificial Sequence
  Description of Artificial Sequence:  Enzymatic Nucleic Acid
cuucggaacugaugaggccguuaggccgaaaagaccgc

SEQ ID NO: 12774 - RNA, 38 nt, Artificial Sequence
  Description of Artificial Sequence:  Enzymatic Nucleic Acid
uacuucggcugaugaggccguuaggccgaaagaagacc

SEQ ID NO: 12775 - RNA, 38 nt, Artificial Sequence
  Description of Artificial Sequence:  Enzymatic Nucleic Acid
uuacuucgcugaugaggccguuaggccgaaaagaagac

SEQ ID NO: 12776 - RNA, 38 nt, Artificial Sequence
  Description of Artificial Sequence:  Enzymatic Nucleic Acid
ucugucuucugaugaggccguuaggccgaaacuucgga

SEQ ID NO: 12777 - RNA, 38 nt, Artificial Sequence
  Description of Artificial Sequence:  Enzymatic Nucleic Acid
uugacaggcugaugaggccguuaggccgaaagucuguc

SEQ ID NO: 12778 - RNA, 38 nt, Artificial Sequence
  Description of Artificial Sequence:  Enzymatic Nucleic Acid
uaaugauucugaugaggccguuaggccgaaacagguag

SEQ ID NO: 12779 - RNA, 38 nt, Artificial Sequence
  Description of Artificial Sequence:  Enzymatic Nucleic Acid
uccauaaucugaugaggccguuaggccgaaauugacag

SEQ ID NO: 12780 - RNA, 38 nt, Artificial Sequence
  Description of Artificial Sequence:  Enzymatic Nucleic Acid
ggguccaucugaugaggccguuaggccgaaaugauuga

SEQ ID NO: 12781 - RNA, 38 nt, Artificial Sequence
  Description of Artificial Sequence:  Enzymatic Nucleic Acid
uggguccacugaugaggccguuaggccgaaaaugauug

SEQ ID NO: 12782 - RNA, 38 nt, Artificial Sequence
  Description of Artificial Sequence:  Enzymatic Nucleic Acid
uccaggggcugaugaggccguuaggccgaaacuucauc

SEQ ID NO: 12783 - RNA, 38 nt, Artificial Sequence
  Description of Artificial Sequence:  Enzymatic Nucleic Acid
auccagggcugaugaggccguuaggccgaaaacuucau

SEQ ID NO: 12784 - RNA, 38 nt, Artificial Sequence
  Description of Artificial Sequence:  Enzymatic Nucleic Acid
uggcaucacugaugaggccguuaggccgaaagggcagc

SEQ ID NO: 12785 - RNA, 38 nt, Artificial Sequence
  Description of Artificial Sequence:  Enzymatic Nucleic Acid
cccgugcacugaugaggccguuaggccgaaacucccac

SEQ ID NO: 12786 - RNA, 38 nt, Artificial Sequence
  Description of Artificial Sequence:  Enzymatic Nucleic Acid
ucccgugccugaugaggccguuaggccgaaaacuccca

SEQ ID NO: 12787 - RNA, 38 nt, Artificial Sequence
  Description of Artificial Sequence:  Enzymatic Nucleic Acid
gauuugcccugaugaggccguuaggccgaaaguuucag

SEQ ID NO: 12788 - RNA, 38 nt, Artificial Sequence
  Description of Artificial Sequence:  Enzymatic Nucleic Acid
uuccgagccugaugaggccguuaggccgaaauuugccu

SEQ ID NO: 12789 - RNA, 38 nt, Artificial Sequence
  Description of Artificial Sequence:  Enzymatic Nucleic Acid
ccucuucccugaugaggccguuaggccgaaagcgauuu

SEQ ID NO: 12790 - RNA, 38 nt, Artificial Sequence
  Description of Artificial Sequence:  Enzymatic Nucleic Acid
uuucccaacugaugaggccguuaggccgaaagccccuc

SEQ ID NO: 12791 - RNA, 38 nt, Artificial Sequence
  Description of Artificial Sequence:  Enzymatic Nucleic Acid
cuuucccacugaugaggccguuaggccgaaaagccccu

SEQ ID NO: 12792 - RNA, 38 nt, Artificial Sequence
  Description of Artificial Sequence:  Enzymatic Nucleic Acid
acuuuccccugaugaggccguuaggccgaaaaagcccc

SEQ ID NO: 12793 - RNA, 38 nt, Artificial Sequence
  Description of Artificial Sequence:  Enzymatic Nucleic Acid
gcuugaaccugaugaggccguuaggccgaaacuuuccc

SEQ ID NO: 12794 - RNA, 38 nt, Artificial Sequence
  Description of Artificial Sequence:  Enzymatic Nucleic Acid
gaggcuugcugaugaggccguuaggccgaaacgacuuu

SEQ ID NO: 12795 - RNA, 38 nt, Artificial Sequence
  Description of Artificial Sequence:  Enzymatic Nucleic Acid
agaggcuucugaugaggccguuaggccgaaaacgacuu

SEQ ID NO: 12796 - RNA, 38 nt, Artificial Sequence
  Description of Artificial Sequence:  Enzymatic Nucleic Acid
caaaugcacugaugaggccguuaggccgaaaggcuuga

SEQ ID NO: 12797 - RNA, 38 nt, Artificial Sequence
  Description of Artificial Sequence:  Enzymatic Nucleic Acid
uaaugccacugaugaggccguuaggccgaaaugcagag

SEQ ID NO: 12798 - RNA, 38 nt, Artificial Sequence
  Description of Artificial Sequence:  Enzymatic Nucleic Acid
uuaaugcccugaugaggccguuaggccgaaaaugcaga

SEQ ID NO: 12799 - RNA, 38 nt, Artificial Sequence
  Description of Artificial Sequence:  Enzymatic Nucleic Acid
aggugggucugaugaggccguuaggccgaaauuucuua

SEQ ID NO: 12800 - RNA, 38 nt, Artificial Sequence
  Description of Artificial Sequence:  Enzymatic Nucleic Acid
ccucuuuccugaugaggccguuaggccgaaacaucuuc

SEQ ID NO: 12801 - RNA, 38 nt, Artificial Sequence
  Description of Artificial Sequence:  Enzymatic Nucleic Acid
gagcuuugcugaugaggccguuaggccgaaacucacug

SEQ ID NO: 12802 - RNA, 38 nt, Artificial Sequence
  Description of Artificial Sequence:  Enzymatic Nucleic Acid
ggucaucacugaugaggccguuaggccgaaagcuuugu

SEQ ID NO: 12803 - RNA, 38 nt, Artificial Sequence
  Description of Artificial Sequence:  Enzymatic Nucleic Acid
aagaucuucugaugaggccguuaggccgaaaguucggu

SEQ ID NO: 12804 - RNA, 38 nt, Artificial Sequence
  Description of Artificial Sequence:  Enzymatic Nucleic Acid
ugggucaacugaugaggccguuaggccgaaaucuugag

SEQ ID NO: 12805 - RNA, 38 nt, Artificial Sequence
  Description of Artificial Sequence:  Enzymatic Nucleic Acid
uguggguccugaugaggccguuaggccgaaagaucuug

SEQ ID NO: 12806 - RNA, 38 nt, Artificial Sequence
  Description of Artificial Sequence:  Enzymatic Nucleic Acid
ugauggcccugaugaggccguuaggccgaaaugugggu

SEQ ID NO: 12807 - RNA, 38 nt, Artificial Sequence
  Description of Artificial Sequence:  Enzymatic Nucleic Acid
auucagaucugaugaggccguuaggccgaaauggccga

SEQ ID NO: 12808 - RNA, 38 nt, Artificial Sequence
  Description of Artificial Sequence:  Enzymatic Nucleic Acid
cacauucacugaugaggccguuaggccgaaaugauggc

SEQ ID NO: 12809 - RNA, 38 nt, Artificial Sequence
  Description of Artificial Sequence:  Enzymatic Nucleic Acid
aggagguucugaugaggccguuaggccgaaaccacauu

SEQ ID NO: 12810 - RNA, 38 nt, Artificial Sequence
  Description of Artificial Sequence:  Enzymatic Nucleic Acid
caggaggucugaugaggccguuaggccgaaaaccacau

SEQ ID NO: 12811 - RNA, 38 nt, Artificial Sequence
  Description of Artificial Sequence:  Enzymatic Nucleic Acid
gcucccagcugaugaggccguuaggccgaaagguuaac

SEQ ID NO: 12812 - RNA, 38 nt, Artificial Sequence
  Description of Artificial Sequence:  Enzymatic Nucleic Acid
uauuccaccugaugaggccguuaggccgaaaucaccau

SEQ ID NO: 12813 - RNA, 38 nt, Artificial Sequence
  Description of Artificial Sequence:  Enzymatic Nucleic Acid
auuugcagcugaugaggccguuaggccgaaauuccacg

SEQ ID NO: 12814 - RNA, 38 nt, Artificial Sequence
  Description of Artificial Sequence:  Enzymatic Nucleic Acid
gguuuccgcugaugaggccguuaggccgaaauuugcag

SEQ ID NO: 12815 - RNA, 38 nt, Artificial Sequence
  Description of Artificial Sequence:  Enzymatic Nucleic Acid
gguaguugcugaugaggccguuaggccgaaacagguuu

SEQ ID NO: 12816 - RNA, 38 nt, Artificial Sequence
  Description of Artificial Sequence:  Enzymatic Nucleic Acid
ucuugaggcugaugaggccguuaggccgaaaguuggac

SEQ ID NO: 12817 - RNA, 38 nt, Artificial Sequence
  Description of Artificial Sequence:  Enzymatic Nucleic Acid
gacagaaucugaugaggccguuaggccgaaagucacgu

SEQ ID NO: 12818 - RNA, 38 nt, Artificial Sequence
  Description of Artificial Sequence:  Enzymatic Nucleic Acid
agacagaacugaugaggccguuaggccgaaaagucacg

SEQ ID NO: 12819 - RNA, 38 nt, Artificial Sequence
  Description of Artificial Sequence:  Enzymatic Nucleic Acid
ugagacagcugaugaggccguuaggccgaaauaaguca

SEQ ID NO: 12820 - RNA, 38 nt, Artificial Sequence
  Description of Artificial Sequence:  Enzymatic Nucleic Acid
uugagacacugaugaggccguuaggccgaaaauaaguc

SEQ ID NO: 12821 - RNA, 38 nt, Artificial Sequence
  Description of Artificial Sequence:  Enzymatic Nucleic Acid
cuuguugacugaugaggccguuaggccgaaacagaaua

SEQ ID NO: 12822 - RNA, 38 nt, Artificial Sequence
  Description of Artificial Sequence:  Enzymatic Nucleic Acid
uccuuguucugaugaggccguuaggccgaaagacagaa

SEQ ID NO: 12823 - RNA, 38 nt, Artificial Sequence
  Description of Artificial Sequence:  Enzymatic Nucleic Acid
ccauaugccugaugaggccguuaggccgaaaggcugcg

SEQ ID NO: 12824 - RNA, 38 nt, Artificial Sequence
  Description of Artificial Sequence:  Enzymatic Nucleic Acid
gagcuccacugaugaggccguuaggccgaaaugcaagg

SEQ ID NO: 12825 - RNA, 38 nt, Artificial Sequence
  Description of Artificial Sequence:  Enzymatic Nucleic Acid
ucuuucuucugaugaggccguuaggccgaaagcuccau

SEQ ID NO: 12826 - RNA, 38 nt, Artificial Sequence
  Description of Artificial Sequence:  Enzymatic Nucleic Acid
acacuguccugaugaggccguuaggccgaaaggcgggg

SEQ ID NO: 12827 - RNA, 38 nt, Artificial Sequence
  Description of Artificial Sequence:  Enzymatic Nucleic Acid
gagcugcucugaugaggccguuaggccgaaacacuguc

SEQ ID NO: 12828 - RNA, 38 nt, Artificial Sequence
  Description of Artificial Sequence:  Enzymatic Nucleic Acid
ugacacuucugaugaggccguuaggccgaaagcugcug

SEQ ID NO: 12829 - RNA, 38 nt, Artificial Sequence
  Description of Artificial Sequence:  Enzymatic Nucleic Acid
gagcuggucugaugaggccguuaggccgaaacacuuga

SEQ ID NO: 12830 - RNA, 38 nt, Artificial Sequence
  Description of Artificial Sequence:  Enzymatic Nucleic Acid
ggaagcugcugaugaggccguuaggccgaaagcuggug

SEQ ID NO: 12831 - RNA, 38 nt, Artificial Sequence
  Description of Artificial Sequence:  Enzymatic Nucleic Acid
cuucagggcugaugaggccguuaggccgaaagcuggag

SEQ ID NO: 12832 - RNA, 38 nt, Artificial Sequence
  Description of Artificial Sequence:  Enzymatic Nucleic Acid
ucuucaggcugaugaggccguuaggccgaaaagcugga

SEQ ID NO: 12833 - RNA, 38 nt, Artificial Sequence
  Description of Artificial Sequence:  Enzymatic Nucleic Acid
cucacugucugaugaggccguuaggccgaaauccucgu

SEQ ID NO: 12834 - RNA, 38 nt, Artificial Sequence
  Description of Artificial Sequence:  Enzymatic Nucleic Acid
ucucacugcugaugaggccguuaggccgaaaauccucg

SEQ ID NO: 12835 - RNA, 38 nt, Artificial Sequence
  Description of Artificial Sequence:  Enzymatic Nucleic Acid
ugcuuggacugaugaggccguuaggccgaaaucucacu

SEQ ID NO: 12836 - RNA, 38 nt, Artificial Sequence
  Description of Artificial Sequence:  Enzymatic Nucleic Acid
gcugcuugcugaugaggccguuaggccgaaagaucuca

SEQ ID NO: 12837 - RNA, 38 nt, Artificial Sequence
  Description of Artificial Sequence:  Enzymatic Nucleic Acid
uccauggucugaugaggccguuaggccgaaaggggcug

SEQ ID NO: 12838 - RNA, 38 nt, Artificial Sequence
  Description of Artificial Sequence:  Enzymatic Nucleic Acid
cuguaggacugaugaggccguuaggccgaaaucagguc

SEQ ID NO: 12839 - RNA, 38 nt, Artificial Sequence
  Description of Artificial Sequence:  Enzymatic Nucleic Acid
acuguaggcugaugaggccguuaggccgaaaaucaggu

SEQ ID NO: 12840 - RNA, 38 nt, Artificial Sequence
  Description of Artificial Sequence:  Enzymatic Nucleic Acid
aacuguagcugaugaggccguuaggccgaaaaaucagg

SEQ ID NO: 12841 - RNA, 38 nt, Artificial Sequence
  Description of Artificial Sequence:  Enzymatic Nucleic Acid
ggaaacugcugaugaggccguuaggccgaaaggaaauc

SEQ ID NO: 12842 - RNA, 38 nt, Artificial Sequence
  Description of Artificial Sequence:  Enzymatic Nucleic Acid
cacuuggacugaugaggccguuaggccgaaacuguagg

SEQ ID NO: 12843 - RNA, 38 nt, Artificial Sequence
  Description of Artificial Sequence:  Enzymatic Nucleic Acid
ccacuuggcugaugaggccguuaggccgaaaacuguag

SEQ ID NO: 12844 - RNA, 38 nt, Artificial Sequence
  Description of Artificial Sequence:  Enzymatic Nucleic Acid
aggacagacugaugaggccguuaggccgaaacuccaug

SEQ ID NO: 12845 - RNA, 38 nt, Artificial Sequence
  Description of Artificial Sequence:  Enzymatic Nucleic Acid
gaggacagcugaugaggccguuaggccgaaaacuccau

SEQ ID NO: 12846 - RNA, 38 nt, Artificial Sequence
  Description of Artificial Sequence:  Enzymatic Nucleic Acid
ggaggacacugaugaggccguuaggccgaaaaacucca

SEQ ID NO: 12847 - RNA, 38 nt, Artificial Sequence
  Description of Artificial Sequence:  Enzymatic Nucleic Acid
uucuggagcugaugaggccguuaggccgaaacagaaac

SEQ ID NO: 12848 - RNA, 38 nt, Artificial Sequence
  Description of Artificial Sequence:  Enzymatic Nucleic Acid
acuuucugcugaugaggccguuaggccgaaaggacaga

SEQ ID NO: 12849 - RNA, 38 nt, Artificial Sequence
  Description of Artificial Sequence:  Enzymatic Nucleic Acid
ucagauaacugaugaggccguuaggccgaaaggauguu

SEQ ID NO: 12850 - RNA, 38 nt, Artificial Sequence
  Description of Artificial Sequence:  Enzymatic Nucleic Acid
cucagauacugaugaggccguuaggccgaaaaggaugu

SEQ ID NO: 12851 - RNA, 38 nt, Artificial Sequence
  Description of Artificial Sequence:  Enzymatic Nucleic Acid
ucucagaucugaugaggccguuaggccgaaaaaggaug

SEQ ID NO: 12852 - RNA, 38 nt, Artificial Sequence
  Description of Artificial Sequence:  Enzymatic Nucleic Acid
uucucagacugaugaggccguuaggccgaaaaaaggau

SEQ ID NO: 12853 - RNA, 38 nt, Artificial Sequence
  Description of Artificial Sequence:  Enzymatic Nucleic Acid
uguucucacugaugaggccguuaggccgaaauaaaagg

SEQ ID NO: 12854 - RNA, 38 nt, Artificial Sequence
  Description of Artificial Sequence:  Enzymatic Nucleic Acid
aagucgcacugaugaggccguuaggccgaaaucuucac

SEQ ID NO: 12855 - RNA, 38 nt, Artificial Sequence
  Description of Artificial Sequence:  Enzymatic Nucleic Acid
aaagucgccugaugaggccguuaggccgaaaaucuuca

SEQ ID NO: 12856 - RNA, 38 nt, Artificial Sequence
  Description of Artificial Sequence:  Enzymatic Nucleic Acid
ccaggccacugaugaggccguuaggccgaaagucgcaa

SEQ ID NO: 12857 - RNA, 38 nt, Artificial Sequence
  Description of Artificial Sequence:  Enzymatic Nucleic Acid
gccaggcccugaugaggccguuaggccgaaaagucgca

SEQ ID NO: 12858 - RNA, 38 nt, Artificial Sequence
  Description of Artificial Sequence:  Enzymatic Nucleic Acid
aggguucucugaugaggccguuaggccgaaauaaauau

SEQ ID NO: 12859 - RNA, 38 nt, Artificial Sequence
  Description of Artificial Sequence:  Enzymatic Nucleic Acid
ccucacaucugaugaggccguuaggccgaaaucagggu

SEQ ID NO: 12860 - RNA, 38 nt, Artificial Sequence
  Description of Artificial Sequence:  Enzymatic Nucleic Acid
uccucacacugaugaggccguuaggccgaaaaucaggg

SEQ ID NO: 12861 - RNA, 38 nt, Artificial Sequence
  Description of Artificial Sequence:  Enzymatic Nucleic Acid
aagucgagcugaugaggccguuaggccgaaaucuccuc

SEQ ID NO: 12862 - RNA, 38 nt, Artificial Sequence
  Description of Artificial Sequence:  Enzymatic Nucleic Acid
gggaaguccugaugaggccguuaggccgaaaguaucuc

SEQ ID NO: 12863 - RNA, 38 nt, Artificial Sequence
  Description of Artificial Sequence:  Enzymatic Nucleic Acid
uuuaggggcugaugaggccguuaggccgaaagucgagu

SEQ ID NO: 12864 - RNA, 38 nt, Artificial Sequence
  Description of Artificial Sequence:  Enzymatic Nucleic Acid
uuuuagggcugaugaggccguuaggccgaaaagucgag

SEQ ID NO: 12865 - RNA, 38 nt, Artificial Sequence
  Description of Artificial Sequence:  Enzymatic Nucleic Acid
auccauuucugaugaggccguuaggccgaaaggggaag

SEQ ID NO: 12866 - RNA, 38 nt, Artificial Sequence
  Description of Artificial Sequence:  Enzymatic Nucleic Acid
ggauucagcugaugaggccguuaggccgaaagccaucc

SEQ ID NO: 12867 - RNA, 38 nt, Artificial Sequence
  Description of Artificial Sequence:  Enzymatic Nucleic Acid
caaagaugcugaugaggccguuaggccgaaauucagga

SEQ ID NO: 12868 - RNA, 38 nt, Artificial Sequence
  Description of Artificial Sequence:  Enzymatic Nucleic Acid
uugucaaacugaugaggccguuaggccgaaauggauuc

SEQ ID NO: 12869 - RNA, 38 nt, Artificial Sequence
  Description of Artificial Sequence:  Enzymatic Nucleic Acid
ccuugucacugaugaggccguuaggccgaaagauggau

SEQ ID NO: 12870 - RNA, 38 nt, Artificial Sequence
  Description of Artificial Sequence:  Enzymatic Nucleic Acid
accuuguccugaugaggccguuaggccgaaaagaugga

SEQ ID NO: 12871 - RNA, 38 nt, Artificial Sequence
  Description of Artificial Sequence:  Enzymatic Nucleic Acid
gugcuguacugaugaggccguuaggccgaaaccuuguc

SEQ ID NO: 12872 - RNA, 38 nt, Artificial Sequence
  Description of Artificial Sequence:  Enzymatic Nucleic Acid
uggugcugcugaugaggccguuaggccgaaagaccuug

SEQ ID NO: 12873 - RNA, 38 nt, Artificial Sequence
  Description of Artificial Sequence:  Enzymatic Nucleic Acid
cgccauagcugaugaggccguuaggccgaaaccacaca

SEQ ID NO: 12874 - RNA, 38 nt, Artificial Sequence
  Description of Artificial Sequence:  Enzymatic Nucleic Acid
acacgccacugaugaggccguuaggccgaaaggaccac

SEQ ID NO: 12875 - RNA, 38 nt, Artificial Sequence
  Description of Artificial Sequence:  Enzymatic Nucleic Acid
cccacagccugaugaggccguuaggccgaaacacgcca

SEQ ID NO: 12876 - RNA, 38 nt, Artificial Sequence
  Description of Artificial Sequence:  Enzymatic Nucleic Acid
aaggagaacugaugaggccguuaggccgaaaucuccca

SEQ ID NO: 12877 - RNA, 38 nt, Artificial Sequence
  Description of Artificial Sequence:  Enzymatic Nucleic Acid
cuaaggagcugaugaggccguuaggccgaaagaucucc

SEQ ID NO: 12878 - RNA, 38 nt, Artificial Sequence
  Description of Artificial Sequence:  Enzymatic Nucleic Acid
ccuaaggacugaugaggccguuaggccgaaaagaucuc

SEQ ID NO: 12879 - RNA, 38 nt, Artificial Sequence
  Description of Artificial Sequence:  Enzymatic Nucleic Acid
ccccuaagcugaugaggccguuaggccgaaagaagauc

SEQ ID NO: 12880 - RNA, 38 nt, Artificial Sequence
  Description of Artificial Sequence:  Enzymatic Nucleic Acid
aacccccucugaugaggccguuaggccgaaaggagaag

SEQ ID NO: 12881 - RNA, 38 nt, Artificial Sequence
  Description of Artificial Sequence:  Enzymatic Nucleic Acid
gaaccccccugaugaggccguuaggccgaaaaggagaa

SEQ ID NO: 12882 - RNA, 38 nt, Artificial Sequence
  Description of Artificial Sequence:  Enzymatic Nucleic Acid
guauggagcugaugaggccguuaggccgaaacccccua

SEQ ID NO: 12883 - RNA, 38 nt, Artificial Sequence
  Description of Artificial Sequence:  Enzymatic Nucleic Acid
gguauggacugaugaggccguuaggccgaaaacccccu

SEQ ID NO: 12884 - RNA, 38 nt, Artificial Sequence
  Description of Artificial Sequence:  Enzymatic Nucleic Acid
uggguaugcugaugaggccguuaggccgaaagaacccc

SEQ ID NO: 12885 - RNA, 38 nt, Artificial Sequence
  Description of Artificial Sequence:  Enzymatic Nucleic Acid
cuccugggcugaugaggccguuaggccgaaauggagaa

SEQ ID NO: 12886 - RNA, 38 nt, Artificial Sequence
  Description of Artificial Sequence:  Enzymatic Nucleic Acid
ggcugcagcugaugaggccguuaggccgaaagucuuca

SEQ ID NO: 12887 - RNA, 38 nt, Artificial Sequence
  Description of Artificial Sequence:  Enzymatic Nucleic Acid
cggcugcacugaugaggccguuaggccgaaaagucuuc

SEQ ID NO: 12888 - RNA, 38 nt, Artificial Sequence
  Description of Artificial Sequence:  Enzymatic Nucleic Acid
guguggcacugaugaggccguuaggccgaaacuccggg

SEQ ID NO: 12889 - RNA, 38 nt, Artificial Sequence
  Description of Artificial Sequence:  Enzymatic Nucleic Acid
auuugguacugaugaggccguuaggccgaaauuucagg

SEQ ID NO: 12890 - RNA, 38 nt, Artificial Sequence
  Description of Artificial Sequence:  Enzymatic Nucleic Acid
ugauuuggcugaugaggccguuaggccgaaagauuuca

SEQ ID NO: 12891 - RNA, 38 nt, Artificial Sequence
  Description of Artificial Sequence:  Enzymatic Nucleic Acid
uccaacaucugaugaggccguuaggccgaaauuuggua

SEQ ID NO: 12892 - RNA, 38 nt, Artificial Sequence
  Description of Artificial Sequence:  Enzymatic Nucleic Acid
agcaaucccugaugaggccguuaggccgaaacaugauu

SEQ ID NO: 12893 - RNA, 38 nt, Artificial Sequence
  Description of Artificial Sequence:  Enzymatic Nucleic Acid
gugccagccugaugaggccguuaggccgaaauccaaca

SEQ ID NO: 12894 - RNA, 38 nt, Artificial Sequence
  Description of Artificial Sequence:  Enzymatic Nucleic Acid
guucagcacugaugaggccguuaggccgaaaccggggc

SEQ ID NO: 12895 - RNA, 38 nt, Artificial Sequence
  Description of Artificial Sequence:  Enzymatic Nucleic Acid
aguucagccugaugaggccguuaggccgaaaaccgggg

SEQ ID NO: 12896 - RNA, 38 nt, Artificial Sequence
  Description of Artificial Sequence:  Enzymatic Nucleic Acid
uucuccaccugaugaggccguuaggccgaaaguucagc

SEQ ID NO: 12897 - RNA, 38 nt, Artificial Sequence
  Description of Artificial Sequence:  Enzymatic Nucleic Acid
aggucacccugaugaggccguuaggccgaaaguuucuc

SEQ ID NO: 12898 - RNA, 38 nt, Artificial Sequence
  Description of Artificial Sequence:  Enzymatic Nucleic Acid
uuggcuugcugaugaggccguuaggccgaaagcagguc

SEQ ID NO: 12899 - RNA, 38 nt, Artificial Sequence
  Description of Artificial Sequence:  Enzymatic Nucleic Acid
guuggcuucugaugaggccguuaggccgaaaagcaggu

SEQ ID NO: 12900 - RNA, 38 nt, Artificial Sequence
  Description of Artificial Sequence:  Enzymatic Nucleic Acid
uccuguugcugaugaggccguuaggccgaaacguuggc

SEQ ID NO: 12901 - RNA, 38 nt, Artificial Sequence
  Description of Artificial Sequence:  Enzymatic Nucleic Acid
ggggaugucugaugaggccguuaggccgaaaucuuucc

SEQ ID NO: 12902 - RNA, 38 nt, Artificial Sequence
  Description of Artificial Sequence:  Enzymatic Nucleic Acid
gggggaugcugaugaggccguuaggccgaaaaucuuuc

SEQ ID NO: 12903 - RNA, 38 nt, Artificial Sequence
  Description of Artificial Sequence:  Enzymatic Nucleic Acid
uugaggggcugaugaggccguuaggccgaaauguaauc

SEQ ID NO: 12904 - RNA, 38 nt, Artificial Sequence
  Description of Artificial Sequence:  Enzymatic Nucleic Acid
auggcauucugaugaggccguuaggccgaaagggggau

SEQ ID NO: 12905 - RNA, 38 nt, Artificial Sequence
  Description of Artificial Sequence:  Enzymatic Nucleic Acid
cuagucagcugaugaggccguuaggccgaaauggcauu

SEQ ID NO: 12906 - RNA, 38 nt, Artificial Sequence
  Description of Artificial Sequence:  Enzymatic Nucleic Acid
acuguuuccugaugaggccguuaggccgaaagucagua

SEQ ID NO: 12907 - RNA, 38 nt, Artificial Sequence
  Description of Artificial Sequence:  Enzymatic Nucleic Acid
ugugaagccugaugaggccguuaggccgaaacuguuuc

SEQ ID NO: 12908 - RNA, 38 nt, Artificial Sequence
  Description of Artificial Sequence:  Enzymatic Nucleic Acid
aguaugugcugaugaggccguuaggccgaaagcuacug

SEQ ID NO: 12909 - RNA, 38 nt, Artificial Sequence
  Description of Artificial Sequence:  Enzymatic Nucleic Acid
gaguaugucugaugaggccguuaggccgaaaagcuacu

SEQ ID NO: 12910 - RNA, 38 nt, Artificial Sequence
  Description of Artificial Sequence:  Enzymatic Nucleic Acid
gggucgagcugaugaggccguuaggccgaaaugugaag

SEQ ID NO: 12911 - RNA, 38 nt, Artificial Sequence
  Description of Artificial Sequence:  Enzymatic Nucleic Acid
uggggguccugaugaggccguuaggccgaaaguaugug

SEQ ID NO: 12912 - RNA, 38 nt, Artificial Sequence
  Description of Artificial Sequence:  Enzymatic Nucleic Acid
ccucagagcugaugaggccguuaggccgaaaggugggg

SEQ ID NO: 12913 - RNA, 38 nt, Artificial Sequence
  Description of Artificial Sequence:  Enzymatic Nucleic Acid
uccucagacugaugaggccguuaggccgaaaagguggg

SEQ ID NO: 12914 - RNA, 38 nt, Artificial Sequence
  Description of Artificial Sequence:  Enzymatic Nucleic Acid
gguccucacugaugaggccguuaggccgaaagaaggug

SEQ ID NO: 12915 - RNA, 38 nt, Artificial Sequence
  Description of Artificial Sequence:  Enzymatic Nucleic Acid
uccuugaacugaugaggccguuaggccgaaagguccuc

SEQ ID NO: 12916 - RNA, 38 nt, Artificial Sequence
  Description of Artificial Sequence:  Enzymatic Nucleic Acid
guccuugacugaugaggccguuaggccgaaaagguccu

SEQ ID NO: 12917 - RNA, 38 nt, Artificial Sequence
  Description of Artificial Sequence:  Enzymatic Nucleic Acid
cguccuugcugaugaggccguuaggccgaaaaaggucc

SEQ ID NO: 12918 - RNA, 38 nt, Artificial Sequence
  Description of Artificial Sequence:  Enzymatic Nucleic Acid
ccguccuucugaugaggccguuaggccgaaaaaagguc

SEQ ID NO: 12919 - RNA, 38 nt, Artificial Sequence
  Description of Artificial Sequence:  Enzymatic Nucleic Acid
gaucugcacugaugaggccguuaggccgaaagccgucc

SEQ ID NO: 12920 - RNA, 38 nt, Artificial Sequence
  Description of Artificial Sequence:  Enzymatic Nucleic Acid
ggaucugccugaugaggccguuaggccgaaaagccguc

SEQ ID NO: 12921 - RNA, 38 nt, Artificial Sequence
  Description of Artificial Sequence:  Enzymatic Nucleic Acid
aaaaugugcugaugaggccguuaggccgaaaucugcaa

SEQ ID NO: 12922 - RNA, 38 nt, Artificial Sequence
  Description of Artificial Sequence:  Enzymatic Nucleic Acid
ggaaugaacugaugaggccguuaggccgaaauguggau

SEQ ID NO: 12923 - RNA, 38 nt, Artificial Sequence
  Description of Artificial Sequence:  Enzymatic Nucleic Acid
cggaaugacugaugaggccguuaggccgaaaaugugga

SEQ ID NO: 12924 - RNA, 38 nt, Artificial Sequence
  Description of Artificial Sequence:  Enzymatic Nucleic Acid
ccggaaugcugaugaggccguuaggccgaaaaaugugg

SEQ ID NO: 12925 - RNA, 38 nt, Artificial Sequence
  Description of Artificial Sequence:  Enzymatic Nucleic Acid
uccggaaucugaugaggccguuaggccgaaaaaaugug

SEQ ID NO: 12926 - RNA, 38 nt, Artificial Sequence
  Description of Artificial Sequence:  Enzymatic Nucleic Acid
gcuuccggcugaugaggccguuaggccgaaaugaaaau

SEQ ID NO: 12927 - RNA, 38 nt, Artificial Sequence
  Description of Artificial Sequence:  Enzymatic Nucleic Acid
agcuuccgcugaugaggccguuaggccgaaaaugaaaa

SEQ ID NO: 12928 - RNA, 38 nt, Artificial Sequence
  Description of Artificial Sequence:  Enzymatic Nucleic Acid
caucaucacugaugaggccguuaggccgaaagcuuccg

SEQ ID NO: 12929 - RNA, 38 nt, Artificial Sequence
  Description of Artificial Sequence:  Enzymatic Nucleic Acid
cguuuacacugaugaggccguuaggccgaaaucucaca

SEQ ID NO: 12930 - RNA, 38 nt, Artificial Sequence
  Description of Artificial Sequence:  Enzymatic Nucleic Acid
aaagcguucugaugaggccguuaggccgaaacauaucu

SEQ ID NO: 12931 - RNA, 38 nt, Artificial Sequence
  Description of Artificial Sequence:  Enzymatic Nucleic Acid
gaauuugacugaugaggccguuaggccgaaagcguuua

SEQ ID NO: 12932 - RNA, 38 nt, Artificial Sequence
  Description of Artificial Sequence:  Enzymatic Nucleic Acid
ugaauuugcugaugaggccguuaggccgaaaagcguuu

SEQ ID NO: 12933 - RNA, 38 nt, Artificial Sequence
  Description of Artificial Sequence:  Enzymatic Nucleic Acid
augaauuucugaugaggccguuaggccgaaaaagcguu

SEQ ID NO: 12934 - RNA, 38 nt, Artificial Sequence
  Description of Artificial Sequence:  Enzymatic Nucleic Acid
ggcucaugcugaugaggccguuaggccgaaauuugaaa

SEQ ID NO: 12935 - RNA, 38 nt, Artificial Sequence
  Description of Artificial Sequence:  Enzymatic Nucleic Acid
aggcucaucugaugaggccguuaggccgaaaauuugaa

SEQ ID NO: 12936 - RNA, 38 nt, Artificial Sequence
  Description of Artificial Sequence:  Enzymatic Nucleic Acid
gcuccucacugaugaggccguuaggccgaaagguuuug

SEQ ID NO: 12937 - RNA, 38 nt, Artificial Sequence
  Description of Artificial Sequence:  Enzymatic Nucleic Acid
agcuccuccugaugaggccguuaggccgaaaagguuuu

SEQ ID NO: 12938 - RNA, 38 nt, Artificial Sequence
  Description of Artificial Sequence:  Enzymatic Nucleic Acid
uucggugacugaugaggccguuaggccgaaagcuccuc

SEQ ID NO: 12939 - RNA, 38 nt, Artificial Sequence
  Description of Artificial Sequence:  Enzymatic Nucleic Acid
guucggugcugaugaggccguuaggccgaaaagcuccu

SEQ ID NO: 12940 - RNA, 38 nt, Artificial Sequence
  Description of Artificial Sequence:  Enzymatic Nucleic Acid
aguucggucugaugaggccguuaggccgaaaaagcucc

SEQ ID NO: 12941 - RNA, 38 nt, Artificial Sequence
  Description of Artificial Sequence:  Enzymatic Nucleic Acid
uggaggugcugaugaggccguuaggccgaaaguucggu

SEQ ID NO: 12942 - RNA, 38 nt, Artificial Sequence
  Description of Artificial Sequence:  Enzymatic Nucleic Acid
caaacaugcugaugaggccguuaggccgaaagguggag

SEQ ID NO: 12943 - RNA, 38 nt, Artificial Sequence
  Description of Artificial Sequence:  Enzymatic Nucleic Acid
aguccucacugaugaggccguuaggccgaaacauggag

SEQ ID NO: 12944 - RNA, 38 nt, Artificial Sequence
  Description of Artificial Sequence:  Enzymatic Nucleic Acid
uaguccuccugaugaggccguuaggccgaaaacaugga

SEQ ID NO: 12945 - RNA, 38 nt, Artificial Sequence
  Description of Artificial Sequence:  Enzymatic Nucleic Acid
ccagcugacugaugaggccguuaggccgaaaguccuca

SEQ ID NO: 12946 - RNA, 38 nt, Artificial Sequence
  Description of Artificial Sequence:  Enzymatic Nucleic Acid
guccagcucugaugaggccguuaggccgaaauaguccu

SEQ ID NO: 12947 - RNA, 38 nt, Artificial Sequence
  Description of Artificial Sequence:  Enzymatic Nucleic Acid
cagagugccugaugaggccguuaggccgaaagugucca

SEQ ID NO: 12948 - RNA, 38 nt, Artificial Sequence
  Description of Artificial Sequence:  Enzymatic Nucleic Acid
gcccagcacugaugaggccguuaggccgaaagugcuag

SEQ ID NO: 12949 - RNA, 38 nt, Artificial Sequence
  Description of Artificial Sequence:  Enzymatic Nucleic Acid
gcaaggggcugaugaggccguuaggccgaaagcccagc

SEQ ID NO: 12950 - RNA, 38 nt, Artificial Sequence
  Description of Artificial Sequence:  Enzymatic Nucleic Acid
gcuucagccugaugaggccguuaggccgaaagggggag

SEQ ID NO: 12951 - RNA, 38 nt, Artificial Sequence
  Description of Artificial Sequence:  Enzymatic Nucleic Acid
uccaggugcugaugaggccguuaggccgaaaccgcuuc

SEQ ID NO: 12952 - RNA, 38 nt, Artificial Sequence
  Description of Artificial Sequence:  Enzymatic Nucleic Acid
guccaggucugaugaggccguuaggccgaaaaccgcuu

SEQ ID NO: 12953 - RNA, 38 nt, Artificial Sequence
  Description of Artificial Sequence:  Enzymatic Nucleic Acid
ucuucaugcugaugaggccguuaggccgaaaggccuug

SEQ ID NO: 12954 - RNA, 38 nt, Artificial Sequence
  Description of Artificial Sequence:  Enzymatic Nucleic Acid
cucaaguccugaugaggccguuaggccgaaaucuucau

SEQ ID NO: 12955 - RNA, 38 nt, Artificial Sequence
  Description of Artificial Sequence:  Enzymatic Nucleic Acid
cuauucuccugaugaggccguuaggccgaaagucuauc

SEQ ID NO: 12956 - RNA, 38 nt, Artificial Sequence
  Description of Artificial Sequence:  Enzymatic Nucleic Acid
uuacucgccugaugaggccguuaggccgaaauucucaa

SEQ ID NO: 12957 - RNA, 38 nt, Artificial Sequence
  Description of Artificial Sequence:  Enzymatic Nucleic Acid
cuugcuuucugaugaggccguuaggccgaaacucgcua

SEQ ID NO: 12958 - RNA, 38 nt, Artificial Sequence
  Description of Artificial Sequence:  Enzymatic Nucleic Acid
agaucggacugaugaggccguuaggccgaaagucccgc

SEQ ID NO: 12959 - RNA, 38 nt, Artificial Sequence
  Description of Artificial Sequence:  Enzymatic Nucleic Acid
cagaucggcugaugaggccguuaggccgaaaagucccg

SEQ ID NO: 12960 - RNA, 38 nt, Artificial Sequence
  Description of Artificial Sequence:  Enzymatic Nucleic Acid
gcagaucgcugaugaggccguuaggccgaaaaaguccc

SEQ ID NO: 12961 - RNA, 38 nt, Artificial Sequence
  Description of Artificial Sequence:  Enzymatic Nucleic Acid
ccucggcacugaugaggccguuaggccgaaaucggaaa

SEQ ID NO: 12962 - RNA, 38 nt, Artificial Sequence
  Description of Artificial Sequence:  Enzymatic Nucleic Acid
agaagcagcugaugaggccguuaggccgaaagcugggc

SEQ ID NO: 12963 - RNA, 38 nt, Artificial Sequence
  Description of Artificial Sequence:  Enzymatic Nucleic Acid
gagaagcacugaugaggccguuaggccgaaaagcuggg

SEQ ID NO: 12964 - RNA, 38 nt, Artificial Sequence
  Description of Artificial Sequence:  Enzymatic Nucleic Acid
agcuggagcugaugaggccguuaggccgaaagcagaag

SEQ ID NO: 12965 - RNA, 38 nt, Artificial Sequence
  Description of Artificial Sequence:  Enzymatic Nucleic Acid
cagcuggacugaugaggccguuaggccgaaaagcagaa

SEQ ID NO: 12966 - RNA, 38 nt, Artificial Sequence
  Description of Artificial Sequence:  Enzymatic Nucleic Acid
cacagcugcugaugaggccguuaggccgaaagaagcag

SEQ ID NO: 12967 - RNA, 38 nt, Artificial Sequence
  Description of Artificial Sequence:  Enzymatic Nucleic Acid
acgggccucugaugaggccguuaggccgaaauguggcc

SEQ ID NO: 12968 - RNA, 38 nt, Artificial Sequence
  Description of Artificial Sequence:  Enzymatic Nucleic Acid
ccagcucacugaugaggccguuaggccgaaauucaucg

SEQ ID NO: 12969 - RNA, 38 nt, Artificial Sequence
  Description of Artificial Sequence:  Enzymatic Nucleic Acid
aacagcagcugaugaggccguuaggccgaaacuccuuu

SEQ ID NO: 12970 - RNA, 38 nt, Artificial Sequence
  Description of Artificial Sequence:  Enzymatic Nucleic Acid
ggguggagcugaugaggccguuaggccgaaacagcagg

SEQ ID NO: 12971 - RNA, 38 nt, Artificial Sequence
  Description of Artificial Sequence:  Enzymatic Nucleic Acid
gggguggacugaugaggccguuaggccgaaaacagcag

SEQ ID NO: 12972 - RNA, 38 nt, Artificial Sequence
  Description of Artificial Sequence:  Enzymatic Nucleic Acid
ugggggugcugaugaggccguuaggccgaaagaacagc

SEQ ID NO: 12973 - RNA, 38 nt, Artificial Sequence
  Description of Artificial Sequence:  Enzymatic Nucleic Acid
cggaguugcugaugaggccguuaggccgaaagucuggg

SEQ ID NO: 12974 - RNA, 38 nt, Artificial Sequence
  Description of Artificial Sequence:  Enzymatic Nucleic Acid
acaccacgcugaugaggccguuaggccgaaaguuguag

SEQ ID NO: 12975 - RNA, 38 nt, Artificial Sequence
  Description of Artificial Sequence:  Enzymatic Nucleic Acid
aggaguaccugaugaggccguuaggccgaaacaccacg

SEQ ID NO: 12976 - RNA, 38 nt, Artificial Sequence
  Description of Artificial Sequence:  Enzymatic Nucleic Acid
gggaggagcugaugaggccguuaggccgaaacaacacc

SEQ ID NO: 12977 - RNA, 38 nt, Artificial Sequence
  Description of Artificial Sequence:  Enzymatic Nucleic Acid
gcggggagcugaugaggccguuaggccgaaaguacaac

SEQ ID NO: 12978 - RNA, 38 nt, Artificial Sequence
  Description of Artificial Sequence:  Enzymatic Nucleic Acid
cgggcgggcugaugaggccguuaggccgaaaggaguac

SEQ ID NO: 12979 - RNA, 38 nt, Artificial Sequence
  Description of Artificial Sequence:  Enzymatic Nucleic Acid
agaagcuucugaugaggccguuaggccgaaaggcgggc

SEQ ID NO: 12980 - RNA, 38 nt, Artificial Sequence
  Description of Artificial Sequence:  Enzymatic Nucleic Acid
cuggugagcugaugaggccguuaggccgaaagcuuuag

SEQ ID NO: 12981 - RNA, 38 nt, Artificial Sequence
  Description of Artificial Sequence:  Enzymatic Nucleic Acid
gcuggugacugaugaggccguuaggccgaaaagcuuua

SEQ ID NO: 12982 - RNA, 38 nt, Artificial Sequence
  Description of Artificial Sequence:  Enzymatic Nucleic Acid
gggcuggucugaugaggccguuaggccgaaagaagcuu

SEQ ID NO: 12983 - RNA, 38 nt, Artificial Sequence
  Description of Artificial Sequence:  Enzymatic Nucleic Acid
auguauaacugaugaggccguuaggccgaaacugucag

SEQ ID NO: 12984 - RNA, 38 nt, Artificial Sequence
  Description of Artificial Sequence:  Enzymatic Nucleic Acid
agauguaucugaugaggccguuaggccgaaauacuguc

SEQ ID NO: 12985 - RNA, 38 nt, Artificial Sequence
  Description of Artificial Sequence:  Enzymatic Nucleic Acid
uagauguacugaugaggccguuaggccgaaaauacugu

SEQ ID NO: 12986 - RNA, 38 nt, Artificial Sequence
  Description of Artificial Sequence:  Enzymatic Nucleic Acid
cauagaugcugaugaggccguuaggccgaaauaauacu

SEQ ID NO: 12987 - RNA, 38 nt, Artificial Sequence
  Description of Artificial Sequence:  Enzymatic Nucleic Acid
aacucauacugaugaggccguuaggccgaaauguauaa

SEQ ID NO: 12988 - RNA, 38 nt, Artificial Sequence
  Description of Artificial Sequence:  Enzymatic Nucleic Acid
uaaacucacugaugaggccguuaggccgaaagauguau

SEQ ID NO: 12989 - RNA, 38 nt, Artificial Sequence
  Description of Artificial Sequence:  Enzymatic Nucleic Acid
uagguguacugaugaggccguuaggccgaaacucauag

SEQ ID NO: 12990 - RNA, 38 nt, Artificial Sequence
  Description of Artificial Sequence:  Enzymatic Nucleic Acid
auaggugucugaugaggccguuaggccgaaaacucaua

SEQ ID NO: 12991 - RNA, 38 nt, Artificial Sequence
  Description of Artificial Sequence:  Enzymatic Nucleic Acid
aauaggugcugaugaggccguuaggccgaaaaacucau

SEQ ID NO: 12992 - RNA, 38 nt, Artificial Sequence
  Description of Artificial Sequence:  Enzymatic Nucleic Acid
gagcggaacugaugaggccguuaggccgaaagguguaa

SEQ ID NO: 12993 - RNA, 38 nt, Artificial Sequence
  Description of Artificial Sequence:  Enzymatic Nucleic Acid
uggagcggcugaugaggccguuaggccgaaauaggugu

SEQ ID NO: 12994 - RNA, 38 nt, Artificial Sequence
  Description of Artificial Sequence:  Enzymatic Nucleic Acid
guggagcgcugaugaggccguuaggccgaaaauaggug

SEQ ID NO: 12995 - RNA, 38 nt, Artificial Sequence
  Description of Artificial Sequence:  Enzymatic Nucleic Acid
cuccugugcugaugaggccguuaggccgaaagcggaau

SEQ ID NO: 12996 - RNA, 38 nt, Artificial Sequence
  Description of Artificial Sequence:  Enzymatic Nucleic Acid
gucacgaacugaugaggccguuaggccgaaagcagcug

SEQ ID NO: 12997 - RNA, 38 nt, Artificial Sequence
  Description of Artificial Sequence:  Enzymatic Nucleic Acid
ggucacgacugaugaggccguuaggccgaaaagcagcu

SEQ ID NO: 12998 - RNA, 38 nt, Artificial Sequence
  Description of Artificial Sequence:  Enzymatic Nucleic Acid
aggucacgcugaugaggccguuaggccgaaaaagcagc

SEQ ID NO: 12999 - RNA, 38 nt, Artificial Sequence
  Description of Artificial Sequence:  Enzymatic Nucleic Acid
aaggucaccugaugaggccguuaggccgaaaaaagcag

SEQ ID NO: 13000 - RNA, 38 nt, Artificial Sequence
  Description of Artificial Sequence:  Enzymatic Nucleic Acid
cacgauuacugaugaggccguuaggccgaaaggucacg

SEQ ID NO: 13001 - RNA, 38 nt, Artificial Sequence
  Description of Artificial Sequence:  Enzymatic Nucleic Acid
gcacgauucugaugaggccguuaggccgaaaaggucac

SEQ ID NO: 13002 - RNA, 38 nt, Artificial Sequence
  Description of Artificial Sequence:  Enzymatic Nucleic Acid
agcacgaucugaugaggccguuaggccgaaaaagguca

SEQ ID NO: 13003 - RNA, 38 nt, Artificial Sequence
  Description of Artificial Sequence:  Enzymatic Nucleic Acid
aaaagcaccugaugaggccguuaggccgaaauuaaagg

SEQ ID NO: 13004 - RNA, 38 nt, Artificial Sequence
  Description of Artificial Sequence:  Enzymatic Nucleic Acid
aaacaaaacugaugaggccguuaggccgaaagcacgau

SEQ ID NO: 13005 - RNA, 38 nt, Artificial Sequence
  Description of Artificial Sequence:  Enzymatic Nucleic Acid
aaaacaaacugaugaggccguuaggccgaaaagcacga

SEQ ID NO: 13006 - RNA, 38 nt, Artificial Sequence
  Description of Artificial Sequence:  Enzymatic Nucleic Acid
aaaaacaacugaugaggccguuaggccgaaaaagcacg

SEQ ID NO: 13007 - RNA, 38 nt, Artificial Sequence
  Description of Artificial Sequence:  Enzymatic Nucleic Acid
aaaaaacacugaugaggccguuaggccgaaaaaagcac

SEQ ID NO: 13008 - RNA, 38 nt, Artificial Sequence
  Description of Artificial Sequence:  Enzymatic Nucleic Acid
caaaaaaccugaugaggccguuaggccgaaaaaaagca

SEQ ID NO: 13009 - RNA, 38 nt, Artificial Sequence
  Description of Artificial Sequence:  Enzymatic Nucleic Acid
aaacaaaacugaugaggccguuaggccgaaacaaaaaa

SEQ ID NO: 13010 - RNA, 38 nt, Artificial Sequence
  Description of Artificial Sequence:  Enzymatic Nucleic Acid
aaaacaaacugaugaggccguuaggccgaaaacaaaaa

SEQ ID NO: 13011 - RNA, 38 nt, Artificial Sequence
  Description of Artificial Sequence:  Enzymatic Nucleic Acid
caaaacaacugaugaggccguuaggccgaaaaacaaaa

SEQ ID NO: 13012 - RNA, 38 nt, Artificial Sequence
  Description of Artificial Sequence:  Enzymatic Nucleic Acid
acaaaacacugaugaggccguuaggccgaaaaaacaaa

SEQ ID NO: 13013 - RNA, 38 nt, Artificial Sequence
  Description of Artificial Sequence:  Enzymatic Nucleic Acid
aacaaaaccugaugaggccguuaggccgaaaaaaacaa

SEQ ID NO: 13014 - RNA, 38 nt, Artificial Sequence
  Description of Artificial Sequence:  Enzymatic Nucleic Acid
acaaacaacugaugaggccguuaggccgaaacaaaaaa

SEQ ID NO: 13015 - RNA, 38 nt, Artificial Sequence
  Description of Artificial Sequence:  Enzymatic Nucleic Acid
aacaaacacugaugaggccguuaggccgaaaacaaaaa

SEQ ID NO: 13016 - RNA, 38 nt, Artificial Sequence
  Description of Artificial Sequence:  Enzymatic Nucleic Acid
caacaaaccugaugaggccguuaggccgaaaaacaaaa

SEQ ID NO: 13017 - RNA, 38 nt, Artificial Sequence
  Description of Artificial Sequence:  Enzymatic Nucleic Acid
caacaacacugaugaggccguuaggccgaaacaaaaca

SEQ ID NO: 13018 - RNA, 38 nt, Artificial Sequence
  Description of Artificial Sequence:  Enzymatic Nucleic Acid
gcaacaaccugaugaggccguuaggccgaaaacaaaac

SEQ ID NO: 13019 - RNA, 38 nt, Artificial Sequence
  Description of Artificial Sequence:  Enzymatic Nucleic Acid
acagcaaccugaugaggccguuaggccgaaacaaacaa

SEQ ID NO: 13020 - RNA, 38 nt, Artificial Sequence
  Description of Artificial Sequence:  Enzymatic Nucleic Acid
aaaacagccugaugaggccguuaggccgaaacaacaaa

SEQ ID NO: 13021 - RNA, 38 nt, Artificial Sequence
  Description of Artificial Sequence:  Enzymatic Nucleic Acid
uuagucaacugaugaggccguuaggccgaaacagcaac

SEQ ID NO: 13022 - RNA, 38 nt, Artificial Sequence
  Description of Artificial Sequence:  Enzymatic Nucleic Acid
guuagucacugaugaggccguuaggccgaaaacagcaa

SEQ ID NO: 13023 - RNA, 38 nt, Artificial Sequence
  Description of Artificial Sequence:  Enzymatic Nucleic Acid
uguuaguccugaugaggccguuaggccgaaaaacagca

SEQ ID NO: 13024 - RNA, 38 nt, Artificial Sequence
  Description of Artificial Sequence:  Enzymatic Nucleic Acid
acuggggucugaugaggccguuaggccgaaacauucuu

SEQ ID NO: 13025 - RNA, 38 nt, Artificial Sequence
  Description of Artificial Sequence:  Enzymatic Nucleic Acid
acgucacucugaugaggccguuaggccgaaacuggggu

SEQ ID NO: 13026 - RNA, 38 nt, Artificial Sequence
  Description of Artificial Sequence:  Enzymatic Nucleic Acid
cacgucaccugaugaggccguuaggccgaaaacugggg

SEQ ID NO: 13027 - RNA, 38 nt, Artificial Sequence
  Description of Artificial Sequence:  Enzymatic Nucleic Acid
aacaauagcugaugaggccguuaggccgaaauucuuca

SEQ ID NO: 13028 - RNA, 38 nt, Artificial Sequence
  Description of Artificial Sequence:  Enzymatic Nucleic Acid
ucuaacaacugaugaggccguuaggccgaaaguauucu

SEQ ID NO: 13029 - RNA, 38 nt, Artificial Sequence
  Description of Artificial Sequence:  Enzymatic Nucleic Acid
ucucuaaccugaugaggccguuaggccgaaauaguauu

SEQ ID NO: 13030 - RNA, 38 nt, Artificial Sequence
  Description of Artificial Sequence:  Enzymatic Nucleic Acid
auuucucucugaugaggccguuaggccgaaacaauagu

SEQ ID NO: 13031 - RNA, 38 nt, Artificial Sequence
  Description of Artificial Sequence:  Enzymatic Nucleic Acid
gauuucuccugaugaggccguuaggccgaaaacaauag

SEQ ID NO: 13032 - RNA, 38 nt, Artificial Sequence
  Description of Artificial Sequence:  Enzymatic Nucleic Acid
gcggggggcugaugaggccguuaggccgaaauuucucu

SEQ ID NO: 13033 - RNA, 38 nt, Artificial Sequence
  Description of Artificial Sequence:  Enzymatic Nucleic Acid
guuacccucugaugaggccguuaggccgaaaggcuuug

SEQ ID NO: 13034 - RNA, 38 nt, Artificial Sequence
  Description of Artificial Sequence:  Enzymatic Nucleic Acid
guccaggucugaugaggccguuaggccgaaacccugag

SEQ ID NO: 13035 - RNA, 38 nt, Artificial Sequence
  Description of Artificial Sequence:  Enzymatic Nucleic Acid
ggucgccacugaugaggccguuaggccgaaaggcaccu

SEQ ID NO: 13036 - RNA, 38 nt, Artificial Sequence
  Description of Artificial Sequence:  Enzymatic Nucleic Acid
gcugcaggcugaugaggccguuaggccgaaaggguggg

SEQ ID NO: 13037 - RNA, 38 nt, Artificial Sequence
  Description of Artificial Sequence:  Enzymatic Nucleic Acid
acugccuccugaugaggccguuaggccgaaagucccac

SEQ ID NO: 13038 - RNA, 38 nt, Artificial Sequence
  Description of Artificial Sequence:  Enzymatic Nucleic Acid
aaugggcucugaugaggccguuaggccgaaacugccuc

SEQ ID NO: 13039 - RNA, 38 nt, Artificial Sequence
  Description of Artificial Sequence:  Enzymatic Nucleic Acid
caugagcucugaugaggccguuaggccgaaaugggcuu

SEQ ID NO: 13040 - RNA, 38 nt, Artificial Sequence
  Description of Artificial Sequence:  Enzymatic Nucleic Acid
ccaugagccugaugaggccguuaggccgaaaaugggcu

SEQ ID NO: 13041 - RNA, 38 nt, Artificial Sequence
  Description of Artificial Sequence:  Enzymatic Nucleic Acid
gcagccaucugaugaggccguuaggccgaaagcuaaug

SEQ ID NO: 13042 - RNA, 38 nt, Artificial Sequence
  Description of Artificial Sequence:  Enzymatic Nucleic Acid
gagagacacugaugaggccguuaggccgaaagcagguc

SEQ ID NO: 13043 - RNA, 38 nt, Artificial Sequence
  Description of Artificial Sequence:  Enzymatic Nucleic Acid
auaagagacugaugaggccguuaggccgaaacagagca

SEQ ID NO: 13044 - RNA, 38 nt, Artificial Sequence
  Description of Artificial Sequence:  Enzymatic Nucleic Acid
ccauaagacugaugaggccguuaggccgaaagacagag

SEQ ID NO: 13045 - RNA, 38 nt, Artificial Sequence
  Description of Artificial Sequence:  Enzymatic Nucleic Acid
cuccauaacugaugaggccguuaggccgaaagagacag

SEQ ID NO: 13046 - RNA, 38 nt, Artificial Sequence
  Description of Artificial Sequence:  Enzymatic Nucleic Acid
uccuccaucugaugaggccguuaggccgaaagagagac

SEQ ID NO: 13047 - RNA, 38 nt, Artificial Sequence
  Description of Artificial Sequence:  Enzymatic Nucleic Acid
uuccuccacugaugaggccguuaggccgaaaagagaga

SEQ ID NO: 13048 - RNA, 38 nt, Artificial Sequence
  Description of Artificial Sequence:  Enzymatic Nucleic Acid
gcaucccacugaugaggccguuaggccgaaagccuuuu

SEQ ID NO: 13049 - RNA, 38 nt, Artificial Sequence
  Description of Artificial Sequence:  Enzymatic Nucleic Acid
cgcauccccugaugaggccguuaggccgaaaagccuuu

SEQ ID NO: 13050 - RNA, 38 nt, Artificial Sequence
  Description of Artificial Sequence:  Enzymatic Nucleic Acid
acaggacgcugaugaggccguuaggccgaaacgcaucc

SEQ ID NO: 13051 - RNA, 38 nt, Artificial Sequence
  Description of Artificial Sequence:  Enzymatic Nucleic Acid
cuccacagcugaugaggccguuaggccgaaacggacgc

SEQ ID NO: 13052 - RNA, 38 nt, Artificial Sequence
  Description of Artificial Sequence:  Enzymatic Nucleic Acid
gcauagcgcugaugaggccguuaggccgaaagcccccu

SEQ ID NO: 13053 - RNA, 38 nt, Artificial Sequence
  Description of Artificial Sequence:  Enzymatic Nucleic Acid
aaguggcacugaugaggccguuaggccgaaagcggagc

SEQ ID NO: 13054 - RNA, 38 nt, Artificial Sequence
  Description of Artificial Sequence:  Enzymatic Nucleic Acid
agucacugcugaugaggccguuaggccgaaaguggcau

SEQ ID NO: 13055 - RNA, 38 nt, Artificial Sequence
  Description of Artificial Sequence:  Enzymatic Nucleic Acid
aagucacucugaugaggccguuaggccgaaaaguggca

SEQ ID NO: 13056 - RNA, 38 nt, Artificial Sequence
  Description of Artificial Sequence:  Enzymatic Nucleic Acid
ggagugagcugaugaggccguuaggccgaaagucacug

SEQ ID NO: 13057 - RNA, 38 nt, Artificial Sequence
  Description of Artificial Sequence:  Enzymatic Nucleic Acid
aggagugacugaugaggccguuaggccgaaaagucacu

SEQ ID NO: 13058 - RNA, 38 nt, Artificial Sequence
  Description of Artificial Sequence:  Enzymatic Nucleic Acid
ccaggagucugaugaggccguuaggccgaaagaaguca

SEQ ID NO: 13059 - RNA, 38 nt, Artificial Sequence
  Description of Artificial Sequence:  Enzymatic Nucleic Acid
gaggccagcugaugaggccguuaggccgaaagugagaa

SEQ ID NO: 13060 - RNA, 38 nt, Artificial Sequence
  Description of Artificial Sequence:  Enzymatic Nucleic Acid
aaacagcgcugaugaggccguuaggccgaaaggccagg

SEQ ID NO: 13061 - RNA, 38 nt, Artificial Sequence
  Description of Artificial Sequence:  Enzymatic Nucleic Acid
gggcccgacugaugaggccguuaggccgaaacagcgga

SEQ ID NO: 13062 - RNA, 38 nt, Artificial Sequence
  Description of Artificial Sequence:  Enzymatic Nucleic Acid
ggggcccgcugaugaggccguuaggccgaaaacagcgg

SEQ ID NO: 13063 - RNA, 38 nt, Artificial Sequence
  Description of Artificial Sequence:  Enzymatic Nucleic Acid
gggggccccugaugaggccguuaggccgaaaaacagcg

SEQ ID NO: 13064 - RNA, 38 nt, Artificial Sequence
  Description of Artificial Sequence:  Enzymatic Nucleic Acid
ccucuuggcugaugaggccguuaggccgaaagggggcc

SEQ ID NO: 13065 - RNA, 38 nt, Artificial Sequence
  Description of Artificial Sequence:  Enzymatic Nucleic Acid
accucuugcugaugaggccguuaggccgaaaagggggc

SEQ ID NO: 13066 - RNA, 38 nt, Artificial Sequence
  Description of Artificial Sequence:  Enzymatic Nucleic Acid
ugcucugacugaugaggccguuaggccgaaaccucuug

SEQ ID NO: 13067 - RNA, 38 nt, Artificial Sequence
  Description of Artificial Sequence:  Enzymatic Nucleic Acid
ucugcucucugaugaggccguuaggccgaaauaccucu

SEQ ID NO: 13068 - RNA, 38 nt, Artificial Sequence
  Description of Artificial Sequence:  Enzymatic Nucleic Acid
gucuaggacugaugaggccguuaggccgaaacgucccu

SEQ ID NO: 13069 - RNA, 38 nt, Artificial Sequence
  Description of Artificial Sequence:  Enzymatic Nucleic Acid
ggucuaggcugaugaggccguuaggccgaaaacguccc

SEQ ID NO: 13070 - RNA, 38 nt, Artificial Sequence
  Description of Artificial Sequence:  Enzymatic Nucleic Acid
uggucuagcugaugaggccguuaggccgaaaaacgucc

SEQ ID NO: 13071 - RNA, 38 nt, Artificial Sequence
  Description of Artificial Sequence:  Enzymatic Nucleic Acid
cccugguccugaugaggccguuaggccgaaaggaaacg

SEQ ID NO: 13072 - RNA, 38 nt, Artificial Sequence
  Description of Artificial Sequence:  Enzymatic Nucleic Acid
uucccgagcugaugaggccguuaggccgaaacaugugc

SEQ ID NO: 13073 - RNA, 38 nt, Artificial Sequence
  Description of Artificial Sequence:  Enzymatic Nucleic Acid
guucccgacugaugaggccguuaggccgaaaacaugug

SEQ ID NO: 13074 - RNA, 38 nt, Artificial Sequence
  Description of Artificial Sequence:  Enzymatic Nucleic Acid
ugguuccccugaugaggccguuaggccgaaagaacaug

SEQ ID NO: 13075 - RNA, 38 nt, Artificial Sequence
  Description of Artificial Sequence:  Enzymatic Nucleic Acid
uuaagauucugaugaggccguuaggccgaaacuguggu

SEQ ID NO: 13076 - RNA, 38 nt, Artificial Sequence
  Description of Artificial Sequence:  Enzymatic Nucleic Acid
uuuaagaucugaugaggccguuaggccgaaaacugugg

SEQ ID NO: 13077 - RNA, 38 nt, Artificial Sequence
  Description of Artificial Sequence:  Enzymatic Nucleic Acid
agauuuaacugaugaggccguuaggccgaaauuaacug

SEQ ID NO: 13078 - RNA, 38 nt, Artificial Sequence
  Description of Artificial Sequence:  Enzymatic Nucleic Acid
aaagauuucugaugaggccguuaggccgaaagauuaac

SEQ ID NO: 13079 - RNA, 38 nt, Artificial Sequence
  Description of Artificial Sequence:  Enzymatic Nucleic Acid
aaaagauucugaugaggccguuaggccgaaaagauuaa

SEQ ID NO: 13080 - RNA, 38 nt, Artificial Sequence
  Description of Artificial Sequence:  Enzymatic Nucleic Acid
cgggaaaacugaugaggccguuaggccgaaauuuaaga

SEQ ID NO: 13081 - RNA, 38 nt, Artificial Sequence
  Description of Artificial Sequence:  Enzymatic Nucleic Acid
cccgggaacugaugaggccguuaggccgaaagauuuaa

SEQ ID NO: 13082 - RNA, 38 nt, Artificial Sequence
  Description of Artificial Sequence:  Enzymatic Nucleic Acid
ucccgggacugaugaggccguuaggccgaaaagauuua

SEQ ID NO: 13083 - RNA, 38 nt, Artificial Sequence
  Description of Artificial Sequence:  Enzymatic Nucleic Acid
cucccgggcugaugaggccguuaggccgaaaaagauuu

SEQ ID NO: 13084 - RNA, 38 nt, Artificial Sequence
  Description of Artificial Sequence:  Enzymatic Nucleic Acid
acucccggcugaugaggccguuaggccgaaaaaagauu

SEQ ID NO: 13085 - RNA, 38 nt, Artificial Sequence
  Description of Artificial Sequence:  Enzymatic Nucleic Acid
caacagaacugaugaggccguuaggccgaaacucccgg

SEQ ID NO: 13086 - RNA, 38 nt, Artificial Sequence
  Description of Artificial Sequence:  Enzymatic Nucleic Acid
gacaacagcugaugaggccguuaggccgaaagacuccc

SEQ ID NO: 13087 - RNA, 38 nt, Artificial Sequence
  Description of Artificial Sequence:  Enzymatic Nucleic Acid
agacaacacugaugaggccguuaggccgaaaagacucc

SEQ ID NO: 13088 - RNA, 38 nt, Artificial Sequence
  Description of Artificial Sequence:  Enzymatic Nucleic Acid
aaacagaccugaugaggccguuaggccgaaacagaaga

SEQ ID NO: 13089 - RNA, 38 nt, Artificial Sequence
  Description of Artificial Sequence:  Enzymatic Nucleic Acid
gguaaacacugaugaggccguuaggccgaaacaacaga

SEQ ID NO: 13090 - RNA, 38 nt, Artificial Sequence
  Description of Artificial Sequence:  Enzymatic Nucleic Acid
ggaugguacugaugaggccguuaggccgaaacagacaa

SEQ ID NO: 13091 - RNA, 38 nt, Artificial Sequence
  Description of Artificial Sequence:  Enzymatic Nucleic Acid
uggauggucugaugaggccguuaggccgaaaacagaca

SEQ ID NO: 13092 - RNA, 38 nt, Artificial Sequence
  Description of Artificial Sequence:  Enzymatic Nucleic Acid
uuggauggcugaugaggccguuaggccgaaaaacagac

SEQ ID NO: 13093 - RNA, 38 nt, Artificial Sequence
  Description of Artificial Sequence:  Enzymatic Nucleic Acid
augcuuugcugaugaggccguuaggccgaaaugguaaa

SEQ ID NO: 13094 - RNA, 38 nt, Artificial Sequence
  Description of Artificial Sequence:  Enzymatic Nucleic Acid
auguuaaacugaugaggccguuaggccgaaaugcuuug

SEQ ID NO: 13095 - RNA, 38 nt, Artificial Sequence
  Description of Artificial Sequence:  Enzymatic Nucleic Acid
acauguuacugaugaggccguuaggccgaaauaugcuu

SEQ ID NO: 13096 - RNA, 38 nt, Artificial Sequence
  Description of Artificial Sequence:  Enzymatic Nucleic Acid
cacauguucugaugaggccguuaggccgaaaauaugcu

SEQ ID NO: 13097 - RNA, 38 nt, Artificial Sequence
  Description of Artificial Sequence:  Enzymatic Nucleic Acid
acacaugucugaugaggccguuaggccgaaaaauaugc

SEQ ID NO: 13098 - RNA, 38 nt, Artificial Sequence
  Description of Artificial Sequence:  Enzymatic Nucleic Acid
cccccacucugaugaggccguuaggccgaaacacaugu

SEQ ID NO: 13099 - RNA, 38 nt, Artificial Sequence
  Description of Artificial Sequence:  Enzymatic Nucleic Acid
cagaagcccugaugaggccguuaggccgaaagcgccac

SEQ ID NO: 13100 - RNA, 38 nt, Artificial Sequence
  Description of Artificial Sequence:  Enzymatic Nucleic Acid
ggccucagcugaugaggccguuaggccgaaagccaagc

SEQ ID NO: 13101 - RNA, 38 nt, Artificial Sequence
  Description of Artificial Sequence:  Enzymatic Nucleic Acid
uggccucacugaugaggccguuaggccgaaaagccaag

SEQ ID NO: 13102 - RNA, 38 nt, Artificial Sequence
  Description of Artificial Sequence:  Enzymatic Nucleic Acid
gaacugaucugaugaggccguuaggccgaaauggcucu

SEQ ID NO: 13103 - RNA, 38 nt, Artificial Sequence
  Description of Artificial Sequence:  Enzymatic Nucleic Acid
gaggaacucugaugaggccguuaggccgaaaugauggc

SEQ ID NO: 13104 - RNA, 38 nt, Artificial Sequence
  Description of Artificial Sequence:  Enzymatic Nucleic Acid
acuagaggcugaugaggccguuaggccgaaacugauga

SEQ ID NO: 13105 - RNA, 38 nt, Artificial Sequence
  Description of Artificial Sequence:  Enzymatic Nucleic Acid
cacuagagcugaugaggccguuaggccgaaaacugaug

SEQ ID NO: 13106 - RNA, 38 nt, Artificial Sequence
  Description of Artificial Sequence:  Enzymatic Nucleic Acid
ucucacuacugaugaggccguuaggccgaaaggaacug

SEQ ID NO: 13107 - RNA, 38 nt, Artificial Sequence
  Description of Artificial Sequence:  Enzymatic Nucleic Acid
caucucaccugaugaggccguuaggccgaaagaggaac

SEQ ID NO: 13108 - RNA, 38 nt, Artificial Sequence
  Description of Artificial Sequence:  Enzymatic Nucleic Acid
augaccuccugaugaggccguuaggccgaaaugcaucu

SEQ ID NO: 13109 - RNA, 38 nt, Artificial Sequence
  Description of Artificial Sequence:  Enzymatic Nucleic Acid
uuggguaucugaugaggccguuaggccgaaaccucaau

SEQ ID NO: 13110 - RNA, 38 nt, Artificial Sequence
  Description of Artificial Sequence:  Enzymatic Nucleic Acid
agcuugggcugaugaggccguuaggccgaaaugaccuc

SEQ ID NO: 13111 - RNA, 38 nt, Artificial Sequence
  Description of Artificial Sequence:  Enzymatic Nucleic Acid
aggccugccugaugaggccguuaggccgaaagcuuggg

SEQ ID NO: 13112 - RNA, 38 nt, Artificial Sequence
  Description of Artificial Sequence:  Enzymatic Nucleic Acid
aguaugcgcugaugaggccguuaggccgaaaggucagg

SEQ ID NO: 13113 - RNA, 38 nt, Artificial Sequence
  Description of Artificial Sequence:  Enzymatic Nucleic Acid
caguaugccugaugaggccguuaggccgaaaaggucag

SEQ ID NO: 13114 - RNA, 38 nt, Artificial Sequence
  Description of Artificial Sequence:  Enzymatic Nucleic Acid
gugagcagcugaugaggccguuaggccgaaaugcgaag

SEQ ID NO: 13115 - RNA, 38 nt, Artificial Sequence
  Description of Artificial Sequence:  Enzymatic Nucleic Acid
cuccccgucugaugaggccguuaggccgaaagcaguau

SEQ ID NO: 13116 - RNA, 38 nt, Artificial Sequence
  Description of Artificial Sequence:  Enzymatic Nucleic Acid
gaccacuucugaugaggccguuaggccgaaacuccccg

SEQ ID NO: 13117 - RNA, 38 nt, Artificial Sequence
  Description of Artificial Sequence:  Enzymatic Nucleic Acid
ggaccacucugaugaggccguuaggccgaaaacucccc

SEQ ID NO: 13118 - RNA, 38 nt, Artificial Sequence
  Description of Artificial Sequence:  Enzymatic Nucleic Acid
ccaaacugcugaugaggccguuaggccgaaaccacuua

SEQ ID NO: 13119 - RNA, 38 nt, Artificial Sequence
  Description of Artificial Sequence:  Enzymatic Nucleic Acid
cuaggccacugaugaggccguuaggccgaaacuggacc

SEQ ID NO: 13120 - RNA, 38 nt, Artificial Sequence
  Description of Artificial Sequence:  Enzymatic Nucleic Acid
acuaggcccugaugaggccguuaggccgaaaacuggac

SEQ ID NO: 13121 - RNA, 38 nt, Artificial Sequence
  Description of Artificial Sequence:  Enzymatic Nucleic Acid
aaccuuaccugaugaggccguuaggccgaaaggccaaa

SEQ ID NO: 13122 - RNA, 38 nt, Artificial Sequence
  Description of Artificial Sequence:  Enzymatic Nucleic Acid
ggcaaccucugaugaggccguuaggccgaaacuaggcc

SEQ ID NO: 13123 - RNA, 38 nt, Artificial Sequence
  Description of Artificial Sequence:  Enzymatic Nucleic Acid
caguaggccugaugaggccguuaggccgaaaccuuacu

SEQ ID NO: 13124 - RNA, 38 nt, Artificial Sequence
  Description of Artificial Sequence:  Enzymatic Nucleic Acid
cccaucagcugaugaggccguuaggccgaaaggcaacc

SEQ ID NO: 13125 - RNA, 38 nt, Artificial Sequence
  Description of Artificial Sequence:  Enzymatic Nucleic Acid
uggcuuuucugaugaggccguuaggccgaaagcccauc

SEQ ID NO: 13126 - RNA, 38 nt, Artificial Sequence
  Description of Artificial Sequence:  Enzymatic Nucleic Acid
cuguuuaacugaugaggccguuaggccgaaauguggcu

SEQ ID NO: 13127 - RNA, 38 nt, Artificial Sequence
  Description of Artificial Sequence:  Enzymatic Nucleic Acid
ccuguuuacugaugaggccguuaggccgaaaauguggc

SEQ ID NO: 13128 - RNA, 38 nt, Artificial Sequence
  Description of Artificial Sequence:  Enzymatic Nucleic Acid
accuguuucugaugaggccguuaggccgaaaaaugugg

SEQ ID NO: 13129 - RNA, 38 nt, Artificial Sequence
  Description of Artificial Sequence:  Enzymatic Nucleic Acid
aaccuguucugaugaggccguuaggccgaaaaaaugug

SEQ ID NO: 13130 - RNA, 38 nt, Artificial Sequence
  Description of Artificial Sequence:  Enzymatic Nucleic Acid
ugagauaacugaugaggccguuaggccgaaaccuguuu

SEQ ID NO: 13131 - RNA, 38 nt, Artificial Sequence
  Description of Artificial Sequence:  Enzymatic Nucleic Acid
uugagauacugaugaggccguuaggccgaaaaccuguu

SEQ ID NO: 13132 - RNA, 38 nt, Artificial Sequence
  Description of Artificial Sequence:  Enzymatic Nucleic Acid
cuugagaucugaugaggccguuaggccgaaaaaccugu

SEQ ID NO: 13133 - RNA, 38 nt, Artificial Sequence
  Description of Artificial Sequence:  Enzymatic Nucleic Acid
acuugagacugaugaggccguuaggccgaaaaaaccug

SEQ ID NO: 13134 - RNA, 38 nt, Artificial Sequence
  Description of Artificial Sequence:  Enzymatic Nucleic Acid
auacuugacugaugaggccguuaggccgaaauaaaacc

SEQ ID NO: 13135 - RNA, 38 nt, Artificial Sequence
  Description of Artificial Sequence:  Enzymatic Nucleic Acid
uaauacuucugaugaggccguuaggccgaaagauaaaa

SEQ ID NO: 13136 - RNA, 38 nt, Artificial Sequence
  Description of Artificial Sequence:  Enzymatic Nucleic Acid
uauauuaacugaugaggccguuaggccgaaacuugaga

SEQ ID NO: 13137 - RNA, 38 nt, Artificial Sequence
  Description of Artificial Sequence:  Enzymatic Nucleic Acid
uauauauucugaugaggccguuaggccgaaauacuuga

SEQ ID NO: 13138 - RNA, 38 nt, Artificial Sequence
  Description of Artificial Sequence:  Enzymatic Nucleic Acid
cuauauaucugaugaggccguuaggccgaaaauacuug

SEQ ID NO: 13139 - RNA, 38 nt, Artificial Sequence
  Description of Artificial Sequence:  Enzymatic Nucleic Acid
ugucuauacugaugaggccguuaggccgaaauuaauac

SEQ ID NO: 13140 - RNA, 38 nt, Artificial Sequence
  Description of Artificial Sequence:  Enzymatic Nucleic Acid
cuugucuacugaugaggccguuaggccgaaauauuaau

SEQ ID NO: 13141 - RNA, 38 nt, Artificial Sequence
  Description of Artificial Sequence:  Enzymatic Nucleic Acid
gucuuguccugaugaggccguuaggccgaaauauauua

SEQ ID NO: 13142 - RNA, 38 nt, Artificial Sequence
  Description of Artificial Sequence:  Enzymatic Nucleic Acid
uaaugcaucugaugaggccguuaggccgaaagugucuu

SEQ ID NO: 13143 - RNA, 38 nt, Artificial Sequence
  Description of Artificial Sequence:  Enzymatic Nucleic Acid
auaaugcacugaugaggccguuaggccgaaaagugucu

SEQ ID NO: 13144 - RNA, 38 nt, Artificial Sequence
  Description of Artificial Sequence:  Enzymatic Nucleic Acid
aacaggaucugaugaggccguuaggccgaaaugcauaa

SEQ ID NO: 13145 - RNA, 38 nt, Artificial Sequence
  Description of Artificial Sequence:  Enzymatic Nucleic Acid
aaacaggacugaugaggccguuaggccgaaaaugcaua

SEQ ID NO: 13146 - RNA, 38 nt, Artificial Sequence
  Description of Artificial Sequence:  Enzymatic Nucleic Acid
uaaaacagcugaugaggccguuaggccgaaauaaugca

SEQ ID NO: 13147 - RNA, 38 nt, Artificial Sequence
  Description of Artificial Sequence:  Enzymatic Nucleic Acid
auauauaacugaugaggccguuaggccgaaacaggaua

SEQ ID NO: 13148 - RNA, 38 nt, Artificial Sequence
  Description of Artificial Sequence:  Enzymatic Nucleic Acid
gauauauacugaugaggccguuaggccgaaaacaggau

SEQ ID NO: 13149 - RNA, 38 nt, Artificial Sequence
  Description of Artificial Sequence:  Enzymatic Nucleic Acid
ggauauaucugaugaggccguuaggccgaaaaacagga

SEQ ID NO: 13150 - RNA, 38 nt, Artificial Sequence
  Description of Artificial Sequence:  Enzymatic Nucleic Acid
uggauauacugaugaggccguuaggccgaaaaaacagg

SEQ ID NO: 13151 - RNA, 38 nt, Artificial Sequence
  Description of Artificial Sequence:  Enzymatic Nucleic Acid
auuggauacugaugaggccguuaggccgaaauaaaaca

SEQ ID NO: 13152 - RNA, 38 nt, Artificial Sequence
  Description of Artificial Sequence:  Enzymatic Nucleic Acid
ucauuggacugaugaggccguuaggccgaaauauaaaa

SEQ ID NO: 13153 - RNA, 38 nt, Artificial Sequence
  Description of Artificial Sequence:  Enzymatic Nucleic Acid
auucauugcugaugaggccguuaggccgaaauauauaa

SEQ ID NO: 13154 - RNA, 38 nt, Artificial Sequence
  Description of Artificial Sequence:  Enzymatic Nucleic Acid
cccaguuacugaugaggccguuaggccgaaauucauug

SEQ ID NO: 13155 - RNA, 38 nt, Artificial Sequence
  Description of Artificial Sequence:  Enzymatic Nucleic Acid
gccccagucugaugaggccguuaggccgaaauauucau

SEQ ID NO: 13156 - RNA, 38 nt, Artificial Sequence
  Description of Artificial Sequence:  Enzymatic Nucleic Acid
ugacucuucugaugaggccguuaggccgaaacucgccc

SEQ ID NO: 13157 - RNA, 38 nt, Artificial Sequence
  Description of Artificial Sequence:  Enzymatic Nucleic Acid
augacucucugaugaggccguuaggccgaaaacucgcc

SEQ ID NO: 13158 - RNA, 38 nt, Artificial Sequence
  Description of Artificial Sequence:  Enzymatic Nucleic Acid
uagaccaucugaugaggccguuaggccgaaacucuuaa

SEQ ID NO: 13159 - RNA, 38 nt, Artificial Sequence
  Description of Artificial Sequence:  Enzymatic Nucleic Acid
cuuuucuacugaugaggccguuaggccgaaaccaugac

SEQ ID NO: 13160 - RNA, 38 nt, Artificial Sequence
  Description of Artificial Sequence:  Enzymatic Nucleic Acid
cccuuuuccugaugaggccguuaggccgaaagaccaug

SEQ ID NO: 13161 - RNA, 38 nt, Artificial Sequence
  Description of Artificial Sequence:  Enzymatic Nucleic Acid
uacagagacugaugaggccguuaggccgaaaccccuuu

SEQ ID NO: 13162 - RNA, 38 nt, Artificial Sequence
  Description of Artificial Sequence:  Enzymatic Nucleic Acid
guacagagcugaugaggccguuaggccgaaaaccccuu

SEQ ID NO: 13163 - RNA, 38 nt, Artificial Sequence
  Description of Artificial Sequence:  Enzymatic Nucleic Acid
gguacagacugaugaggccguuaggccgaaaaaccccu

SEQ ID NO: 13164 - RNA, 38 nt, Artificial Sequence
  Description of Artificial Sequence:  Enzymatic Nucleic Acid
uggguacacugaugaggccguuaggccgaaagaaaccc

SEQ ID NO: 13165 - RNA, 38 nt, Artificial Sequence
  Description of Artificial Sequence:  Enzymatic Nucleic Acid
gauuugggcugaugaggccguuaggccgaaacagagaa

SEQ ID NO: 13166 - RNA, 38 nt, Artificial Sequence
  Description of Artificial Sequence:  Enzymatic Nucleic Acid
accagccccugaugaggccguuaggccgaaauuugggu

SEQ ID NO: 13167 - RNA, 38 nt, Artificial Sequence
  Description of Artificial Sequence:  Enzymatic Nucleic Acid
cuuggucccugaugaggccguuaggccgaaaccagccc

SEQ ID NO: 13168 - RNA, 38 nt, Artificial Sequence
  Description of Artificial Sequence:  Enzymatic Nucleic Acid
gcugggaccugaugaggccguuaggccgaaaccacucu

SEQ ID NO: 13169 - RNA, 38 nt, Artificial Sequence
  Description of Artificial Sequence:  Enzymatic Nucleic Acid
auagcuggcugaugaggccguuaggccgaaacaaccac

SEQ ID NO: 13170 - RNA, 38 nt, Artificial Sequence
  Description of Artificial Sequence:  Enzymatic Nucleic Acid
aguaacuacugaugaggccguuaggccgaaagcuggga

SEQ ID NO: 13171 - RNA, 38 nt, Artificial Sequence
  Description of Artificial Sequence:  Enzymatic Nucleic Acid
uuaguaaccugaugaggccguuaggccgaaauagcugg

SEQ ID NO: 13172 - RNA, 38 nt, Artificial Sequence
  Description of Artificial Sequence:  Enzymatic Nucleic Acid
aguuuagucugaugaggccguuaggccgaaacuauagc

SEQ ID NO: 13173 - RNA, 38 nt, Artificial Sequence
  Description of Artificial Sequence:  Enzymatic Nucleic Acid
uaguuuagcugaugaggccguuaggccgaaaacuauag

SEQ ID NO: 13174 - RNA, 38 nt, Artificial Sequence
  Description of Artificial Sequence:  Enzymatic Nucleic Acid
gaguaguucugaugaggccguuaggccgaaaguaacua

SEQ ID NO: 13175 - RNA, 38 nt, Artificial Sequence
  Description of Artificial Sequence:  Enzymatic Nucleic Acid
ugggugagcugaugaggccguuaggccgaaaguuuagu

SEQ ID NO: 13176 - RNA, 38 nt, Artificial Sequence
  Description of Artificial Sequence:  Enzymatic Nucleic Acid
cuuugggucugaugaggccguuaggccgaaaguaguuu

SEQ ID NO: 13177 - RNA, 38 nt, Artificial Sequence
  Description of Artificial Sequence:  Enzymatic Nucleic Acid
gagguccccugaugaggccguuaggccgaaacuuuggg

SEQ ID NO: 13178 - RNA, 38 nt, Artificial Sequence
  Description of Artificial Sequence:  Enzymatic Nucleic Acid
aagccagucugaugaggccguuaggccgaaagguccca

SEQ ID NO: 13179 - RNA, 38 nt, Artificial Sequence
  Description of Artificial Sequence:  Enzymatic Nucleic Acid
guaaagagcugaugaggccguuaggccgaaagccagug

SEQ ID NO: 13180 - RNA, 38 nt, Artificial Sequence
  Description of Artificial Sequence:  Enzymatic Nucleic Acid
aguaaagacugaugaggccguuaggccgaaaagccagu

SEQ ID NO: 13181 - RNA, 38 nt, Artificial Sequence
  Description of Artificial Sequence:  Enzymatic Nucleic Acid
gaaguaaacugaugaggccguuaggccgaaagaagcca

SEQ ID NO: 13182 - RNA, 38 nt, Artificial Sequence
  Description of Artificial Sequence:  Enzymatic Nucleic Acid
augaaguacugaugaggccguuaggccgaaagagaagc

SEQ ID NO: 13183 - RNA, 38 nt, Artificial Sequence
  Description of Artificial Sequence:  Enzymatic Nucleic Acid
gaugaagucugaugaggccguuaggccgaaaagagaag

SEQ ID NO: 13184 - RNA, 38 nt, Artificial Sequence
  Description of Artificial Sequence:  Enzymatic Nucleic Acid
ugaugaagcugaugaggccguuaggccgaaaaagagaa

SEQ ID NO: 13185 - RNA, 38 nt, Artificial Sequence
  Description of Artificial Sequence:  Enzymatic Nucleic Acid
ccaugaugcugaugaggccguuaggccgaaaguaaaga

SEQ ID NO: 13186 - RNA, 38 nt, Artificial Sequence
  Description of Artificial Sequence:  Enzymatic Nucleic Acid
uccaugaucugaugaggccguuaggccgaaaaguaaag

SEQ ID NO: 13187 - RNA, 38 nt, Artificial Sequence
  Description of Artificial Sequence:  Enzymatic Nucleic Acid
aaauccaucugaugaggccguuaggccgaaaugaagua

SEQ ID NO: 13188 - RNA, 38 nt, Artificial Sequence
  Description of Artificial Sequence:  Enzymatic Nucleic Acid
gauggugacugaugaggccguuaggccgaaauccauga

SEQ ID NO: 13189 - RNA, 38 nt, Artificial Sequence
  Description of Artificial Sequence:  Enzymatic Nucleic Acid
ggauggugcugaugaggccguuaggccgaaaauccaug

SEQ ID NO: 13190 - RNA, 38 nt, Artificial Sequence
  Description of Artificial Sequence:  Enzymatic Nucleic Acid
gggauggucugaugaggccguuaggccgaaaaauccau

SEQ ID NO: 13191 - RNA, 38 nt, Artificial Sequence
  Description of Artificial Sequence:  Enzymatic Nucleic Acid
ugccuuggcugaugaggccguuaggccgaaauggugaa

SEQ ID NO: 13192 - RNA, 38 nt, Artificial Sequence
  Description of Artificial Sequence:  Enzymatic Nucleic Acid
uccucucacugaugaggccguuaggccgaaacugccuu

SEQ ID NO: 13193 - RNA, 38 nt, Artificial Sequence
  Description of Artificial Sequence:  Enzymatic Nucleic Acid
auacucuucugaugaggccguuaggccgaaagcuccuc

SEQ ID NO: 13194 - RNA, 38 nt, Artificial Sequence
  Description of Artificial Sequence:  Enzymatic Nucleic Acid
ugggcugacugaugaggccguuaggccgaaacucuuua

SEQ ID NO: 13195 - RNA, 38 nt, Artificial Sequence
  Description of Artificial Sequence:  Enzymatic Nucleic Acid
uaugggcucugaugaggccguuaggccgaaauacucuu

SEQ ID NO: 13196 - RNA, 38 nt, Artificial Sequence
  Description of Artificial Sequence:  Enzymatic Nucleic Acid
uuaauaaacugaugaggccguuaggccgaaaugggcug

SEQ ID NO: 13197 - RNA, 38 nt, Artificial Sequence
  Description of Artificial Sequence:  Enzymatic Nucleic Acid
gcuuaauacugaugaggccguuaggccgaaauaugggc

SEQ ID NO: 13198 - RNA, 38 nt, Artificial Sequence
  Description of Artificial Sequence:  Enzymatic Nucleic Acid
ugcuuaaucugaugaggccguuaggccgaaaauauggg

SEQ ID NO: 13199 - RNA, 38 nt, Artificial Sequence
  Description of Artificial Sequence:  Enzymatic Nucleic Acid
gugcuuaacugaugaggccguuaggccgaaaaauaugg

SEQ ID NO: 13200 - RNA, 38 nt, Artificial Sequence
  Description of Artificial Sequence:  Enzymatic Nucleic Acid
aagugcuucugaugaggccguuaggccgaaauaaauau

SEQ ID NO: 13201 - RNA, 38 nt, Artificial Sequence
  Description of Artificial Sequence:  Enzymatic Nucleic Acid
aaagugcucugaugaggccguuaggccgaaaauaaaua

SEQ ID NO: 13202 - RNA, 38 nt, Artificial Sequence
  Description of Artificial Sequence:  Enzymatic Nucleic Acid
ggagcauacugaugaggccguuaggccgaaagugcuua

SEQ ID NO: 13203 - RNA, 38 nt, Artificial Sequence
  Description of Artificial Sequence:  Enzymatic Nucleic Acid
aggagcaucugaugaggccguuaggccgaaaagugcuu

SEQ ID NO: 13204 - RNA, 38 nt, Artificial Sequence
  Description of Artificial Sequence:  Enzymatic Nucleic Acid
aaggagcacugaugaggccguuaggccgaaaaagugcu

SEQ ID NO: 13205 - RNA, 38 nt, Artificial Sequence
  Description of Artificial Sequence:  Enzymatic Nucleic Acid
gugccaagcugaugaggccguuaggccgaaagcauaaa

SEQ ID NO: 13206 - RNA, 38 nt, Artificial Sequence
  Description of Artificial Sequence:  Enzymatic Nucleic Acid
gcugugcccugaugaggccguuaggccgaaaggagcau

SEQ ID NO: 13207 - RNA, 38 nt, Artificial Sequence
  Description of Artificial Sequence:  Enzymatic Nucleic Acid
gcauaaaucugaugaggccguuaggccgaaacacauca

SEQ ID NO: 13208 - RNA, 38 nt, Artificial Sequence
  Description of Artificial Sequence:  Enzymatic Nucleic Acid
cuugcauacugaugaggccguuaggccgaaauuacaca

SEQ ID NO: 13209 - RNA, 38 nt, Artificial Sequence
  Description of Artificial Sequence:  Enzymatic Nucleic Acid
gcuugcaucugaugaggccguuaggccgaaaauuacac

SEQ ID NO: 13210 - RNA, 38 nt, Artificial Sequence
  Description of Artificial Sequence:  Enzymatic Nucleic Acid
agcuugcacugaugaggccguuaggccgaaaaauuaca

SEQ ID NO: 13211 - RNA, 38 nt, Artificial Sequence
  Description of Artificial Sequence:  Enzymatic Nucleic Acid
uggagaggcugaugaggccguuaggccgaaagcuugca

SEQ ID NO: 13212 - RNA, 38 nt, Artificial Sequence
  Description of Artificial Sequence:  Enzymatic Nucleic Acid
uagcuggacugaugaggccguuaggccgaaagggagcu

SEQ ID NO: 13213 - RNA, 38 nt, Artificial Sequence
  Description of Artificial Sequence:  Enzymatic Nucleic Acid
ccuagcugcugaugaggccguuaggccgaaagagggag

SEQ ID NO: 13214 - RNA, 38 nt, Artificial Sequence
  Description of Artificial Sequence:  Enzymatic Nucleic Acid
cugagucccugaugaggccguuaggccgaaagcuggag

SEQ ID NO: 13215 - RNA, 38 nt, Artificial Sequence
  Description of Artificial Sequence:  Enzymatic Nucleic Acid
aauauccucugaugaggccguuaggccgaaaguccuag

SEQ ID NO: 13216 - RNA, 38 nt, Artificial Sequence
  Description of Artificial Sequence:  Enzymatic Nucleic Acid
uugacuaacugaugaggccguuaggccgaaauccugag

SEQ ID NO: 13217 - RNA, 38 nt, Artificial Sequence
  Description of Artificial Sequence:  Enzymatic Nucleic Acid
cauugacucugaugaggccguuaggccgaaauauccug

SEQ ID NO: 13218 - RNA, 38 nt, Artificial Sequence
  Description of Artificial Sequence:  Enzymatic Nucleic Acid
ucauugaccugaugaggccguuaggccgaaaauauccu

SEQ ID NO: 13219 - RNA, 38 nt, Artificial Sequence
  Description of Artificial Sequence:  Enzymatic Nucleic Acid
uuccuuuucugaugaggccguuaggccgaaauggcuca

SEQ ID NO: 13220 - RNA, 38 nt, Artificial Sequence
  Description of Artificial Sequence:  Enzymatic Nucleic Acid
aaauaagacugaugaggccguuaggccgaaagguuuuu

SEQ ID NO: 13221 - RNA, 38 nt, Artificial Sequence
  Description of Artificial Sequence:  Enzymatic Nucleic Acid
gaaaauaacugaugaggccguuaggccgaaauagguuu

SEQ ID NO: 13222 - RNA, 38 nt, Artificial Sequence
  Description of Artificial Sequence:  Enzymatic Nucleic Acid
augaaaaucugaugaggccguuaggccgaaagauaggu

SEQ ID NO: 13223 - RNA, 38 nt, Artificial Sequence
  Description of Artificial Sequence:  Enzymatic Nucleic Acid
gaugaaaacugaugaggccguuaggccgaaaagauagg

SEQ ID NO: 13224 - RNA, 38 nt, Artificial Sequence
  Description of Artificial Sequence:  Enzymatic Nucleic Acid
cagaugaacugaugaggccguuaggccgaaauaagaua

SEQ ID NO: 13225 - RNA, 38 nt, Artificial Sequence
  Description of Artificial Sequence:  Enzymatic Nucleic Acid
acagaugacugaugaggccguuaggccgaaaauaagau

SEQ ID NO: 13226 - RNA, 38 nt, Artificial Sequence
  Description of Artificial Sequence:  Enzymatic Nucleic Acid
aacagaugcugaugaggccguuaggccgaaaaauaaga

SEQ ID NO: 13227 - RNA, 38 nt, Artificial Sequence
  Description of Artificial Sequence:  Enzymatic Nucleic Acid
aaacagaucugaugaggccguuaggccgaaaaaauaag

SEQ ID NO: 13228 - RNA, 38 nt, Artificial Sequence
  Description of Artificial Sequence:  Enzymatic Nucleic Acid
augaaacacugaugaggccguuaggccgaaaugaaaau

SEQ ID NO: 13229 - RNA, 38 nt, Artificial Sequence
  Description of Artificial Sequence:  Enzymatic Nucleic Acid
agguaugacugaugaggccguuaggccgaaacagauga

SEQ ID NO: 13230 - RNA, 38 nt, Artificial Sequence
  Description of Artificial Sequence:  Enzymatic Nucleic Acid
aagguaugcugaugaggccguuaggccgaaaacagaug

SEQ ID NO: 13231 - RNA, 38 nt, Artificial Sequence
  Description of Artificial Sequence:  Enzymatic Nucleic Acid
caagguaucugaugaggccguuaggccgaaaaacagau

SEQ ID NO: 13232 - RNA, 38 nt, Artificial Sequence
  Description of Artificial Sequence:  Enzymatic Nucleic Acid
agacaaggcugaugaggccguuaggccgaaaugaaaca

SEQ ID NO: 13233 - RNA, 38 nt, Artificial Sequence
  Description of Artificial Sequence:  Enzymatic Nucleic Acid
ccccagaccugaugaggccguuaggccgaaagguauga

SEQ ID NO: 13234 - RNA, 38 nt, Artificial Sequence
  Description of Artificial Sequence:  Enzymatic Nucleic Acid
agaccccacugaugaggccguuaggccgaaacaaggua

SEQ ID NO: 13235 - RNA, 38 nt, Artificial Sequence
  Description of Artificial Sequence:  Enzymatic Nucleic Acid
cgucauuacugaugaggccguuaggccgaaaccccaga

SEQ ID NO: 13236 - RNA, 38 nt, Artificial Sequence
  Description of Artificial Sequence:  Enzymatic Nucleic Acid
aucgucaucugaugaggccguuaggccgaaagacccca

SEQ ID NO: 13237 - RNA, 38 nt, Artificial Sequence
  Description of Artificial Sequence:  Enzymatic Nucleic Acid
cccauguccugaugaggccguuaggccgaaacccuguu

SEQ ID NO: 13238 - RNA, 38 nt, Artificial Sequence
  Description of Artificial Sequence:  Enzymatic Nucleic Acid
cccuuuuccugaugaggccguuaggccgaaacccuguc

SEQ ID NO: 13239 - RNA, 38 nt, Artificial Sequence
  Description of Artificial Sequence:  Enzymatic Nucleic Acid
accccaaacugaugaggccguuaggccgaaagcgggca

SEQ ID NO: 13240 - RNA, 38 nt, Artificial Sequence
  Description of Artificial Sequence:  Enzymatic Nucleic Acid
agaccccacugaugaggccguuaggccgaaagagcggg

SEQ ID NO: 13241 - RNA, 38 nt, Artificial Sequence
  Description of Artificial Sequence:  Enzymatic Nucleic Acid
uagacccccugaugaggccguuaggccgaaaagagcgg

SEQ ID NO: 13242 - RNA, 38 nt, Artificial Sequence
  Description of Artificial Sequence:  Enzymatic Nucleic Acid
caucucuacugaugaggccguuaggccgaaaccccaaa

SEQ ID NO: 13243 - RNA, 38 nt, Artificial Sequence
  Description of Artificial Sequence:  Enzymatic Nucleic Acid
cucaucuccugaugaggccguuaggccgaaagacccca

SEQ ID NO: 13244 - RNA, 38 nt, Artificial Sequence
  Description of Artificial Sequence:  Enzymatic Nucleic Acid
auuuuagacugaugaggccguuaggccgaaacccaggg

SEQ ID NO: 13245 - RNA, 38 nt, Artificial Sequence
  Description of Artificial Sequence:  Enzymatic Nucleic Acid
ccauuuuacugaugaggccguuaggccgaaagacccag

SEQ ID NO: 13246 - RNA, 38 nt, Artificial Sequence
  Description of Artificial Sequence:  Enzymatic Nucleic Acid
agccauuucugaugaggccguuaggccgaaagagaccc

SEQ ID NO: 13247 - RNA, 38 nt, Artificial Sequence
  Description of Artificial Sequence:  Enzymatic Nucleic Acid
uucuaagacugaugaggccguuaggccgaaagccauuu

SEQ ID NO: 13248 - RNA, 38 nt, Artificial Sequence
  Description of Artificial Sequence:  Enzymatic Nucleic Acid
acuucuaacugaugaggccguuaggccgaaagagccau

SEQ ID NO: 13249 - RNA, 38 nt, Artificial Sequence
  Description of Artificial Sequence:  Enzymatic Nucleic Acid
caacuucucugaugaggccguuaggccgaaagagagcc

SEQ ID NO: 13250 - RNA, 38 nt, Artificial Sequence
  Description of Artificial Sequence:  Enzymatic Nucleic Acid
acaacuuccugaugaggccguuaggccgaaaagagagc

SEQ ID NO: 13251 - RNA, 38 nt, Artificial Sequence
  Description of Artificial Sequence:  Enzymatic Nucleic Acid
gcacauaccugaugaggccguuaggccgaaacuucuaa

SEQ ID NO: 13252 - RNA, 38 nt, Artificial Sequence
  Description of Artificial Sequence:  Enzymatic Nucleic Acid
uuugcacacugaugaggccguuaggccgaaacaacuuc

SEQ ID NO: 13253 - RNA, 38 nt, Artificial Sequence
  Description of Artificial Sequence:  Enzymatic Nucleic Acid
cagaccaucugaugaggccguuaggccgaaauuugcac

SEQ ID NO: 13254 - RNA, 38 nt, Artificial Sequence
  Description of Artificial Sequence:  Enzymatic Nucleic Acid
acagaccacugaugaggccguuaggccgaaaauuugca

SEQ ID NO: 13255 - RNA, 38 nt, Artificial Sequence
  Description of Artificial Sequence:  Enzymatic Nucleic Acid
agcacacacugaugaggccguuaggccgaaaccauaau

SEQ ID NO: 13256 - RNA, 38 nt, Artificial Sequence
  Description of Artificial Sequence:  Enzymatic Nucleic Acid
cacgaccucugaugaggccguuaggccgaaagcacaca

SEQ ID NO: 13257 - RNA, 38 nt, Artificial Sequence
  Description of Artificial Sequence:  Enzymatic Nucleic Acid
gcacgacccugaugaggccguuaggccgaaaagcacac

SEQ ID NO: 13258 - RNA, 38 nt, Artificial Sequence
  Description of Artificial Sequence:  Enzymatic Nucleic Acid
gugugcaccugaugaggccguuaggccgaaaccuaagc

SEQ ID NO: 13259 - RNA, 38 nt, Artificial Sequence
  Description of Artificial Sequence:  Enzymatic Nucleic Acid
ccagcugucugaugaggccguuaggccgaaaccggcuc

SEQ ID NO: 13260 - RNA, 38 nt, Artificial Sequence
  Description of Artificial Sequence:  Enzymatic Nucleic Acid
aaagcagccugaugaggccguuaggccgaaauucaucg

SEQ ID NO: 13261 - RNA, 38 nt, Artificial Sequence
  Description of Artificial Sequence:  Enzymatic Nucleic Acid
cucucccacugaugaggccguuaggccgaaagcagcua

SEQ ID NO: 13262 - RNA, 38 nt, Artificial Sequence
  Description of Artificial Sequence:  Enzymatic Nucleic Acid
gcucuccccugaugaggccguuaggccgaaaagcagcu

SEQ ID NO: 13263 - RNA, 38 nt, Artificial Sequence
  Description of Artificial Sequence:  Enzymatic Nucleic Acid
uaaguggccugaugaggccguuaggccgaaagcaugcu

SEQ ID NO: 13264 - RNA, 38 nt, Artificial Sequence
  Description of Artificial Sequence:  Enzymatic Nucleic Acid
agagaauucugaugaggccguuaggccgaaaguggcua

SEQ ID NO: 13265 - RNA, 38 nt, Artificial Sequence
  Description of Artificial Sequence:  Enzymatic Nucleic Acid
cagagaaucugaugaggccguuaggccgaaaaguggcu

SEQ ID NO: 13266 - RNA, 38 nt, Artificial Sequence
  Description of Artificial Sequence:  Enzymatic Nucleic Acid
ggucagagcugaugaggccguuaggccgaaauuaagug

SEQ ID NO: 13267 - RNA, 38 nt, Artificial Sequence
  Description of Artificial Sequence:  Enzymatic Nucleic Acid
cggucagacugaugaggccguuaggccgaaaauuaagu

SEQ ID NO: 13268 - RNA, 38 nt, Artificial Sequence
  Description of Artificial Sequence:  Enzymatic Nucleic Acid
cccggucacugaugaggccguuaggccgaaagaauuaa

SEQ ID NO: 13269 - RNA, 38 nt, Artificial Sequence
  Description of Artificial Sequence:  Enzymatic Nucleic Acid
guacccaucugaugaggccguuaggccgaaaugcuggc

SEQ ID NO: 13270 - RNA, 38 nt, Artificial Sequence
  Description of Artificial Sequence:  Enzymatic Nucleic Acid
ggagcaggcugaugaggccguuaggccgaaacccauga

SEQ ID NO: 13271 - RNA, 38 nt, Artificial Sequence
  Description of Artificial Sequence:  Enzymatic Nucleic Acid
acacagggcugaugaggccguuaggccgaaagcaggua

SEQ ID NO: 13272 - RNA, 38 nt, Artificial Sequence
  Description of Artificial Sequence:  Enzymatic Nucleic Acid
ggauggggcugaugaggccguuaggccgaaacacaggg

SEQ ID NO: 13273 - RNA, 38 nt, Artificial Sequence
  Description of Artificial Sequence:  Enzymatic Nucleic Acid
accuuaagcugaugaggccguuaggccgaaauggggua

SEQ ID NO: 13274 - RNA, 38 nt, Artificial Sequence
  Description of Artificial Sequence:  Enzymatic Nucleic Acid
aaaaccuucugaugaggccguuaggccgaaaggauggg

SEQ ID NO: 13275 - RNA, 38 nt, Artificial Sequence
  Description of Artificial Sequence:  Enzymatic Nucleic Acid
gaaaaccucugaugaggccguuaggccgaaaaggaugg

SEQ ID NO: 13276 - RNA, 38 nt, Artificial Sequence
  Description of Artificial Sequence:  Enzymatic Nucleic Acid
agacagaacugaugaggccguuaggccgaaaccuuaag

SEQ ID NO: 13277 - RNA, 38 nt, Artificial Sequence
  Description of Artificial Sequence:  Enzymatic Nucleic Acid
cagacagacugaugaggccguuaggccgaaaaccuuaa

SEQ ID NO: 13278 - RNA, 38 nt, Artificial Sequence
  Description of Artificial Sequence:  Enzymatic Nucleic Acid
ucagacagcugaugaggccguuaggccgaaaaaccuua

SEQ ID NO: 13279 - RNA, 38 nt, Artificial Sequence
  Description of Artificial Sequence:  Enzymatic Nucleic Acid
aucagacacugaugaggccguuaggccgaaaaaaccuu

SEQ ID NO: 13280 - RNA, 38 nt, Artificial Sequence
  Description of Artificial Sequence:  Enzymatic Nucleic Acid
ucucaucacugaugaggccguuaggccgaaacagaaaa

SEQ ID NO: 13281 - RNA, 38 nt, Artificial Sequence
  Description of Artificial Sequence:  Enzymatic Nucleic Acid
ucagugggcugaugaggccguuaggccgaaauugcacu

SEQ ID NO: 13282 - RNA, 38 nt, Artificial Sequence
  Description of Artificial Sequence:  Enzymatic Nucleic Acid
ugcaccaacugaugaggccguuaggccgaaagccacag

SEQ ID NO: 13283 - RNA, 38 nt, Artificial Sequence
  Description of Artificial Sequence:  Enzymatic Nucleic Acid
agugcacccugaugaggccguuaggccgaaagagccac

SEQ ID NO: 13284 - RNA, 38 nt, Artificial Sequence
  Description of Artificial Sequence:  Enzymatic Nucleic Acid
uggcuggucugaugaggccguuaggccgaaagugcacc

SEQ ID NO: 13285 - RNA, 38 nt, Artificial Sequence
  Description of Artificial Sequence:  Enzymatic Nucleic Acid
uacuuguccugaugaggccguuaggccgaaaguccugg

SEQ ID NO: 13286 - RNA, 38 nt, Artificial Sequence
  Description of Artificial Sequence:  Enzymatic Nucleic Acid
cccuuucccugaugaggccguuaggccgaaacuugucu

SEQ ID NO: 13287 - RNA, 38 nt, Artificial Sequence
  Description of Artificial Sequence:  Enzymatic Nucleic Acid
guggcuagcugaugaggccguuaggccgaaagcccuuu

SEQ ID NO: 13288 - RNA, 38 nt, Artificial Sequence
  Description of Artificial Sequence:  Enzymatic Nucleic Acid
uguggcuacugaugaggccguuaggccgaaaagcccuu

SEQ ID NO: 13289 - RNA, 38 nt, Artificial Sequence
  Description of Artificial Sequence:  Enzymatic Nucleic Acid
aguguggccugaugaggccguuaggccgaaagaagccc

SEQ ID NO: 13290 - RNA, 38 nt, Artificial Sequence
  Description of Artificial Sequence:  Enzymatic Nucleic Acid
cccuaccucugaugaggccguuaggccgaaauuuucuu

SEQ ID NO: 13291 - RNA, 38 nt, Artificial Sequence
  Description of Artificial Sequence:  Enzymatic Nucleic Acid
gccagccccugaugaggccguuaggccgaaaccugauu

SEQ ID NO: 13292 - RNA, 38 nt, Artificial Sequence
  Description of Artificial Sequence:  Enzymatic Nucleic Acid
uggacaaacugaugaggccguuaggccgaaaugucuuu

SEQ ID NO: 13293 - RNA, 38 nt, Artificial Sequence
  Description of Artificial Sequence:  Enzymatic Nucleic Acid
aauggacacugaugaggccguuaggccgaaagaugucu

SEQ ID NO: 13294 - RNA, 38 nt, Artificial Sequence
  Description of Artificial Sequence:  Enzymatic Nucleic Acid
gaauggaccugaugaggccguuaggccgaaaagauguc

SEQ ID NO: 13295 - RNA, 38 nt, Artificial Sequence
  Description of Artificial Sequence:  Enzymatic Nucleic Acid
ugcgaaugcugaugaggccguuaggccgaaacaaagau

SEQ ID NO: 13296 - RNA, 38 nt, Artificial Sequence
  Description of Artificial Sequence:  Enzymatic Nucleic Acid
cuuuugcgcugaugaggccguuaggccgaaauggacaa

SEQ ID NO: 13297 - RNA, 38 nt, Artificial Sequence
  Description of Artificial Sequence:  Enzymatic Nucleic Acid
gcuuuugccugaugaggccguuaggccgaaaauggaca

SEQ ID NO: 13298 - RNA, 38 nt, Artificial Sequence
  Description of Artificial Sequence:  Enzymatic Nucleic Acid
gccgacaacugaugaggccguuaggccgaaagcuuuug

SEQ ID NO: 13299 - RNA, 38 nt, Artificial Sequence
  Description of Artificial Sequence:  Enzymatic Nucleic Acid
cagccgaccugaugaggccguuaggccgaaagagcuuu

SEQ ID NO: 13300 - RNA, 38 nt, Artificial Sequence
  Description of Artificial Sequence:  Enzymatic Nucleic Acid
cugcagcccugaugaggccguuaggccgaaacaagagc

SEQ ID NO: 13301 - RNA, 38 nt, Artificial Sequence
  Description of Artificial Sequence:  Enzymatic Nucleic Acid
gccugacucugaugaggccguuaggccgaaacacacug

SEQ ID NO: 13302 - RNA, 38 nt, Artificial Sequence
  Description of Artificial Sequence:  Enzymatic Nucleic Acid
caucgccucugaugaggccguuaggccgaaacuuacac

SEQ ID NO: 13303 - RNA, 38 nt, Artificial Sequence
  Description of Artificial Sequence:  Enzymatic Nucleic Acid
uucucuggcugaugaggccguuaggccgaaagccucug

SEQ ID NO: 13304 - RNA, 38 nt, Artificial Sequence
  Description of Artificial Sequence:  Enzymatic Nucleic Acid
ggaugagacugaugaggccguuaggccgaaaccucagg

SEQ ID NO: 13305 - RNA, 38 nt, Artificial Sequence
  Description of Artificial Sequence:  Enzymatic Nucleic Acid
uggaugagcugaugaggccguuaggccgaaaaccucag

SEQ ID NO: 13306 - RNA, 38 nt, Artificial Sequence
  Description of Artificial Sequence:  Enzymatic Nucleic Acid
cuggaugacugaugaggccguuaggccgaaaaaccuca

SEQ ID NO: 13307 - RNA, 38 nt, Artificial Sequence
  Description of Artificial Sequence:  Enzymatic Nucleic Acid
aucuggaucugaugaggccguuaggccgaaagaaaccu

SEQ ID NO: 13308 - RNA, 38 nt, Artificial Sequence
  Description of Artificial Sequence:  Enzymatic Nucleic Acid
gauaucugcugaugaggccguuaggccgaaaugagaaa

SEQ ID NO: 13309 - RNA, 38 nt, Artificial Sequence
  Description of Artificial Sequence:  Enzymatic Nucleic Acid
uugcuggacugaugaggccguuaggccgaaaucuggau

SEQ ID NO: 13310 - RNA, 38 nt, Artificial Sequence
  Description of Artificial Sequence:  Enzymatic Nucleic Acid
aauugcugcugaugaggccguuaggccgaaauaucugg

SEQ ID NO: 13311 - RNA, 38 nt, Artificial Sequence
  Description of Artificial Sequence:  Enzymatic Nucleic Acid
cacccccccugaugaggccguuaggccgaaauugcugg

SEQ ID NO: 13312 - RNA, 38 nt, Artificial Sequence
  Description of Artificial Sequence:  Enzymatic Nucleic Acid
ggaccauccugaugaggccguuaggccgaaauggucuu

SEQ ID NO: 13313 - RNA, 38 nt, Artificial Sequence
  Description of Artificial Sequence:  Enzymatic Nucleic Acid
uaauacagcugaugaggccguuaggccgaaaccaucua

SEQ ID NO: 13314 - RNA, 38 nt, Artificial Sequence
  Description of Artificial Sequence:  Enzymatic Nucleic Acid
cggaauaacugaugaggccguuaggccgaaacaggacc

SEQ ID NO: 13315 - RNA, 38 nt, Artificial Sequence
  Description of Artificial Sequence:  Enzymatic Nucleic Acid
aucggaaucugaugaggccguuaggccgaaauacagga

SEQ ID NO: 13316 - RNA, 38 nt, Artificial Sequence
  Description of Artificial Sequence:  Enzymatic Nucleic Acid
aaucggaacugaugaggccguuaggccgaaaauacagg

SEQ ID NO: 13317 - RNA, 38 nt, Artificial Sequence
  Description of Artificial Sequence:  Enzymatic Nucleic Acid
aaaaucggcugaugaggccguuaggccgaaauaauaca

SEQ ID NO: 13318 - RNA, 38 nt, Artificial Sequence
  Description of Artificial Sequence:  Enzymatic Nucleic Acid
uaaaaucgcugaugaggccguuaggccgaaaauaauac

SEQ ID NO: 13319 - RNA, 38 nt, Artificial Sequence
  Description of Artificial Sequence:  Enzymatic Nucleic Acid
auuauuaacugaugaggccguuaggccgaaaucggaau

SEQ ID NO: 13320 - RNA, 38 nt, Artificial Sequence
  Description of Artificial Sequence:  Enzymatic Nucleic Acid
gauuauuacugaugaggccguuaggccgaaaaucggaa

SEQ ID NO: 13321 - RNA, 38 nt, Artificial Sequence
  Description of Artificial Sequence:  Enzymatic Nucleic Acid
agauuauucugaugaggccguuaggccgaaaaaucgga

SEQ ID NO: 13322 - RNA, 38 nt, Artificial Sequence
  Description of Artificial Sequence:  Enzymatic Nucleic Acid
uagauuaucugaugaggccguuaggccgaaaaaaucgg

SEQ ID NO: 13323 - RNA, 38 nt, Artificial Sequence
  Description of Artificial Sequence:  Enzymatic Nucleic Acid
aauuagaucugaugaggccguuaggccgaaauuaaaau

SEQ ID NO: 13324 - RNA, 38 nt, Artificial Sequence
  Description of Artificial Sequence:  Enzymatic Nucleic Acid
acgaauuacugaugaggccguuaggccgaaauuauuaa

SEQ ID NO: 13325 - RNA, 38 nt, Artificial Sequence
  Description of Artificial Sequence:  Enzymatic Nucleic Acid
ucacgaaucugaugaggccguuaggccgaaagauuauu

SEQ ID NO: 13326 - RNA, 38 nt, Artificial Sequence
  Description of Artificial Sequence:  Enzymatic Nucleic Acid
ugaucacgcugaugaggccguuaggccgaaauuagauu

SEQ ID NO: 13327 - RNA, 38 nt, Artificial Sequence
  Description of Artificial Sequence:  Enzymatic Nucleic Acid
augaucaccugaugaggccguuaggccgaaaauuagau

SEQ ID NO: 13328 - RNA, 38 nt, Artificial Sequence
  Description of Artificial Sequence:  Enzymatic Nucleic Acid
cucuuaaucugaugaggccguuaggccgaaaucacgaa

SEQ ID NO: 13329 - RNA, 38 nt, Artificial Sequence
  Description of Artificial Sequence:  Enzymatic Nucleic Acid
agucucuucugaugaggccguuaggccgaaaugaucac

SEQ ID NO: 13330 - RNA, 38 nt, Artificial Sequence
  Description of Artificial Sequence:  Enzymatic Nucleic Acid
aagucucucugaugaggccguuaggccgaaaaugauca

SEQ ID NO: 13331 - RNA, 38 nt, Artificial Sequence
  Description of Artificial Sequence:  Enzymatic Nucleic Acid
auuuacuacugaugaggccguuaggccgaaagucucuu

SEQ ID NO: 13332 - RNA, 38 nt, Artificial Sequence
  Description of Artificial Sequence:  Enzymatic Nucleic Acid
cauuuacucugaugaggccguuaggccgaaaagucucu

SEQ ID NO: 13333 - RNA, 38 nt, Artificial Sequence
  Description of Artificial Sequence:  Enzymatic Nucleic Acid
acauuuaccugaugaggccguuaggccgaaaaagucuc

SEQ ID NO: 13334 - RNA, 38 nt, Artificial Sequence
  Description of Artificial Sequence:  Enzymatic Nucleic Acid
gggacauucugaugaggccguuaggccgaaacuaaagu

SEQ ID NO: 13335 - RNA, 38 nt, Artificial Sequence
  Description of Artificial Sequence:  Enzymatic Nucleic Acid
ggaaaaggcugaugaggccguuaggccgaaacauuuac

SEQ ID NO: 13336 - RNA, 38 nt, Artificial Sequence
  Description of Artificial Sequence:  Enzymatic Nucleic Acid
ugugggaacugaugaggccguuaggccgaaagggacau

SEQ ID NO: 13337 - RNA, 38 nt, Artificial Sequence
  Description of Artificial Sequence:  Enzymatic Nucleic Acid
uugugggacugaugaggccguuaggccgaaaagggaca

SEQ ID NO: 13338 - RNA, 38 nt, Artificial Sequence
  Description of Artificial Sequence:  Enzymatic Nucleic Acid
uuugugggcugaugaggccguuaggccgaaaaagggac

SEQ ID NO: 13339 - RNA, 38 nt, Artificial Sequence
  Description of Artificial Sequence:  Enzymatic Nucleic Acid
uuuuguggcugaugaggccguuaggccgaaaaaaggga

SEQ ID NO: 13340 - RNA, 38 nt, Artificial Sequence
  Description of Artificial Sequence:  Enzymatic Nucleic Acid
cuuuucuucugaugaggccguuaggccgaaacuuuugu

SEQ ID NO: 13341 - RNA, 38 nt, Artificial Sequence
  Description of Artificial Sequence:  Enzymatic Nucleic Acid
aaucccgacugaugaggccguuaggccgaaagcuuuuc

SEQ ID NO: 13342 - RNA, 38 nt, Artificial Sequence
  Description of Artificial Sequence:  Enzymatic Nucleic Acid
agaauccccugaugaggccguuaggccgaaauagcuuu

SEQ ID NO: 13343 - RNA, 38 nt, Artificial Sequence
  Description of Artificial Sequence:  Enzymatic Nucleic Acid
aaccagagcugaugaggccguuaggccgaaaucccgau

SEQ ID NO: 13344 - RNA, 38 nt, Artificial Sequence
  Description of Artificial Sequence:  Enzymatic Nucleic Acid
gaaccagacugaugaggccguuaggccgaaaaucccga

SEQ ID NO: 13345 - RNA, 38 nt, Artificial Sequence
  Description of Artificial Sequence:  Enzymatic Nucleic Acid
cagaaccacugaugaggccguuaggccgaaagaauccc

SEQ ID NO: 13346 - RNA, 38 nt, Artificial Sequence
  Description of Artificial Sequence:  Enzymatic Nucleic Acid
uuaagcagcugaugaggccguuaggccgaaaccagaga

SEQ ID NO: 13347 - RNA, 38 nt, Artificial Sequence
  Description of Artificial Sequence:  Enzymatic Nucleic Acid
uuuaagcacugaugaggccguuaggccgaaaaccagag

SEQ ID NO: 13348 - RNA, 38 nt, Artificial Sequence
  Description of Artificial Sequence:  Enzymatic Nucleic Acid
aagucuuucugaugaggccguuaggccgaaagcagaac

SEQ ID NO: 13349 - RNA, 38 nt, Artificial Sequence
  Description of Artificial Sequence:  Enzymatic Nucleic Acid
uaagucuucugaugaggccguuaggccgaaaagcagaa

SEQ ID NO: 13350 - RNA, 38 nt, Artificial Sequence
  Description of Artificial Sequence:  Enzymatic Nucleic Acid
ccaaagcucugaugaggccguuaggccgaaagucuuua

SEQ ID NO: 13351 - RNA, 38 nt, Artificial Sequence
  Description of Artificial Sequence:  Enzymatic Nucleic Acid
uccaaagccugaugaggccguuaggccgaaaagucuuu

SEQ ID NO: 13352 - RNA, 38 nt, Artificial Sequence
  Description of Artificial Sequence:  Enzymatic Nucleic Acid
aggcuccacugaugaggccguuaggccgaaagcuaagu

SEQ ID NO: 13353 - RNA, 38 nt, Artificial Sequence
  Description of Artificial Sequence:  Enzymatic Nucleic Acid
uaggcucccugaugaggccguuaggccgaaaagcuaag

SEQ ID NO: 13354 - RNA, 38 nt, Artificial Sequence
  Description of Artificial Sequence:  Enzymatic Nucleic Acid
aacuuucacugaugaggccguuaggccgaaaggcucca

SEQ ID NO: 13355 - RNA, 38 nt, Artificial Sequence
  Description of Artificial Sequence:  Enzymatic Nucleic Acid
ggcugauccugaugaggccguuaggccgaaacuuucau

SEQ ID NO: 13356 - RNA, 54 nt, Artificial Sequence
  Description of Artificial Sequence:  Enzymatic Nucleic Acid
gucccagcagaagaccauaccagagaaacacacguugugguacauuaccuggua

SEQ ID NO: 13357 - RNA, 54 nt, Artificial Sequence
  Description of Artificial Sequence:  Enzymatic Nucleic Acid
ggugucccagaagcugacaccagagaaacacacguugugguacauuaccuggua

SEQ ID NO: 13358 - RNA, 54 nt, Artificial Sequence
  Description of Artificial Sequence:  Enzymatic Nucleic Acid
uaaggcaaagaagcggugaccagagaaacacacguugugguacauuaccuggua

SEQ ID NO: 13359 - RNA, 54 nt, Artificial Sequence
  Description of Artificial Sequence:  Enzymatic Nucleic Acid
gacacccgagaagcgcguaccagagaaacacacguugugguacauuaccuggua

SEQ ID NO: 13360 - RNA, 54 nt, Artificial Sequence
  Description of Artificial Sequence:  Enzymatic Nucleic Acid
cugugagaagaagacaccaccagagaaacacacguugugguacauuaccuggua

SEQ ID NO: 13361 - RNA, 54 nt, Artificial Sequence
  Description of Artificial Sequence:  Enzymatic Nucleic Acid
gaaagagaagaaggccugaccagagaaacacacguugugguacauuaccuggua

SEQ ID NO: 13362 - RNA, 54 nt, Artificial Sequence
  Description of Artificial Sequence:  Enzymatic Nucleic Acid
caugagugagaagccuccaccagagaaacacacguugugguacauuaccuggua

SEQ ID NO: 13363 - RNA, 54 nt, Artificial Sequence
  Description of Artificial Sequence:  Enzymatic Nucleic Acid
cggucgugagaagagaccaccagagaaacacacguugugguacauuaccuggua

SEQ ID NO: 13364 - RNA, 54 nt, Artificial Sequence
  Description of Artificial Sequence:  Enzymatic Nucleic Acid
cucccacaagaagaugggaccagagaaacacacguugugguacauuaccuggua

SEQ ID NO: 13365 - RNA, 54 nt, Artificial Sequence
  Description of Artificial Sequence:  Enzymatic Nucleic Acid
ggaugaugagaagucuucaccagagaaacacacguugugguacauuaccuggua

SEQ ID NO: 13366 - RNA, 54 nt, Artificial Sequence
  Description of Artificial Sequence:  Enzymatic Nucleic Acid
cgucacccagaaggggauaccagagaaacacacguugugguacauuaccuggua

SEQ ID NO: 13367 - RNA, 54 nt, Artificial Sequence
  Description of Artificial Sequence:  Enzymatic Nucleic Acid
cuuugcccagaagggguaaccagagaaacacacguugugguacauuaccuggua

SEQ ID NO: 13368 - RNA, 54 nt, Artificial Sequence
  Description of Artificial Sequence:  Enzymatic Nucleic Acid
cgcaguucagaaguccuaaccagagaaacacacguugugguacauuaccuggua

SEQ ID NO: 13369 - RNA, 54 nt, Artificial Sequence
  Description of Artificial Sequence:  Enzymatic Nucleic Acid
gccgauggagaagauaguaccagagaaacacacguugugguacauuaccuggua

SEQ ID NO: 13370 - RNA, 54 nt, Artificial Sequence
  Description of Artificial Sequence:  Enzymatic Nucleic Acid
uuguauugagaagccgauaccagagaaacacacguugugguacauuaccuggua

SEQ ID NO: 13371 - RNA, 54 nt, Artificial Sequence
  Description of Artificial Sequence:  Enzymatic Nucleic Acid
cugggcucagaaggcguaaccagagaaacacacguugugguacauuaccuggua

SEQ ID NO: 13372 - RNA, 54 nt, Artificial Sequence
  Description of Artificial Sequence:  Enzymatic Nucleic Acid
gcccguggagaagucucaaccagagaaacacacguugugguacauuaccuggua

SEQ ID NO: 13373 - RNA, 54 nt, Artificial Sequence
  Description of Artificial Sequence:  Enzymatic Nucleic Acid
ggacaagaagaagcccguaccagagaaacacacguugugguacauuaccuggua

SEQ ID NO: 13374 - RNA, 54 nt, Artificial Sequence
  Description of Artificial Sequence:  Enzymatic Nucleic Acid
uccggucaagaagcugccaccagagaaacacacguugugguacauuaccuggua

SEQ ID NO: 13375 - RNA, 54 nt, Artificial Sequence
  Description of Artificial Sequence:  Enzymatic Nucleic Acid
cuucacgcagaagguguaaccagagaaacacacguugugguacauuaccuggua

SEQ ID NO: 13376 - RNA, 54 nt, Artificial Sequence
  Description of Artificial Sequence:  Enzymatic Nucleic Acid
uguugaaaagaaggaacgaccagagaaacacacguugugguacauuaccuggua

SEQ ID NO: 13377 - RNA, 54 nt, Artificial Sequence
  Description of Artificial Sequence:  Enzymatic Nucleic Acid
ccugcaccagaagcuuccaccagagaaacacacguugugguacauuaccuggua

SEQ ID NO: 13378 - RNA, 54 nt, Artificial Sequence
  Description of Artificial Sequence:  Enzymatic Nucleic Acid
gccgauagagaagucuucaccagagaaacacacguugugguacauuaccuggua

SEQ ID NO: 13379 - RNA, 54 nt, Artificial Sequence
  Description of Artificial Sequence:  Enzymatic Nucleic Acid
ucauggacagaagauaggaccagagaaacacacguugugguacauuaccuggua

SEQ ID NO: 13380 - RNA, 54 nt, Artificial Sequence
  Description of Artificial Sequence:  Enzymatic Nucleic Acid
cuuucaugagaagccgauaccagagaaacacacguugugguacauuaccuggua

SEQ ID NO: 13381 - RNA, 54 nt, Artificial Sequence
  Description of Artificial Sequence:  Enzymatic Nucleic Acid
aaauagcgagaagacuucaccagagaaacacacguugugguacauuaccuggua

SEQ ID NO: 13382 - RNA, 54 nt, Artificial Sequence
  Description of Artificial Sequence:  Enzymatic Nucleic Acid
uuucguagagaagagguuaccagagaaacacacguugugguacauuaccuggua

SEQ ID NO: 13383 - RNA, 54 nt, Artificial Sequence
  Description of Artificial Sequence:  Enzymatic Nucleic Acid
ugcugcccagaagauagaaccagagaaacacacguugugguacauuaccuggua

SEQ ID NO: 13384 - RNA, 54 nt, Artificial Sequence
  Description of Artificial Sequence:  Enzymatic Nucleic Acid
gucugagaagaagccaccaccagagaaacacacguugugguacauuaccuggua

SEQ ID NO: 13385 - RNA, 54 nt, Artificial Sequence
  Description of Artificial Sequence:  Enzymatic Nucleic Acid
uuccagggagaagagaguaccagagaaacacacguugugguacauuaccuggua

SEQ ID NO: 13386 - RNA, 54 nt, Artificial Sequence
  Description of Artificial Sequence:  Enzymatic Nucleic Acid
ggcccggcagaaguagauaccagagaaacacacguugugguacauuaccuggua

SEQ ID NO: 13387 - RNA, 54 nt, Artificial Sequence
  Description of Artificial Sequence:  Enzymatic Nucleic Acid
gaaggcccagaagcuguaaccagagaaacacacguugugguacauuaccuggua

SEQ ID NO: 13388 - RNA, 54 nt, Artificial Sequence
  Description of Artificial Sequence:  Enzymatic Nucleic Acid
uucggcacagaagugacaaccagagaaacacacguugugguacauuaccuggua

SEQ ID NO: 13389 - RNA, 54 nt, Artificial Sequence
  Description of Artificial Sequence:  Enzymatic Nucleic Acid
ucuccuucagaaggcaucaccagagaaacacacguugugguacauuaccuggua

SEQ ID NO: 13390 - RNA, 54 nt, Artificial Sequence
  Description of Artificial Sequence:  Enzymatic Nucleic Acid
ccacacagagaaguuucaaccagagaaacacacguugugguacauuaccuggua

SEQ ID NO: 13391 - RNA, 54 nt, Artificial Sequence
  Description of Artificial Sequence:  Enzymatic Nucleic Acid
gguuuugaagaaggugugaccagagaaacacacguugugguacauuaccuggua

SEQ ID NO: 13392 - RNA, 54 nt, Artificial Sequence
  Description of Artificial Sequence:  Enzymatic Nucleic Acid
accaagugagaagaggcgaccagagaaacacacguugugguacauuaccuggua

SEQ ID NO: 13393 - RNA, 54 nt, Artificial Sequence
  Description of Artificial Sequence:  Enzymatic Nucleic Acid
gugagguaagaagcgcuuaccagagaaacacacguugugguacauuaccuggua

SEQ ID NO: 13394 - RNA, 54 nt, Artificial Sequence
  Description of Artificial Sequence:  Enzymatic Nucleic Acid
ugagcgugagaagcuccaaccagagaaacacacguugugguacauuaccuggua

SEQ ID NO: 13395 - RNA, 54 nt, Artificial Sequence
  Description of Artificial Sequence:  Enzymatic Nucleic Acid
cggaagaaagaagcuucaaccagagaaacacacguugugguacauuaccuggua

SEQ ID NO: 13396 - RNA, 54 nt, Artificial Sequence
  Description of Artificial Sequence:  Enzymatic Nucleic Acid
gacagguaagaagucuuuaccagagaaacacacguugugguacauuaccuggua

SEQ ID NO: 13397 - RNA, 54 nt, Artificial Sequence
  Description of Artificial Sequence:  Enzymatic Nucleic Acid
cauagggcagaaguucacaccagagaaacacacguugugguacauuaccuggua

SEQ ID NO: 13398 - RNA, 54 nt, Artificial Sequence
  Description of Artificial Sequence:  Enzymatic Nucleic Acid
caucauagagaagccguuaccagagaaacacacguugugguacauuaccuggua

SEQ ID NO: 13399 - RNA, 54 nt, Artificial Sequence
  Description of Artificial Sequence:  Enzymatic Nucleic Acid
cacaguccagaaggugggaccagagaaacacacguugugguacauuaccuggua

SEQ ID NO: 13400 - RNA, 54 nt, Artificial Sequence
  Description of Artificial Sequence:  Enzymatic Nucleic Acid
cagccacaagaaggcaggaccagagaaacacacguugugguacauuaccuggua

SEQ ID NO: 13401 - RNA, 54 nt, Artificial Sequence
  Description of Artificial Sequence:  Enzymatic Nucleic Acid
guucggucagaagagcuuaccagagaaacacacguugugguacauuaccuggua

SEQ ID NO: 13402 - RNA, 54 nt, Artificial Sequence
  Description of Artificial Sequence:  Enzymatic Nucleic Acid
cgaucaccagaagaggccaccagagaaacacacguugugguacauuaccuggua

SEQ ID NO: 13403 - RNA, 54 nt, Artificial Sequence
  Description of Artificial Sequence:  Enzymatic Nucleic Acid
gguaguugagaagguuucaccagagaaacacacguugugguacauuaccuggua

SEQ ID NO: 13404 - RNA, 54 nt, Artificial Sequence
  Description of Artificial Sequence:  Enzymatic Nucleic Acid
cuuguugaagaagaauaaaccagagaaacacacguugugguacauuaccuggua

SEQ ID NO: 13405 - RNA, 54 nt, Artificial Sequence
  Description of Artificial Sequence:  Enzymatic Nucleic Acid
auaugcaaagaagcguccaccagagaaacacacguugugguacauuaccuggua

SEQ ID NO: 13406 - RNA, 54 nt, Artificial Sequence
  Description of Artificial Sequence:  Enzymatic Nucleic Acid
acugucuaagaagggcuuaccagagaaacacacguugugguacauuaccuggua

SEQ ID NO: 13407 - RNA, 54 nt, Artificial Sequence
  Description of Artificial Sequence:  Enzymatic Nucleic Acid
gacacuugagaagcugacaccagagaaacacacguugugguacauuaccuggua

SEQ ID NO: 13408 - RNA, 54 nt, Artificial Sequence
  Description of Artificial Sequence:  Enzymatic Nucleic Acid
gaagcuggagaaggugacaccagagaaacacacguugugguacauuaccuggua

SEQ ID NO: 13409 - RNA, 54 nt, Artificial Sequence
  Description of Artificial Sequence:  Enzymatic Nucleic Acid
uucagggaagaaggagcuaccagagaaacacacguugugguacauuaccuggua

SEQ ID NO: 13410 - RNA, 54 nt, Artificial Sequence
  Description of Artificial Sequence:  Enzymatic Nucleic Acid
uggugaggagaagcuuggaccagagaaacacacguugugguacauuaccuggua

SEQ ID NO: 13411 - RNA, 54 nt, Artificial Sequence
  Description of Artificial Sequence:  Enzymatic Nucleic Acid
uguaggaaagaaggucuuaccagagaaacacacguugugguacauuaccuggua

SEQ ID NO: 13412 - RNA, 54 nt, Artificial Sequence
  Description of Artificial Sequence:  Enzymatic Nucleic Acid
cacuuggaagaaguaggaaccagagaaacacacguugugguacauuaccuggua

SEQ ID NO: 13413 - RNA, 54 nt, Artificial Sequence
  Description of Artificial Sequence:  Enzymatic Nucleic Acid
uucuggagagaagaaacuaccagagaaacacacguugugguacauuaccuggua

SEQ ID NO: 13414 - RNA, 54 nt, Artificial Sequence
  Description of Artificial Sequence:  Enzymatic Nucleic Acid
cuucaggcagaagcagaaaccagagaaacacacguugugguacauuaccuggua

SEQ ID NO: 13415 - RNA, 54 nt, Artificial Sequence
  Description of Artificial Sequence:  Enzymatic Nucleic Acid
uuccuucaagaagcugcaaccagagaaacacacguugugguacauuaccuggua

SEQ ID NO: 13416 - RNA, 54 nt, Artificial Sequence
  Description of Artificial Sequence:  Enzymatic Nucleic Acid
ggguucucagaagcaugcaccagagaaacacacguugugguacauuaccuggua

SEQ ID NO: 13417 - RNA, 54 nt, Artificial Sequence
  Description of Artificial Sequence:  Enzymatic Nucleic Acid
guucagcaagaaggggccaccagagaaacacacguugugguacauuaccuggua

SEQ ID NO: 13418 - RNA, 54 nt, Artificial Sequence
  Description of Artificial Sequence:  Enzymatic Nucleic Acid
uggcuugaagaaggucacaccagagaaacacacguugugguacauuaccuggua

SEQ ID NO: 13419 - RNA, 54 nt, Artificial Sequence
  Description of Artificial Sequence:  Enzymatic Nucleic Acid
uguuucuaagaaguauggaccagagaaacacacguugugguacauuaccuggua

SEQ ID NO: 13420 - RNA, 54 nt, Artificial Sequence
  Description of Artificial Sequence:  Enzymatic Nucleic Acid
aucugcaaagaaguccuuaccagagaaacacacguugugguacauuaccuggua

SEQ ID NO: 13421 - RNA, 54 nt, Artificial Sequence
  Description of Artificial Sequence:  Enzymatic Nucleic Acid
aaauguggagaagcaaagaccagagaaacacacguugugguacauuaccuggua

SEQ ID NO: 13422 - RNA, 54 nt, Artificial Sequence
  Description of Artificial Sequence:  Enzymatic Nucleic Acid
cucacaucagaagagcuuaccagagaaacacacguugugguacauuaccuggua

SEQ ID NO: 13423 - RNA, 54 nt, Artificial Sequence
  Description of Artificial Sequence:  Enzymatic Nucleic Acid
uaguguccagaagauaguaccagagaaacacacguugugguacauuaccuggua

SEQ ID NO: 13424 - RNA, 54 nt, Artificial Sequence
  Description of Artificial Sequence:  Enzymatic Nucleic Acid
gggagcccagaagagugcaccagagaaacacacguugugguacauuaccuggua

SEQ ID NO: 13425 - RNA, 54 nt, Artificial Sequence
  Description of Artificial Sequence:  Enzymatic Nucleic Acid
uccaggugagaagcuucaaccagagaaacacacguugugguacauuaccuggua

SEQ ID NO: 13426 - RNA, 54 nt, Artificial Sequence
  Description of Artificial Sequence:  Enzymatic Nucleic Acid
cucggcagagaagaaaguaccagagaaacacacguugugguacauuaccuggua

SEQ ID NO: 13427 - RNA, 54 nt, Artificial Sequence
  Description of Artificial Sequence:  Enzymatic Nucleic Acid
ugggccucagaagaucggaccagagaaacacacguugugguacauuaccuggua

SEQ ID NO: 13428 - RNA, 54 nt, Artificial Sequence
  Description of Artificial Sequence:  Enzymatic Nucleic Acid
gaagcagaagaagggccuaccagagaaacacacguugugguacauuaccuggua

SEQ ID NO: 13429 - RNA, 54 nt, Artificial Sequence
  Description of Artificial Sequence:  Enzymatic Nucleic Acid
gcuggagaagaagaagcuaccagagaaacacacguugugguacauuaccuggua

SEQ ID NO: 13430 - RNA, 54 nt, Artificial Sequence
  Description of Artificial Sequence:  Enzymatic Nucleic Acid
guggccacagaaggagaaaccagagaaacacacguugugguacauuaccuggua

SEQ ID NO: 13431 - RNA, 54 nt, Artificial Sequence
  Description of Artificial Sequence:  Enzymatic Nucleic Acid
uggagaacagaaggacucaccagagaaacacacguugugguacauuaccuggua

SEQ ID NO: 13432 - RNA, 54 nt, Artificial Sequence
  Description of Artificial Sequence:  Enzymatic Nucleic Acid
ggguggagagaagcaggaaccagagaaacacacguugugguacauuaccuggua

SEQ ID NO: 13433 - RNA, 54 nt, Artificial Sequence
  Description of Artificial Sequence:  Enzymatic Nucleic Acid
gaguuguaagaaggggguaccagagaaacacacguugugguacauuaccuggua

SEQ ID NO: 13434 - RNA, 54 nt, Artificial Sequence
  Description of Artificial Sequence:  Enzymatic Nucleic Acid
uuuaggcgagaagggaggaccagagaaacacacguugugguacauuaccuggua

SEQ ID NO: 13435 - RNA, 54 nt, Artificial Sequence
  Description of Artificial Sequence:  Enzymatic Nucleic Acid
aagcuuuaagaaggcgggaccagagaaacacacguugugguacauuaccuggua

SEQ ID NO: 13436 - RNA, 54 nt, Artificial Sequence
  Description of Artificial Sequence:  Enzymatic Nucleic Acid
guugucggagaaggugagaccagagaaacacacguugugguacauuaccuggua

SEQ ID NO: 13437 - RNA, 54 nt, Artificial Sequence
  Description of Artificial Sequence:  Enzymatic Nucleic Acid
cugucaggagaagguuguaccagagaaacacacguugugguacauuaccuggua

SEQ ID NO: 13438 - RNA, 54 nt, Artificial Sequence
  Description of Artificial Sequence:  Enzymatic Nucleic Acid
uccuguggagaagaauagaccagagaaacacacguugugguacauuaccuggua

SEQ ID NO: 13439 - RNA, 54 nt, Artificial Sequence
  Description of Artificial Sequence:  Enzymatic Nucleic Acid
cgaaaagcagaaggcuccaccagagaaacacacguugugguacauuaccuggua

SEQ ID NO: 13440 - RNA, 54 nt, Artificial Sequence
  Description of Artificial Sequence:  Enzymatic Nucleic Acid
ucacgaaaagaagcuggcaccagagaaacacacguugugguacauuaccuggua

SEQ ID NO: 13441 - RNA, 54 nt, Artificial Sequence
  Description of Artificial Sequence:  Enzymatic Nucleic Acid
uuagucaaagaagcaacaaccagagaaacacacguugugguacauuaccuggua

SEQ ID NO: 13442 - RNA, 54 nt, Artificial Sequence
  Description of Artificial Sequence:  Enzymatic Nucleic Acid
ggugggcgagaagucgccaccagagaaacacacguugugguacauuaccuggua

SEQ ID NO: 13443 - RNA, 54 nt, Artificial Sequence
  Description of Artificial Sequence:  Enzymatic Nucleic Acid
ggccggugagaaggcgguaccagagaaacacacguugugguacauuaccuggua

SEQ ID NO: 13444 - RNA, 54 nt, Artificial Sequence
  Description of Artificial Sequence:  Enzymatic Nucleic Acid
agucccacagaagcagggaccagagaaacacacguugugguacauuaccuggua

SEQ ID NO: 13445 - RNA, 54 nt, Artificial Sequence
  Description of Artificial Sequence:  Enzymatic Nucleic Acid
cagagcagagaagugcauaccagagaaacacacguugugguacauuaccuggua

SEQ ID NO: 13446 - RNA, 54 nt, Artificial Sequence
  Description of Artificial Sequence:  Enzymatic Nucleic Acid
agagacagagaaggucagaccagagaaacacacguugugguacauuaccuggua

SEQ ID NO: 13447 - RNA, 54 nt, Artificial Sequence
  Description of Artificial Sequence:  Enzymatic Nucleic Acid
auaagagaagaagagcagaccagagaaacacacguugugguacauuaccuggua

SEQ ID NO: 13448 - RNA, 54 nt, Artificial Sequence
  Description of Artificial Sequence:  Enzymatic Nucleic Acid
cuccacagagaagacgcaaccagagaaacacacguugugguacauuaccuggua

SEQ ID NO: 13449 - RNA, 54 nt, Artificial Sequence
  Description of Artificial Sequence:  Enzymatic Nucleic Acid
cccgaaacagaagaggccaccagagaaacacacguugugguacauuaccuggua

SEQ ID NO: 13450 - RNA, 54 nt, Artificial Sequence
  Description of Artificial Sequence:  Enzymatic Nucleic Acid
gggcccgaagaagcggagaccagagaaacacacguugugguacauuaccuggua

SEQ ID NO: 13451 - RNA, 54 nt, Artificial Sequence
  Description of Artificial Sequence:  Enzymatic Nucleic Acid
aaacagacagaagaagacaccagagaaacacacguugugguacauuaccuggua

SEQ ID NO: 13452 - RNA, 54 nt, Artificial Sequence
  Description of Artificial Sequence:  Enzymatic Nucleic Acid
ggaugguaagaagacaacaccagagaaacacacguugugguacauuaccuggua

SEQ ID NO: 13453 - RNA, 54 nt, Artificial Sequence
  Description of Artificial Sequence:  Enzymatic Nucleic Acid
acuagaggagaagaugauaccagagaaacacacguugugguacauuaccuggua

SEQ ID NO: 13454 - RNA, 54 nt, Artificial Sequence
  Description of Artificial Sequence:  Enzymatic Nucleic Acid
augcgaagagaaggccugaccagagaaacacacguugugguacauuaccuggua

SEQ ID NO: 13455 - RNA, 54 nt, Artificial Sequence
  Description of Artificial Sequence:  Enzymatic Nucleic Acid
uccccgugagaaguaugcaccagagaaacacacguugugguacauuaccuggua

SEQ ID NO: 13456 - RNA, 54 nt, Artificial Sequence
  Description of Artificial Sequence:  Enzymatic Nucleic Acid
cuaggccaagaaggaccaaccagagaaacacacguugugguacauuaccuggua

SEQ ID NO: 13457 - RNA, 54 nt, Artificial Sequence
  Description of Artificial Sequence:  Enzymatic Nucleic Acid
uugagcccagaaguaggcaccagagaaacacacguugugguacauuaccuggua

SEQ ID NO: 13458 - RNA, 54 nt, Artificial Sequence
  Description of Artificial Sequence:  Enzymatic Nucleic Acid
auauauaaagaaggauaaaccagagaaacacacguugugguacauuaccuggua

SEQ ID NO: 13459 - RNA, 54 nt, Artificial Sequence
  Description of Artificial Sequence:  Enzymatic Nucleic Acid
uccucucaagaagccuugaccagagaaacacacguugugguacauuaccuggua

SEQ ID NO: 13460 - RNA, 54 nt, Artificial Sequence
  Description of Artificial Sequence:  Enzymatic Nucleic Acid
uaaauaugagaagauacuaccagagaaacacacguugugguacauuaccuggua

SEQ ID NO: 13461 - RNA, 54 nt, Artificial Sequence
  Description of Artificial Sequence:  Enzymatic Nucleic Acid
agguaugaagaagaugaaaccagagaaacacacguugugguacauuaccuggua

SEQ ID NO: 13462 - RNA, 54 nt, Artificial Sequence
  Description of Artificial Sequence:  Enzymatic Nucleic Acid
ccccaaagagaaggcaccaccagagaaacacacguugugguacauuaccuggua

SEQ ID NO: 13463 - RNA, 54 nt, Artificial Sequence
  Description of Artificial Sequence:  Enzymatic Nucleic Acid
ccggcuccagaaggugugaccagagaaacacacguugugguacauuaccuggua

SEQ ID NO: 13464 - RNA, 54 nt, Artificial Sequence
  Description of Artificial Sequence:  Enzymatic Nucleic Acid
gucugcccagaagugaccaccagagaaacacacguugugguacauuaccuggua

SEQ ID NO: 13465 - RNA, 54 nt, Artificial Sequence
  Description of Artificial Sequence:  Enzymatic Nucleic Acid
uauucaucagaagcccagaccagagaaacacacguugugguacauuaccuggua

SEQ ID NO: 13466 - RNA, 54 nt, Artificial Sequence
  Description of Artificial Sequence:  Enzymatic Nucleic Acid
ucucccaaagaagcuauuaccagagaaacacacguugugguacauuaccuggua

SEQ ID NO: 13467 - RNA, 54 nt, Artificial Sequence
  Description of Artificial Sequence:  Enzymatic Nucleic Acid
cuggcccgagaagagaauaccagagaaacacacguugugguacauuaccuggua

SEQ ID NO: 13468 - RNA, 54 nt, Artificial Sequence
  Description of Artificial Sequence:  Enzymatic Nucleic Acid
cacaggggagaagguaccaccagagaaacacacguugugguacauuaccuggua

SEQ ID NO: 13469 - RNA, 54 nt, Artificial Sequence
  Description of Artificial Sequence:  Enzymatic Nucleic Acid
ucucaucaagaagaaaacaccagagaaacacacguugugguacauuaccuggua

SEQ ID NO: 13470 - RNA, 54 nt, Artificial Sequence
  Description of Artificial Sequence:  Enzymatic Nucleic Acid
ccagucucagaagacagaaccagagaaacacacguugugguacauuaccuggua

SEQ ID NO: 13471 - RNA, 54 nt, Artificial Sequence
  Description of Artificial Sequence:  Enzymatic Nucleic Acid
gggcugcaagaagucucaaccagagaaacacacguugugguacauuaccuggua

SEQ ID NO: 13472 - RNA, 54 nt, Artificial Sequence
  Description of Artificial Sequence:  Enzymatic Nucleic Acid
ccacagugagaagcaggcaccagagaaacacacguugugguacauuaccuggua

SEQ ID NO: 13473 - RNA, 54 nt, Artificial Sequence
  Description of Artificial Sequence:  Enzymatic Nucleic Acid
cacacugcagaagacaagaccagagaaacacacguugugguacauuaccuggua

SEQ ID NO: 13474 - RNA, 54 nt, Artificial Sequence
  Description of Artificial Sequence:  Enzymatic Nucleic Acid
cuguucucagaaguuucuaccagagaaacacacguugugguacauuaccuggua

SEQ ID NO: 13475 - RNA, 54 nt, Artificial Sequence
  Description of Artificial Sequence:  Enzymatic Nucleic Acid
aaaccucaagaagcuguuaccagagaaacacacguugugguacauuaccuggua

SEQ ID NO: 13476 - RNA, 54 nt, Artificial Sequence
  Description of Artificial Sequence:  Enzymatic Nucleic Acid
uuauuaaaagaagaauaaaccagagaaacacacguugugguacauuaccuggua

SEQ ID NO: 13477 - RNA, 54 nt, Artificial Sequence
  Description of Artificial Sequence:  Enzymatic Nucleic Acid
agucuuuaagaagaaccaaccagagaaacacacguugugguacauuaccuggua

SEQ ID NO: 13478 - RNA, 35 nt, Artificial Sequence
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'-amino
  misc_feature (12)..(12): 2'-deoxy-2'-amino
  misc_feature (35)..(35): n stands for inverted deoxyabasic derivative
aucuuuucugaugaggcgaaagccgaaaccauacn

SEQ ID NO: 13479 - RNA, 35 nt, Artificial Sequence
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (10)..(10): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'-amino
  misc_feature (12)..(12): 2'-deoxy-2'-amino
  misc_feature (35)..(35): n stands for inverted deoxyabasic derivative
aucuuuucuuaugaggcgaaagccgauaccauacn

SEQ ID NO: 13480 - RNA, 35 nt, Artificial Sequence; identical to SEQ ID NO: 13478
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (12)..(12): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'- C-Allyl
  misc_feature (35)..(35): n stands for inverted deoxyabasic derivative

SEQ ID NO: 13481 - RNA, 35 nt, Artificial Sequence; identical to SEQ ID NO: 13479
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (10)..(10): 2'-O-Methyl
  misc_feature (12)..(12): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'- C-Allyl
  misc_feature (35)..(35): n stands for inverted deoxyabasic derivative

SEQ ID NO: 13482 - RNA, 33 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'-amino
  misc_feature (11)..(11): 2'-deoxy-2'-amino
  misc_feature (33)..(33): n stands for inverted deoxyabasic derivative
gaguugcugaugaggcgaaagccgaaagucugn

SEQ ID NO: 13483 - RNA, 33 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(9): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'-amino
  misc_feature (11)..(11): 2'-deoxy-2'-amino
  misc_feature (33)..(33): n stands for inverted deoxyabasic derivative
gaguugcuuaugaggcgaaagccgauagucugn

SEQ ID NO: 13484 - RNA, 33 nt, Artificial Sequence; identical to SEQ ID NO: 13482
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (11)..(11): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'- C-Allyl
  misc_feature (33)..(33): n stands for inverted deoxyabasic derivative

SEQ ID NO: 13485 - RNA, 33 nt, Artificial Sequence; identical to SEQ ID NO: 13483
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(9): 2'-O-Methyl
  misc_feature (11)..(11): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'- C-Allyl
  misc_feature (33)..(33): n stands for inverted deoxyabasic derivative

SEQ ID NO: 13486 - RNA, 35 nt, Artificial Sequence
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'-amino
  misc_feature (12)..(12): 2'-deoxy-2'-amino
  misc_feature (35)..(35): n stands for inverted deoxyabasic derivative
uacaauucugaugaggcgaaagccgaaaagacaan

SEQ ID NO: 13487 - RNA, 35 nt, Artificial Sequence
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (10)..(10): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'-amino
  misc_feature (12)..(12): 2'-deoxy-2'-amino
  misc_feature (35)..(35): n stands for inverted deoxyabasic derivative
uacaauucuuaugaggcgaaagccgauaagacaan

SEQ ID NO: 13488 - RNA, 35 nt, Artificial Sequence; identical to SEQ ID NO: 13486
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (12)..(12): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'- C-Allyl
  misc_feature (35)..(35): n stands for inverted deoxyabasic derivative

SEQ ID NO: 13489 - RNA, 35 nt, Artificial Sequence; identical to SEQ ID NO: 13487
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (10)..(10): 2'-O-Methyl
  misc_feature (12)..(12): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'- C-Allyl
  misc_feature (35)..(35): n stands for inverted deoxyabasic derivative

SEQ ID NO: 13490 - RNA, 33 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'-amino
  misc_feature (11)..(11): 2'-deoxy-2'-amino
  misc_feature (33)..(33): n stands for inverted deoxyabasic derivative
cuggagcugaugaggcgaaagccgaaacacggn

SEQ ID NO: 13491 - RNA, 33 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(9): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'-amino
  misc_feature (11)..(11): 2'-deoxy-2'-amino
  misc_feature (33)..(33): n stands for inverted deoxyabasic derivative
cuggagcuuaugaggcgaaagccgauacacggn

SEQ ID NO: 13492 - RNA, 33 nt, Artificial Sequence; identical to SEQ ID NO: 13490
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (11)..(11): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'- C-Allyl
  misc_feature (33)..(33): n stands for inverted deoxyabasic derivative

SEQ ID NO: 13493 - RNA, 33 nt, Artificial Sequence; identical to SEQ ID NO: 13491
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(9): 2'-O-Methyl
  misc_feature (11)..(11): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'- C-Allyl
  misc_feature (33)..(33): n stands for inverted deoxyabasic derivative

SEQ ID NO: 13494 - RNA, 35 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-amino
  misc_feature (35)..(35): n stands for inverted deoxyabasic derivative
gaguugcugaugaggccgaaaggccgaaagucugn

SEQ ID NO: 13495 - RNA, 35 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-amino
  misc_feature (35)..(35): n stands for inverted deoxyabasic derivative
gaguugcuagagaggccgaaaggccgauagucugn

SEQ ID NO: 13496 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(33): 2'-O-Methyl
  misc_feature (8)..(8): 2'-deoxy-2'-amino
  misc_feature (34)..(34): n stands for inverted deoxyabasic derivative
gaaggucuagugaggccgaaaggccgauaugucn

SEQ ID NO: 13497 - RNA, 38 nt, Artificial Sequence
  Description of Artificial Sequence:  Enzymatic Nucleic Acid
  misc_feature (31)..(31): n stands for inosine
ccgagaggcugaugaggccguuaggccgaanuguccgc

SEQ ID NO: 13498 - RNA, 38 nt, Artificial Sequence
  Description of Artificial Sequence:  Enzymatic Nucleic Acid
  misc_feature (31)..(31): n stands for inosine
agccgagacugaugaggccguuaggccgaanagugucc

SEQ ID NO: 13499 - RNA, 38 nt, Artificial Sequence
  Description of Artificial Sequence:  Enzymatic Nucleic Acid
  misc_feature (31)..(31): n stands for inosine
gagccgagcugaugaggccguuaggccgaangaguguc

SEQ ID NO: 13500 - RNA, 38 nt, Artificial Sequence
  Description of Artificial Sequence:  Enzymatic Nucleic Acid
  misc_feature (31)..(31): n stands for inosine
aggagccgcugaugaggccguuaggccgaanaggagug

SEQ ID NO: 13501 - RNA, 38 nt, Artificial Sequence
  Description of Artificial Sequence:  Enzymatic Nucleic Acid
  misc_feature (31)..(31): n stands for inosine
cggggaggcugaugaggccguuaggccgaanccgagag

SEQ ID NO: 13502 - RNA, 38 nt, Artificial Sequence
  Description of Artificial Sequence:  Enzymatic Nucleic Acid
  misc_feature (31)..(31): n stands for inosine
gccggggacugaugaggccguuaggccgaanagccgag

SEQ ID NO: 13503 - RNA, 38 nt, Artificial Sequence
  Description of Artificial Sequence:  Enzymatic Nucleic Acid
  misc_feature (31)..(31): n stands for inosine
ugccggggcugaugaggccguuaggccgaangagccga

SEQ ID NO: 13504 - RNA, 38 nt, Artificial Sequence
  Description of Artificial Sequence:  Enzymatic Nucleic Acid
  misc_feature (31)..(31): n stands for inosine
gcugccggcugaugaggccguuaggccgaanaggagcc

SEQ ID NO: 13505 - RNA, 38 nt, Artificial Sequence
  Description of Artificial Sequence:  Enzymatic Nucleic Acid
  misc_feature (31)..(31): n stands for inosine
cgcugccgcugaugaggccguuaggccgaangaggagc

SEQ ID NO: 13506 - RNA, 38 nt, Artificial Sequence
  Description of Artificial Sequence:  Enzymatic Nucleic Acid
  misc_feature (31)..(31): n stands for inosine
ccgcugcccugaugaggccguuaggccgaanggaggag

SEQ ID NO: 13507 - RNA, 38 nt, Artificial Sequence
  Description of Artificial Sequence:  Enzymatic Nucleic Acid
  misc_feature (31)..(31): n stands for inosine
gccgccgccugaugaggccguuaggccgaanccgggga

SEQ ID NO: 13508 - RNA, 38 nt, Artificial Sequence
  Description of Artificial Sequence:  Enzymatic Nucleic Acid
  misc_feature (31)..(31): n stands for inosine
ccgcuccgcugaugaggccguuaggccgaanccgccgc

SEQ ID NO: 13509 - RNA, 38 nt, Artificial Sequence
  Description of Artificial Sequence:  Enzymatic Nucleic Acid
  misc_feature (31)..(31): n stands for inosine
agccccggcugaugaggccguuaggccgaancccgcuc

SEQ ID NO: 13510 - RNA, 38 nt, Artificial Sequence
  Description of Artificial Sequence:  Enzymatic Nucleic Acid
  misc_feature (31)..(31): n stands for inosine
cgagcccccugaugaggccguuaggccgaanagcccgc

SEQ ID NO: 13511 - RNA, 38 nt, Artificial Sequence
  Description of Artificial Sequence:  Enzymatic Nucleic Acid
  misc_feature (31)..(31): n stands for inosine
ugcacccgcugaugaggccguuaggccgaanccccgga

SEQ ID NO: 13512 - RNA, 38 nt, Artificial Sequence
  Description of Artificial Sequence:  Enzymatic Nucleic Acid
  misc_feature (31)..(31): n stands for inosine
cuggccgccugaugaggccguuaggccgaancacccga

SEQ ID NO: 13513 - RNA, 38 nt, Artificial Sequence
  Description of Artificial Sequence:  Enzymatic Nucleic Acid
  misc_feature (31)..(31): n stands for inosine
ggcccgcucugaugaggccguuaggccgaanccgcugc

SEQ ID NO: 13514 - RNA, 38 nt, Artificial Sequence
  Description of Artificial Sequence:  Enzymatic Nucleic Acid
  misc_feature (31)..(31): n stands for inosine
aggcccgccugaugaggccguuaggccgaangccgcug

SEQ ID NO: 13515 - RNA, 38 nt, Artificial Sequence
  Description of Artificial Sequence:  Enzymatic Nucleic Acid
  misc_feature (31)..(31): n stands for inosine
cgccgccacugaugaggccguuaggccgaancccgcug

SEQ ID NO: 13516 - RNA, 38 nt, Artificial Sequence
  Description of Artificial Sequence:  Enzymatic Nucleic Acid
  misc_feature (31)..(31): n stands for inosine
ucgccgcccugaugaggccguuaggccgaangcccgcu

SEQ ID NO: 13517 - RNA, 38 nt, Artificial Sequence
  Description of Artificial Sequence:  Enzymatic Nucleic Acid
  misc_feature (31)..(31): n stands for inosine
cuuccccgcugaugaggccguuaggccgaanuaauccu

SEQ ID NO: 13518 - RNA, 38 nt, Artificial Sequence
  Description of Artificial Sequence:  Enzymatic Nucleic Acid
  misc_feature (31)..(31): n stands for inosine
acuucccccugaugaggccguuaggccgaanguaaucc

SEQ ID NO: 13519 - RNA, 38 nt, Artificial Sequence
  Description of Artificial Sequence:  Enzymatic Nucleic Acid
  misc_feature (31)..(31): n stands for inosine
cagccaggcugaugaggccguuaggccgaanacaacca

SEQ ID NO: 13520 - RNA, 38 nt, Artificial Sequence
  Description of Artificial Sequence:  Enzymatic Nucleic Acid
  misc_feature (31)..(31): n stands for inosine
uccagccacugaugaggccguuaggccgaanagacaac

SEQ ID NO: 13521 - RNA, 38 nt, Artificial Sequence
  Description of Artificial Sequence:  Enzymatic Nucleic Acid
  misc_feature (31)..(31): n stands for inosine
cuccagcccugaugaggccguuaggccgaangagacaa

SEQ ID NO: 13522 - RNA, 38 nt, Artificial Sequence
  Description of Artificial Sequence:  Enzymatic Nucleic Acid
  misc_feature (31)..(31): n stands for inosine
gcggcucccugaugaggccguuaggccgaanccaggag

SEQ ID NO: 13523 - RNA, 38 nt, Artificial Sequence
  Description of Artificial Sequence:  Enzymatic Nucleic Acid
  misc_feature (31)..(31): n stands for inosine
cgucucgccugaugaggccguuaggccgaancuccagc

SEQ ID NO: 13524 - RNA, 38 nt, Artificial Sequence
  Description of Artificial Sequence:  Enzymatic Nucleic Acid
  misc_feature (31)..(31): n stands for inosine
gcgcccugcugaugaggccguuaggccgaancgcccgu

SEQ ID NO: 13525 - RNA, 38 nt, Artificial Sequence
  Description of Artificial Sequence:  Enzymatic Nucleic Acid
  misc_feature (31)..(31): n stands for inosine
ccgcgccccugaugaggccguuaggccgaanagcgccc

SEQ ID NO: 13526 - RNA, 38 nt, Artificial Sequence
  Description of Artificial Sequence:  Enzymatic Nucleic Acid
  misc_feature (31)..(31): n stands for inosine
ccgccgcccugaugaggccguuaggccgaanccccgcg

SEQ ID NO: 13527 - RNA, 38 nt, Artificial Sequence
  Description of Artificial Sequence:  Enzymatic Nucleic Acid
  misc_feature (31)..(31): n stands for inosine
gccgccagcugaugaggccguuaggccgaanuccgucc

SEQ ID NO: 13528 - RNA, 38 nt, Artificial Sequence
  Description of Artificial Sequence:  Enzymatic Nucleic Acid
  misc_feature (31)..(31): n stands for inosine
cggccgcccugaugaggccguuaggccgaanaguccgu

SEQ ID NO: 13529 - RNA, 38 nt, Artificial Sequence
  Description of Artificial Sequence:  Enzymatic Nucleic Acid
  misc_feature (31)..(31): n stands for inosine
aacgaccccugaugaggccguuaggccgaanccgccag

SEQ ID NO: 13530 - RNA, 38 nt, Artificial Sequence
  Description of Artificial Sequence:  Enzymatic Nucleic Acid
  misc_feature (31)..(31): n stands for inosine
gcuccccccugaugaggccguuaggccgaanccaacga

SEQ ID NO: 13531 - RNA, 38 nt, Artificial Sequence
  Description of Artificial Sequence:  Enzymatic Nucleic Acid
  misc_feature (31)..(31): n stands for inosine
ucgcccggcugaugaggccguuaggccgaancccgcgc

SEQ ID NO: 13532 - RNA, 38 nt, Artificial Sequence
  Description of Artificial Sequence:  Enzymatic Nucleic Acid
  misc_feature (31)..(31): n stands for inosine
gcucgccccugaugaggccguuaggccgaanugcccgc

SEQ ID NO: 13533 - RNA, 38 nt, Artificial Sequence
  Description of Artificial Sequence:  Enzymatic Nucleic Acid
  misc_feature (31)..(31): n stands for inosine
acgcggcccugaugaggccguuaggccgaancucgccc

SEQ ID NO: 13534 - RNA, 38 nt, Artificial Sequence
  Description of Artificial Sequence:  Enzymatic Nucleic Acid
  misc_feature (31)..(31): n stands for inosine
cgcgacgccugaugaggccguuaggccgaanccugcuc

SEQ ID NO: 13535 - RNA, 38 nt, Artificial Sequence
  Description of Artificial Sequence:  Enzymatic Nucleic Acid
  misc_feature (31)..(31): n stands for inosine
ccauggugcugaugaggccguuaggccgaancgcgacg

SEQ ID NO: 13536 - RNA, 38 nt, Artificial Sequence
  Description of Artificial Sequence:  Enzymatic Nucleic Acid
  misc_feature (31)..(31): n stands for inosine
gaccauggcugaugaggccguuaggccgaanagcgcga

SEQ ID NO: 13537 - RNA, 38 nt, Artificial Sequence
  Description of Artificial Sequence:  Enzymatic Nucleic Acid
  misc_feature (31)..(31): n stands for inosine
cugaccaucugaugaggccguuaggccgaanugagcgc

SEQ ID NO: 13538 - RNA, 38 nt, Artificial Sequence
  Description of Artificial Sequence:  Enzymatic Nucleic Acid
  misc_feature (31)..(31): n stands for inosine
gcugaccacugaugaggccguuaggccgaangugagcg

SEQ ID NO: 13539 - RNA, 38 nt, Artificial Sequence
  Description of Artificial Sequence:  Enzymatic Nucleic Acid
  misc_feature (31)..(31): n stands for inosine
ccaguagccugaugaggccguuaggccgaanaccaugg

SEQ ID NO: 13540 - RNA, 38 nt, Artificial Sequence
  Description of Artificial Sequence:  Enzymatic Nucleic Acid
  misc_feature (31)..(31): n stands for inosine
gucccagucugaugaggccguuaggccgaancugacca

SEQ ID NO: 13541 - RNA, 38 nt, Artificial Sequence
  Description of Artificial Sequence:  Enzymatic Nucleic Acid
  misc_feature (31)..(31): n stands for inosine
gguguccccugaugaggccguuaggccgaanuagcuga

SEQ ID NO: 13542 - RNA, 38 nt, Artificial Sequence
  Description of Artificial Sequence:  Enzymatic Nucleic Acid
  misc_feature (31)..(31): n stands for inosine
gaccccggcugaugaggccguuaggccgaanucccagu

SEQ ID NO: 13543 - RNA, 38 nt, Artificial Sequence
  Description of Artificial Sequence:  Enzymatic Nucleic Acid
  misc_feature (31)..(31): n stands for inosine
aggacccccugaugaggccguuaggccgaanuguccca

SEQ ID NO: 13544 - RNA, 38 nt, Artificial Sequence
  Description of Artificial Sequence:  Enzymatic Nucleic Acid
  misc_feature (31)..(31): n stands for inosine
gcacagcacugaugaggccguuaggccgaanaccccgg

SEQ ID NO: 13545 - RNA, 38 nt, Artificial Sequence
  Description of Artificial Sequence:  Enzymatic Nucleic Acid
  misc_feature (31)..(31): n stands for inosine
cgcacagccugaugaggccguuaggccgaangaccccg

SEQ ID NO: 13546 - RNA, 38 nt, Artificial Sequence
  Description of Artificial Sequence:  Enzymatic Nucleic Acid
  misc_feature (31)..(31): n stands for inosine
gcgcgcaccugaugaggccguuaggccgaancaggacc

SEQ ID NO: 13547 - RNA, 38 nt, Artificial Sequence
  Description of Artificial Sequence:  Enzymatic Nucleic Acid
  misc_feature (31)..(31): n stands for inosine
agcugagccugaugaggccguuaggccgaancgcgcac

SEQ ID NO: 13548 - RNA, 38 nt, Artificial Sequence
  Description of Artificial Sequence:  Enzymatic Nucleic Acid
  misc_feature (31)..(31): n stands for inosine
gacagcugcugaugaggccguuaggccgaancagcgcg

SEQ ID NO: 13549 - RNA, 38 nt, Artificial Sequence
  Description of Artificial Sequence:  Enzymatic Nucleic Acid
  misc_feature (31)..(31): n stands for inosine
cagacagccugaugaggccguuaggccgaanagcagcg

SEQ ID NO: 13550 - RNA, 38 nt, Artificial Sequence
  Description of Artificial Sequence:  Enzymatic Nucleic Acid
  misc_feature (31)..(31): n stands for inosine
aagcagaccugaugaggccguuaggccgaancugagca

SEQ ID NO: 13551 - RNA, 38 nt, Artificial Sequence
  Description of Artificial Sequence:  Enzymatic Nucleic Acid
  misc_feature (31)..(31): n stands for inosine
ugagaagccugaugaggccguuaggccgaanacagcug

SEQ ID NO: 13552 - RNA, 38 nt, Artificial Sequence
  Description of Artificial Sequence:  Enzymatic Nucleic Acid
  misc_feature (31)..(31): n stands for inosine
cugugagacugaugaggccguuaggccgaancagacag

SEQ ID NO: 13553 - RNA, 38 nt, Artificial Sequence
  Description of Artificial Sequence:  Enzymatic Nucleic Acid
  misc_feature (31)..(31): n stands for inosine
auccugugcugaugaggccguuaggccgaanaagcaga

SEQ ID NO: 13554 - RNA, 38 nt, Artificial Sequence
  Description of Artificial Sequence:  Enzymatic Nucleic Acid
  misc_feature (31)..(31): n stands for inosine
agauccugcugaugaggccguuaggccgaanagaagca

SEQ ID NO: 13555 - RNA, 38 nt, Artificial Sequence
  Description of Artificial Sequence:  Enzymatic Nucleic Acid
  misc_feature (31)..(31): n stands for inosine
cuagaucccugaugaggccguuaggccgaanugagaag

SEQ ID NO: 13556 - RNA, 38 nt, Artificial Sequence
  Description of Artificial Sequence:  Enzymatic Nucleic Acid
  misc_feature (31)..(31): n stands for inosine
ccugaacucugaugaggccguuaggccgaanauccugu

SEQ ID NO: 13557 - RNA, 38 nt, Artificial Sequence
  Description of Artificial Sequence:  Enzymatic Nucleic Acid
  misc_feature (31)..(31): n stands for inosine
uuugaacccugaugaggccguuaggccgaanaacuaga

SEQ ID NO: 13558 - RNA, 38 nt, Artificial Sequence
  Description of Artificial Sequence:  Enzymatic Nucleic Acid
  misc_feature (31)..(31): n stands for inosine
uuuaauuucugaugaggccguuaggccgaanaaccuga

SEQ ID NO: 13559 - RNA, 38 nt, Artificial Sequence
  Description of Artificial Sequence:  Enzymatic Nucleic Acid
  misc_feature (31)..(31): n stands for inosine
ucaguucacugaugaggccguuaggccgaanaucuuuu

SEQ ID NO: 13560 - RNA, 38 nt, Artificial Sequence
  Description of Artificial Sequence:  Enzymatic Nucleic Acid
  misc_feature (31)..(31): n stands for inosine
cucaguuccugaugaggccguuaggccgaangaucuuu

SEQ ID NO: 13561 - RNA, 38 nt, Artificial Sequence
  Description of Artificial Sequence:  Enzymatic Nucleic Acid
  misc_feature (31)..(31): n stands for inosine
uuaaacuccugaugaggccguuaggccgaanuucagga

SEQ ID NO: 13562 - RNA, 38 nt, Artificial Sequence
  Description of Artificial Sequence:  Enzymatic Nucleic Acid
  misc_feature (31)..(31): n stands for inosine
gugcugggcugaugaggccguuaggccgaanccuuuua

SEQ ID NO: 13563 - RNA, 38 nt, Artificial Sequence
  Description of Artificial Sequence:  Enzymatic Nucleic Acid
  misc_feature (31)..(31): n stands for inosine
augugcugcugaugaggccguuaggccgaanugccuuu

SEQ ID NO: 13564 - RNA, 38 nt, Artificial Sequence
  Description of Artificial Sequence:  Enzymatic Nucleic Acid
  misc_feature (31)..(31): n stands for inosine
gaugugcucugaugaggccguuaggccgaangugccuu

SEQ ID NO: 13565 - RNA, 38 nt, Artificial Sequence
  Description of Artificial Sequence:  Enzymatic Nucleic Acid
  misc_feature (31)..(31): n stands for inosine
ugaugugccugaugaggccguuaggccgaanggugccu

SEQ ID NO: 13566 - RNA, 38 nt, Artificial Sequence
  Description of Artificial Sequence:  Enzymatic Nucleic Acid
  misc_feature (31)..(31): n stands for inosine
gcaugaugcugaugaggccguuaggccgaancugggug

SEQ ID NO: 13567 - RNA, 38 nt, Artificial Sequence
  Description of Artificial Sequence:  Enzymatic Nucleic Acid
  misc_feature (31)..(31): n stands for inosine
uugcaugacugaugaggccguuaggccgaanugcuggg

SEQ ID NO: 13568 - RNA, 38 nt, Artificial Sequence
  Description of Artificial Sequence:  Enzymatic Nucleic Acid
  misc_feature (31)..(31): n stands for inosine
ugcuugcacugaugaggccguuaggccgaanaugugcu

SEQ ID NO: 13569 - RNA, 38 nt, Artificial Sequence
  Description of Artificial Sequence:  Enzymatic Nucleic Acid
  misc_feature (31)..(31): n stands for inosine
ggccugcucugaugaggccguuaggccgaancaugaug

SEQ ID NO: 13570 - RNA, 38 nt, Artificial Sequence
  Description of Artificial Sequence:  Enzymatic Nucleic Acid
  misc_feature (31)..(31): n stands for inosine
gucuggcccugaugaggccguuaggccgaancuugcau

SEQ ID NO: 13571 - RNA, 38 nt, Artificial Sequence
  Description of Artificial Sequence:  Enzymatic Nucleic Acid
  misc_feature (31)..(31): n stands for inosine
cagugucucugaugaggccguuaggccgaanccugcuu

SEQ ID NO: 13572 - RNA, 38 nt, Artificial Sequence
  Description of Artificial Sequence:  Enzymatic Nucleic Acid
  misc_feature (31)..(31): n stands for inosine
gcaguguccugaugaggccguuaggccgaangccugcu

SEQ ID NO: 13573 - RNA, 38 nt, Artificial Sequence
  Description of Artificial Sequence:  Enzymatic Nucleic Acid
  misc_feature (31)..(31): n stands for inosine
agaugcagcugaugaggccguuaggccgaanucuggcc

SEQ ID NO: 13574 - RNA, 38 nt, Artificial Sequence
  Description of Artificial Sequence:  Enzymatic Nucleic Acid
  misc_feature (31)..(31): n stands for inosine
ggagaugccugaugaggccguuaggccgaanugucugg

SEQ ID NO: 13575 - RNA, 38 nt, Artificial Sequence
  Description of Artificial Sequence:  Enzymatic Nucleic Acid
  misc_feature (31)..(31): n stands for inosine
auuggagacugaugaggccguuaggccgaancaguguc

SEQ ID NO: 13576 - RNA, 38 nt, Artificial Sequence
  Description of Artificial Sequence:  Enzymatic Nucleic Acid
  misc_feature (31)..(31): n stands for inosine
ugcauuggcugaugaggccguuaggccgaanaugcagu

SEQ ID NO: 13577 - RNA, 38 nt, Artificial Sequence
  Description of Artificial Sequence:  Enzymatic Nucleic Acid
  misc_feature (31)..(31): n stands for inosine
ccugcauucugaugaggccguuaggccgaanagaugca

SEQ ID NO: 13578 - RNA, 38 nt, Artificial Sequence
  Description of Artificial Sequence:  Enzymatic Nucleic Acid
  misc_feature (31)..(31): n stands for inosine
cccugcaucugaugaggccguuaggccgaangagaugc

SEQ ID NO: 13579 - RNA, 38 nt, Artificial Sequence
  Description of Artificial Sequence:  Enzymatic Nucleic Acid
  misc_feature (31)..(31): n stands for inosine
uucccccccugaugaggccguuaggccgaancauugga

SEQ ID NO: 13580 - RNA, 38 nt, Artificial Sequence
  Description of Artificial Sequence:  Enzymatic Nucleic Acid
  misc_feature (31)..(31): n stands for inosine
uuaugggccugaugaggccguuaggccgaancuucccc

SEQ ID NO: 13581 - RNA, 38 nt, Artificial Sequence
  Description of Artificial Sequence:  Enzymatic Nucleic Acid
  misc_feature (31)..(31): n stands for inosine
cauuuaugcugaugaggccguuaggccgaancugcuuc

SEQ ID NO: 13582 - RNA, 38 nt, Artificial Sequence
  Description of Artificial Sequence:  Enzymatic Nucleic Acid
  misc_feature (31)..(31): n stands for inosine
ccauuuaucugaugaggccguuaggccgaangcugcuu

SEQ ID NO: 13583 - RNA, 38 nt, Artificial Sequence
  Description of Artificial Sequence:  Enzymatic Nucleic Acid
  misc_feature (31)..(31): n stands for inosine
accauuuacugaugaggccguuaggccgaanggcugcu

SEQ ID NO: 13584 - RNA, 38 nt, Artificial Sequence
  Description of Artificial Sequence:  Enzymatic Nucleic Acid
  misc_feature (31)..(31): n stands for inosine
ucaggcaacugaugaggccguuaggccgaanaccauuu

SEQ ID NO: 13585 - RNA, 38 nt, Artificial Sequence
  Description of Artificial Sequence:  Enzymatic Nucleic Acid
  misc_feature (31)..(31): n stands for inosine
ccauuucacugaugaggccguuaggccgaancaaagac

SEQ ID NO: 13586 - RNA, 38 nt, Artificial Sequence
  Description of Artificial Sequence:  Enzymatic Nucleic Acid
  misc_feature (31)..(31): n stands for inosine
accauuuccugaugaggccguuaggccgaangcaaaga

SEQ ID NO: 13587 - RNA, 38 nt, Artificial Sequence
  Description of Artificial Sequence:  Enzymatic Nucleic Acid
  misc_feature (31)..(31): n stands for inosine
uuaugcuccugaugaggccguuaggccgaanccuuucg

SEQ ID NO: 13588 - RNA, 38 nt, Artificial Sequence
  Description of Artificial Sequence:  Enzymatic Nucleic Acid
  misc_feature (31)..(31): n stands for inosine
uuuaguuacugaugaggccguuaggccgaancucagcc

SEQ ID NO: 13589 - RNA, 38 nt, Artificial Sequence
  Description of Artificial Sequence:  Enzymatic Nucleic Acid
  misc_feature (31)..(31): n stands for inosine
gcagauuucugaugaggccguuaggccgaanuuaugcu

SEQ ID NO: 13590 - RNA, 38 nt, Artificial Sequence
  Description of Artificial Sequence:  Enzymatic Nucleic Acid
  misc_feature (31)..(31): n stands for inosine
ccacaggccugaugaggccguuaggccgaanauuuagu

SEQ ID NO: 13591 - RNA, 38 nt, Artificial Sequence
  Description of Artificial Sequence:  Enzymatic Nucleic Acid
  misc_feature (31)..(31): n stands for inosine
cuuccacacugaugaggccguuaggccgaancagauuu

SEQ ID NO: 13592 - RNA, 38 nt, Artificial Sequence
  Description of Artificial Sequence:  Enzymatic Nucleic Acid
  misc_feature (31)..(31): n stands for inosine
ucuuccaccugaugaggccguuaggccgaangcagauu

SEQ ID NO: 13593 - RNA, 38 nt, Artificial Sequence
  Description of Artificial Sequence:  Enzymatic Nucleic Acid
  misc_feature (31)..(31): n stands for inosine
gaauuguucugaugaggccguuaggccgaanccauuuc

SEQ ID NO: 13594 - RNA, 38 nt, Artificial Sequence
  Description of Artificial Sequence:  Enzymatic Nucleic Acid
  misc_feature (31)..(31): n stands for inosine
ugcagaaucugaugaggccguuaggccgaanuuugcca

SEQ ID NO: 13595 - RNA, 38 nt, Artificial Sequence
  Description of Artificial Sequence:  Enzymatic Nucleic Acid
  misc_feature (31)..(31): n stands for inosine
aguacugccugaugaggccguuaggccgaanaauuguu

SEQ ID NO: 13596 - RNA, 38 nt, Artificial Sequence
  Description of Artificial Sequence:  Enzymatic Nucleic Acid
  misc_feature (31)..(31): n stands for inosine
uaaaguaccugaugaggccguuaggccgaancagaauu

SEQ ID NO: 13597 - RNA, 38 nt, Artificial Sequence
  Description of Artificial Sequence:  Enzymatic Nucleic Acid
  misc_feature (31)..(31): n stands for inosine
aagguuaacugaugaggccguuaggccgaanuacugca

SEQ ID NO: 13598 - RNA, 38 nt, Artificial Sequence
  Description of Artificial Sequence:  Enzymatic Nucleic Acid
  misc_feature (31)..(31): n stands for inosine
guguucaacugaugaggccguuaggccgaanuuaaagu

SEQ ID NO: 13599 - RNA, 38 nt, Artificial Sequence
  Description of Artificial Sequence:  Enzymatic Nucleic Acid
  misc_feature (31)..(31): n stands for inosine
uguguucacugaugaggccguuaggccgaanguuaaag

SEQ ID NO: 13600 - RNA, 38 nt, Artificial Sequence
  Description of Artificial Sequence:  Enzymatic Nucleic Acid
  misc_feature (31)..(31): n stands for inosine
uugagcugcugaugaggccguuaggccgaanuucaagg

SEQ ID NO: 13601 - RNA, 38 nt, Artificial Sequence
  Description of Artificial Sequence:  Enzymatic Nucleic Acid
  misc_feature (31)..(31): n stands for inosine
gcuugagccugaugaggccguuaggccgaanuguucaa

SEQ ID NO: 13602 - RNA, 38 nt, Artificial Sequence
  Description of Artificial Sequence:  Enzymatic Nucleic Acid
  misc_feature (31)..(31): n stands for inosine
uuugcuugcugaugaggccguuaggccgaancuguguu

SEQ ID NO: 13603 - RNA, 38 nt, Artificial Sequence
  Description of Artificial Sequence:  Enzymatic Nucleic Acid
  misc_feature (31)..(31): n stands for inosine
gguuugcucugaugaggccguuaggccgaanagcugug

SEQ ID NO: 13604 - RNA, 38 nt, Artificial Sequence
  Description of Artificial Sequence:  Enzymatic Nucleic Acid
  misc_feature (31)..(31): n stands for inosine
gugugguucugaugaggccguuaggccgaancuugagc

SEQ ID NO: 13605 - RNA, 38 nt, Artificial Sequence
  Description of Artificial Sequence:  Enzymatic Nucleic Acid
  misc_feature (31)..(31): n stands for inosine
gccagugucugaugaggccguuaggccgaanuuugcuu

SEQ ID NO: 13606 - RNA, 38 nt, Artificial Sequence
  Description of Artificial Sequence:  Enzymatic Nucleic Acid
  misc_feature (31)..(31): n stands for inosine
agccagugcugaugaggccguuaggccgaanguuugcu

SEQ ID NO: 13607 - RNA, 38 nt, Artificial Sequence
  Description of Artificial Sequence:  Enzymatic Nucleic Acid
  misc_feature (31)..(31): n stands for inosine
gaagccagcugaugaggccguuaggccgaanugguuug

SEQ ID NO: 13608 - RNA, 38 nt, Artificial Sequence
  Description of Artificial Sequence:  Enzymatic Nucleic Acid
  misc_feature (31)..(31): n stands for inosine
uagaagcccugaugaggccguuaggccgaanugugguu

SEQ ID NO: 13609 - RNA, 38 nt, Artificial Sequence
  Description of Artificial Sequence:  Enzymatic Nucleic Acid
  misc_feature (31)..(31): n stands for inosine
gcuguagacugaugaggccguuaggccgaanccagugu

SEQ ID NO: 13610 - RNA, 38 nt, Artificial Sequence
  Description of Artificial Sequence:  Enzymatic Nucleic Acid
  misc_feature (31)..(31): n stands for inosine
gcagcugucugaugaggccguuaggccgaanaagccag

SEQ ID NO: 13611 - RNA, 38 nt, Artificial Sequence
  Description of Artificial Sequence:  Enzymatic Nucleic Acid
  misc_feature (31)..(31): n stands for inosine
uuugcagccugaugaggccguuaggccgaanuagaagc

SEQ ID NO: 13612 - RNA, 38 nt, Artificial Sequence
  Description of Artificial Sequence:  Enzymatic Nucleic Acid
  misc_feature (31)..(31): n stands for inosine
auauuugccugaugaggccguuaggccgaancuguaga

SEQ ID NO: 13613 - RNA, 38 nt, Artificial Sequence
  Description of Artificial Sequence:  Enzymatic Nucleic Acid
  misc_feature (31)..(31): n stands for inosine
uagauauucugaugaggccguuaggccgaancagcugu

SEQ ID NO: 13614 - RNA, 38 nt, Artificial Sequence
  Description of Artificial Sequence:  Enzymatic Nucleic Acid
  misc_feature (31)..(31): n stands for inosine
guacagcucugaugaggccguuaggccgaanauauuug

SEQ ID NO: 13615 - RNA, 38 nt, Artificial Sequence
  Description of Artificial Sequence:  Enzymatic Nucleic Acid
  misc_feature (31)..(31): n stands for inosine
guagguaccugaugaggccguuaggccgaancuagaua

SEQ ID NO: 13616 - RNA, 38 nt, Artificial Sequence
  Description of Artificial Sequence:  Enzymatic Nucleic Acid
  misc_feature (31)..(31): n stands for inosine
uugaaguacugaugaggccguuaggccgaanuacagcu

SEQ ID NO: 13617 - RNA, 38 nt, Artificial Sequence
  Description of Artificial Sequence:  Enzymatic Nucleic Acid
  misc_feature (31)..(31): n stands for inosine
uuugaagucugaugaggccguuaggccgaanguacagc

SEQ ID NO: 13618 - RNA, 38 nt, Artificial Sequence
  Description of Artificial Sequence:  Enzymatic Nucleic Acid
  misc_feature (31)..(31): n stands for inosine
uucuuugacugaugaggccguuaggccgaanuagguac

SEQ ID NO: 13619 - RNA, 38 nt, Artificial Sequence
  Description of Artificial Sequence:  Enzymatic Nucleic Acid
  misc_feature (31)..(31): n stands for inosine
uucuucuucugaugaggccguuaggccgaanaaguagg

SEQ ID NO: 13620 - RNA, 38 nt, Artificial Sequence
  Description of Artificial Sequence:  Enzymatic Nucleic Acid
  misc_feature (31)..(31): n stands for inosine
gcagauuccugaugaggccguuaggccgaanuuuccuu

SEQ ID NO: 13621 - RNA, 38 nt, Artificial Sequence
  Description of Artificial Sequence:  Enzymatic Nucleic Acid
  misc_feature (31)..(31): n stands for inosine
uagauugccugaugaggccguuaggccgaanauucugu

SEQ ID NO: 13622 - RNA, 38 nt, Artificial Sequence
  Description of Artificial Sequence:  Enzymatic Nucleic Acid
  misc_feature (31)..(31): n stands for inosine
auauagaucugaugaggccguuaggccgaancagauuc

SEQ ID NO: 13623 - RNA, 38 nt, Artificial Sequence
  Description of Artificial Sequence:  Enzymatic Nucleic Acid
  misc_feature (31)..(31): n stands for inosine
aaauauaucugaugaggccguuaggccgaanauugcag

SEQ ID NO: 13624 - RNA, 38 nt, Artificial Sequence
  Description of Artificial Sequence:  Enzymatic Nucleic Acid
  misc_feature (31)..(31): n stands for inosine
ggucuacccugaugaggccguuaggccgaanuaucacu

SEQ ID NO: 13625 - RNA, 38 nt, Artificial Sequence
  Description of Artificial Sequence:  Enzymatic Nucleic Acid
  misc_feature (31)..(31): n stands for inosine
cuacgaaacugaugaggccguuaggccgaanucuaccu

SEQ ID NO: 13626 - RNA, 38 nt, Artificial Sequence
  Description of Artificial Sequence:  Enzymatic Nucleic Acid
  misc_feature (31)..(31): n stands for inosine
ucuacgaacugaugaggccguuaggccgaangucuacc

SEQ ID NO: 13627 - RNA, 38 nt, Artificial Sequence
  Description of Artificial Sequence:  Enzymatic Nucleic Acid
  misc_feature (31)..(31): n stands for inosine
gauuucaccugaugaggccguuaggccgaanuacaucu

SEQ ID NO: 13628 - RNA, 38 nt, Artificial Sequence
  Description of Artificial Sequence:  Enzymatic Nucleic Acid
  misc_feature (31)..(31): n stands for inosine
aauuucggcugaugaggccguuaggccgaanauuucac

SEQ ID NO: 13629 - RNA, 38 nt, Artificial Sequence
  Description of Artificial Sequence:  Enzymatic Nucleic Acid
  misc_feature (31)..(31): n stands for inosine
uaauuucgcugaugaggccguuaggccgaangauuuca

SEQ ID NO: 13630 - RNA, 38 nt, Artificial Sequence
  Description of Artificial Sequence:  Enzymatic Nucleic Acid
  misc_feature (31)..(31): n stands for inosine
auaauuuccugaugaggccguuaggccgaanggauuuc

SEQ ID NO: 13631 - RNA, 38 nt, Artificial Sequence
  Description of Artificial Sequence:  Enzymatic Nucleic Acid
  misc_feature (31)..(31): n stands for inosine
cagucaugcugaugaggccguuaggccgaanuauaauu

SEQ ID NO: 13632 - RNA, 38 nt, Artificial Sequence
  Description of Artificial Sequence:  Enzymatic Nucleic Acid
  misc_feature (31)..(31): n stands for inosine
uucagucacugaugaggccguuaggccgaanuguauaa

SEQ ID NO: 13633 - RNA, 38 nt, Artificial Sequence
  Description of Artificial Sequence:  Enzymatic Nucleic Acid
  misc_feature (31)..(31): n stands for inosine
cuuccuuccugaugaggccguuaggccgaanucaugug

SEQ ID NO: 13634 - RNA, 38 nt, Artificial Sequence
  Description of Artificial Sequence:  Enzymatic Nucleic Acid
  misc_feature (31)..(31): n stands for inosine
gaaugacgcugaugaggccguuaggccgaancucccuu

SEQ ID NO: 13635 - RNA, 38 nt, Artificial Sequence
  Description of Artificial Sequence:  Enzymatic Nucleic Acid
  misc_feature (31)..(31): n stands for inosine
gcagggaacugaugaggccguuaggccgaanacgagcu

SEQ ID NO: 13636 - RNA, 38 nt, Artificial Sequence
  Description of Artificial Sequence:  Enzymatic Nucleic Acid
  misc_feature (31)..(31): n stands for inosine
cccggcagcugaugaggccguuaggccgaanaaugacg

SEQ ID NO: 13637 - RNA, 38 nt, Artificial Sequence
  Description of Artificial Sequence:  Enzymatic Nucleic Acid
  misc_feature (31)..(31): n stands for inosine
acccggcacugaugaggccguuaggccgaangaaugac

SEQ ID NO: 13638 - RNA, 38 nt, Artificial Sequence
  Description of Artificial Sequence:  Enzymatic Nucleic Acid
  misc_feature (31)..(31): n stands for inosine
aacccggccugaugaggccguuaggccgaanggaauga

SEQ ID NO: 13639 - RNA, 38 nt, Artificial Sequence
  Description of Artificial Sequence:  Enzymatic Nucleic Acid
  misc_feature (31)..(31): n stands for inosine
cguaaccccugaugaggccguuaggccgaancagggaa

SEQ ID NO: 13640 - RNA, 38 nt, Artificial Sequence
  Description of Artificial Sequence:  Enzymatic Nucleic Acid
  misc_feature (31)..(31): n stands for inosine
auguuaggcugaugaggccguuaggccgaanacguaac

SEQ ID NO: 13641 - RNA, 38 nt, Artificial Sequence
  Description of Artificial Sequence:  Enzymatic Nucleic Acid
  misc_feature (31)..(31): n stands for inosine
ugauguuacugaugaggccguuaggccgaanugacgua

SEQ ID NO: 13642 - RNA, 38 nt, Artificial Sequence
  Description of Artificial Sequence:  Enzymatic Nucleic Acid
  misc_feature (31)..(31): n stands for inosine
gugauguucugaugaggccguuaggccgaangugacgu

SEQ ID NO: 13643 - RNA, 38 nt, Artificial Sequence
  Description of Artificial Sequence:  Enzymatic Nucleic Acid
  misc_feature (31)..(31): n stands for inosine
aacagugacugaugaggccguuaggccgaanuuaggug

SEQ ID NO: 13644 - RNA, 38 nt, Artificial Sequence
  Description of Artificial Sequence:  Enzymatic Nucleic Acid
  misc_feature (31)..(31): n stands for inosine
aguaacagcugaugaggccguuaggccgaanauguuag

SEQ ID NO: 13645 - RNA, 38 nt, Artificial Sequence
  Description of Artificial Sequence:  Enzymatic Nucleic Acid
  misc_feature (31)..(31): n stands for inosine
aaaguaaccugaugaggccguuaggccgaanugauguu

SEQ ID NO: 13646 - RNA, 38 nt, Artificial Sequence
  Description of Artificial Sequence:  Enzymatic Nucleic Acid
  misc_feature (31)..(31): n stands for inosine
uuuuuuaacugaugaggccguuaggccgaanuaacagu

SEQ ID NO: 13647 - RNA, 38 nt, Artificial Sequence
  Description of Artificial Sequence:  Enzymatic Nucleic Acid
  misc_feature (31)..(31): n stands for inosine
ugucaagucugaugaggccguuaggccgaanaaacuuu

SEQ ID NO: 13648 - RNA, 38 nt, Artificial Sequence
  Description of Artificial Sequence:  Enzymatic Nucleic Acid
  misc_feature (31)..(31): n stands for inosine
gugucaagcugaugaggccguuaggccgaangaaacuu

SEQ ID NO: 13649 - RNA, 38 nt, Artificial Sequence
  Description of Artificial Sequence:  Enzymatic Nucleic Acid
  misc_feature (31)..(31): n stands for inosine
aagugucacugaugaggccguuaggccgaanuggaaac

SEQ ID NO: 13650 - RNA, 38 nt, Artificial Sequence
  Description of Artificial Sequence:  Enzymatic Nucleic Acid
  misc_feature (31)..(31): n stands for inosine
gaucaaagcugaugaggccguuaggccgaanucaagug

SEQ ID NO: 13651 - RNA, 38 nt, Artificial Sequence
  Description of Artificial Sequence:  Enzymatic Nucleic Acid
  misc_feature (31)..(31): n stands for inosine
gggaucaacugaugaggccguuaggccgaanugucaag

SEQ ID NO: 13652 - RNA, 38 nt, Artificial Sequence
  Description of Artificial Sequence:  Enzymatic Nucleic Acid
  misc_feature (31)..(31): n stands for inosine
uccaucagcugaugaggccguuaggccgaanaucaaag

SEQ ID NO: 13653 - RNA, 38 nt, Artificial Sequence
  Description of Artificial Sequence:  Enzymatic Nucleic Acid
  misc_feature (31)..(31): n stands for inosine
uuccaucacugaugaggccguuaggccgaangaucaaa

SEQ ID NO: 13654 - RNA, 38 nt, Artificial Sequence
  Description of Artificial Sequence:  Enzymatic Nucleic Acid
  misc_feature (31)..(31): n stands for inosine
uuuccauccugaugaggccguuaggccgaanggaucaa

SEQ ID NO: 13655 - RNA, 38 nt, Artificial Sequence
  Description of Artificial Sequence:  Enzymatic Nucleic Acid
  misc_feature (31)..(31): n stands for inosine
ccagauuacugaugaggccguuaggccgaancguuuuc

SEQ ID NO: 13656 - RNA, 38 nt, Artificial Sequence
  Description of Artificial Sequence:  Enzymatic Nucleic Acid
  misc_feature (31)..(31): n stands for inosine
acuguccccugaugaggccguuaggccgaanauuaugc

SEQ ID NO: 13657 - RNA, 38 nt, Artificial Sequence
  Description of Artificial Sequence:  Enzymatic Nucleic Acid
  misc_feature (31)..(31): n stands for inosine
cuuucuaccugaugaggccguuaggccgaanucccaga

SEQ ID NO: 13658 - RNA, 38 nt, Artificial Sequence
  Description of Artificial Sequence:  Enzymatic Nucleic Acid
  misc_feature (31)..(31): n stands for inosine
uaugaugacugaugaggccguuaggccgaancccuuuc

SEQ ID NO: 13659 - RNA, 38 nt, Artificial Sequence
  Description of Artificial Sequence:  Enzymatic Nucleic Acid
  misc_feature (31)..(31): n stands for inosine
ugauaugacugaugaggccguuaggccgaanaagcccu

SEQ ID NO: 13660 - RNA, 38 nt, Artificial Sequence
  Description of Artificial Sequence:  Enzymatic Nucleic Acid
  misc_feature (31)..(31): n stands for inosine
auuugauacugaugaggccguuaggccgaanaugaagc

SEQ ID NO: 13661 - RNA, 38 nt, Artificial Sequence
  Description of Artificial Sequence:  Enzymatic Nucleic Acid
  misc_feature (31)..(31): n stands for inosine
guugcauucugaugaggccguuaggccgaanauaugau

SEQ ID NO: 13662 - RNA, 38 nt, Artificial Sequence
  Description of Artificial Sequence:  Enzymatic Nucleic Acid
  misc_feature (31)..(31): n stands for inosine
uuguacgucugaugaggccguuaggccgaancauuuga

SEQ ID NO: 13663 - RNA, 38 nt, Artificial Sequence
  Description of Artificial Sequence:  Enzymatic Nucleic Acid
  misc_feature (31)..(31): n stands for inosine
uauuucuucugaugaggccguuaggccgaanuacguug

SEQ ID NO: 13664 - RNA, 38 nt, Artificial Sequence
  Description of Artificial Sequence:  Enzymatic Nucleic Acid
  misc_feature (31)..(31): n stands for inosine
aggucagacugaugaggccguuaggccgaancccuauu

SEQ ID NO: 13665 - RNA, 38 nt, Artificial Sequence
  Description of Artificial Sequence:  Enzymatic Nucleic Acid
  misc_feature (31)..(31): n stands for inosine
cacagguccugaugaggccguuaggccgaanaagcccu

SEQ ID NO: 13666 - RNA, 38 nt, Artificial Sequence
  Description of Artificial Sequence:  Enzymatic Nucleic Acid
  misc_feature (31)..(31): n stands for inosine
gcuucacacugaugaggccguuaggccgaanucagaag

SEQ ID NO: 13667 - RNA, 38 nt, Artificial Sequence
  Description of Artificial Sequence:  Enzymatic Nucleic Acid
  misc_feature (31)..(31): n stands for inosine
ugcuucaccugaugaggccguuaggccgaangucagaa

SEQ ID NO: 13668 - RNA, 38 nt, Artificial Sequence
  Description of Artificial Sequence:  Enzymatic Nucleic Acid
  misc_feature (31)..(31): n stands for inosine
uugacugucugaugaggccguuaggccgaancuucaca

SEQ ID NO: 13669 - RNA, 38 nt, Artificial Sequence
  Description of Artificial Sequence:  Enzymatic Nucleic Acid
  misc_feature (31)..(31): n stands for inosine
ccauugaccugaugaggccguuaggccgaanuugcuuc

SEQ ID NO: 13670 - RNA, 38 nt, Artificial Sequence
  Description of Artificial Sequence:  Enzymatic Nucleic Acid
  misc_feature (31)..(31): n stands for inosine
augcccaucugaugaggccguuaggccgaanacuguug

SEQ ID NO: 13671 - RNA, 38 nt, Artificial Sequence
  Description of Artificial Sequence:  Enzymatic Nucleic Acid
  misc_feature (31)..(31): n stands for inosine
uauacaaacugaugaggccguuaggccgaancccauug

SEQ ID NO: 13672 - RNA, 38 nt, Artificial Sequence
  Description of Artificial Sequence:  Enzymatic Nucleic Acid
  misc_feature (31)..(31): n stands for inosine
agauaguucugaugaggccguuaggccgaanucuuaua

SEQ ID NO: 13673 - RNA, 38 nt, Artificial Sequence
  Description of Artificial Sequence:  Enzymatic Nucleic Acid
  misc_feature (31)..(31): n stands for inosine
ugugagaucugaugaggccguuaggccgaanuuugucu

SEQ ID NO: 13674 - RNA, 38 nt, Artificial Sequence
  Description of Artificial Sequence:  Enzymatic Nucleic Acid
  misc_feature (31)..(31): n stands for inosine
gaugugugcugaugaggccguuaggccgaanauaguuu

SEQ ID NO: 13675 - RNA, 38 nt, Artificial Sequence
  Description of Artificial Sequence:  Enzymatic Nucleic Acid
  misc_feature (31)..(31): n stands for inosine
ucgaugugcugaugaggccguuaggccgaanagauagu

SEQ ID NO: 13676 - RNA, 38 nt, Artificial Sequence
  Description of Artificial Sequence:  Enzymatic Nucleic Acid
  misc_feature (31)..(31): n stands for inosine
ugucgaugcugaugaggccguuaggccgaanugagaua

SEQ ID NO: 13677 - RNA, 38 nt, Artificial Sequence
  Description of Artificial Sequence:  Enzymatic Nucleic Acid
  misc_feature (31)..(31): n stands for inosine
uuugucgacugaugaggccguuaggccgaanugugaga

SEQ ID NO: 13678 - RNA, 38 nt, Artificial Sequence
  Description of Artificial Sequence:  Enzymatic Nucleic Acid
  misc_feature (31)..(31): n stands for inosine
uauugguucugaugaggccguuaggccgaanucgaugu

SEQ ID NO: 13679 - RNA, 38 nt, Artificial Sequence
  Description of Artificial Sequence:  Enzymatic Nucleic Acid
  misc_feature (31)..(31): n stands for inosine
auuguauucugaugaggccguuaggccgaanuuugucg

SEQ ID NO: 13680 - RNA, 38 nt, Artificial Sequence
  Description of Artificial Sequence:  Enzymatic Nucleic Acid
  misc_feature (31)..(31): n stands for inosine
gauuguaucugaugaggccguuaggccgaanguuuguc

SEQ ID NO: 13681 - RNA, 38 nt, Artificial Sequence
  Description of Artificial Sequence:  Enzymatic Nucleic Acid
  misc_feature (31)..(31): n stands for inosine
ucuaugaucugaugaggccguuaggccgaanuauuggu

SEQ ID NO: 13682 - RNA, 38 nt, Artificial Sequence
  Description of Artificial Sequence:  Enzymatic Nucleic Acid
  misc_feature (31)..(31): n stands for inosine
gacaucuacugaugaggccguuaggccgaanauuguau

SEQ ID NO: 13683 - RNA, 38 nt, Artificial Sequence
  Description of Artificial Sequence:  Enzymatic Nucleic Acid
  misc_feature (31)..(31): n stands for inosine
gcuuauuucugaugaggccguuaggccgaanacaucua

SEQ ID NO: 13684 - RNA, 38 nt, Artificial Sequence
  Description of Artificial Sequence:  Enzymatic Nucleic Acid
  misc_feature (31)..(31): n stands for inosine
ugcuuauucugaugaggccguuaggccgaangacaucu

SEQ ID NO: 13685 - RNA, 38 nt, Artificial Sequence
  Description of Artificial Sequence:  Enzymatic Nucleic Acid
  misc_feature (31)..(31): n stands for inosine
gcguggugcugaugaggccguuaggccgaancuuauuu

SEQ ID NO: 13686 - RNA, 38 nt, Artificial Sequence
  Description of Artificial Sequence:  Enzymatic Nucleic Acid
  misc_feature (31)..(31): n stands for inosine
gggcguggcugaugaggccguuaggccgaanugcuuau

SEQ ID NO: 13687 - RNA, 38 nt, Artificial Sequence
  Description of Artificial Sequence:  Enzymatic Nucleic Acid
  misc_feature (31)..(31): n stands for inosine
cugggcgucugaugaggccguuaggccgaanugugcuu

SEQ ID NO: 13688 - RNA, 38 nt, Artificial Sequence
  Description of Artificial Sequence:  Enzymatic Nucleic Acid
  misc_feature (31)..(31): n stands for inosine
acugggcgcugaugaggccguuaggccgaangugugcu

SEQ ID NO: 13689 - RNA, 38 nt, Artificial Sequence
  Description of Artificial Sequence:  Enzymatic Nucleic Acid
  misc_feature (31)..(31): n stands for inosine
uuugacugcugaugaggccguuaggccgaancguggug

SEQ ID NO: 13690 - RNA, 38 nt, Artificial Sequence
  Description of Artificial Sequence:  Enzymatic Nucleic Acid
  misc_feature (31)..(31): n stands for inosine
auuugacucugaugaggccguuaggccgaangcguggu

SEQ ID NO: 13691 - RNA, 38 nt, Artificial Sequence
  Description of Artificial Sequence:  Enzymatic Nucleic Acid
  misc_feature (31)..(31): n stands for inosine
aauuugaccugaugaggccguuaggccgaanggcgugg

SEQ ID NO: 13692 - RNA, 38 nt, Artificial Sequence
  Description of Artificial Sequence:  Enzymatic Nucleic Acid
  misc_feature (31)..(31): n stands for inosine
aaguaauucugaugaggccguuaggccgaanacugggc

SEQ ID NO: 13693 - RNA, 38 nt, Artificial Sequence
  Description of Artificial Sequence:  Enzymatic Nucleic Acid
  misc_feature (31)..(31): n stands for inosine
ggccucuacugaugaggccguuaggccgaanuaauuug

SEQ ID NO: 13694 - RNA, 38 nt, Artificial Sequence
  Description of Artificial Sequence:  Enzymatic Nucleic Acid
  misc_feature (31)..(31): n stands for inosine
aagaguaucugaugaggccguuaggccgaanccucuaa

SEQ ID NO: 13695 - RNA, 38 nt, Artificial Sequence
  Description of Artificial Sequence:  Enzymatic Nucleic Acid
  misc_feature (31)..(31): n stands for inosine
caagaguacugaugaggccguuaggccgaangccucua

SEQ ID NO: 13696 - RNA, 38 nt, Artificial Sequence
  Description of Artificial Sequence:  Enzymatic Nucleic Acid
  misc_feature (31)..(31): n stands for inosine
aggacaagcugaugaggccguuaggccgaanuauggcc

SEQ ID NO: 13697 - RNA, 38 nt, Artificial Sequence
  Description of Artificial Sequence:  Enzymatic Nucleic Acid
  misc_feature (31)..(31): n stands for inosine
ugaggacacugaugaggccguuaggccgaanaguaugg

SEQ ID NO: 13698 - RNA, 38 nt, Artificial Sequence
  Description of Artificial Sequence:  Enzymatic Nucleic Acid
  misc_feature (31)..(31): n stands for inosine
acaauugacugaugaggccguuaggccgaanacaagag

SEQ ID NO: 13699 - RNA, 38 nt, Artificial Sequence
  Description of Artificial Sequence:  Enzymatic Nucleic Acid
  misc_feature (31)..(31): n stands for inosine
uacaauugcugaugaggccguuaggccgaangacaaga

SEQ ID NO: 13700 - RNA, 38 nt, Artificial Sequence
  Description of Artificial Sequence:  Enzymatic Nucleic Acid
  misc_feature (31)..(31): n stands for inosine
aguacaaucugaugaggccguuaggccgaanaggacaa

SEQ ID NO: 13701 - RNA, 38 nt, Artificial Sequence
  Description of Artificial Sequence:  Enzymatic Nucleic Acid
  misc_feature (31)..(31): n stands for inosine
gugguagccugaugaggccguuaggccgaanuacaauu

SEQ ID NO: 13702 - RNA, 38 nt, Artificial Sequence
  Description of Artificial Sequence:  Enzymatic Nucleic Acid
  misc_feature (31)..(31): n stands for inosine
ggaguggucugaugaggccguuaggccgaancaguaca

SEQ ID NO: 13703 - RNA, 38 nt, Artificial Sequence
  Description of Artificial Sequence:  Enzymatic Nucleic Acid
  misc_feature (31)..(31): n stands for inosine
aagggagucugaugaggccguuaggccgaanuagcagu

SEQ ID NO: 13704 - RNA, 38 nt, Artificial Sequence
  Description of Artificial Sequence:  Enzymatic Nucleic Acid
  misc_feature (31)..(31): n stands for inosine
caagggagcugaugaggccguuaggccgaanguagcag

SEQ ID NO: 13705 - RNA, 38 nt, Artificial Sequence
  Description of Artificial Sequence:  Enzymatic Nucleic Acid
  misc_feature (31)..(31): n stands for inosine
uucaagggcugaugaggccguuaggccgaanugguagc

SEQ ID NO: 13706 - RNA, 38 nt, Artificial Sequence
  Description of Artificial Sequence:  Enzymatic Nucleic Acid
  misc_feature (31)..(31): n stands for inosine
uguucaagcugaugaggccguuaggccgaanaguggua

SEQ ID NO: 13707 - RNA, 38 nt, Artificial Sequence
  Description of Artificial Sequence:  Enzymatic Nucleic Acid
  misc_feature (31)..(31): n stands for inosine
guguucaacugaugaggccguuaggccgaangaguggu

SEQ ID NO: 13708 - RNA, 38 nt, Artificial Sequence
  Description of Artificial Sequence:  Enzymatic Nucleic Acid
  misc_feature (31)..(31): n stands for inosine
cguguucacugaugaggccguuaggccgaanggagugg

SEQ ID NO: 13709 - RNA, 38 nt, Artificial Sequence
  Description of Artificial Sequence:  Enzymatic Nucleic Acid
  misc_feature (31)..(31): n stands for inosine
aacucucgcugaugaggccguuaggccgaanuucaagg

SEQ ID NO: 13710 - RNA, 38 nt, Artificial Sequence
  Description of Artificial Sequence:  Enzymatic Nucleic Acid
  misc_feature (31)..(31): n stands for inosine
aggucauucugaugaggccguuaggccgaanaacucuc

SEQ ID NO: 13711 - RNA, 38 nt, Artificial Sequence
  Description of Artificial Sequence:  Enzymatic Nucleic Acid
  misc_feature (31)..(31): n stands for inosine
uaacuccacugaugaggccguuaggccgaanucauuug

SEQ ID NO: 13712 - RNA, 38 nt, Artificial Sequence
  Description of Artificial Sequence:  Enzymatic Nucleic Acid
  misc_feature (31)..(31): n stands for inosine
guaacucccugaugaggccguuaggccgaangucauuu

SEQ ID NO: 13713 - RNA, 38 nt, Artificial Sequence
  Description of Artificial Sequence:  Enzymatic Nucleic Acid
  misc_feature (31)..(31): n stands for inosine
uucaucagcugaugaggccguuaggccgaanuaacucc

SEQ ID NO: 13714 - RNA, 38 nt, Artificial Sequence
  Description of Artificial Sequence:  Enzymatic Nucleic Acid
  misc_feature (31)..(31): n stands for inosine
uuucaucacugaugaggccguuaggccgaanguaacuc

SEQ ID NO: 13715 - RNA, 38 nt, Artificial Sequence
  Description of Artificial Sequence:  Enzymatic Nucleic Acid
  misc_feature (31)..(31): n stands for inosine
uuuucauccugaugaggccguuaggccgaangguaacu

SEQ ID NO: 13716 - RNA, 38 nt, Artificial Sequence
  Description of Artificial Sequence:  Enzymatic Nucleic Acid
  misc_feature (31)..(31): n stands for inosine
cuuacggacugaugaggccguuaggccgaancucucuu

SEQ ID NO: 13717 - RNA, 38 nt, Artificial Sequence
  Description of Artificial Sequence:  Enzymatic Nucleic Acid
  misc_feature (31)..(31): n stands for inosine
cgccuuaccugaugaggccguuaggccgaanaagcucu

SEQ ID NO: 13718 - RNA, 38 nt, Artificial Sequence
  Description of Artificial Sequence:  Enzymatic Nucleic Acid
  misc_feature (31)..(31): n stands for inosine
auugcuuucugaugaggccguuaggccgaanucaauuc

SEQ ID NO: 13719 - RNA, 38 nt, Artificial Sequence
  Description of Artificial Sequence:  Enzymatic Nucleic Acid
  misc_feature (31)..(31): n stands for inosine
aauugcuucugaugaggccguuaggccgaangucaauu

SEQ ID NO: 13720 - RNA, 38 nt, Artificial Sequence
  Description of Artificial Sequence:  Enzymatic Nucleic Acid
  misc_feature (31)..(31): n stands for inosine
augggaaucugaugaggccguuaggccgaancuuuggu

SEQ ID NO: 13721 - RNA, 38 nt, Artificial Sequence
  Description of Artificial Sequence:  Enzymatic Nucleic Acid
  misc_feature (31)..(31): n stands for inosine
uuggcaugcugaugaggccguuaggccgaanaauugcu

SEQ ID NO: 13722 - RNA, 38 nt, Artificial Sequence
  Description of Artificial Sequence:  Enzymatic Nucleic Acid
  misc_feature (31)..(31): n stands for inosine
guuggcaucugaugaggccguuaggccgaangaauugc

SEQ ID NO: 13723 - RNA, 38 nt, Artificial Sequence
  Description of Artificial Sequence:  Enzymatic Nucleic Acid
  misc_feature (31)..(31): n stands for inosine
uguuggcacugaugaggccguuaggccgaanggaauug

SEQ ID NO: 13724 - RNA, 38 nt, Artificial Sequence
  Description of Artificial Sequence:  Enzymatic Nucleic Acid
  misc_feature (31)..(31): n stands for inosine
aauauguucugaugaggccguuaggccgaancauggga

SEQ ID NO: 13725 - RNA, 38 nt, Artificial Sequence
  Description of Artificial Sequence:  Enzymatic Nucleic Acid
  misc_feature (31)..(31): n stands for inosine
gaauaugucugaugaggccguuaggccgaangcauggg

SEQ ID NO: 13726 - RNA, 38 nt, Artificial Sequence
  Description of Artificial Sequence:  Enzymatic Nucleic Acid
  misc_feature (31)..(31): n stands for inosine
guagaauacugaugaggccguuaggccgaanuuggcau

SEQ ID NO: 13727 - RNA, 38 nt, Artificial Sequence
  Description of Artificial Sequence:  Enzymatic Nucleic Acid
  misc_feature (31)..(31): n stands for inosine
aacacugucugaugaggccguuaggccgaanaauaugu

SEQ ID NO: 13728 - RNA, 38 nt, Artificial Sequence
  Description of Artificial Sequence:  Enzymatic Nucleic Acid
  misc_feature (31)..(31): n stands for inosine
aagaacaccugaugaggccguuaggccgaanuagaaua

SEQ ID NO: 13729 - RNA, 38 nt, Artificial Sequence
  Description of Artificial Sequence:  Enzymatic Nucleic Acid
  misc_feature (31)..(31): n stands for inosine
caauaguacugaugaggccguuaggccgaanaacacug

SEQ ID NO: 13730 - RNA, 38 nt, Artificial Sequence
  Description of Artificial Sequence:  Enzymatic Nucleic Acid
  misc_feature (31)..(31): n stands for inosine
uugucaaucugaugaggccguuaggccgaanuaagaac

SEQ ID NO: 13731 - RNA, 38 nt, Artificial Sequence
  Description of Artificial Sequence:  Enzymatic Nucleic Acid
  misc_feature (31)..(31): n stands for inosine
cugcauuucugaugaggccguuaggccgaanucaauag

SEQ ID NO: 13732 - RNA, 38 nt, Artificial Sequence
  Description of Artificial Sequence:  Enzymatic Nucleic Acid
  misc_feature (31)..(31): n stands for inosine
cuuuguuccugaugaggccguuaggccgaancauuuug

SEQ ID NO: 13733 - RNA, 38 nt, Artificial Sequence
  Description of Artificial Sequence:  Enzymatic Nucleic Acid
  misc_feature (31)..(31): n stands for inosine
uuugucuucugaugaggccguuaggccgaanuucugca

SEQ ID NO: 13734 - RNA, 38 nt, Artificial Sequence
  Description of Artificial Sequence:  Enzymatic Nucleic Acid
  misc_feature (31)..(31): n stands for inosine
aaguccuucugaugaggccguuaggccgaanucuuugu

SEQ ID NO: 13735 - RNA, 38 nt, Artificial Sequence
  Description of Artificial Sequence:  Enzymatic Nucleic Acid
  misc_feature (31)..(31): n stands for inosine
aaguauaacugaugaggccguuaggccgaanuccuuug

SEQ ID NO: 13736 - RNA, 38 nt, Artificial Sequence
  Description of Artificial Sequence:  Enzymatic Nucleic Acid
  misc_feature (31)..(31): n stands for inosine
acacgacacugaugaggccguuaggccgaanuauaaag

SEQ ID NO: 13737 - RNA, 38 nt, Artificial Sequence
  Description of Artificial Sequence:  Enzymatic Nucleic Acid
  misc_feature (31)..(31): n stands for inosine
ugaaugaucugaugaggccguuaggccgaanuccacuc

SEQ ID NO: 13738 - RNA, 38 nt, Artificial Sequence
  Description of Artificial Sequence:  Enzymatic Nucleic Acid
  misc_feature (31)..(31): n stands for inosine
uugaaugacugaugaggccguuaggccgaanguccacu

SEQ ID NO: 13739 - RNA, 38 nt, Artificial Sequence
  Description of Artificial Sequence:  Enzymatic Nucleic Acid
  misc_feature (31)..(31): n stands for inosine
gauuugaacugaugaggccguuaggccgaanauggucc

SEQ ID NO: 13740 - RNA, 38 nt, Artificial Sequence
  Description of Artificial Sequence:  Enzymatic Nucleic Acid
  misc_feature (31)..(31): n stands for inosine
aacagauucugaugaggccguuaggccgaanaaugaug

SEQ ID NO: 13741 - RNA, 38 nt, Artificial Sequence
  Description of Artificial Sequence:  Enzymatic Nucleic Acid
  misc_feature (31)..(31): n stands for inosine
guguuaaccugaugaggccguuaggccgaanauuugaa

SEQ ID NO: 13742 - RNA, 38 nt, Artificial Sequence
  Description of Artificial Sequence:  Enzymatic Nucleic Acid
  misc_feature (31)..(31): n stands for inosine
cacugaggcugaugaggccguuaggccgaanuuaacag

SEQ ID NO: 13743 - RNA, 38 nt, Artificial Sequence
  Description of Artificial Sequence:  Enzymatic Nucleic Acid
  misc_feature (31)..(31): n stands for inosine
ugcacugacugaugaggccguuaggccgaanuguuaac

SEQ ID NO: 13744 - RNA, 38 nt, Artificial Sequence
  Description of Artificial Sequence:  Enzymatic Nucleic Acid
  misc_feature (31)..(31): n stands for inosine
augcacugcugaugaggccguuaggccgaanguguuaa

SEQ ID NO: 13745 - RNA, 38 nt, Artificial Sequence
  Description of Artificial Sequence:  Enzymatic Nucleic Acid
  misc_feature (31)..(31): n stands for inosine
auaugcaccugaugaggccguuaggccgaanagguguu

SEQ ID NO: 13746 - RNA, 38 nt, Artificial Sequence
  Description of Artificial Sequence:  Enzymatic Nucleic Acid
  misc_feature (31)..(31): n stands for inosine
cauauauacugaugaggccguuaggccgaancacugag

SEQ ID NO: 13747 - RNA, 38 nt, Artificial Sequence
  Description of Artificial Sequence:  Enzymatic Nucleic Acid
  misc_feature (31)..(31): n stands for inosine
gugaugaacugaugaggccguuaggccgaancuuuauc

SEQ ID NO: 13748 - RNA, 38 nt, Artificial Sequence
  Description of Artificial Sequence:  Enzymatic Nucleic Acid
  misc_feature (31)..(31): n stands for inosine
cacagugacugaugaggccguuaggccgaanaaugcuu

SEQ ID NO: 13749 - RNA, 38 nt, Artificial Sequence
  Description of Artificial Sequence:  Enzymatic Nucleic Acid
  misc_feature (31)..(31): n stands for inosine
uuucacagcugaugaggccguuaggccgaanaugaaug

SEQ ID NO: 13750 - RNA, 38 nt, Artificial Sequence
  Description of Artificial Sequence:  Enzymatic Nucleic Acid
  misc_feature (31)..(31): n stands for inosine
uguuucaccugaugaggccguuaggccgaanugaugaa

SEQ ID NO: 13751 - RNA, 38 nt, Artificial Sequence
  Description of Artificial Sequence:  Enzymatic Nucleic Acid
  misc_feature (31)..(31): n stands for inosine
guuuucgacugaugaggccguuaggccgaanuuucaca

SEQ ID NO: 13752 - RNA, 38 nt, Artificial Sequence
  Description of Artificial Sequence:  Enzymatic Nucleic Acid
  misc_feature (31)..(31): n stands for inosine
gcaccugccugaugaggccguuaggccgaanuuuucga

SEQ ID NO: 13753 - RNA, 38 nt, Artificial Sequence
  Description of Artificial Sequence:  Enzymatic Nucleic Acid
  misc_feature (31)..(31): n stands for inosine
caagcacccugaugaggccguuaggccgaancuguuuu

SEQ ID NO: 13754 - RNA, 38 nt, Artificial Sequence
  Description of Artificial Sequence:  Enzymatic Nucleic Acid
  misc_feature (31)..(31): n stands for inosine
cgguuucacugaugaggccguuaggccgaancaccugc

SEQ ID NO: 13755 - RNA, 38 nt, Artificial Sequence
  Description of Artificial Sequence:  Enzymatic Nucleic Acid
  misc_feature (31)..(31): n stands for inosine
ccagcuaccugaugaggccguuaggccgaanuuucaag

SEQ ID NO: 13756 - RNA, 38 nt, Artificial Sequence
  Description of Artificial Sequence:  Enzymatic Nucleic Acid
  misc_feature (31)..(31): n stands for inosine
cgcuugcccugaugaggccguuaggccgaancuacggu

SEQ ID NO: 13757 - RNA, 38 nt, Artificial Sequence
  Description of Artificial Sequence:  Enzymatic Nucleic Acid
  misc_feature (31)..(31): n stands for inosine
agaccgcucugaugaggccguuaggccgaanccagcua

SEQ ID NO: 13758 - RNA, 38 nt, Artificial Sequence
  Description of Artificial Sequence:  Enzymatic Nucleic Acid
  misc_feature (31)..(31): n stands for inosine
agccgguacugaugaggccguuaggccgaanaccgcuu

SEQ ID NO: 13759 - RNA, 38 nt, Artificial Sequence
  Description of Artificial Sequence:  Enzymatic Nucleic Acid
  misc_feature (31)..(31): n stands for inosine
agagagcccugaugaggccguuaggccgaanuaagacc

SEQ ID NO: 13760 - RNA, 38 nt, Artificial Sequence
  Description of Artificial Sequence:  Enzymatic Nucleic Acid
  misc_feature (31)..(31): n stands for inosine
ucauagagcugaugaggccguuaggccgaanccgguaa

SEQ ID NO: 13761 - RNA, 38 nt, Artificial Sequence
  Description of Artificial Sequence:  Enzymatic Nucleic Acid
  misc_feature (31)..(31): n stands for inosine
uuucauagcugaugaggccguuaggccgaanagccggu

SEQ ID NO: 13762 - RNA, 38 nt, Artificial Sequence
  Description of Artificial Sequence:  Enzymatic Nucleic Acid
  misc_feature (31)..(31): n stands for inosine
acuuucaucugaugaggccguuaggccgaanagagccg

SEQ ID NO: 13763 - RNA, 38 nt, Artificial Sequence
  Description of Artificial Sequence:  Enzymatic Nucleic Acid
  misc_feature (31)..(31): n stands for inosine
gagggaaacugaugaggccguuaggccgaanccuucac

SEQ ID NO: 13764 - RNA, 38 nt, Artificial Sequence
  Description of Artificial Sequence:  Enzymatic Nucleic Acid
  misc_feature (31)..(31): n stands for inosine
ccggcgagcugaugaggccguuaggccgaanaaaugcc

SEQ ID NO: 13765 - RNA, 38 nt, Artificial Sequence
  Description of Artificial Sequence:  Enzymatic Nucleic Acid
  misc_feature (31)..(31): n stands for inosine
uccggcgacugaugaggccguuaggccgaangaaaugc

SEQ ID NO: 13766 - RNA, 38 nt, Artificial Sequence
  Description of Artificial Sequence:  Enzymatic Nucleic Acid
  misc_feature (31)..(31): n stands for inosine
uuccggcgcugaugaggccguuaggccgaanggaaaug

SEQ ID NO: 13767 - RNA, 38 nt, Artificial Sequence
  Description of Artificial Sequence:  Enzymatic Nucleic Acid
  misc_feature (31)..(31): n stands for inosine
caacuucccugaugaggccguuaggccgaancgaggga

SEQ ID NO: 13768 - RNA, 38 nt, Artificial Sequence
  Description of Artificial Sequence:  Enzymatic Nucleic Acid
  misc_feature (31)..(31): n stands for inosine
cagucgcacugaugaggccguuaggccgaanuaaccca

SEQ ID NO: 13769 - RNA, 38 nt, Artificial Sequence
  Description of Artificial Sequence:  Enzymatic Nucleic Acid
  misc_feature (31)..(31): n stands for inosine
ucagucgccugaugaggccguuaggccgaanguaaccc

SEQ ID NO: 13770 - RNA, 38 nt, Artificial Sequence
  Description of Artificial Sequence:  Enzymatic Nucleic Acid
  misc_feature (31)..(31): n stands for inosine
gauuucuccugaugaggccguuaggccgaanucgcagg

SEQ ID NO: 13771 - RNA, 38 nt, Artificial Sequence
  Description of Artificial Sequence:  Enzymatic Nucleic Acid
  misc_feature (31)..(31): n stands for inosine
uagcgagccugaugaggccguuaggccgaanauuucuc

SEQ ID NO: 13772 - RNA, 38 nt, Artificial Sequence
  Description of Artificial Sequence:  Enzymatic Nucleic Acid
  misc_feature (31)..(31): n stands for inosine
aaauagcgcugaugaggccguuaggccgaancagauuu

SEQ ID NO: 13773 - RNA, 38 nt, Artificial Sequence
  Description of Artificial Sequence:  Enzymatic Nucleic Acid
  misc_feature (31)..(31): n stands for inosine
agucaaaucugaugaggccguuaggccgaancgagcag

SEQ ID NO: 13774 - RNA, 38 nt, Artificial Sequence
  Description of Artificial Sequence:  Enzymatic Nucleic Acid
  misc_feature (31)..(31): n stands for inosine
uagccacgcugaugaggccguuaggccgaanucaaaua

SEQ ID NO: 13775 - RNA, 38 nt, Artificial Sequence
  Description of Artificial Sequence:  Enzymatic Nucleic Acid
  misc_feature (31)..(31): n stands for inosine
uaacgagucugaugaggccguuaggccgaanccacgag

SEQ ID NO: 13776 - RNA, 38 nt, Artificial Sequence
  Description of Artificial Sequence:  Enzymatic Nucleic Acid
  misc_feature (31)..(31): n stands for inosine
aauuaacgcugaugaggccguuaggccgaanuagccac

SEQ ID NO: 13777 - RNA, 38 nt, Artificial Sequence
  Description of Artificial Sequence:  Enzymatic Nucleic Acid
  misc_feature (31)..(31): n stands for inosine
uacguccucugaugaggccguuaggccgaanauaauua

SEQ ID NO: 13778 - RNA, 38 nt, Artificial Sequence
  Description of Artificial Sequence:  Enzymatic Nucleic Acid
  misc_feature (31)..(31): n stands for inosine
uccucuuccugaugaggccguuaggccgaanuuacguc

SEQ ID NO: 13779 - RNA, 38 nt, Artificial Sequence
  Description of Artificial Sequence:  Enzymatic Nucleic Acid
  misc_feature (31)..(31): n stands for inosine
uaauuccccugaugaggccguuaggccgaancauccuc

SEQ ID NO: 13780 - RNA, 38 nt, Artificial Sequence
  Description of Artificial Sequence:  Enzymatic Nucleic Acid
  misc_feature (31)..(31): n stands for inosine
agcaagaucugaugaggccguuaggccgaanuauaauu

SEQ ID NO: 13781 - RNA, 38 nt, Artificial Sequence
  Description of Artificial Sequence:  Enzymatic Nucleic Acid
  misc_feature (31)..(31): n stands for inosine
gcucagcacugaugaggccguuaggccgaanauuguau

SEQ ID NO: 13782 - RNA, 38 nt, Artificial Sequence
  Description of Artificial Sequence:  Enzymatic Nucleic Acid
  misc_feature (31)..(31): n stands for inosine
uuaugcuccugaugaggccguuaggccgaancaagauu

SEQ ID NO: 13783 - RNA, 38 nt, Artificial Sequence
  Description of Artificial Sequence:  Enzymatic Nucleic Acid
  misc_feature (31)..(31): n stands for inosine
cuguuuuacugaugaggccguuaggccgaancucagca

SEQ ID NO: 13784 - RNA, 38 nt, Artificial Sequence
  Description of Artificial Sequence:  Enzymatic Nucleic Acid
  misc_feature (31)..(31): n stands for inosine
cauuugaccugaugaggccguuaggccgaanuuuuaug

SEQ ID NO: 13785 - RNA, 38 nt, Artificial Sequence
  Description of Artificial Sequence:  Enzymatic Nucleic Acid
  misc_feature (31)..(31): n stands for inosine
aacacauucugaugaggccguuaggccgaanacuguuu

SEQ ID NO: 13786 - RNA, 38 nt, Artificial Sequence
  Description of Artificial Sequence:  Enzymatic Nucleic Acid
  misc_feature (31)..(31): n stands for inosine
ggcagugacugaugaggccguuaggccgaanuuuuuaa

SEQ ID NO: 13787 - RNA, 38 nt, Artificial Sequence
  Description of Artificial Sequence:  Enzymatic Nucleic Acid
  misc_feature (31)..(31): n stands for inosine
uggcagugcugaugaggccguuaggccgaanguuuuua

SEQ ID NO: 13788 - RNA, 38 nt, Artificial Sequence
  Description of Artificial Sequence:  Enzymatic Nucleic Acid
  misc_feature (31)..(31): n stands for inosine
aguggcagcugaugaggccguuaggccgaanagguuuu

SEQ ID NO: 13789 - RNA, 38 nt, Artificial Sequence
  Description of Artificial Sequence:  Enzymatic Nucleic Acid
  misc_feature (31)..(31): n stands for inosine
agaguggccugaugaggccguuaggccgaanugagguu

SEQ ID NO: 13790 - RNA, 38 nt, Artificial Sequence
  Description of Artificial Sequence:  Enzymatic Nucleic Acid
  misc_feature (31)..(31): n stands for inosine
auuagagucugaugaggccguuaggccgaancagugag

SEQ ID NO: 13791 - RNA, 38 nt, Artificial Sequence
  Description of Artificial Sequence:  Enzymatic Nucleic Acid
  misc_feature (31)..(31): n stands for inosine
aauuagagcugaugaggccguuaggccgaangcaguga

SEQ ID NO: 13792 - RNA, 38 nt, Artificial Sequence
  Description of Artificial Sequence:  Enzymatic Nucleic Acid
  misc_feature (31)..(31): n stands for inosine
acaauuagcugaugaggccguuaggccgaanuggcagu

SEQ ID NO: 13793 - RNA, 38 nt, Artificial Sequence
  Description of Artificial Sequence:  Enzymatic Nucleic Acid
  misc_feature (31)..(31): n stands for inosine
ugacaauucugaugaggccguuaggccgaanaguggca

SEQ ID NO: 13794 - RNA, 38 nt, Artificial Sequence
  Description of Artificial Sequence:  Enzymatic Nucleic Acid
  misc_feature (31)..(31): n stands for inosine
uuucacaucugaugaggccguuaggccgaanacaauua

SEQ ID NO: 13795 - RNA, 38 nt, Artificial Sequence
  Description of Artificial Sequence:  Enzymatic Nucleic Acid
  misc_feature (31)..(31): n stands for inosine
aaaucuggcugaugaggccguuaggccgaanuuucaca

SEQ ID NO: 13796 - RNA, 38 nt, Artificial Sequence
  Description of Artificial Sequence:  Enzymatic Nucleic Acid
  misc_feature (31)..(31): n stands for inosine
uaaaucugcugaugaggccguuaggccgaanguuucac

SEQ ID NO: 13797 - RNA, 38 nt, Artificial Sequence
  Description of Artificial Sequence:  Enzymatic Nucleic Acid
  misc_feature (31)..(31): n stands for inosine
guaaaucucugaugaggccguuaggccgaangguuuca

SEQ ID NO: 13798 - RNA, 38 nt, Artificial Sequence
  Description of Artificial Sequence:  Enzymatic Nucleic Acid
  misc_feature (31)..(31): n stands for inosine
cguaaauccugaugaggccguuaggccgaanggguuuc

SEQ ID NO: 13799 - RNA, 38 nt, Artificial Sequence
  Description of Artificial Sequence:  Enzymatic Nucleic Acid
  misc_feature (31)..(31): n stands for inosine
gaugacaccugaugaggccguuaggccgaanccuuuuc

SEQ ID NO: 13800 - RNA, 38 nt, Artificial Sequence
  Description of Artificial Sequence:  Enzymatic Nucleic Acid
  misc_feature (31)..(31): n stands for inosine
ggaaacgacugaugaggccguuaggccgaanacacggc

SEQ ID NO: 13801 - RNA, 38 nt, Artificial Sequence
  Description of Artificial Sequence:  Enzymatic Nucleic Acid
  misc_feature (31)..(31): n stands for inosine
ccgggucucugaugaggccguuaggccgaanaaacgau

SEQ ID NO: 13802 - RNA, 38 nt, Artificial Sequence
  Description of Artificial Sequence:  Enzymatic Nucleic Acid
  misc_feature (31)..(31): n stands for inosine
gccggguccugaugaggccguuaggccgaangaaacga

SEQ ID NO: 13803 - RNA, 38 nt, Artificial Sequence
  Description of Artificial Sequence:  Enzymatic Nucleic Acid
  misc_feature (31)..(31): n stands for inosine
gagagccgcugaugaggccguuaggccgaanucuggaa

SEQ ID NO: 13804 - RNA, 38 nt, Artificial Sequence
  Description of Artificial Sequence:  Enzymatic Nucleic Acid
  misc_feature (31)..(31): n stands for inosine
agagagcccugaugaggccguuaggccgaangucugga

SEQ ID NO: 13805 - RNA, 38 nt, Artificial Sequence
  Description of Artificial Sequence:  Enzymatic Nucleic Acid
  misc_feature (31)..(31): n stands for inosine
ggguagagcugaugaggccguuaggccgaanccggguc

SEQ ID NO: 13806 - RNA, 38 nt, Artificial Sequence
  Description of Artificial Sequence:  Enzymatic Nucleic Acid
  misc_feature (31)..(31): n stands for inosine
guggguagcugaugaggccguuaggccgaanagccggg

SEQ ID NO: 13807 - RNA, 38 nt, Artificial Sequence
  Description of Artificial Sequence:  Enzymatic Nucleic Acid
  misc_feature (31)..(31): n stands for inosine
cagugggucugaugaggccguuaggccgaanagagccg

SEQ ID NO: 13808 - RNA, 38 nt, Artificial Sequence
  Description of Artificial Sequence:  Enzymatic Nucleic Acid
  misc_feature (31)..(31): n stands for inosine
gcccagugcugaugaggccguuaggccgaanuagagag

SEQ ID NO: 13809 - RNA, 38 nt, Artificial Sequence
  Description of Artificial Sequence:  Enzymatic Nucleic Acid
  misc_feature (31)..(31): n stands for inosine
ugcccagucugaugaggccguuaggccgaanguagaga

SEQ ID NO: 13810 - RNA, 38 nt, Artificial Sequence
  Description of Artificial Sequence:  Enzymatic Nucleic Acid
  misc_feature (31)..(31): n stands for inosine
cugcccagcugaugaggccguuaggccgaangguagag

SEQ ID NO: 13811 - RNA, 38 nt, Artificial Sequence
  Description of Artificial Sequence:  Enzymatic Nucleic Acid
  misc_feature (31)..(31): n stands for inosine
ugcugccccugaugaggccguuaggccgaanuggguag

SEQ ID NO: 13812 - RNA, 38 nt, Artificial Sequence
  Description of Artificial Sequence:  Enzymatic Nucleic Acid
  misc_feature (31)..(31): n stands for inosine
uugucugccugaugaggccguuaggccgaancccagug

SEQ ID NO: 13813 - RNA, 38 nt, Artificial Sequence
  Description of Artificial Sequence:  Enzymatic Nucleic Acid
  misc_feature (31)..(31): n stands for inosine
gauuuguccugaugaggccguuaggccgaancugccca

SEQ ID NO: 13814 - RNA, 38 nt, Artificial Sequence
  Description of Artificial Sequence:  Enzymatic Nucleic Acid
  misc_feature (31)..(31): n stands for inosine
ucaggauucugaugaggccguuaggccgaanucugcug

SEQ ID NO: 13815 - RNA, 38 nt, Artificial Sequence
  Description of Artificial Sequence:  Enzymatic Nucleic Acid
  misc_feature (31)..(31): n stands for inosine
acaagucacugaugaggccguuaggccgaanauuuguc

SEQ ID NO: 13816 - RNA, 38 nt, Artificial Sequence
  Description of Artificial Sequence:  Enzymatic Nucleic Acid
  misc_feature (31)..(31): n stands for inosine
uacaaguccugaugaggccguuaggccgaangauuugu

SEQ ID NO: 13817 - RNA, 38 nt, Artificial Sequence
  Description of Artificial Sequence:  Enzymatic Nucleic Acid
  misc_feature (31)..(31): n stands for inosine
gcgguacacugaugaggccguuaggccgaanucaggau

SEQ ID NO: 13818 - RNA, 38 nt, Artificial Sequence
  Description of Artificial Sequence:  Enzymatic Nucleic Acid
  misc_feature (31)..(31): n stands for inosine
ccauaugccugaugaggccguuaggccgaanuacaagu

SEQ ID NO: 13819 - RNA, 38 nt, Artificial Sequence
  Description of Artificial Sequence:  Enzymatic Nucleic Acid
  misc_feature (31)..(31): n stands for inosine
auaccauacugaugaggccguuaggccgaancgguaca

SEQ ID NO: 13820 - RNA, 38 nt, Artificial Sequence
  Description of Artificial Sequence:  Enzymatic Nucleic Acid
  misc_feature (31)..(31): n stands for inosine
agguugagcugaugaggccguuaggccgaanauaccau

SEQ ID NO: 13821 - RNA, 38 nt, Artificial Sequence
  Description of Artificial Sequence:  Enzymatic Nucleic Acid
  misc_feature (31)..(31): n stands for inosine
uagguugacugaugaggccguuaggccgaangauacca

SEQ ID NO: 13822 - RNA, 38 nt, Artificial Sequence
  Description of Artificial Sequence:  Enzymatic Nucleic Acid
  misc_feature (31)..(31): n stands for inosine
guagguugcugaugaggccguuaggccgaanggauacc

SEQ ID NO: 13823 - RNA, 38 nt, Artificial Sequence
  Description of Artificial Sequence:  Enzymatic Nucleic Acid
  misc_feature (31)..(31): n stands for inosine
uuguaggucugaugaggccguuaggccgaanagggaua

SEQ ID NO: 13824 - RNA, 38 nt, Artificial Sequence
  Description of Artificial Sequence:  Enzymatic Nucleic Acid
  misc_feature (31)..(31): n stands for inosine
ugauuguacugaugaggccguuaggccgaanuugaggg

SEQ ID NO: 13825 - RNA, 38 nt, Artificial Sequence
  Description of Artificial Sequence:  Enzymatic Nucleic Acid
  misc_feature (31)..(31): n stands for inosine
uugauugucugaugaggccguuaggccgaanguugagg

SEQ ID NO: 13826 - RNA, 38 nt, Artificial Sequence
  Description of Artificial Sequence:  Enzymatic Nucleic Acid
  misc_feature (31)..(31): n stands for inosine
cacuugaucugaugaggccguuaggccgaanuagguug

SEQ ID NO: 13827 - RNA, 38 nt, Artificial Sequence
  Description of Artificial Sequence:  Enzymatic Nucleic Acid
  misc_feature (31)..(31): n stands for inosine
gaaccacucugaugaggccguuaggccgaanauuguag

SEQ ID NO: 13828 - RNA, 38 nt, Artificial Sequence
  Description of Artificial Sequence:  Enzymatic Nucleic Acid
  misc_feature (31)..(31): n stands for inosine
ggggugcccugaugaggccguuaggccgaanaaccacu

SEQ ID NO: 13829 - RNA, 38 nt, Artificial Sequence
  Description of Artificial Sequence:  Enzymatic Nucleic Acid
  misc_feature (31)..(31): n stands for inosine
uacaggggcugaugaggccguuaggccgaanccagaac

SEQ ID NO: 13830 - RNA, 38 nt, Artificial Sequence
  Description of Artificial Sequence:  Enzymatic Nucleic Acid
  misc_feature (31)..(31): n stands for inosine
guuacaggcugaugaggccguuaggccgaanugccaga

SEQ ID NO: 13831 - RNA, 38 nt, Artificial Sequence
  Description of Artificial Sequence:  Enzymatic Nucleic Acid
  misc_feature (31)..(31): n stands for inosine
gguuacagcugaugaggccguuaggccgaangugccag

SEQ ID NO: 13832 - RNA, 38 nt, Artificial Sequence
  Description of Artificial Sequence:  Enzymatic Nucleic Acid
  misc_feature (31)..(31): n stands for inosine
ugguuacacugaugaggccguuaggccgaanggugcca

SEQ ID NO: 13833 - RNA, 38 nt, Artificial Sequence
  Description of Artificial Sequence:  Enzymatic Nucleic Acid
  misc_feature (31)..(31): n stands for inosine
augguuaccugaugaggccguuaggccgaangggugcc

SEQ ID NO: 13834 - RNA, 38 nt, Artificial Sequence
  Description of Artificial Sequence:  Enzymatic Nucleic Acid
  misc_feature (31)..(31): n stands for inosine
augauuaucugaugaggccguuaggccgaanuuacagg

SEQ ID NO: 13835 - RNA, 38 nt, Artificial Sequence
  Description of Artificial Sequence:  Enzymatic Nucleic Acid
  misc_feature (31)..(31): n stands for inosine
aaugauuacugaugaggccguuaggccgaanguuacag

SEQ ID NO: 13836 - RNA, 38 nt, Artificial Sequence
  Description of Artificial Sequence:  Enzymatic Nucleic Acid
  misc_feature (31)..(31): n stands for inosine
cuucggaacugaugaggccguuaggccgaanauuaugg

SEQ ID NO: 13837 - RNA, 38 nt, Artificial Sequence
  Description of Artificial Sequence:  Enzymatic Nucleic Acid
  misc_feature (31)..(31): n stands for inosine
cuugcuuccugaugaggccguuaggccgaanaaugauu

SEQ ID NO: 13838 - RNA, 38 nt, Artificial Sequence
  Description of Artificial Sequence:  Enzymatic Nucleic Acid
  misc_feature (31)..(31): n stands for inosine
ucacaccucugaugaggccguuaggccgaancuucgga

SEQ ID NO: 13839 - RNA, 38 nt, Artificial Sequence
  Description of Artificial Sequence:  Enzymatic Nucleic Acid
  misc_feature (31)..(31): n stands for inosine
ggaacaaacugaugaggccguuaggccgaanucacacc

SEQ ID NO: 13840 - RNA, 38 nt, Artificial Sequence
  Description of Artificial Sequence:  Enzymatic Nucleic Acid
  misc_feature (31)..(31): n stands for inosine
ucauuauucugaugaggccguuaggccgaanaacaaaa

SEQ ID NO: 13841 - RNA, 38 nt, Artificial Sequence
  Description of Artificial Sequence:  Enzymatic Nucleic Acid
  misc_feature (31)..(31): n stands for inosine
uucauuaucugaugaggccguuaggccgaangaacaaa

SEQ ID NO: 13842 - RNA, 38 nt, Artificial Sequence
  Description of Artificial Sequence:  Enzymatic Nucleic Acid
  misc_feature (31)..(31): n stands for inosine
aggauaaacugaugaggccguuaggccgaanacucuuc

SEQ ID NO: 13843 - RNA, 38 nt, Artificial Sequence
  Description of Artificial Sequence:  Enzymatic Nucleic Acid
  misc_feature (31)..(31): n stands for inosine
caggauaacugaugaggccguuaggccgaangacucuu

SEQ ID NO: 13844 - RNA, 38 nt, Artificial Sequence
  Description of Artificial Sequence:  Enzymatic Nucleic Acid
  misc_feature (31)..(31): n stands for inosine
agcauccacugaugaggccguuaggccgaanauaaagg

SEQ ID NO: 13845 - RNA, 38 nt, Artificial Sequence
  Description of Artificial Sequence:  Enzymatic Nucleic Acid
  misc_feature (31)..(31): n stands for inosine
cagcaucccugaugaggccguuaggccgaangauaaag

SEQ ID NO: 13846 - RNA, 38 nt, Artificial Sequence
  Description of Artificial Sequence:  Enzymatic Nucleic Acid
  misc_feature (31)..(31): n stands for inosine
uugcuguccugaugaggccguuaggccgaancauccag

SEQ ID NO: 13847 - RNA, 38 nt, Artificial Sequence
  Description of Artificial Sequence:  Enzymatic Nucleic Acid
  misc_feature (31)..(31): n stands for inosine
cauguugccugaugaggccguuaggccgaanucagcau

SEQ ID NO: 13848 - RNA, 38 nt, Artificial Sequence
  Description of Artificial Sequence:  Enzymatic Nucleic Acid
  misc_feature (31)..(31): n stands for inosine
ucccaugucugaugaggccguuaggccgaancugucag

SEQ ID NO: 13849 - RNA, 38 nt, Artificial Sequence
  Description of Artificial Sequence:  Enzymatic Nucleic Acid
  misc_feature (31)..(31): n stands for inosine
guuucccacugaugaggccguuaggccgaanuugcugu

SEQ ID NO: 13850 - RNA, 38 nt, Artificial Sequence
  Description of Artificial Sequence:  Enzymatic Nucleic Acid
  misc_feature (31)..(31): n stands for inosine
cucaauuccugaugaggccguuaggccgaanuuuccca

SEQ ID NO: 13851 - RNA, 38 nt, Artificial Sequence
  Description of Artificial Sequence:  Enzymatic Nucleic Acid
  misc_feature (31)..(31): n stands for inosine
cugagugacugaugaggccguuaggccgaancucucaa

SEQ ID NO: 13852 - RNA, 38 nt, Artificial Sequence
  Description of Artificial Sequence:  Enzymatic Nucleic Acid
  misc_feature (31)..(31): n stands for inosine
gcgcugagcugaugaggccguuaggccgaanaugcucu

SEQ ID NO: 13853 - RNA, 38 nt, Artificial Sequence
  Description of Artificial Sequence:  Enzymatic Nucleic Acid
  misc_feature (31)..(31): n stands for inosine
augcgcugcugaugaggccguuaggccgaanugaugcu

SEQ ID NO: 13854 - RNA, 38 nt, Artificial Sequence
  Description of Artificial Sequence:  Enzymatic Nucleic Acid
  misc_feature (31)..(31): n stands for inosine
ccaugcgccugaugaggccguuaggccgaanagugaug

SEQ ID NO: 13855 - RNA, 38 nt, Artificial Sequence
  Description of Artificial Sequence:  Enzymatic Nucleic Acid
  misc_feature (31)..(31): n stands for inosine
uauugccacugaugaggccguuaggccgaancgcugag

SEQ ID NO: 13856 - RNA, 38 nt, Artificial Sequence
  Description of Artificial Sequence:  Enzymatic Nucleic Acid
  misc_feature (31)..(31): n stands for inosine
ucuauuaucugaugaggccguuaggccgaanccaugcg

SEQ ID NO: 13857 - RNA, 38 nt, Artificial Sequence
  Description of Artificial Sequence:  Enzymatic Nucleic Acid
  misc_feature (31)..(31): n stands for inosine
aaggugcucugaugaggccguuaggccgaanccaucuu

SEQ ID NO: 13858 - RNA, 38 nt, Artificial Sequence
  Description of Artificial Sequence:  Enzymatic Nucleic Acid
  misc_feature (31)..(31): n stands for inosine
aaccaaggcugaugaggccguuaggccgaancuagcca

SEQ ID NO: 13859 - RNA, 38 nt, Artificial Sequence
  Description of Artificial Sequence:  Enzymatic Nucleic Acid
  misc_feature (31)..(31): n stands for inosine
acaaccaacugaugaggccguuaggccgaanugcuagc

SEQ ID NO: 13860 - RNA, 38 nt, Artificial Sequence
  Description of Artificial Sequence:  Enzymatic Nucleic Acid
  misc_feature (31)..(31): n stands for inosine
cacaaccacugaugaggccguuaggccgaangugcuag

SEQ ID NO: 13861 - RNA, 38 nt, Artificial Sequence
  Description of Artificial Sequence:  Enzymatic Nucleic Acid
  misc_feature (31)..(31): n stands for inosine
cuagaguccugaugaggccguuaggccgaanccacaac

SEQ ID NO: 13862 - RNA, 38 nt, Artificial Sequence
  Description of Artificial Sequence:  Enzymatic Nucleic Acid
  misc_feature (31)..(31): n stands for inosine
aauucuagcugaugaggccguuaggccgaanucagcca

SEQ ID NO: 13863 - RNA, 38 nt, Artificial Sequence
  Description of Artificial Sequence:  Enzymatic Nucleic Acid
  misc_feature (31)..(31): n stands for inosine
gaaauucucugaugaggccguuaggccgaanagucagc

SEQ ID NO: 13864 - RNA, 38 nt, Artificial Sequence
  Description of Artificial Sequence:  Enzymatic Nucleic Acid
  misc_feature (31)..(31): n stands for inosine
uagauucccugaugaggccguuaggccgaanaaauucu

SEQ ID NO: 13865 - RNA, 38 nt, Artificial Sequence
  Description of Artificial Sequence:  Enzymatic Nucleic Acid
  misc_feature (31)..(31): n stands for inosine
gcaaaugucugaugaggccguuaggccgaanauuccag

SEQ ID NO: 13866 - RNA, 38 nt, Artificial Sequence
  Description of Artificial Sequence:  Enzymatic Nucleic Acid
  misc_feature (31)..(31): n stands for inosine
uaugcaaacugaugaggccguuaggccgaanuagauuc

SEQ ID NO: 13867 - RNA, 38 nt, Artificial Sequence
  Description of Artificial Sequence:  Enzymatic Nucleic Acid
  misc_feature (31)..(31): n stands for inosine
ggaagcuacugaugaggccguuaggccgaancaaaugu

SEQ ID NO: 13868 - RNA, 38 nt, Artificial Sequence
  Description of Artificial Sequence:  Enzymatic Nucleic Acid
  misc_feature (31)..(31): n stands for inosine
uuauuggacugaugaggccguuaggccgaancuaugca

SEQ ID NO: 13869 - RNA, 38 nt, Artificial Sequence
  Description of Artificial Sequence:  Enzymatic Nucleic Acid
  misc_feature (31)..(31): n stands for inosine
acuuuauucugaugaggccguuaggccgaanaagcuau

SEQ ID NO: 13870 - RNA, 38 nt, Artificial Sequence
  Description of Artificial Sequence:  Enzymatic Nucleic Acid
  misc_feature (31)..(31): n stands for inosine
aacuuuaucugaugaggccguuaggccgaangaagcua

SEQ ID NO: 13871 - RNA, 38 nt, Artificial Sequence
  Description of Artificial Sequence:  Enzymatic Nucleic Acid
  misc_feature (31)..(31): n stands for inosine
cuucccaccugaugaggccguuaggccgaanucccaac

SEQ ID NO: 13872 - RNA, 38 nt, Artificial Sequence
  Description of Artificial Sequence:  Enzymatic Nucleic Acid
  misc_feature (31)..(31): n stands for inosine
aaagcuuacugaugaggccguuaggccgaanuuucuuc

SEQ ID NO: 13873 - RNA, 38 nt, Artificial Sequence
  Description of Artificial Sequence:  Enzymatic Nucleic Acid
  misc_feature (31)..(31): n stands for inosine
gauauaaacugaugaggccguuaggccgaancuuaugu

SEQ ID NO: 13874 - RNA, 38 nt, Artificial Sequence
  Description of Artificial Sequence:  Enzymatic Nucleic Acid
  misc_feature (31)..(31): n stands for inosine
cacaucugcugaugaggccguuaggccgaanauauaaa

SEQ ID NO: 13875 - RNA, 38 nt, Artificial Sequence
  Description of Artificial Sequence:  Enzymatic Nucleic Acid
  misc_feature (31)..(31): n stands for inosine
ggcacauccugaugaggccguuaggccgaanugauaua

SEQ ID NO: 13876 - RNA, 38 nt, Artificial Sequence
  Description of Artificial Sequence:  Enzymatic Nucleic Acid
  misc_feature (31)..(31): n stands for inosine
acccauuucugaugaggccguuaggccgaancacaucu

SEQ ID NO: 13877 - RNA, 38 nt, Artificial Sequence
  Description of Artificial Sequence:  Enzymatic Nucleic Acid
  misc_feature (31)..(31): n stands for inosine
aacccauucugaugaggccguuaggccgaangcacauc

SEQ ID NO: 13878 - RNA, 38 nt, Artificial Sequence
  Description of Artificial Sequence:  Enzymatic Nucleic Acid
  misc_feature (31)..(31): n stands for inosine
aguuaacacugaugaggccguuaggccgaanaaaccca

SEQ ID NO: 13879 - RNA, 38 nt, Artificial Sequence
  Description of Artificial Sequence:  Enzymatic Nucleic Acid
  misc_feature (31)..(31): n stands for inosine
uuuuuccacugaugaggccguuaggccgaanuuaacau

SEQ ID NO: 13880 - RNA, 38 nt, Artificial Sequence
  Description of Artificial Sequence:  Enzymatic Nucleic Acid
  misc_feature (31)..(31): n stands for inosine
cuuccguccugaugaggccguuaggccgaancauuuuu

SEQ ID NO: 13881 - RNA, 38 nt, Artificial Sequence
  Description of Artificial Sequence:  Enzymatic Nucleic Acid
  misc_feature (31)..(31): n stands for inosine
caguuucacugaugaggccguuaggccgaanuccucuc

SEQ ID NO: 13882 - RNA, 38 nt, Artificial Sequence
  Description of Artificial Sequence:  Enzymatic Nucleic Acid
  misc_feature (31)..(31): n stands for inosine
acaguuuccugaugaggccguuaggccgaanguccucu

SEQ ID NO: 13883 - RNA, 38 nt, Artificial Sequence
  Description of Artificial Sequence:  Enzymatic Nucleic Acid
  misc_feature (31)..(31): n stands for inosine
ugcaagaccugaugaggccguuaggccgaanuuucagg

SEQ ID NO: 13884 - RNA, 38 nt, Artificial Sequence
  Description of Artificial Sequence:  Enzymatic Nucleic Acid
  misc_feature (31)..(31): n stands for inosine
acugugcacugaugaggccguuaggccgaanacaguuu

SEQ ID NO: 13885 - RNA, 38 nt, Artificial Sequence
  Description of Artificial Sequence:  Enzymatic Nucleic Acid
  misc_feature (31)..(31): n stands for inosine
guuaacugcugaugaggccguuaggccgaancaagaca

SEQ ID NO: 13886 - RNA, 38 nt, Artificial Sequence
  Description of Artificial Sequence:  Enzymatic Nucleic Acid
  misc_feature (31)..(31): n stands for inosine
uuguuaaccugaugaggccguuaggccgaanugcaaga

SEQ ID NO: 13887 - RNA, 38 nt, Artificial Sequence
  Description of Artificial Sequence:  Enzymatic Nucleic Acid
  misc_feature (31)..(31): n stands for inosine
uaagaacucugaugaggccguuaggccgaanuuaacug

SEQ ID NO: 13888 - RNA, 38 nt, Artificial Sequence
  Description of Artificial Sequence:  Enzymatic Nucleic Acid
  misc_feature (31)..(31): n stands for inosine
ucuguauacugaugaggccguuaggccgaanaacuugu

SEQ ID NO: 13889 - RNA, 38 nt, Artificial Sequence
  Description of Artificial Sequence:  Enzymatic Nucleic Acid
  misc_feature (31)..(31): n stands for inosine
aacgucuccugaugaggccguuaggccgaanuauaaga

SEQ ID NO: 13890 - RNA, 38 nt, Artificial Sequence
  Description of Artificial Sequence:  Enzymatic Nucleic Acid
  misc_feature (31)..(31): n stands for inosine
aaaauccacugaugaggccguuaggccgaanuaacguc

SEQ ID NO: 13891 - RNA, 38 nt, Artificial Sequence
  Description of Artificial Sequence:  Enzymatic Nucleic Acid
  misc_feature (31)..(31): n stands for inosine
cuguccgccugaugaggccguuaggccgaanuaaaauc

SEQ ID NO: 13892 - RNA, 38 nt, Artificial Sequence
  Description of Artificial Sequence:  Enzymatic Nucleic Acid
  misc_feature (31)..(31): n stands for inosine
uuauuaaccugaugaggccguuaggccgaanuccgcag

SEQ ID NO: 13893 - RNA, 38 nt, Artificial Sequence
  Description of Artificial Sequence:  Enzymatic Nucleic Acid
  misc_feature (31)..(31): n stands for inosine
cauuguuccugaugaggccguuaggccgaanuuauuaa

SEQ ID NO: 13894 - RNA, 38 nt, Artificial Sequence
  Description of Artificial Sequence:  Enzymatic Nucleic Acid
  misc_feature (31)..(31): n stands for inosine
uagugcaucugaugaggccguuaggccgaanuucuguu

SEQ ID NO: 13895 - RNA, 38 nt, Artificial Sequence
  Description of Artificial Sequence:  Enzymatic Nucleic Acid
  misc_feature (31)..(31): n stands for inosine
uacuguagcugaugaggccguuaggccgaancauuguu

SEQ ID NO: 13896 - RNA, 38 nt, Artificial Sequence
  Description of Artificial Sequence:  Enzymatic Nucleic Acid
  misc_feature (31)..(31): n stands for inosine
aauacugucugaugaggccguuaggccgaanugcauug

SEQ ID NO: 13897 - RNA, 38 nt, Artificial Sequence
  Description of Artificial Sequence:  Enzymatic Nucleic Acid
  misc_feature (31)..(31): n stands for inosine
gcuaauaccugaugaggccguuaggccgaanuagugca

SEQ ID NO: 13898 - RNA, 38 nt, Artificial Sequence
  Description of Artificial Sequence:  Enzymatic Nucleic Acid
  misc_feature (31)..(31): n stands for inosine
uuuuugcucugaugaggccguuaggccgaancuaauac

SEQ ID NO: 13899 - RNA, 38 nt, Artificial Sequence
  Description of Artificial Sequence:  Enzymatic Nucleic Acid
  misc_feature (31)..(31): n stands for inosine
ccauuuuucugaugaggccguuaggccgaancuugcua

SEQ ID NO: 13900 - RNA, 38 nt, Artificial Sequence
  Description of Artificial Sequence:  Enzymatic Nucleic Acid
  misc_feature (31)..(31): n stands for inosine
uuagugaucugaugaggccguuaggccgaanccauuuu

SEQ ID NO: 13901 - RNA, 38 nt, Artificial Sequence
  Description of Artificial Sequence:  Enzymatic Nucleic Acid
  misc_feature (31)..(31): n stands for inosine
cuuagugacugaugaggccguuaggccgaangccauuu

SEQ ID NO: 13902 - RNA, 38 nt, Artificial Sequence
  Description of Artificial Sequence:  Enzymatic Nucleic Acid
  misc_feature (31)..(31): n stands for inosine
cuccuuagcugaugaggccguuaggccgaanauggcca

SEQ ID NO: 13903 - RNA, 38 nt, Artificial Sequence
  Description of Artificial Sequence:  Enzymatic Nucleic Acid
  misc_feature (31)..(31): n stands for inosine
ugcuccuucugaugaggccguuaggccgaanugauggc

SEQ ID NO: 13904 - RNA, 38 nt, Artificial Sequence
  Description of Artificial Sequence:  Enzymatic Nucleic Acid
  misc_feature (31)..(31): n stands for inosine
ugauggagcugaugaggccguuaggccgaancuccuua

SEQ ID NO: 13905 - RNA, 38 nt, Artificial Sequence
  Description of Artificial Sequence:  Enzymatic Nucleic Acid
  misc_feature (31)..(31): n stands for inosine
agugauggcugaugaggccguuaggccgaanugcuccu

SEQ ID NO: 13906 - RNA, 38 nt, Artificial Sequence
  Description of Artificial Sequence:  Enzymatic Nucleic Acid
  misc_feature (31)..(31): n stands for inosine
agagugaucugaugaggccguuaggccgaanagugcuc

SEQ ID NO: 13907 - RNA, 38 nt, Artificial Sequence
  Description of Artificial Sequence:  Enzymatic Nucleic Acid
  misc_feature (31)..(31): n stands for inosine
aagagugacugaugaggccguuaggccgaangagugcu

SEQ ID NO: 13908 - RNA, 38 nt, Artificial Sequence
  Description of Artificial Sequence:  Enzymatic Nucleic Acid
  misc_feature (31)..(31): n stands for inosine
auuaagagcugaugaggccguuaggccgaanauggagu

SEQ ID NO: 13909 - RNA, 38 nt, Artificial Sequence
  Description of Artificial Sequence:  Enzymatic Nucleic Acid
  misc_feature (31)..(31): n stands for inosine
agauuaagcugaugaggccguuaggccgaanugaugga

SEQ ID NO: 13910 - RNA, 38 nt, Artificial Sequence
  Description of Artificial Sequence:  Enzymatic Nucleic Acid
  misc_feature (31)..(31): n stands for inosine
uaagauuacugaugaggccguuaggccgaanagugaug

SEQ ID NO: 13911 - RNA, 38 nt, Artificial Sequence
  Description of Artificial Sequence:  Enzymatic Nucleic Acid
  misc_feature (31)..(31): n stands for inosine
ugaugguacugaugaggccguuaggccgaanauuaaga

SEQ ID NO: 13912 - RNA, 38 nt, Artificial Sequence
  Description of Artificial Sequence:  Enzymatic Nucleic Acid
  misc_feature (31)..(31): n stands for inosine
uucaugaucugaugaggccguuaggccgaanuaagauu

SEQ ID NO: 13913 - RNA, 38 nt, Artificial Sequence
  Description of Artificial Sequence:  Enzymatic Nucleic Acid
  misc_feature (31)..(31): n stands for inosine
auucaugacugaugaggccguuaggccgaanguaagau

SEQ ID NO: 13914 - RNA, 38 nt, Artificial Sequence
  Description of Artificial Sequence:  Enzymatic Nucleic Acid
  misc_feature (31)..(31): n stands for inosine
aacauucacugaugaggccguuaggccgaanaugguaa

SEQ ID NO: 13915 - RNA, 38 nt, Artificial Sequence
  Description of Artificial Sequence:  Enzymatic Nucleic Acid
  misc_feature (31)..(31): n stands for inosine
ucuugcagcugaugaggccguuaggccgaanaaacauu

SEQ ID NO: 13916 - RNA, 38 nt, Artificial Sequence
  Description of Artificial Sequence:  Enzymatic Nucleic Acid
  misc_feature (31)..(31): n stands for inosine
aucuugcacugaugaggccguuaggccgaangaaacau

SEQ ID NO: 13917 - RNA, 38 nt, Artificial Sequence
  Description of Artificial Sequence:  Enzymatic Nucleic Acid
  misc_feature (31)..(31): n stands for inosine
aaucuugccugaugaggccguuaggccgaanggaaaca

SEQ ID NO: 13918 - RNA, 38 nt, Artificial Sequence
  Description of Artificial Sequence:  Enzymatic Nucleic Acid
  misc_feature (31)..(31): n stands for inosine
cugaaucucugaugaggccguuaggccgaancagggaa

SEQ ID NO: 13919 - RNA, 38 nt, Artificial Sequence
  Description of Artificial Sequence:  Enzymatic Nucleic Acid
  misc_feature (31)..(31): n stands for inosine
uaggugcccugaugaggccguuaggccgaanaaucuug

SEQ ID NO: 13920 - RNA, 38 nt, Artificial Sequence
  Description of Artificial Sequence:  Enzymatic Nucleic Acid
  misc_feature (31)..(31): n stands for inosine
ggcauaggcugaugaggccguuaggccgaanccugaau

SEQ ID NO: 13921 - RNA, 38 nt, Artificial Sequence
  Description of Artificial Sequence:  Enzymatic Nucleic Acid
  misc_feature (31)..(31): n stands for inosine
caggcauacugaugaggccguuaggccgaanugccuga

SEQ ID NO: 13922 - RNA, 38 nt, Artificial Sequence
  Description of Artificial Sequence:  Enzymatic Nucleic Acid
  misc_feature (31)..(31): n stands for inosine
gcaggcaucugaugaggccguuaggccgaangugccug

SEQ ID NO: 13923 - RNA, 38 nt, Artificial Sequence
  Description of Artificial Sequence:  Enzymatic Nucleic Acid
  misc_feature (31)..(31): n stands for inosine
gcucugcacugaugaggccguuaggccgaancauaggu

SEQ ID NO: 13924 - RNA, 38 nt, Artificial Sequence
  Description of Artificial Sequence:  Enzymatic Nucleic Acid
  misc_feature (31)..(31): n stands for inosine
ggcucugccugaugaggccguuaggccgaangcauagg

SEQ ID NO: 13925 - RNA, 38 nt, Artificial Sequence
  Description of Artificial Sequence:  Enzymatic Nucleic Acid
  misc_feature (31)..(31): n stands for inosine
ccuggcuccugaugaggccguuaggccgaancaggcau

SEQ ID NO: 13926 - RNA, 38 nt, Artificial Sequence
  Description of Artificial Sequence:  Enzymatic Nucleic Acid
  misc_feature (31)..(31): n stands for inosine
acauuccucugaugaggccguuaggccgaancucugca

SEQ ID NO: 13927 - RNA, 38 nt, Artificial Sequence
  Description of Artificial Sequence:  Enzymatic Nucleic Acid
  misc_feature (31)..(31): n stands for inosine
uacauucccugaugaggccguuaggccgaangcucugc

SEQ ID NO: 13928 - RNA, 38 nt, Artificial Sequence
  Description of Artificial Sequence:  Enzymatic Nucleic Acid
  misc_feature (31)..(31): n stands for inosine
uuccccugcugaugaggccguuaggccgaanuauacau

SEQ ID NO: 13929 - RNA, 38 nt, Artificial Sequence
  Description of Artificial Sequence:  Enzymatic Nucleic Acid
  misc_feature (31)..(31): n stands for inosine
ucuucccccugaugaggccguuaggccgaanuguauac

SEQ ID NO: 13930 - RNA, 38 nt, Artificial Sequence
  Description of Artificial Sequence:  Enzymatic Nucleic Acid
  misc_feature (31)..(31): n stands for inosine
cuucuggacugaugaggccguuaggccgaanauuucuu

SEQ ID NO: 13931 - RNA, 38 nt, Artificial Sequence
  Description of Artificial Sequence:  Enzymatic Nucleic Acid
  misc_feature (31)..(31): n stands for inosine
ucuucuggcugaugaggccguuaggccgaangauuucu

SEQ ID NO: 13932 - RNA, 38 nt, Artificial Sequence
  Description of Artificial Sequence:  Enzymatic Nucleic Acid
  misc_feature (31)..(31): n stands for inosine
uuucuucucugaugaggccguuaggccgaanaggauuu

SEQ ID NO: 13933 - RNA, 38 nt, Artificial Sequence
  Description of Artificial Sequence:  Enzymatic Nucleic Acid
  misc_feature (31)..(31): n stands for inosine
cuuucuuccugaugaggccguuaggccgaangaggauu

SEQ ID NO: 13934 - RNA, 38 nt, Artificial Sequence
  Description of Artificial Sequence:  Enzymatic Nucleic Acid
  misc_feature (31)..(31): n stands for inosine
ucucugaucugaugaggccguuaggccgaanuaauuuc

SEQ ID NO: 13935 - RNA, 38 nt, Artificial Sequence
  Description of Artificial Sequence:  Enzymatic Nucleic Acid
  misc_feature (31)..(31): n stands for inosine
cugaucuccugaugaggccguuaggccgaanauuguaa

SEQ ID NO: 13936 - RNA, 38 nt, Artificial Sequence
  Description of Artificial Sequence:  Enzymatic Nucleic Acid
  misc_feature (31)..(31): n stands for inosine
gugcuucccugaugaggccguuaggccgaanaucucug

SEQ ID NO: 13937 - RNA, 38 nt, Artificial Sequence
  Description of Artificial Sequence:  Enzymatic Nucleic Acid
  misc_feature (31)..(31): n stands for inosine
agguauggcugaugaggccguuaggccgaancuuccug

SEQ ID NO: 13938 - RNA, 38 nt, Artificial Sequence
  Description of Artificial Sequence:  Enzymatic Nucleic Acid
  misc_feature (31)..(31): n stands for inosine
ggagguaucugaugaggccguuaggccgaanugcuucc

SEQ ID NO: 13939 - RNA, 38 nt, Artificial Sequence
  Description of Artificial Sequence:  Enzymatic Nucleic Acid
  misc_feature (31)..(31): n stands for inosine
aggagguacugaugaggccguuaggccgaangugcuuc

SEQ ID NO: 13940 - RNA, 38 nt, Artificial Sequence
  Description of Artificial Sequence:  Enzymatic Nucleic Acid
  misc_feature (31)..(31): n stands for inosine
ucgcaggacugaugaggccguuaggccgaanuauggug

SEQ ID NO: 13941 - RNA, 38 nt, Artificial Sequence
  Description of Artificial Sequence:  Enzymatic Nucleic Acid
  misc_feature (31)..(31): n stands for inosine
uucgcaggcugaugaggccguuaggccgaanguauggu

SEQ ID NO: 13942 - RNA, 38 nt, Artificial Sequence
  Description of Artificial Sequence:  Enzymatic Nucleic Acid
  misc_feature (31)..(31): n stands for inosine
guuucgcacugaugaggccguuaggccgaanagguaug

SEQ ID NO: 13943 - RNA, 38 nt, Artificial Sequence
  Description of Artificial Sequence:  Enzymatic Nucleic Acid
  misc_feature (31)..(31): n stands for inosine
gguuucgccugaugaggccguuaggccgaangagguau

SEQ ID NO: 13944 - RNA, 38 nt, Artificial Sequence
  Description of Artificial Sequence:  Enzymatic Nucleic Acid
  misc_feature (31)..(31): n stands for inosine
aucacugacugaugaggccguuaggccgaanuuucgca

SEQ ID NO: 13945 - RNA, 38 nt, Artificial Sequence
  Description of Artificial Sequence:  Enzymatic Nucleic Acid
  misc_feature (31)..(31): n stands for inosine
gaucacugcugaugaggccguuaggccgaanguuucgc

SEQ ID NO: 13946 - RNA, 38 nt, Artificial Sequence
  Description of Artificial Sequence:  Enzymatic Nucleic Acid
  misc_feature (31)..(31): n stands for inosine
gugaucaccugaugaggccguuaggccgaanagguuuc

SEQ ID NO: 13947 - RNA, 38 nt, Artificial Sequence
  Description of Artificial Sequence:  Enzymatic Nucleic Acid
  misc_feature (31)..(31): n stands for inosine
ccacugugcugaugaggccguuaggccgaanaucacug

SEQ ID NO: 13948 - RNA, 38 nt, Artificial Sequence
  Description of Artificial Sequence:  Enzymatic Nucleic Acid
  misc_feature (31)..(31): n stands for inosine
ggccacugcugaugaggccguuaggccgaanugaucac

SEQ ID NO: 13949 - RNA, 38 nt, Artificial Sequence
  Description of Artificial Sequence:  Enzymatic Nucleic Acid
  misc_feature (31)..(31): n stands for inosine
auggccaccugaugaggccguuaggccgaanugugauc

SEQ ID NO: 13950 - RNA, 38 nt, Artificial Sequence
  Description of Artificial Sequence:  Enzymatic Nucleic Acid
  misc_feature (31)..(31): n stands for inosine
cugcugaucugaugaggccguuaggccgaanccacugu

SEQ ID NO: 13951 - RNA, 38 nt, Artificial Sequence
  Description of Artificial Sequence:  Enzymatic Nucleic Acid
  misc_feature (31)..(31): n stands for inosine
acugcugacugaugaggccguuaggccgaangccacug

SEQ ID NO: 13952 - RNA, 38 nt, Artificial Sequence
  Description of Artificial Sequence:  Enzymatic Nucleic Acid
  misc_feature (31)..(31): n stands for inosine
ggaacugccugaugaggccguuaggccgaanauggcca

SEQ ID NO: 13953 - RNA, 38 nt, Artificial Sequence
  Description of Artificial Sequence:  Enzymatic Nucleic Acid
  misc_feature (31)..(31): n stands for inosine
gguggaaccugaugaggccguuaggccgaancugaugg

SEQ ID NO: 13954 - RNA, 38 nt, Artificial Sequence
  Description of Artificial Sequence:  Enzymatic Nucleic Acid
  misc_feature (31)..(31): n stands for inosine
aaaguggucugaugaggccguuaggccgaanaacugcu

SEQ ID NO: 13955 - RNA, 38 nt, Artificial Sequence
  Description of Artificial Sequence:  Enzymatic Nucleic Acid
  misc_feature (31)..(31): n stands for inosine
uaaaguggcugaugaggccguuaggccgaangaacugc

SEQ ID NO: 13956 - RNA, 38 nt, Artificial Sequence
  Description of Artificial Sequence:  Enzymatic Nucleic Acid
  misc_feature (31)..(31): n stands for inosine
ucuaaagucugaugaggccguuaggccgaanuggaacu

SEQ ID NO: 13957 - RNA, 38 nt, Artificial Sequence
  Description of Artificial Sequence:  Enzymatic Nucleic Acid
  misc_feature (31)..(31): n stands for inosine
gucuaaagcugaugaggccguuaggccgaanguggaac

SEQ ID NO: 13958 - RNA, 38 nt, Artificial Sequence
  Description of Artificial Sequence:  Enzymatic Nucleic Acid
  misc_feature (31)..(31): n stands for inosine
cagucuaacugaugaggccguuaggccgaanuggugga

SEQ ID NO: 13959 - RNA, 38 nt, Artificial Sequence
  Description of Artificial Sequence:  Enzymatic Nucleic Acid
  misc_feature (31)..(31): n stands for inosine
agcaugaccugaugaggccguuaggccgaanucuaaag

SEQ ID NO: 13960 - RNA, 38 nt, Artificial Sequence
  Description of Artificial Sequence:  Enzymatic Nucleic Acid
  misc_feature (31)..(31): n stands for inosine
cauuagcacugaugaggccguuaggccgaanacagucu

SEQ ID NO: 13961 - RNA, 38 nt, Artificial Sequence
  Description of Artificial Sequence:  Enzymatic Nucleic Acid
  misc_feature (31)..(31): n stands for inosine
acaccauucugaugaggccguuaggccgaancaugaca

SEQ ID NO: 13962 - RNA, 38 nt, Artificial Sequence
  Description of Artificial Sequence:  Enzymatic Nucleic Acid
  misc_feature (31)..(31): n stands for inosine
aggcucggcugaugaggccguuaggccgaanacaccau

SEQ ID NO: 13963 - RNA, 38 nt, Artificial Sequence
  Description of Artificial Sequence:  Enzymatic Nucleic Acid
  misc_feature (31)..(31): n stands for inosine
gaggcucgcugaugaggccguuaggccgaangacacca

SEQ ID NO: 13964 - RNA, 38 nt, Artificial Sequence
  Description of Artificial Sequence:  Enzymatic Nucleic Acid
  misc_feature (31)..(31): n stands for inosine
ugaggcuccugaugaggccguuaggccgaanggacacc

SEQ ID NO: 13965 - RNA, 38 nt, Artificial Sequence
  Description of Artificial Sequence:  Enzymatic Nucleic Acid
  misc_feature (31)..(31): n stands for inosine
ugaucugacugaugaggccguuaggccgaancucgggg

SEQ ID NO: 13966 - RNA, 38 nt, Artificial Sequence
  Description of Artificial Sequence:  Enzymatic Nucleic Acid
  misc_feature (31)..(31): n stands for inosine
gugaucugcugaugaggccguuaggccgaangcucggg

SEQ ID NO: 13967 - RNA, 38 nt, Artificial Sequence
  Description of Artificial Sequence:  Enzymatic Nucleic Acid
  misc_feature (31)..(31): n stands for inosine
aagugauccugaugaggccguuaggccgaanaggcucg

SEQ ID NO: 13968 - RNA, 38 nt, Artificial Sequence
  Description of Artificial Sequence:  Enzymatic Nucleic Acid
  misc_feature (31)..(31): n stands for inosine
aaaccaagcugaugaggccguuaggccgaanaucugag

SEQ ID NO: 13969 - RNA, 38 nt, Artificial Sequence
  Description of Artificial Sequence:  Enzymatic Nucleic Acid
  misc_feature (31)..(31): n stands for inosine
uuaaaccacugaugaggccguuaggccgaanugaucug

SEQ ID NO: 13970 - RNA, 38 nt, Artificial Sequence
  Description of Artificial Sequence:  Enzymatic Nucleic Acid
  misc_feature (31)..(31): n stands for inosine
uuuguggucugaugaggccguuaggccgaanuuuuuaa

SEQ ID NO: 13971 - RNA, 38 nt, Artificial Sequence
  Description of Artificial Sequence:  Enzymatic Nucleic Acid
  misc_feature (31)..(31): n stands for inosine
uauuuugucugaugaggccguuaggccgaanuuguuuu

SEQ ID NO: 13972 - RNA, 38 nt, Artificial Sequence
  Description of Artificial Sequence:  Enzymatic Nucleic Acid
  misc_feature (31)..(31): n stands for inosine
guauuuugcugaugaggccguuaggccgaanguuguuu

SEQ ID NO: 13973 - RNA, 38 nt, Artificial Sequence
  Description of Artificial Sequence:  Enzymatic Nucleic Acid
  misc_feature (31)..(31): n stands for inosine
uuguauuucugaugaggccguuaggccgaanugguugu

SEQ ID NO: 13974 - RNA, 38 nt, Artificial Sequence
  Description of Artificial Sequence:  Enzymatic Nucleic Acid
  misc_feature (31)..(31): n stands for inosine
gcucuugucugaugaggccguuaggccgaanuauuuug

SEQ ID NO: 13975 - RNA, 38 nt, Artificial Sequence
  Description of Artificial Sequence:  Enzymatic Nucleic Acid
  misc_feature (31)..(31): n stands for inosine
caggcucucugaugaggccguuaggccgaanuuguauu

SEQ ID NO: 13976 - RNA, 38 nt, Artificial Sequence
  Description of Artificial Sequence:  Enzymatic Nucleic Acid
  misc_feature (31)..(31): n stands for inosine
uaauuccacugaugaggccguuaggccgaancucuugu

SEQ ID NO: 13977 - RNA, 38 nt, Artificial Sequence
  Description of Artificial Sequence:  Enzymatic Nucleic Acid
  misc_feature (31)..(31): n stands for inosine
auaauucccugaugaggccguuaggccgaangcucuug

SEQ ID NO: 13978 - RNA, 38 nt, Artificial Sequence
  Description of Artificial Sequence:  Enzymatic Nucleic Acid
  misc_feature (31)..(31): n stands for inosine
ugcuuccucugaugaggccguuaggccgaanuccuaaa

SEQ ID NO: 13979 - RNA, 38 nt, Artificial Sequence
  Description of Artificial Sequence:  Enzymatic Nucleic Acid
  misc_feature (31)..(31): n stands for inosine
cugcuucccugaugaggccguuaggccgaanguccuaa

SEQ ID NO: 13980 - RNA, 38 nt, Artificial Sequence
  Description of Artificial Sequence:  Enzymatic Nucleic Acid
  misc_feature (31)..(31): n stands for inosine
cagcgugccugaugaggccguuaggccgaancuuccug

SEQ ID NO: 13981 - RNA, 38 nt, Artificial Sequence
  Description of Artificial Sequence:  Enzymatic Nucleic Acid
  misc_feature (31)..(31): n stands for inosine
aaacagcgcugaugaggccguuaggccgaancugcuuc

SEQ ID NO: 13982 - RNA, 38 nt, Artificial Sequence
  Description of Artificial Sequence:  Enzymatic Nucleic Acid
  misc_feature (31)..(31): n stands for inosine
caauaaaccugaugaggccguuaggccgaancgugcug

SEQ ID NO: 13983 - RNA, 38 nt, Artificial Sequence
  Description of Artificial Sequence:  Enzymatic Nucleic Acid
  misc_feature (31)..(31): n stands for inosine
cucuucugcugaugaggccguuaggccgaanacucuuu

SEQ ID NO: 13984 - RNA, 38 nt, Artificial Sequence
  Description of Artificial Sequence:  Enzymatic Nucleic Acid
  misc_feature (31)..(31): n stands for inosine
uccucuuccugaugaggccguuaggccgaanugacucu

SEQ ID NO: 13985 - RNA, 38 nt, Artificial Sequence
  Description of Artificial Sequence:  Enzymatic Nucleic Acid
  misc_feature (31)..(31): n stands for inosine
gcagugaucugaugaggccguuaggccgaanacaccuu

SEQ ID NO: 13986 - RNA, 38 nt, Artificial Sequence
  Description of Artificial Sequence:  Enzymatic Nucleic Acid
  misc_feature (31)..(31): n stands for inosine
cuuugcagcugaugaggccguuaggccgaanauagaca

SEQ ID NO: 13987 - RNA, 38 nt, Artificial Sequence
  Description of Artificial Sequence:  Enzymatic Nucleic Acid
  misc_feature (31)..(31): n stands for inosine
ggcuuugccugaugaggccguuaggccgaanugauaga

SEQ ID NO: 13988 - RNA, 38 nt, Artificial Sequence
  Description of Artificial Sequence:  Enzymatic Nucleic Acid
  misc_feature (31)..(31): n stands for inosine
gguggcuucugaugaggccguuaggccgaancagugau

SEQ ID NO: 13989 - RNA, 38 nt, Artificial Sequence
  Description of Artificial Sequence:  Enzymatic Nucleic Acid
  misc_feature (31)..(31): n stands for inosine
ugguuggucugaugaggccguuaggccgaancuuugca

SEQ ID NO: 13990 - RNA, 38 nt, Artificial Sequence
  Description of Artificial Sequence:  Enzymatic Nucleic Acid
  misc_feature (31)..(31): n stands for inosine
cugguuggcugaugaggccguuaggccgaangcuuugc

SEQ ID NO: 13991 - RNA, 38 nt, Artificial Sequence
  Description of Artificial Sequence:  Enzymatic Nucleic Acid
  misc_feature (31)..(31): n stands for inosine
uucugguucugaugaggccguuaggccgaanuggcuuu

SEQ ID NO: 13992 - RNA, 38 nt, Artificial Sequence
  Description of Artificial Sequence:  Enzymatic Nucleic Acid
  misc_feature (31)..(31): n stands for inosine
cuucuggucugaugaggccguuaggccgaanguggcuu

SEQ ID NO: 13993 - RNA, 38 nt, Artificial Sequence
  Description of Artificial Sequence:  Enzymatic Nucleic Acid
  misc_feature (31)..(31): n stands for inosine
gcccuucucugaugaggccguuaggccgaanuuggugg

SEQ ID NO: 13994 - RNA, 38 nt, Artificial Sequence
  Description of Artificial Sequence:  Enzymatic Nucleic Acid
  misc_feature (31)..(31): n stands for inosine
agcccuuccugaugaggccguuaggccgaanguuggug

SEQ ID NO: 13995 - RNA, 38 nt, Artificial Sequence
  Description of Artificial Sequence:  Enzymatic Nucleic Acid
  misc_feature (31)..(31): n stands for inosine
uuccacagcugaugaggccguuaggccgaancccuucu

SEQ ID NO: 13996 - RNA, 38 nt, Artificial Sequence
  Description of Artificial Sequence:  Enzymatic Nucleic Acid
  misc_feature (31)..(31): n stands for inosine
cuuuccaccugaugaggccguuaggccgaanagcccuu

SEQ ID NO: 13997 - RNA, 38 nt, Artificial Sequence
  Description of Artificial Sequence:  Enzymatic Nucleic Acid
  misc_feature (31)..(31): n stands for inosine
agguaugccugaugaggccguuaggccgaanaacuuuc

SEQ ID NO: 13998 - RNA, 38 nt, Artificial Sequence
  Description of Artificial Sequence:  Enzymatic Nucleic Acid
  misc_feature (31)..(31): n stands for inosine
gugagguacugaugaggccguuaggccgaancugaacu

SEQ ID NO: 13999 - RNA, 38 nt, Artificial Sequence
  Description of Artificial Sequence:  Enzymatic Nucleic Acid
  misc_feature (31)..(31): n stands for inosine
aacagugacugaugaggccguuaggccgaanuaugcug

SEQ ID NO: 14000 - RNA, 38 nt, Artificial Sequence
  Description of Artificial Sequence:  Enzymatic Nucleic Acid
  misc_feature (31)..(31): n stands for inosine
gaacagugcugaugaggccguuaggccgaanguaugcu

SEQ ID NO: 14001 - RNA, 38 nt, Artificial Sequence
  Description of Artificial Sequence:  Enzymatic Nucleic Acid
  misc_feature (31)..(31): n stands for inosine
uugaacagcugaugaggccguuaggccgaanagguaug

SEQ ID NO: 14002 - RNA, 38 nt, Artificial Sequence
  Description of Artificial Sequence:  Enzymatic Nucleic Acid
  misc_feature (31)..(31): n stands for inosine
ccuugaaccugaugaggccguuaggccgaanugaggua

SEQ ID NO: 14003 - RNA, 38 nt, Artificial Sequence
  Description of Artificial Sequence:  Enzymatic Nucleic Acid
  misc_feature (31)..(31): n stands for inosine
agguuccucugaugaggccguuaggccgaanaacagug

SEQ ID NO: 14004 - RNA, 38 nt, Artificial Sequence
  Description of Artificial Sequence:  Enzymatic Nucleic Acid
  misc_feature (31)..(31): n stands for inosine
uuguccgacugaugaggccguuaggccgaanuuccuug

SEQ ID NO: 14005 - RNA, 38 nt, Artificial Sequence
  Description of Artificial Sequence:  Enzymatic Nucleic Acid
  misc_feature (31)..(31): n stands for inosine
cuuguccgcugaugaggccguuaggccgaanguuccuu

SEQ ID NO: 14006 - RNA, 38 nt, Artificial Sequence
  Description of Artificial Sequence:  Enzymatic Nucleic Acid
  misc_feature (31)..(31): n stands for inosine
auuagacucugaugaggccguuaggccgaanuccgagg

SEQ ID NO: 14007 - RNA, 38 nt, Artificial Sequence
  Description of Artificial Sequence:  Enzymatic Nucleic Acid
  misc_feature (31)..(31): n stands for inosine
uccagauucugaugaggccguuaggccgaanacuuguc

SEQ ID NO: 14008 - RNA, 38 nt, Artificial Sequence
  Description of Artificial Sequence:  Enzymatic Nucleic Acid
  misc_feature (31)..(31): n stands for inosine
ucagcucccugaugaggccguuaggccgaanauuagac

SEQ ID NO: 14009 - RNA, 38 nt, Artificial Sequence
  Description of Artificial Sequence:  Enzymatic Nucleic Acid
  misc_feature (31)..(31): n stands for inosine
gagugauccugaugaggccguuaggccgaancuccaga

SEQ ID NO: 14010 - RNA, 38 nt, Artificial Sequence
  Description of Artificial Sequence:  Enzymatic Nucleic Acid
  misc_feature (31)..(31): n stands for inosine
uguuagagcugaugaggccguuaggccgaanaucagcu

SEQ ID NO: 14011 - RNA, 38 nt, Artificial Sequence
  Description of Artificial Sequence:  Enzymatic Nucleic Acid
  misc_feature (31)..(31): n stands for inosine
cauguuagcugaugaggccguuaggccgaanugaucag

SEQ ID NO: 14012 - RNA, 38 nt, Artificial Sequence
  Description of Artificial Sequence:  Enzymatic Nucleic Acid
  misc_feature (31)..(31): n stands for inosine
ugcauguucugaugaggccguuaggccgaanagugauc

SEQ ID NO: 14013 - RNA, 38 nt, Artificial Sequence
  Description of Artificial Sequence:  Enzymatic Nucleic Acid
  misc_feature (31)..(31): n stands for inosine
caggugcacugaugaggccguuaggccgaanuuagagu

SEQ ID NO: 14014 - RNA, 38 nt, Artificial Sequence
  Description of Artificial Sequence:  Enzymatic Nucleic Acid
  misc_feature (31)..(31): n stands for inosine
cacacaggcugaugaggccguuaggccgaancauguua

SEQ ID NO: 14015 - RNA, 38 nt, Artificial Sequence
  Description of Artificial Sequence:  Enzymatic Nucleic Acid
  misc_feature (31)..(31): n stands for inosine
gccacacacugaugaggccguuaggccgaanugcaugu

SEQ ID NO: 14016 - RNA, 38 nt, Artificial Sequence
  Description of Artificial Sequence:  Enzymatic Nucleic Acid
  misc_feature (31)..(31): n stands for inosine
agccacaccugaugaggccguuaggccgaangugcaug

SEQ ID NO: 14017 - RNA, 38 nt, Artificial Sequence
  Description of Artificial Sequence:  Enzymatic Nucleic Acid
  misc_feature (31)..(31): n stands for inosine
agagucgccugaugaggccguuaggccgaanccacaca

SEQ ID NO: 14018 - RNA, 38 nt, Artificial Sequence
  Description of Artificial Sequence:  Enzymatic Nucleic Acid
  misc_feature (31)..(31): n stands for inosine
cagaagagcugaugaggccguuaggccgaanucgcagc

SEQ ID NO: 14019 - RNA, 38 nt, Artificial Sequence
  Description of Artificial Sequence:  Enzymatic Nucleic Acid
  misc_feature (31)..(31): n stands for inosine
gccagaagcugaugaggccguuaggccgaanagucgca

SEQ ID NO: 14020 - RNA, 38 nt, Artificial Sequence
  Description of Artificial Sequence:  Enzymatic Nucleic Acid
  misc_feature (31)..(31): n stands for inosine
gagccagacugaugaggccguuaggccgaanagagucg

SEQ ID NO: 14021 - RNA, 38 nt, Artificial Sequence
  Description of Artificial Sequence:  Enzymatic Nucleic Acid
  misc_feature (31)..(31): n stands for inosine
uaggagcccugaugaggccguuaggccgaanaagagag

SEQ ID NO: 14022 - RNA, 38 nt, Artificial Sequence
  Description of Artificial Sequence:  Enzymatic Nucleic Acid
  misc_feature (31)..(31): n stands for inosine
uuaauaggcugaugaggccguuaggccgaanccagaag

SEQ ID NO: 14023 - RNA, 38 nt, Artificial Sequence
  Description of Artificial Sequence:  Enzymatic Nucleic Acid
  misc_feature (31)..(31): n stands for inosine
gguuaauacugaugaggccguuaggccgaanagccaga

SEQ ID NO: 14024 - RNA, 38 nt, Artificial Sequence
  Description of Artificial Sequence:  Enzymatic Nucleic Acid
  misc_feature (31)..(31): n stands for inosine
ggguuaaucugaugaggccguuaggccgaangagccag

SEQ ID NO: 14025 - RNA, 38 nt, Artificial Sequence
  Description of Artificial Sequence:  Enzymatic Nucleic Acid
  misc_feature (31)..(31): n stands for inosine
auaaggagcugaugaggccguuaggccgaanuuaauag

SEQ ID NO: 14026 - RNA, 38 nt, Artificial Sequence
  Description of Artificial Sequence:  Enzymatic Nucleic Acid
  misc_feature (31)..(31): n stands for inosine
gauaaggacugaugaggccguuaggccgaanguuaaua

SEQ ID NO: 14027 - RNA, 38 nt, Artificial Sequence
  Description of Artificial Sequence:  Enzymatic Nucleic Acid
  misc_feature (31)..(31): n stands for inosine
ggauaaggcugaugaggccguuaggccgaangguuaau

SEQ ID NO: 14028 - RNA, 38 nt, Artificial Sequence
  Description of Artificial Sequence:  Enzymatic Nucleic Acid
  misc_feature (31)..(31): n stands for inosine
ucggauaacugaugaggccguuaggccgaanaggguua

SEQ ID NO: 14029 - RNA, 38 nt, Artificial Sequence
  Description of Artificial Sequence:  Enzymatic Nucleic Acid
  misc_feature (31)..(31): n stands for inosine
uucggauacugaugaggccguuaggccgaangaggguu

SEQ ID NO: 14030 - RNA, 38 nt, Artificial Sequence
  Description of Artificial Sequence:  Enzymatic Nucleic Acid
  misc_feature (31)..(31): n stands for inosine
cauuuuuccugaugaggccguuaggccgaanauaagga

SEQ ID NO: 14031 - RNA, 38 nt, Artificial Sequence
  Description of Artificial Sequence:  Enzymatic Nucleic Acid
  misc_feature (31)..(31): n stands for inosine
ucagaagacugaugaggccguuaggccgaanaccuuuu

SEQ ID NO: 14032 - RNA, 38 nt, Artificial Sequence
  Description of Artificial Sequence:  Enzymatic Nucleic Acid
  misc_feature (31)..(31): n stands for inosine
auuucagacugaugaggccguuaggccgaanaagaccu

SEQ ID NO: 14033 - RNA, 38 nt, Artificial Sequence
  Description of Artificial Sequence:  Enzymatic Nucleic Acid
  misc_feature (31)..(31): n stands for inosine
uuuauuuccugaugaggccguuaggccgaanaagaaga

SEQ ID NO: 14034 - RNA, 38 nt, Artificial Sequence
  Description of Artificial Sequence:  Enzymatic Nucleic Acid
  misc_feature (31)..(31): n stands for inosine
agguaguccugaugaggccguuaggccgaanucuuuau

SEQ ID NO: 14035 - RNA, 38 nt, Artificial Sequence
  Description of Artificial Sequence:  Enzymatic Nucleic Acid
  misc_feature (31)..(31): n stands for inosine
ugauaggucugaugaggccguuaggccgaanucagucu

SEQ ID NO: 14036 - RNA, 38 nt, Artificial Sequence
  Description of Artificial Sequence:  Enzymatic Nucleic Acid
  misc_feature (31)..(31): n stands for inosine
aauugauacugaugaggccguuaggccgaanuagucag

SEQ ID NO: 14037 - RNA, 38 nt, Artificial Sequence
  Description of Artificial Sequence:  Enzymatic Nucleic Acid
  misc_feature (31)..(31): n stands for inosine
uaauugaucugaugaggccguuaggccgaanguaguca

SEQ ID NO: 14038 - RNA, 38 nt, Artificial Sequence
  Description of Artificial Sequence:  Enzymatic Nucleic Acid
  misc_feature (31)..(31): n stands for inosine
auuauaaucugaugaggccguuaggccgaanauaggua

SEQ ID NO: 14039 - RNA, 38 nt, Artificial Sequence
  Description of Artificial Sequence:  Enzymatic Nucleic Acid
  misc_feature (31)..(31): n stands for inosine
uucaucugcugaugaggccguuaggccgaanuccauua

SEQ ID NO: 14040 - RNA, 38 nt, Artificial Sequence
  Description of Artificial Sequence:  Enzymatic Nucleic Acid
  misc_feature (31)..(31): n stands for inosine
cuucaucucugaugaggccguuaggccgaanguccauu

SEQ ID NO: 14041 - RNA, 38 nt, Artificial Sequence
  Description of Artificial Sequence:  Enzymatic Nucleic Acid
  misc_feature (31)..(31): n stands for inosine
acuucauccugaugaggccguuaggccgaangguccau

SEQ ID NO: 14042 - RNA, 38 nt, Artificial Sequence
  Description of Artificial Sequence:  Enzymatic Nucleic Acid
  misc_feature (31)..(31): n stands for inosine
cauccaaacugaugaggccguuaggccgaanaacuuca

SEQ ID NO: 14043 - RNA, 38 nt, Artificial Sequence
  Description of Artificial Sequence:  Enzymatic Nucleic Acid
  misc_feature (31)..(31): n stands for inosine
ucauccaacugaugaggccguuaggccgaangaacuuc

SEQ ID NO: 14044 - RNA, 38 nt, Artificial Sequence
  Description of Artificial Sequence:  Enzymatic Nucleic Acid
  misc_feature (31)..(31): n stands for inosine
gcucacaccugaugaggccguuaggccgaancucaucc

SEQ ID NO: 14045 - RNA, 38 nt, Artificial Sequence
  Description of Artificial Sequence:  Enzymatic Nucleic Acid
  misc_feature (31)..(31): n stands for inosine
cauaagggcugaugaggccguuaggccgaanccgcuca

SEQ ID NO: 14046 - RNA, 38 nt, Artificial Sequence
  Description of Artificial Sequence:  Enzymatic Nucleic Acid
  misc_feature (31)..(31): n stands for inosine
aucauaagcugaugaggccguuaggccgaanagccgcu

SEQ ID NO: 14047 - RNA, 38 nt, Artificial Sequence
  Description of Artificial Sequence:  Enzymatic Nucleic Acid
  misc_feature (31)..(31): n stands for inosine
caucauaacugaugaggccguuaggccgaangagccgc

SEQ ID NO: 14048 - RNA, 38 nt, Artificial Sequence
  Description of Artificial Sequence:  Enzymatic Nucleic Acid
  misc_feature (31)..(31): n stands for inosine
gcaucauacugaugaggccguuaggccgaanggagccg

SEQ ID NO: 14049 - RNA, 38 nt, Artificial Sequence
  Description of Artificial Sequence:  Enzymatic Nucleic Acid
  misc_feature (31)..(31): n stands for inosine
cacuugcucugaugaggccguuaggccgaancaucaua

SEQ ID NO: 14050 - RNA, 38 nt, Artificial Sequence
  Description of Artificial Sequence:  Enzymatic Nucleic Acid
  misc_feature (31)..(31): n stands for inosine
ccacuugccugaugaggccguuaggccgaangcaucau

SEQ ID NO: 14051 - RNA, 38 nt, Artificial Sequence
  Description of Artificial Sequence:  Enzymatic Nucleic Acid
  misc_feature (31)..(31): n stands for inosine
cucccacucugaugaggccguuaggccgaancuggcau

SEQ ID NO: 14052 - RNA, 38 nt, Artificial Sequence
  Description of Artificial Sequence:  Enzymatic Nucleic Acid
  misc_feature (31)..(31): n stands for inosine
cucucccgcugaugaggccguuaggccgaancaaacuc

SEQ ID NO: 14053 - RNA, 38 nt, Artificial Sequence
  Description of Artificial Sequence:  Enzymatic Nucleic Acid
  misc_feature (31)..(31): n stands for inosine
ucucuccccugaugaggccguuaggccgaangcaaacu

SEQ ID NO: 14054 - RNA, 38 nt, Artificial Sequence
  Description of Artificial Sequence:  Enzymatic Nucleic Acid
  misc_feature (31)..(31): n stands for inosine
ccaguuuacugaugaggccguuaggccgaanucucucc

SEQ ID NO: 14055 - RNA, 38 nt, Artificial Sequence
  Description of Artificial Sequence:  Enzymatic Nucleic Acid
  misc_feature (31)..(31): n stands for inosine
auuugccccugaugaggccguuaggccgaanuuuaagu

SEQ ID NO: 14056 - RNA, 38 nt, Artificial Sequence
  Description of Artificial Sequence:  Enzymatic Nucleic Acid
  misc_feature (31)..(31): n stands for inosine
aagugauucugaugaggccguuaggccgaancccaguu

SEQ ID NO: 14057 - RNA, 38 nt, Artificial Sequence
  Description of Artificial Sequence:  Enzymatic Nucleic Acid
  misc_feature (31)..(31): n stands for inosine
cuuccaagcugaugaggccguuaggccgaanauuugcc

SEQ ID NO: 14058 - RNA, 38 nt, Artificial Sequence
  Description of Artificial Sequence:  Enzymatic Nucleic Acid
  misc_feature (31)..(31): n stands for inosine
cucuuccacugaugaggccguuaggccgaanugauuug

SEQ ID NO: 14059 - RNA, 38 nt, Artificial Sequence
  Description of Artificial Sequence:  Enzymatic Nucleic Acid
  misc_feature (31)..(31): n stands for inosine
uuuccaaacugaugaggccguuaggccgaanccccucu

SEQ ID NO: 14060 - RNA, 38 nt, Artificial Sequence
  Description of Artificial Sequence:  Enzymatic Nucleic Acid
  misc_feature (31)..(31): n stands for inosine
cugaugcucugaugaggccguuaggccgaanaaccacu

SEQ ID NO: 14061 - RNA, 38 nt, Artificial Sequence
  Description of Artificial Sequence:  Enzymatic Nucleic Acid
  misc_feature (31)..(31): n stands for inosine
aaugcugacugaugaggccguuaggccgaancuugaac

SEQ ID NO: 14062 - RNA, 38 nt, Artificial Sequence
  Description of Artificial Sequence:  Enzymatic Nucleic Acid
  misc_feature (31)..(31): n stands for inosine
ccaaaugccugaugaggccguuaggccgaanaugcuug

SEQ ID NO: 14063 - RNA, 38 nt, Artificial Sequence
  Description of Artificial Sequence:  Enzymatic Nucleic Acid
  misc_feature (31)..(31): n stands for inosine
augccaaacugaugaggccguuaggccgaancugaugc

SEQ ID NO: 14064 - RNA, 38 nt, Artificial Sequence
  Description of Artificial Sequence:  Enzymatic Nucleic Acid
  misc_feature (31)..(31): n stands for inosine
uuucuuaacugaugaggccguuaggccgaanccaaaug

SEQ ID NO: 14065 - RNA, 38 nt, Artificial Sequence
  Description of Artificial Sequence:  Enzymatic Nucleic Acid
  misc_feature (31)..(31): n stands for inosine
cacguaggcugaugaggccguuaggccgaanauuucuu

SEQ ID NO: 14066 - RNA, 38 nt, Artificial Sequence
  Description of Artificial Sequence:  Enzymatic Nucleic Acid
  misc_feature (31)..(31): n stands for inosine
ggcacguacugaugaggccguuaggccgaanugauuuc

SEQ ID NO: 14067 - RNA, 38 nt, Artificial Sequence
  Description of Artificial Sequence:  Enzymatic Nucleic Acid
  misc_feature (31)..(31): n stands for inosine
cggcacgucugaugaggccguuaggccgaangugauuu

SEQ ID NO: 14068 - RNA, 38 nt, Artificial Sequence
  Description of Artificial Sequence:  Enzymatic Nucleic Acid
  misc_feature (31)..(31): n stands for inosine
cacagucccugaugaggccguuaggccgaancacguag

SEQ ID NO: 14069 - RNA, 38 nt, Artificial Sequence
  Description of Artificial Sequence:  Enzymatic Nucleic Acid
  misc_feature (31)..(31): n stands for inosine
acagccaccugaugaggccguuaggccgaanuccggca

SEQ ID NO: 14070 - RNA, 38 nt, Artificial Sequence
  Description of Artificial Sequence:  Enzymatic Nucleic Acid
  misc_feature (31)..(31): n stands for inosine
auuuucaccugaugaggccguuaggccgaanccacagu

SEQ ID NO: 14071 - RNA, 38 nt, Artificial Sequence
  Description of Artificial Sequence:  Enzymatic Nucleic Acid
  misc_feature (31)..(31): n stands for inosine
ccucuuuccugaugaggccguuaggccgaancauuuuc

SEQ ID NO: 14072 - RNA, 38 nt, Artificial Sequence
  Description of Artificial Sequence:  Enzymatic Nucleic Acid
  misc_feature (31)..(31): n stands for inosine
cuggccgucugaugaggccguuaggccgaancccccuc

SEQ ID NO: 14073 - RNA, 38 nt, Artificial Sequence
  Description of Artificial Sequence:  Enzymatic Nucleic Acid
  misc_feature (31)..(31): n stands for inosine
gcuggccgcugaugaggccguuaggccgaangcccccu

SEQ ID NO: 14074 - RNA, 38 nt, Artificial Sequence
  Description of Artificial Sequence:  Enzymatic Nucleic Acid
  misc_feature (31)..(31): n stands for inosine
uacucgcucugaugaggccguuaggccgaanccguggc

SEQ ID NO: 14075 - RNA, 38 nt, Artificial Sequence
  Description of Artificial Sequence:  Enzymatic Nucleic Acid
  misc_feature (31)..(31): n stands for inosine
guacucgccugaugaggccguuaggccgaangccgugg

SEQ ID NO: 14076 - RNA, 38 nt, Artificial Sequence
  Description of Artificial Sequence:  Enzymatic Nucleic Acid
  misc_feature (31)..(31): n stands for inosine
cagagcuucugaugaggccguuaggccgaanuacucgc

SEQ ID NO: 14077 - RNA, 38 nt, Artificial Sequence
  Description of Artificial Sequence:  Enzymatic Nucleic Acid
  misc_feature (31)..(31): n stands for inosine
gucaucagcugaugaggccguuaggccgaancuuugua

SEQ ID NO: 14078 - RNA, 38 nt, Artificial Sequence
  Description of Artificial Sequence:  Enzymatic Nucleic Acid
  misc_feature (31)..(31): n stands for inosine
cagucauccugaugaggccguuaggccgaanagcuuug

SEQ ID NO: 14079 - RNA, 38 nt, Artificial Sequence
  Description of Artificial Sequence:  Enzymatic Nucleic Acid
  misc_feature (31)..(31): n stands for inosine
uuuagcuccugaugaggccguuaggccgaanucaucag

SEQ ID NO: 14080 - RNA, 38 nt, Artificial Sequence
  Description of Artificial Sequence:  Enzymatic Nucleic Acid
  misc_feature (31)..(31): n stands for inosine
agauuuuucugaugaggccguuaggccgaancucaguc

SEQ ID NO: 14081 - RNA, 38 nt, Artificial Sequence
  Description of Artificial Sequence:  Enzymatic Nucleic Acid
  misc_feature (31)..(31): n stands for inosine
gugggucacugaugaggccguuaggccgaanauuuuua

SEQ ID NO: 14082 - RNA, 38 nt, Artificial Sequence
  Description of Artificial Sequence:  Enzymatic Nucleic Acid
  misc_feature (31)..(31): n stands for inosine
ccaaugugcugaugaggccguuaggccgaanucaagau

SEQ ID NO: 14083 - RNA, 38 nt, Artificial Sequence
  Description of Artificial Sequence:  Enzymatic Nucleic Acid
  misc_feature (31)..(31): n stands for inosine
gccaaugucugaugaggccguuaggccgaangucaaga

SEQ ID NO: 14084 - RNA, 38 nt, Artificial Sequence
  Description of Artificial Sequence:  Enzymatic Nucleic Acid
  misc_feature (31)..(31): n stands for inosine
ggccaaugcugaugaggccguuaggccgaanggucaag

SEQ ID NO: 14085 - RNA, 38 nt, Artificial Sequence
  Description of Artificial Sequence:  Enzymatic Nucleic Acid
  misc_feature (31)..(31): n stands for inosine
guggccaacugaugaggccguuaggccgaanuggguca

SEQ ID NO: 14086 - RNA, 38 nt, Artificial Sequence
  Description of Artificial Sequence:  Enzymatic Nucleic Acid
  misc_feature (31)..(31): n stands for inosine
cagauggucugaugaggccguuaggccgaanccaaugu

SEQ ID NO: 14087 - RNA, 38 nt, Artificial Sequence
  Description of Artificial Sequence:  Enzymatic Nucleic Acid
  misc_feature (31)..(31): n stands for inosine
ucagauggcugaugaggccguuaggccgaangccaaug

SEQ ID NO: 14088 - RNA, 38 nt, Artificial Sequence
  Description of Artificial Sequence:  Enzymatic Nucleic Acid
  misc_feature (31)..(31): n stands for inosine
guucagaucugaugaggccguuaggccgaanuggccaa

SEQ ID NO: 14089 - RNA, 38 nt, Artificial Sequence
  Description of Artificial Sequence:  Enzymatic Nucleic Acid
  misc_feature (31)..(31): n stands for inosine
cguucagacugaugaggccguuaggccgaanguggcca

SEQ ID NO: 14090 - RNA, 38 nt, Artificial Sequence
  Description of Artificial Sequence:  Enzymatic Nucleic Acid
  misc_feature (31)..(31): n stands for inosine
ccacguuccugaugaggccguuaggccgaanauggugg

SEQ ID NO: 14091 - RNA, 38 nt, Artificial Sequence
  Description of Artificial Sequence:  Enzymatic Nucleic Acid
  misc_feature (31)..(31): n stands for inosine
ucccagcacugaugaggccguuaggccgaanuuaacca

SEQ ID NO: 14092 - RNA, 38 nt, Artificial Sequence
  Description of Artificial Sequence:  Enzymatic Nucleic Acid
  misc_feature (31)..(31): n stands for inosine
cucccagccugaugaggccguuaggccgaanguuaacc

SEQ ID NO: 14093 - RNA, 38 nt, Artificial Sequence
  Description of Artificial Sequence:  Enzymatic Nucleic Acid
  misc_feature (31)..(31): n stands for inosine
aggcuccccugaugaggccguuaggccgaancagguua

SEQ ID NO: 14094 - RNA, 38 nt, Artificial Sequence
  Description of Artificial Sequence:  Enzymatic Nucleic Acid
  misc_feature (31)..(31): n stands for inosine
uuggugcacugaugaggccguuaggccgaancucccag

SEQ ID NO: 14095 - RNA, 38 nt, Artificial Sequence
  Description of Artificial Sequence:  Enzymatic Nucleic Acid
  misc_feature (31)..(31): n stands for inosine
cuuggugccugaugaggccguuaggccgaangcuccca

SEQ ID NO: 14096 - RNA, 38 nt, Artificial Sequence
  Description of Artificial Sequence:  Enzymatic Nucleic Acid
  misc_feature (31)..(31): n stands for inosine
uugcuuggcugaugaggccguuaggccgaancaggcuc

SEQ ID NO: 14097 - RNA, 38 nt, Artificial Sequence
  Description of Artificial Sequence:  Enzymatic Nucleic Acid
  misc_feature (31)..(31): n stands for inosine
ccuugcuucugaugaggccguuaggccgaanugcaggc

SEQ ID NO: 14098 - RNA, 38 nt, Artificial Sequence
  Description of Artificial Sequence:  Enzymatic Nucleic Acid
  misc_feature (31)..(31): n stands for inosine
uccuugcucugaugaggccguuaggccgaangugcagg

SEQ ID NO: 14099 - RNA, 38 nt, Artificial Sequence
  Description of Artificial Sequence:  Enzymatic Nucleic Acid
  misc_feature (31)..(31): n stands for inosine
gcccuccucugaugaggccguuaggccgaancuuggug

SEQ ID NO: 14100 - RNA, 38 nt, Artificial Sequence
  Description of Artificial Sequence:  Enzymatic Nucleic Acid
  misc_feature (31)..(31): n stands for inosine
ccaucagacugaugaggccguuaggccgaancccuccu

SEQ ID NO: 14101 - RNA, 38 nt, Artificial Sequence
  Description of Artificial Sequence:  Enzymatic Nucleic Acid
  misc_feature (31)..(31): n stands for inosine
accaucagcugaugaggccguuaggccgaangcccucc

SEQ ID NO: 14102 - RNA, 38 nt, Artificial Sequence
  Description of Artificial Sequence:  Enzymatic Nucleic Acid
  misc_feature (31)..(31): n stands for inosine
ucaccauccugaugaggccguuaggccgaanaggcccu

SEQ ID NO: 14103 - RNA, 38 nt, Artificial Sequence
  Description of Artificial Sequence:  Enzymatic Nucleic Acid
  misc_feature (31)..(31): n stands for inosine
auauuugccugaugaggccguuaggccgaanuauucaa

SEQ ID NO: 14104 - RNA, 38 nt, Artificial Sequence
  Description of Artificial Sequence:  Enzymatic Nucleic Acid
  misc_feature (31)..(31): n stands for inosine
uccauauucugaugaggccguuaggccgaancaguauu

SEQ ID NO: 14105 - RNA, 38 nt, Artificial Sequence
  Description of Artificial Sequence:  Enzymatic Nucleic Acid
  misc_feature (31)..(31): n stands for inosine
aguuggagcugaugaggccguuaggccgaanauuucca

SEQ ID NO: 14106 - RNA, 38 nt, Artificial Sequence
  Description of Artificial Sequence:  Enzymatic Nucleic Acid
  misc_feature (31)..(31): n stands for inosine
guaguuggcugaugaggccguuaggccgaanagauuuc

SEQ ID NO: 14107 - RNA, 38 nt, Artificial Sequence
  Description of Artificial Sequence:  Enzymatic Nucleic Acid
  misc_feature (31)..(31): n stands for inosine
agguaguucugaugaggccguuaggccgaanagagauu

SEQ ID NO: 14108 - RNA, 38 nt, Artificial Sequence
  Description of Artificial Sequence:  Enzymatic Nucleic Acid
  misc_feature (31)..(31): n stands for inosine
gagguagucugaugaggccguuaggccgaangagagau

SEQ ID NO: 14109 - RNA, 38 nt, Artificial Sequence
  Description of Artificial Sequence:  Enzymatic Nucleic Acid
  misc_feature (31)..(31): n stands for inosine
cuugaggucugaugaggccguuaggccgaanuuggaga

SEQ ID NO: 14110 - RNA, 38 nt, Artificial Sequence
  Description of Artificial Sequence:  Enzymatic Nucleic Acid
  misc_feature (31)..(31): n stands for inosine
gcucuugacugaugaggccguuaggccgaanuaguugg

SEQ ID NO: 14111 - RNA, 38 nt, Artificial Sequence
  Description of Artificial Sequence:  Enzymatic Nucleic Acid
  misc_feature (31)..(31): n stands for inosine
ugcucuugcugaugaggccguuaggccgaanguaguug

SEQ ID NO: 14112 - RNA, 38 nt, Artificial Sequence
  Description of Artificial Sequence:  Enzymatic Nucleic Acid
  misc_feature (31)..(31): n stands for inosine
uuugcucucugaugaggccguuaggccgaanagguagu

SEQ ID NO: 14113 - RNA, 38 nt, Artificial Sequence
  Description of Artificial Sequence:  Enzymatic Nucleic Acid
  misc_feature (31)..(31): n stands for inosine
gucacguucugaugaggccguuaggccgaancucuuga

SEQ ID NO: 14114 - RNA, 38 nt, Artificial Sequence
  Description of Artificial Sequence:  Enzymatic Nucleic Acid
  misc_feature (31)..(31): n stands for inosine
aaaaaauacugaugaggccguuaggccgaanucacguu

SEQ ID NO: 14115 - RNA, 38 nt, Artificial Sequence
  Description of Artificial Sequence:  Enzymatic Nucleic Acid
  misc_feature (31)..(31): n stands for inosine
ccuuguugcugaugaggccguuaggccgaanaaaaaau

SEQ ID NO: 14116 - RNA, 38 nt, Artificial Sequence
  Description of Artificial Sequence:  Enzymatic Nucleic Acid
  misc_feature (31)..(31): n stands for inosine
auccuugucugaugaggccguuaggccgaanagaaaaa

SEQ ID NO: 14117 - RNA, 38 nt, Artificial Sequence
  Description of Artificial Sequence:  Enzymatic Nucleic Acid
  misc_feature (31)..(31): n stands for inosine
ugcauccucugaugaggccguuaggccgaanuugagaa

SEQ ID NO: 14118 - RNA, 38 nt, Artificial Sequence
  Description of Artificial Sequence:  Enzymatic Nucleic Acid
  misc_feature (31)..(31): n stands for inosine
uguagugccugaugaggccguuaggccgaancauccuu

SEQ ID NO: 14119 - RNA, 38 nt, Artificial Sequence
  Description of Artificial Sequence:  Enzymatic Nucleic Acid
  misc_feature (31)..(31): n stands for inosine
auguguagcugaugaggccguuaggccgaancugcauc

SEQ ID NO: 14120 - RNA, 38 nt, Artificial Sequence
  Description of Artificial Sequence:  Enzymatic Nucleic Acid
  misc_feature (31)..(31): n stands for inosine
ccaugugucugaugaggccguuaggccgaanugcugca

SEQ ID NO: 14121 - RNA, 38 nt, Artificial Sequence
  Description of Artificial Sequence:  Enzymatic Nucleic Acid
  misc_feature (31)..(31): n stands for inosine
gcuccaugcugaugaggccguuaggccgaanuagugcu

SEQ ID NO: 14122 - RNA, 38 nt, Artificial Sequence
  Description of Artificial Sequence:  Enzymatic Nucleic Acid
  misc_feature (31)..(31): n stands for inosine
aggcuccacugaugaggccguuaggccgaanuguagug

SEQ ID NO: 14123 - RNA, 38 nt, Artificial Sequence
  Description of Artificial Sequence:  Enzymatic Nucleic Acid
  misc_feature (31)..(31): n stands for inosine
cuuucuuacugaugaggccguuaggccgaancuccaug

SEQ ID NO: 14124 - RNA, 38 nt, Artificial Sequence
  Description of Artificial Sequence:  Enzymatic Nucleic Acid
  misc_feature (31)..(31): n stands for inosine
ucuuucuucugaugaggccguuaggccgaangcuccau

SEQ ID NO: 14125 - RNA, 38 nt, Artificial Sequence
  Description of Artificial Sequence:  Enzymatic Nucleic Acid
  misc_feature (31)..(31): n stands for inosine
ccaggccucugaugaggccguuaggccgaancuccauu

SEQ ID NO: 14126 - RNA, 38 nt, Artificial Sequence
  Description of Artificial Sequence:  Enzymatic Nucleic Acid
  misc_feature (31)..(31): n stands for inosine
uccaggcccugaugaggccguuaggccgaangcuccau

SEQ ID NO: 14127 - RNA, 38 nt, Artificial Sequence
  Description of Artificial Sequence:  Enzymatic Nucleic Acid
  misc_feature (31)..(31): n stands for inosine
uuguuccacugaugaggccguuaggccgaanccuggcu

SEQ ID NO: 14128 - RNA, 38 nt, Artificial Sequence
  Description of Artificial Sequence:  Enzymatic Nucleic Acid
  misc_feature (31)..(31): n stands for inosine
cuuguucccugaugaggccguuaggccgaangccuggc

SEQ ID NO: 14129 - RNA, 38 nt, Artificial Sequence
  Description of Artificial Sequence:  Enzymatic Nucleic Acid
  misc_feature (31)..(31): n stands for inosine
ucuugccucugaugaggccguuaggccgaanuuccagg

SEQ ID NO: 14130 - RNA, 38 nt, Artificial Sequence
  Description of Artificial Sequence:  Enzymatic Nucleic Acid
  misc_feature (31)..(31): n stands for inosine
ugguuucucugaugaggccguuaggccgaanccuuguu

SEQ ID NO: 14131 - RNA, 38 nt, Artificial Sequence
  Description of Artificial Sequence:  Enzymatic Nucleic Acid
  misc_feature (31)..(31): n stands for inosine
cuagucuucugaugaggccguuaggccgaanuuucuug

SEQ ID NO: 14132 - RNA, 38 nt, Artificial Sequence
  Description of Artificial Sequence:  Enzymatic Nucleic Acid
  misc_feature (31)..(31): n stands for inosine
ucuagucucugaugaggccguuaggccgaanguuucuu

SEQ ID NO: 14133 - RNA, 38 nt, Artificial Sequence
  Description of Artificial Sequence:  Enzymatic Nucleic Acid
  misc_feature (31)..(31): n stands for inosine
cgcuaucucugaugaggccguuaggccgaanucuuggu

SEQ ID NO: 14134 - RNA, 38 nt, Artificial Sequence
  Description of Artificial Sequence:  Enzymatic Nucleic Acid
  misc_feature (31)..(31): n stands for inosine
gcugcuggcugaugaggccguuaggccgaanacgcuau

SEQ ID NO: 14135 - RNA, 38 nt, Artificial Sequence
  Description of Artificial Sequence:  Enzymatic Nucleic Acid
  misc_feature (31)..(31): n stands for inosine
ucgcugcucugaugaggccguuaggccgaanugacgcu

SEQ ID NO: 14136 - RNA, 38 nt, Artificial Sequence
  Description of Artificial Sequence:  Enzymatic Nucleic Acid
  misc_feature (31)..(31): n stands for inosine
uucgcugccugaugaggccguuaggccgaangugacgc

SEQ ID NO: 14137 - RNA, 38 nt, Artificial Sequence
  Description of Artificial Sequence:  Enzymatic Nucleic Acid
  misc_feature (31)..(31): n stands for inosine
gcuuucgccugaugaggccguuaggccgaancugguga

SEQ ID NO: 14138 - RNA, 38 nt, Artificial Sequence
  Description of Artificial Sequence:  Enzymatic Nucleic Acid
  misc_feature (31)..(31): n stands for inosine
gcucgcaacugaugaggccguuaggccgaancuuucgc

SEQ ID NO: 14139 - RNA, 38 nt, Artificial Sequence
  Description of Artificial Sequence:  Enzymatic Nucleic Acid
  misc_feature (31)..(31): n stands for inosine
aaagccggcugaugaggccguuaggccgaancucgcaa

SEQ ID NO: 14140 - RNA, 38 nt, Artificial Sequence
  Description of Artificial Sequence:  Enzymatic Nucleic Acid
  misc_feature (31)..(31): n stands for inosine
ugaaagcccugaugaggccguuaggccgaanagcucgc

SEQ ID NO: 14141 - RNA, 38 nt, Artificial Sequence
  Description of Artificial Sequence:  Enzymatic Nucleic Acid
  misc_feature (31)..(31): n stands for inosine
uuccugaacugaugaggccguuaggccgaanccggagc

SEQ ID NO: 14142 - RNA, 38 nt, Artificial Sequence
  Description of Artificial Sequence:  Enzymatic Nucleic Acid
  misc_feature (31)..(31): n stands for inosine
uaucuucccugaugaggccguuaggccgaanaaagccg

SEQ ID NO: 14143 - RNA, 38 nt, Artificial Sequence
  Description of Artificial Sequence:  Enzymatic Nucleic Acid
  misc_feature (31)..(31): n stands for inosine
caucacuccugaugaggccguuaggccgaanacuuuua

SEQ ID NO: 14144 - RNA, 38 nt, Artificial Sequence
  Description of Artificial Sequence:  Enzymatic Nucleic Acid
  misc_feature (31)..(31): n stands for inosine
aaaccguccugaugaggccguuaggccgaanaauccuc

SEQ ID NO: 14145 - RNA, 38 nt, Artificial Sequence
  Description of Artificial Sequence:  Enzymatic Nucleic Acid
  misc_feature (31)..(31): n stands for inosine
cuccuugucugaugaggccguuaggccgaanaaaccgu

SEQ ID NO: 14146 - RNA, 38 nt, Artificial Sequence
  Description of Artificial Sequence:  Enzymatic Nucleic Acid
  misc_feature (31)..(31): n stands for inosine
gggcuccucugaugaggccguuaggccgaanuagaaac

SEQ ID NO: 14147 - RNA, 38 nt, Artificial Sequence
  Description of Artificial Sequence:  Enzymatic Nucleic Acid
  misc_feature (31)..(31): n stands for inosine
uagugaugcugaugaggccguuaggccgaancuccuug

SEQ ID NO: 14148 - RNA, 38 nt, Artificial Sequence
  Description of Artificial Sequence:  Enzymatic Nucleic Acid
  misc_feature (31)..(31): n stands for inosine
auagugaucugaugaggccguuaggccgaangcuccuu

SEQ ID NO: 14149 - RNA, 38 nt, Artificial Sequence
  Description of Artificial Sequence:  Enzymatic Nucleic Acid
  misc_feature (31)..(31): n stands for inosine
cauagugacugaugaggccguuaggccgaanggcuccu

SEQ ID NO: 14150 - RNA, 38 nt, Artificial Sequence
  Description of Artificial Sequence:  Enzymatic Nucleic Acid
  misc_feature (31)..(31): n stands for inosine
uuccauagcugaugaggccguuaggccgaanaugggcu

SEQ ID NO: 14151 - RNA, 38 nt, Artificial Sequence
  Description of Artificial Sequence:  Enzymatic Nucleic Acid
  misc_feature (31)..(31): n stands for inosine
ucuuccaucugaugaggccguuaggccgaanugauggg

SEQ ID NO: 14152 - RNA, 38 nt, Artificial Sequence
  Description of Artificial Sequence:  Enzymatic Nucleic Acid
  misc_feature (31)..(31): n stands for inosine
aagaaauccugaugaggccguuaggccgaanaucuucc

SEQ ID NO: 14153 - RNA, 38 nt, Artificial Sequence
  Description of Artificial Sequence:  Enzymatic Nucleic Acid
  misc_feature (31)..(31): n stands for inosine
aaacuguacugaugaggccguuaggccgaanaaaucag

SEQ ID NO: 14154 - RNA, 38 nt, Artificial Sequence
  Description of Artificial Sequence:  Enzymatic Nucleic Acid
  misc_feature (31)..(31): n stands for inosine
uugaaaaccugaugaggccguuaggccgaanuaagaaa

SEQ ID NO: 14155 - RNA, 38 nt, Artificial Sequence
  Description of Artificial Sequence:  Enzymatic Nucleic Acid
  misc_feature (31)..(31): n stands for inosine
uggccacucugaugaggccguuaggccgaanaaaacug

SEQ ID NO: 14156 - RNA, 38 nt, Artificial Sequence
  Description of Artificial Sequence:  Enzymatic Nucleic Acid
  misc_feature (31)..(31): n stands for inosine
augccucucugaugaggccguuaggccgaanccacuug

SEQ ID NO: 14157 - RNA, 38 nt, Artificial Sequence
  Description of Artificial Sequence:  Enzymatic Nucleic Acid
  misc_feature (31)..(31): n stands for inosine
caugccuccugaugaggccguuaggccgaangccacuu

SEQ ID NO: 14158 - RNA, 38 nt, Artificial Sequence
  Description of Artificial Sequence:  Enzymatic Nucleic Acid
  misc_feature (31)..(31): n stands for inosine
gaacuccacugaugaggccguuaggccgaanccucugg

SEQ ID NO: 14159 - RNA, 38 nt, Artificial Sequence
  Description of Artificial Sequence:  Enzymatic Nucleic Acid
  misc_feature (31)..(31): n stands for inosine
ggaagacacugaugaggccguuaggccgaanaacucca

SEQ ID NO: 14160 - RNA, 38 nt, Artificial Sequence
  Description of Artificial Sequence:  Enzymatic Nucleic Acid
  misc_feature (31)..(31): n stands for inosine
uggaagaccugaugaggccguuaggccgaangaacucc

SEQ ID NO: 14161 - RNA, 38 nt, Artificial Sequence
  Description of Artificial Sequence:  Enzymatic Nucleic Acid
  misc_feature (31)..(31): n stands for inosine
uuucuggacugaugaggccguuaggccgaanacaggaa

SEQ ID NO: 14162 - RNA, 38 nt, Artificial Sequence
  Description of Artificial Sequence:  Enzymatic Nucleic Acid
  misc_feature (31)..(31): n stands for inosine
cacuuucucugaugaggccguuaggccgaanaagacag

SEQ ID NO: 14163 - RNA, 38 nt, Artificial Sequence
  Description of Artificial Sequence:  Enzymatic Nucleic Acid
  misc_feature (31)..(31): n stands for inosine
gcacuuuccugaugaggccguuaggccgaangaagaca

SEQ ID NO: 14164 - RNA, 38 nt, Artificial Sequence
  Description of Artificial Sequence:  Enzymatic Nucleic Acid
  misc_feature (31)..(31): n stands for inosine
ccgaugaacugaugaggccguuaggccgaancacuuuc

SEQ ID NO: 14165 - RNA, 38 nt, Artificial Sequence
  Description of Artificial Sequence:  Enzymatic Nucleic Acid
  misc_feature (31)..(31): n stands for inosine
ggucccgacugaugaggccguuaggccgaanaaugcac

SEQ ID NO: 14166 - RNA, 38 nt, Artificial Sequence
  Description of Artificial Sequence:  Enzymatic Nucleic Acid
  misc_feature (31)..(31): n stands for inosine
cgcugccacugaugaggccguuaggccgaanucccgau

SEQ ID NO: 14167 - RNA, 38 nt, Artificial Sequence
  Description of Artificial Sequence:  Enzymatic Nucleic Acid
  misc_feature (31)..(31): n stands for inosine
ucgcugcccugaugaggccguuaggccgaangucccga

SEQ ID NO: 14168 - RNA, 38 nt, Artificial Sequence
  Description of Artificial Sequence:  Enzymatic Nucleic Acid
  misc_feature (31)..(31): n stands for inosine
uuucucgccugaugaggccguuaggccgaanccagguc

SEQ ID NO: 14169 - RNA, 38 nt, Artificial Sequence
  Description of Artificial Sequence:  Enzymatic Nucleic Acid
  misc_feature (31)..(31): n stands for inosine
uaaaagaacugaugaggccguuaggccgaanuuucucg

SEQ ID NO: 14170 - RNA, 38 nt, Artificial Sequence
  Description of Artificial Sequence:  Enzymatic Nucleic Acid
  misc_feature (31)..(31): n stands for inosine
cagauaaacugaugaggccguuaggccgaanaauguuu

SEQ ID NO: 14171 - RNA, 38 nt, Artificial Sequence
  Description of Artificial Sequence:  Enzymatic Nucleic Acid
  misc_feature (31)..(31): n stands for inosine
uuguucuccugaugaggccguuaggccgaanauaaaag

SEQ ID NO: 14172 - RNA, 38 nt, Artificial Sequence
  Description of Artificial Sequence:  Enzymatic Nucleic Acid
  misc_feature (31)..(31): n stands for inosine
caccacgucugaugaggccguuaggccgaanuucucag

SEQ ID NO: 14173 - RNA, 38 nt, Artificial Sequence
  Description of Artificial Sequence:  Enzymatic Nucleic Acid
  misc_feature (31)..(31): n stands for inosine
ccgggcaacugaugaggccguuaggccgaanccaaaau

SEQ ID NO: 14174 - RNA, 38 nt, Artificial Sequence
  Description of Artificial Sequence:  Enzymatic Nucleic Acid
  misc_feature (31)..(31): n stands for inosine
cccgggcacugaugaggccguuaggccgaangccaaaa

SEQ ID NO: 14175 - RNA, 38 nt, Artificial Sequence
  Description of Artificial Sequence:  Enzymatic Nucleic Acid
  misc_feature (31)..(31): n stands for inosine
auaucccgcugaugaggccguuaggccgaancaaggcc

SEQ ID NO: 14176 - RNA, 38 nt, Artificial Sequence
  Description of Artificial Sequence:  Enzymatic Nucleic Acid
  misc_feature (31)..(31): n stands for inosine
aauauccccugaugaggccguuaggccgaangcaaggc

SEQ ID NO: 14177 - RNA, 38 nt, Artificial Sequence
  Description of Artificial Sequence:  Enzymatic Nucleic Acid
  misc_feature (31)..(31): n stands for inosine
auaaucggcugaugaggccguuaggccgaanuucuuau

SEQ ID NO: 14178 - RNA, 38 nt, Artificial Sequence
  Description of Artificial Sequence:  Enzymatic Nucleic Acid
  misc_feature (31)..(31): n stands for inosine
cauaaucgcugaugaggccguuaggccgaanguucuua

SEQ ID NO: 14179 - RNA, 38 nt, Artificial Sequence
  Description of Artificial Sequence:  Enzymatic Nucleic Acid
  misc_feature (31)..(31): n stands for inosine
acauaauccugaugaggccguuaggccgaangguucuu

SEQ ID NO: 14180 - RNA, 38 nt, Artificial Sequence
  Description of Artificial Sequence:  Enzymatic Nucleic Acid
  misc_feature (31)..(31): n stands for inosine
ggaagucgcugaugaggccguuaggccgaanuaucucc

SEQ ID NO: 14181 - RNA, 38 nt, Artificial Sequence
  Description of Artificial Sequence:  Enzymatic Nucleic Acid
  misc_feature (31)..(31): n stands for inosine
ucagaggacugaugaggccguuaggccgaanucgagua

SEQ ID NO: 14182 - RNA, 38 nt, Artificial Sequence
  Description of Artificial Sequence:  Enzymatic Nucleic Acid
  misc_feature (31)..(31): n stands for inosine
auuucagacugaugaggccguuaggccgaanaagucga

SEQ ID NO: 14183 - RNA, 38 nt, Artificial Sequence
  Description of Artificial Sequence:  Enzymatic Nucleic Acid
  misc_feature (31)..(31): n stands for inosine
cauuucagcugaugaggccguuaggccgaangaagucg

SEQ ID NO: 14184 - RNA, 38 nt, Artificial Sequence
  Description of Artificial Sequence:  Enzymatic Nucleic Acid
  misc_feature (31)..(31): n stands for inosine
uccauuuccugaugaggccguuaggccgaanaggaagu

SEQ ID NO: 14185 - RNA, 38 nt, Artificial Sequence
  Description of Artificial Sequence:  Enzymatic Nucleic Acid
  misc_feature (31)..(31): n stands for inosine
gauucgggcugaugaggccguuaggccgaanccaucca

SEQ ID NO: 14186 - RNA, 38 nt, Artificial Sequence
  Description of Artificial Sequence:  Enzymatic Nucleic Acid
  misc_feature (31)..(31): n stands for inosine
uagauucgcugaugaggccguuaggccgaanagccauc

SEQ ID NO: 14187 - RNA, 38 nt, Artificial Sequence
  Description of Artificial Sequence:  Enzymatic Nucleic Acid
  misc_feature (31)..(31): n stands for inosine
auagauuccugaugaggccguuaggccgaangagccau

SEQ ID NO: 14188 - RNA, 38 nt, Artificial Sequence
  Description of Artificial Sequence:  Enzymatic Nucleic Acid
  misc_feature (31)..(31): n stands for inosine
ucaaagaucugaugaggccguuaggccgaanauucggg

SEQ ID NO: 14189 - RNA, 38 nt, Artificial Sequence
  Description of Artificial Sequence:  Enzymatic Nucleic Acid
  misc_feature (31)..(31): n stands for inosine
uuugucaacugaugaggccguuaggccgaanauagauu

SEQ ID NO: 14190 - RNA, 38 nt, Artificial Sequence
  Description of Artificial Sequence:  Enzymatic Nucleic Acid
  misc_feature (31)..(31): n stands for inosine
guagauuucugaugaggccguuaggccgaanucaaaga

SEQ ID NO: 14191 - RNA, 38 nt, Artificial Sequence
  Description of Artificial Sequence:  Enzymatic Nucleic Acid
  misc_feature (31)..(31): n stands for inosine
ggugcugucugaugaggccguuaggccgaanauuuugu

SEQ ID NO: 14192 - RNA, 38 nt, Artificial Sequence
  Description of Artificial Sequence:  Enzymatic Nucleic Acid
  misc_feature (31)..(31): n stands for inosine
cuuggugccugaugaggccguuaggccgaanuagauuu

SEQ ID NO: 14193 - RNA, 38 nt, Artificial Sequence
  Description of Artificial Sequence:  Enzymatic Nucleic Acid
  misc_feature (31)..(31): n stands for inosine
gcucuuggcugaugaggccguuaggccgaancuguaga

SEQ ID NO: 14194 - RNA, 38 nt, Artificial Sequence
  Description of Artificial Sequence:  Enzymatic Nucleic Acid
  misc_feature (31)..(31): n stands for inosine
ucgcucuucugaugaggccguuaggccgaanugcugua

SEQ ID NO: 14195 - RNA, 38 nt, Artificial Sequence
  Description of Artificial Sequence:  Enzymatic Nucleic Acid
  misc_feature (31)..(31): n stands for inosine
gucgcucucugaugaggccguuaggccgaangugcugu

SEQ ID NO: 14196 - RNA, 38 nt, Artificial Sequence
  Description of Artificial Sequence:  Enzymatic Nucleic Acid
  misc_feature (31)..(31): n stands for inosine
acuccguacugaugaggccguuaggccgaanaccacac

SEQ ID NO: 14197 - RNA, 38 nt, Artificial Sequence
  Description of Artificial Sequence:  Enzymatic Nucleic Acid
  misc_feature (31)..(31): n stands for inosine
uuucccaccugaugaggccguuaggccgaancaauacu

SEQ ID NO: 14198 - RNA, 38 nt, Artificial Sequence
  Description of Artificial Sequence:  Enzymatic Nucleic Acid
  misc_feature (31)..(31): n stands for inosine
uaaggagacugaugaggccguuaggccgaanauuuccc

SEQ ID NO: 14199 - RNA, 38 nt, Artificial Sequence
  Description of Artificial Sequence:  Enzymatic Nucleic Acid
  misc_feature (31)..(31): n stands for inosine
accuaaggcugaugaggccguuaggccgaanaagauuu

SEQ ID NO: 14200 - RNA, 38 nt, Artificial Sequence
  Description of Artificial Sequence:  Enzymatic Nucleic Acid
  misc_feature (31)..(31): n stands for inosine
ccaccuaacugaugaggccguuaggccgaanagaagau

SEQ ID NO: 14201 - RNA, 38 nt, Artificial Sequence
  Description of Artificial Sequence:  Enzymatic Nucleic Acid
  misc_feature (31)..(31): n stands for inosine
cccaccuacugaugaggccguuaggccgaangagaaga

SEQ ID NO: 14202 - RNA, 38 nt, Artificial Sequence
  Description of Artificial Sequence:  Enzymatic Nucleic Acid
  misc_feature (31)..(31): n stands for inosine
ggguauggcugaugaggccguuaggccgaanacccacc

SEQ ID NO: 14203 - RNA, 38 nt, Artificial Sequence
  Description of Artificial Sequence:  Enzymatic Nucleic Acid
  misc_feature (31)..(31): n stands for inosine
cuggguaucugaugaggccguuaggccgaanagaccca

SEQ ID NO: 14204 - RNA, 38 nt, Artificial Sequence
  Description of Artificial Sequence:  Enzymatic Nucleic Acid
  misc_feature (31)..(31): n stands for inosine
ccuggguacugaugaggccguuaggccgaangagaccc

SEQ ID NO: 14205 - RNA, 38 nt, Artificial Sequence
  Description of Artificial Sequence:  Enzymatic Nucleic Acid
  misc_feature (31)..(31): n stands for inosine
uacuccugcugaugaggccguuaggccgaanuauggag

SEQ ID NO: 14206 - RNA, 38 nt, Artificial Sequence
  Description of Artificial Sequence:  Enzymatic Nucleic Acid
  misc_feature (31)..(31): n stands for inosine
guacuccucugaugaggccguuaggccgaanguaugga

SEQ ID NO: 14207 - RNA, 38 nt, Artificial Sequence
  Description of Artificial Sequence:  Enzymatic Nucleic Acid
  misc_feature (31)..(31): n stands for inosine
uguacucccugaugaggccguuaggccgaangguaugg

SEQ ID NO: 14208 - RNA, 38 nt, Artificial Sequence
  Description of Artificial Sequence:  Enzymatic Nucleic Acid
  misc_feature (31)..(31): n stands for inosine
cauccauucugaugaggccguuaggccgaanuacuccu

SEQ ID NO: 14209 - RNA, 38 nt, Artificial Sequence
  Description of Artificial Sequence:  Enzymatic Nucleic Acid
  misc_feature (31)..(31): n stands for inosine
acugcaaacugaugaggccguuaggccgaanuccucau

SEQ ID NO: 14210 - RNA, 38 nt, Artificial Sequence
  Description of Artificial Sequence:  Enzymatic Nucleic Acid
  misc_feature (31)..(31): n stands for inosine
caggcgaccugaugaggccguuaggccgaancaaaagu

SEQ ID NO: 14211 - RNA, 38 nt, Artificial Sequence
  Description of Artificial Sequence:  Enzymatic Nucleic Acid
  misc_feature (31)..(31): n stands for inosine
uucccucacugaugaggccguuaggccgaancgacugc

SEQ ID NO: 14212 - RNA, 38 nt, Artificial Sequence
  Description of Artificial Sequence:  Enzymatic Nucleic Acid
  misc_feature (31)..(31): n stands for inosine
cuucccuccugaugaggccguuaggccgaangcgacug

SEQ ID NO: 14213 - RNA, 38 nt, Artificial Sequence
  Description of Artificial Sequence:  Enzymatic Nucleic Acid
  misc_feature (31)..(31): n stands for inosine
cauccucacugaugaggccguuaggccgaanccuuccc

SEQ ID NO: 14214 - RNA, 38 nt, Artificial Sequence
  Description of Artificial Sequence:  Enzymatic Nucleic Acid
  misc_feature (31)..(31): n stands for inosine
uacucaggcugaugaggccguuaggccgaancucucau

SEQ ID NO: 14215 - RNA, 38 nt, Artificial Sequence
  Description of Artificial Sequence:  Enzymatic Nucleic Acid
  misc_feature (31)..(31): n stands for inosine
aguacucacugaugaggccguuaggccgaanagcucuc

SEQ ID NO: 14216 - RNA, 38 nt, Artificial Sequence
  Description of Artificial Sequence:  Enzymatic Nucleic Acid
  misc_feature (31)..(31): n stands for inosine
gaguacuccugaugaggccguuaggccgaangagcucu

SEQ ID NO: 14217 - RNA, 38 nt, Artificial Sequence
  Description of Artificial Sequence:  Enzymatic Nucleic Acid
  misc_feature (31)..(31): n stands for inosine
aggaguagcugaugaggccguuaggccgaanuacucag

SEQ ID NO: 14218 - RNA, 38 nt, Artificial Sequence
  Description of Artificial Sequence:  Enzymatic Nucleic Acid
  misc_feature (31)..(31): n stands for inosine
ucaggagucugaugaggccguuaggccgaanaguacuc

SEQ ID NO: 14219 - RNA, 38 nt, Artificial Sequence
  Description of Artificial Sequence:  Enzymatic Nucleic Acid
  misc_feature (31)..(31): n stands for inosine
auuucaggcugaugaggccguuaggccgaanuagagua

SEQ ID NO: 14220 - RNA, 38 nt, Artificial Sequence
  Description of Artificial Sequence:  Enzymatic Nucleic Acid
  misc_feature (31)..(31): n stands for inosine
agauuucacugaugaggccguuaggccgaanaguagag

SEQ ID NO: 14221 - RNA, 38 nt, Artificial Sequence
  Description of Artificial Sequence:  Enzymatic Nucleic Acid
  misc_feature (31)..(31): n stands for inosine
uagauuuccugaugaggccguuaggccgaangaguaga

SEQ ID NO: 14222 - RNA, 38 nt, Artificial Sequence
  Description of Artificial Sequence:  Enzymatic Nucleic Acid
  misc_feature (31)..(31): n stands for inosine
gaucugaucugaugaggccguuaggccgaanauuucag

SEQ ID NO: 14223 - RNA, 38 nt, Artificial Sequence
  Description of Artificial Sequence:  Enzymatic Nucleic Acid
  misc_feature (31)..(31): n stands for inosine
gcaugauccugaugaggccguuaggccgaanauagauu

SEQ ID NO: 14224 - RNA, 38 nt, Artificial Sequence
  Description of Artificial Sequence:  Enzymatic Nucleic Acid
  misc_feature (31)..(31): n stands for inosine
guccagcacugaugaggccguuaggccgaanaucugau

SEQ ID NO: 14225 - RNA, 38 nt, Artificial Sequence
  Description of Artificial Sequence:  Enzymatic Nucleic Acid
  misc_feature (31)..(31): n stands for inosine
agcagucccugaugaggccguuaggccgaancaugauc

SEQ ID NO: 14226 - RNA, 38 nt, Artificial Sequence
  Description of Artificial Sequence:  Enzymatic Nucleic Acid
  misc_feature (31)..(31): n stands for inosine
gugccagccugaugaggccguuaggccgaanuccagca

SEQ ID NO: 14227 - RNA, 38 nt, Artificial Sequence
  Description of Artificial Sequence:  Enzymatic Nucleic Acid
  misc_feature (31)..(31): n stands for inosine
ucugugcccugaugaggccguuaggccgaancagucca

SEQ ID NO: 14228 - RNA, 38 nt, Artificial Sequence
  Description of Artificial Sequence:  Enzymatic Nucleic Acid
  misc_feature (31)..(31): n stands for inosine
ggucucugcugaugaggccguuaggccgaanccagcag

SEQ ID NO: 14229 - RNA, 38 nt, Artificial Sequence
  Description of Artificial Sequence:  Enzymatic Nucleic Acid
  misc_feature (31)..(31): n stands for inosine
ugggucuccugaugaggccguuaggccgaanugccagc

SEQ ID NO: 14230 - RNA, 38 nt, Artificial Sequence
  Description of Artificial Sequence:  Enzymatic Nucleic Acid
  misc_feature (31)..(31): n stands for inosine
uucuuuugcugaugaggccguuaggccgaanucucugu

SEQ ID NO: 14231 - RNA, 38 nt, Artificial Sequence
  Description of Artificial Sequence:  Enzymatic Nucleic Acid
  misc_feature (31)..(31): n stands for inosine
uuucuuuucugaugaggccguuaggccgaangucucug

SEQ ID NO: 14232 - RNA, 38 nt, Artificial Sequence
  Description of Artificial Sequence:  Enzymatic Nucleic Acid
  misc_feature (31)..(31): n stands for inosine
cuuucuuucugaugaggccguuaggccgaanggucucu

SEQ ID NO: 14233 - RNA, 38 nt, Artificial Sequence
  Description of Artificial Sequence:  Enzymatic Nucleic Acid
  misc_feature (31)..(31): n stands for inosine
caaaucuucugaugaggccguuaggccgaanccuuucu

SEQ ID NO: 14234 - RNA, 38 nt, Artificial Sequence
  Description of Artificial Sequence:  Enzymatic Nucleic Acid
  misc_feature (31)..(31): n stands for inosine
gcaaaucucugaugaggccguuaggccgaangccuuuc

SEQ ID NO: 14235 - RNA, 38 nt, Artificial Sequence
  Description of Artificial Sequence:  Enzymatic Nucleic Acid
  misc_feature (31)..(31): n stands for inosine
acaaguuccugaugaggccguuaggccgaancaaaucu

SEQ ID NO: 14236 - RNA, 38 nt, Artificial Sequence
  Description of Artificial Sequence:  Enzymatic Nucleic Acid
  misc_feature (31)..(31): n stands for inosine
uuuccacacugaugaggccguuaggccgaanuucugca

SEQ ID NO: 14237 - RNA, 38 nt, Artificial Sequence
  Description of Artificial Sequence:  Enzymatic Nucleic Acid
  misc_feature (31)..(31): n stands for inosine
aaucaccucugaugaggccguuaggccgaanuuuuucc

SEQ ID NO: 14238 - RNA, 38 nt, Artificial Sequence
  Description of Artificial Sequence:  Enzymatic Nucleic Acid
  misc_feature (31)..(31): n stands for inosine
uugcuugacugaugaggccguuaggccgaancaaauca

SEQ ID NO: 14239 - RNA, 38 nt, Artificial Sequence
  Description of Artificial Sequence:  Enzymatic Nucleic Acid
  misc_feature (31)..(31): n stands for inosine
cauuugcucugaugaggccguuaggccgaanaagcaaa

SEQ ID NO: 14240 - RNA, 38 nt, Artificial Sequence
  Description of Artificial Sequence:  Enzymatic Nucleic Acid
  misc_feature (31)..(31): n stands for inosine
uguacauucugaugaggccguuaggccgaancuugaag

SEQ ID NO: 14241 - RNA, 38 nt, Artificial Sequence
  Description of Artificial Sequence:  Enzymatic Nucleic Acid
  misc_feature (31)..(31): n stands for inosine
cauccugucugaugaggccguuaggccgaanuacauuu

SEQ ID NO: 14242 - RNA, 38 nt, Artificial Sequence
  Description of Artificial Sequence:  Enzymatic Nucleic Acid
  misc_feature (31)..(31): n stands for inosine
uaccaucccugaugaggccguuaggccgaanuuguaca

SEQ ID NO: 14243 - RNA, 38 nt, Artificial Sequence
  Description of Artificial Sequence:  Enzymatic Nucleic Acid
  misc_feature (31)..(31): n stands for inosine
ugggaugucugaugaggccguuaggccgaanucuuuac

SEQ ID NO: 14244 - RNA, 38 nt, Artificial Sequence
  Description of Artificial Sequence:  Enzymatic Nucleic Acid
  misc_feature (31)..(31): n stands for inosine
gauugggacugaugaggccguuaggccgaanuagucuu

SEQ ID NO: 14245 - RNA, 38 nt, Artificial Sequence
  Description of Artificial Sequence:  Enzymatic Nucleic Acid
  misc_feature (31)..(31): n stands for inosine
auugauugcugaugaggccguuaggccgaanauguagu

SEQ ID NO: 14246 - RNA, 38 nt, Artificial Sequence
  Description of Artificial Sequence:  Enzymatic Nucleic Acid
  misc_feature (31)..(31): n stands for inosine
cauugauucugaugaggccguuaggccgaangauguag

SEQ ID NO: 14247 - RNA, 38 nt, Artificial Sequence
  Description of Artificial Sequence:  Enzymatic Nucleic Acid
  misc_feature (31)..(31): n stands for inosine
gcauugaucugaugaggccguuaggccgaanggaugua

SEQ ID NO: 14248 - RNA, 38 nt, Artificial Sequence
  Description of Artificial Sequence:  Enzymatic Nucleic Acid
  misc_feature (31)..(31): n stands for inosine
uauggcaucugaugaggccguuaggccgaanauuggga

SEQ ID NO: 14249 - RNA, 38 nt, Artificial Sequence
  Description of Artificial Sequence:  Enzymatic Nucleic Acid
  misc_feature (31)..(31): n stands for inosine
gucaguaucugaugaggccguuaggccgaancauugau

SEQ ID NO: 14250 - RNA, 38 nt, Artificial Sequence
  Description of Artificial Sequence:  Enzymatic Nucleic Acid
  misc_feature (31)..(31): n stands for inosine
ugucaguacugaugaggccguuaggccgaangcauuga

SEQ ID NO: 14251 - RNA, 38 nt, Artificial Sequence
  Description of Artificial Sequence:  Enzymatic Nucleic Acid
  misc_feature (31)..(31): n stands for inosine
uuccuguccugaugaggccguuaggccgaanuauggca

SEQ ID NO: 14252 - RNA, 38 nt, Artificial Sequence
  Description of Artificial Sequence:  Enzymatic Nucleic Acid
  misc_feature (31)..(31): n stands for inosine
cuauuucccugaugaggccguuaggccgaanucaguau

SEQ ID NO: 14253 - RNA, 38 nt, Artificial Sequence
  Description of Artificial Sequence:  Enzymatic Nucleic Acid
  misc_feature (31)..(31): n stands for inosine
guugaguacugaugaggccguuaggccgaanuaaaccc

SEQ ID NO: 14254 - RNA, 38 nt, Artificial Sequence
  Description of Artificial Sequence:  Enzymatic Nucleic Acid
  misc_feature (31)..(31): n stands for inosine
aggaguugcugaugaggccguuaggccgaanuauguaa

SEQ ID NO: 14255 - RNA, 38 nt, Artificial Sequence
  Description of Artificial Sequence:  Enzymatic Nucleic Acid
  misc_feature (31)..(31): n stands for inosine
gcaggagucugaugaggccguuaggccgaanaguaugu

SEQ ID NO: 14256 - RNA, 38 nt, Artificial Sequence
  Description of Artificial Sequence:  Enzymatic Nucleic Acid
  misc_feature (31)..(31): n stands for inosine
aaggcaggcugaugaggccguuaggccgaanuugagua

SEQ ID NO: 14257 - RNA, 38 nt, Artificial Sequence
  Description of Artificial Sequence:  Enzymatic Nucleic Acid
  misc_feature (31)..(31): n stands for inosine
agaaggcacugaugaggccguuaggccgaanaguugag

SEQ ID NO: 14258 - RNA, 38 nt, Artificial Sequence
  Description of Artificial Sequence:  Enzymatic Nucleic Acid
  misc_feature (31)..(31): n stands for inosine
gagaaggccugaugaggccguuaggccgaangaguuga

SEQ ID NO: 14259 - RNA, 38 nt, Artificial Sequence
  Description of Artificial Sequence:  Enzymatic Nucleic Acid
  misc_feature (31)..(31): n stands for inosine
ucagagaacugaugaggccguuaggccgaancaggagu

SEQ ID NO: 14260 - RNA, 38 nt, Artificial Sequence
  Description of Artificial Sequence:  Enzymatic Nucleic Acid
  misc_feature (31)..(31): n stands for inosine
cucagagacugaugaggccguuaggccgaangcaggag

SEQ ID NO: 14261 - RNA, 38 nt, Artificial Sequence
  Description of Artificial Sequence:  Enzymatic Nucleic Acid
  misc_feature (31)..(31): n stands for inosine
guccucagcugaugaggccguuaggccgaanaaggcag

SEQ ID NO: 14262 - RNA, 38 nt, Artificial Sequence
  Description of Artificial Sequence:  Enzymatic Nucleic Acid
  misc_feature (31)..(31): n stands for inosine
aaguccuccugaugaggccguuaggccgaanagaaggc

SEQ ID NO: 14263 - RNA, 38 nt, Artificial Sequence
  Description of Artificial Sequence:  Enzymatic Nucleic Acid
  misc_feature (31)..(31): n stands for inosine
cuugaagacugaugaggccguuaggccgaanuccucag

SEQ ID NO: 14264 - RNA, 38 nt, Artificial Sequence
  Description of Artificial Sequence:  Enzymatic Nucleic Acid
  misc_feature (31)..(31): n stands for inosine
uuccuugacugaugaggccguuaggccgaanaaguccu

SEQ ID NO: 14265 - RNA, 38 nt, Artificial Sequence
  Description of Artificial Sequence:  Enzymatic Nucleic Acid
  misc_feature (31)..(31): n stands for inosine
acuuuccucugaugaggccguuaggccgaanaagaagu

SEQ ID NO: 14266 - RNA, 38 nt, Artificial Sequence
  Description of Artificial Sequence:  Enzymatic Nucleic Acid
  misc_feature (31)..(31): n stands for inosine
uucggagccugaugaggccguuaggccgaanaaauacu

SEQ ID NO: 14267 - RNA, 38 nt, Artificial Sequence
  Description of Artificial Sequence:  Enzymatic Nucleic Acid
  misc_feature (31)..(31): n stands for inosine
aacuucggcugaugaggccguuaggccgaancugaaau

SEQ ID NO: 14268 - RNA, 38 nt, Artificial Sequence
  Description of Artificial Sequence:  Enzymatic Nucleic Acid
  misc_feature (31)..(31): n stands for inosine
uaaacuuccugaugaggccguuaggccgaanagcugaa

SEQ ID NO: 14269 - RNA, 38 nt, Artificial Sequence
  Description of Artificial Sequence:  Enzymatic Nucleic Acid
  misc_feature (31)..(31): n stands for inosine
gagcuucccugaugaggccguuaggccgaanaauuaaa

SEQ ID NO: 14270 - RNA, 38 nt, Artificial Sequence
  Description of Artificial Sequence:  Enzymatic Nucleic Acid
  misc_feature (31)..(31): n stands for inosine
aucaucagcugaugaggccguuaggccgaancuuccug

SEQ ID NO: 14271 - RNA, 38 nt, Artificial Sequence
  Description of Artificial Sequence:  Enzymatic Nucleic Acid
  misc_feature (31)..(31): n stands for inosine
acaucauccugaugaggccguuaggccgaanagcuucc

SEQ ID NO: 14272 - RNA, 38 nt, Artificial Sequence
  Description of Artificial Sequence:  Enzymatic Nucleic Acid
  misc_feature (31)..(31): n stands for inosine
uacauauccugaugaggccguuaggccgaanacaucau

SEQ ID NO: 14273 - RNA, 38 nt, Artificial Sequence
  Description of Artificial Sequence:  Enzymatic Nucleic Acid
  misc_feature (31)..(31): n stands for inosine
aacuugaacugaugaggccguuaggccgaancauuuac

SEQ ID NO: 14274 - RNA, 38 nt, Artificial Sequence
  Description of Artificial Sequence:  Enzymatic Nucleic Acid
  misc_feature (31)..(31): n stands for inosine
caugaacucugaugaggccguuaggccgaanaaagcau

SEQ ID NO: 14275 - RNA, 38 nt, Artificial Sequence
  Description of Artificial Sequence:  Enzymatic Nucleic Acid
  misc_feature (31)..(31): n stands for inosine
caggcucacugaugaggccguuaggccgaanaacuuga

SEQ ID NO: 14276 - RNA, 38 nt, Artificial Sequence
  Description of Artificial Sequence:  Enzymatic Nucleic Acid
  misc_feature (31)..(31): n stands for inosine
ucuuuccacugaugaggccguuaggccgaancucauga

SEQ ID NO: 14277 - RNA, 38 nt, Artificial Sequence
  Description of Artificial Sequence:  Enzymatic Nucleic Acid
  misc_feature (31)..(31): n stands for inosine
uucuuucccugaugaggccguuaggccgaangcucaug

SEQ ID NO: 14278 - RNA, 38 nt, Artificial Sequence
  Description of Artificial Sequence:  Enzymatic Nucleic Acid
  misc_feature (31)..(31): n stands for inosine
aaagguuucugaugaggccguuaggccgaanauucuuu

SEQ ID NO: 14279 - RNA, 38 nt, Artificial Sequence
  Description of Artificial Sequence:  Enzymatic Nucleic Acid
  misc_feature (31)..(31): n stands for inosine
ucuucaaacugaugaggccguuaggccgaanuuuugau

SEQ ID NO: 14280 - RNA, 38 nt, Artificial Sequence
  Description of Artificial Sequence:  Enzymatic Nucleic Acid
  misc_feature (31)..(31): n stands for inosine
uucuucaacugaugaggccguuaggccgaanguuuuga

SEQ ID NO: 14281 - RNA, 38 nt, Artificial Sequence
  Description of Artificial Sequence:  Enzymatic Nucleic Acid
  misc_feature (31)..(31): n stands for inosine
ucgguaaacugaugaggccguuaggccgaanuucuuca

SEQ ID NO: 14282 - RNA, 38 nt, Artificial Sequence
  Description of Artificial Sequence:  Enzymatic Nucleic Acid
  misc_feature (31)..(31): n stands for inosine
uggcauuccugaugaggccguuaggccgaanuaaaagu

SEQ ID NO: 14283 - RNA, 38 nt, Artificial Sequence
  Description of Artificial Sequence:  Enzymatic Nucleic Acid
  misc_feature (31)..(31): n stands for inosine
auggaggucugaugaggccguuaggccgaancauucgg

SEQ ID NO: 14284 - RNA, 38 nt, Artificial Sequence
  Description of Artificial Sequence:  Enzymatic Nucleic Acid
  misc_feature (31)..(31): n stands for inosine
cauggaggcugaugaggccguuaggccgaangcauucg

SEQ ID NO: 14285 - RNA, 38 nt, Artificial Sequence
  Description of Artificial Sequence:  Enzymatic Nucleic Acid
  misc_feature (31)..(31): n stands for inosine
aacauggacugaugaggccguuaggccgaanuggcauu

SEQ ID NO: 14286 - RNA, 38 nt, Artificial Sequence
  Description of Artificial Sequence:  Enzymatic Nucleic Acid
  misc_feature (31)..(31): n stands for inosine
aaacauggcugaugaggccguuaggccgaanguggcau

SEQ ID NO: 14287 - RNA, 38 nt, Artificial Sequence
  Description of Artificial Sequence:  Enzymatic Nucleic Acid
  misc_feature (31)..(31): n stands for inosine
ucaaacaucugaugaggccguuaggccgaanagguggc

SEQ ID NO: 14288 - RNA, 38 nt, Artificial Sequence
  Description of Artificial Sequence:  Enzymatic Nucleic Acid
  misc_feature (31)..(31): n stands for inosine
aucaaacacugaugaggccguuaggccgaangaggugg

SEQ ID NO: 14289 - RNA, 38 nt, Artificial Sequence
  Description of Artificial Sequence:  Enzymatic Nucleic Acid
  misc_feature (31)..(31): n stands for inosine
gcccuggucugaugaggccguuaggccgaanucaucaa

SEQ ID NO: 14290 - RNA, 38 nt, Artificial Sequence
  Description of Artificial Sequence:  Enzymatic Nucleic Acid
  misc_feature (31)..(31): n stands for inosine
gucgcccucugaugaggccguuaggccgaanuagucau

SEQ ID NO: 14291 - RNA, 38 nt, Artificial Sequence
  Description of Artificial Sequence:  Enzymatic Nucleic Acid
  misc_feature (31)..(31): n stands for inosine
ugucgccccugaugaggccguuaggccgaanguaguca

SEQ ID NO: 14292 - RNA, 38 nt, Artificial Sequence
  Description of Artificial Sequence:  Enzymatic Nucleic Acid
  misc_feature (31)..(31): n stands for inosine
agugcugccugaugaggccguuaggccgaanucgcccu

SEQ ID NO: 14293 - RNA, 38 nt, Artificial Sequence
  Description of Artificial Sequence:  Enzymatic Nucleic Acid
  misc_feature (31)..(31): n stands for inosine
cagagugccugaugaggccguuaggccgaancugucgc

SEQ ID NO: 14294 - RNA, 38 nt, Artificial Sequence
  Description of Artificial Sequence:  Enzymatic Nucleic Acid
  misc_feature (31)..(31): n stands for inosine
caacagagcugaugaggccguuaggccgaancugcugu

SEQ ID NO: 14295 - RNA, 38 nt, Artificial Sequence
  Description of Artificial Sequence:  Enzymatic Nucleic Acid
  misc_feature (31)..(31): n stands for inosine
gccaacagcugaugaggccguuaggccgaanugcugcu

SEQ ID NO: 14296 - RNA, 38 nt, Artificial Sequence
  Description of Artificial Sequence:  Enzymatic Nucleic Acid
  misc_feature (31)..(31): n stands for inosine
aggccaaccugaugaggccguuaggccgaanagugcug

SEQ ID NO: 14297 - RNA, 38 nt, Artificial Sequence
  Description of Artificial Sequence:  Enzymatic Nucleic Acid
  misc_feature (31)..(31): n stands for inosine
augggagacugaugaggccguuaggccgaanccaacag

SEQ ID NO: 14298 - RNA, 38 nt, Artificial Sequence
  Description of Artificial Sequence:  Enzymatic Nucleic Acid
  misc_feature (31)..(31): n stands for inosine
caugggagcugaugaggccguuaggccgaangccaaca

SEQ ID NO: 14299 - RNA, 38 nt, Artificial Sequence
  Description of Artificial Sequence:  Enzymatic Nucleic Acid
  misc_feature (31)..(31): n stands for inosine
agcaugggcugaugaggccguuaggccgaanaggccaa

SEQ ID NO: 14300 - RNA, 38 nt, Artificial Sequence
  Description of Artificial Sequence:  Enzymatic Nucleic Acid
  misc_feature (31)..(31): n stands for inosine
ucagcaugcugaugaggccguuaggccgaanagaggcc

SEQ ID NO: 14301 - RNA, 38 nt, Artificial Sequence
  Description of Artificial Sequence:  Enzymatic Nucleic Acid
  misc_feature (31)..(31): n stands for inosine
uucagcaucugaugaggccguuaggccgaangagaggc

SEQ ID NO: 14302 - RNA, 38 nt, Artificial Sequence
  Description of Artificial Sequence:  Enzymatic Nucleic Acid
  misc_feature (31)..(31): n stands for inosine
cuucagcacugaugaggccguuaggccgaanggagagg

SEQ ID NO: 14303 - RNA, 38 nt, Artificial Sequence
  Description of Artificial Sequence:  Enzymatic Nucleic Acid
  misc_feature (31)..(31): n stands for inosine
agcgcuuccugaugaggccguuaggccgaancauggga

SEQ ID NO: 14304 - RNA, 38 nt, Artificial Sequence
  Description of Artificial Sequence:  Enzymatic Nucleic Acid
  misc_feature (31)..(31): n stands for inosine
ccaggugacugaugaggccguuaggccgaancgcuuca

SEQ ID NO: 14305 - RNA, 38 nt, Artificial Sequence
  Description of Artificial Sequence:  Enzymatic Nucleic Acid
  misc_feature (31)..(31): n stands for inosine
aguccaggcugaugaggccguuaggccgaanaagcgcu

SEQ ID NO: 14306 - RNA, 38 nt, Artificial Sequence
  Description of Artificial Sequence:  Enzymatic Nucleic Acid
  misc_feature (31)..(31): n stands for inosine
ucaguccacugaugaggccguuaggccgaanugaagcg

SEQ ID NO: 14307 - RNA, 38 nt, Artificial Sequence
  Description of Artificial Sequence:  Enzymatic Nucleic Acid
  misc_feature (31)..(31): n stands for inosine
gucagucccugaugaggccguuaggccgaangugaagc

SEQ ID NO: 14308 - RNA, 38 nt, Artificial Sequence
  Description of Artificial Sequence:  Enzymatic Nucleic Acid
  misc_feature (31)..(31): n stands for inosine
uugcuguccugaugaggccguuaggccgaanuccaggu

SEQ ID NO: 14309 - RNA, 38 nt, Artificial Sequence
  Description of Artificial Sequence:  Enzymatic Nucleic Acid
  misc_feature (31)..(31): n stands for inosine
ggguuugccugaugaggccguuaggccgaanucagucc

SEQ ID NO: 14310 - RNA, 38 nt, Artificial Sequence
  Description of Artificial Sequence:  Enzymatic Nucleic Acid
  misc_feature (31)..(31): n stands for inosine
cuuggguucugaugaggccguuaggccgaancugucag

SEQ ID NO: 14311 - RNA, 38 nt, Artificial Sequence
  Description of Artificial Sequence:  Enzymatic Nucleic Acid
  misc_feature (31)..(31): n stands for inosine
aggccuugcugaugaggccguuaggccgaanuuugcug

SEQ ID NO: 14312 - RNA, 38 nt, Artificial Sequence
  Description of Artificial Sequence:  Enzymatic Nucleic Acid
  misc_feature (31)..(31): n stands for inosine
gaggccuucugaugaggccguuaggccgaanguuugcu

SEQ ID NO: 14313 - RNA, 38 nt, Artificial Sequence
  Description of Artificial Sequence:  Enzymatic Nucleic Acid
  misc_feature (31)..(31): n stands for inosine
cgaggccucugaugaggccguuaggccgaangguuugc

SEQ ID NO: 14314 - RNA, 38 nt, Artificial Sequence
  Description of Artificial Sequence:  Enzymatic Nucleic Acid
  misc_feature (31)..(31): n stands for inosine
uugagcgacugaugaggccguuaggccgaanccuuggg

SEQ ID NO: 14315 - RNA, 38 nt, Artificial Sequence
  Description of Artificial Sequence:  Enzymatic Nucleic Acid
  misc_feature (31)..(31): n stands for inosine
cuugagcgcugaugaggccguuaggccgaangccuugg

SEQ ID NO: 14316 - RNA, 38 nt, Artificial Sequence
  Description of Artificial Sequence:  Enzymatic Nucleic Acid
  misc_feature (31)..(31): n stands for inosine
caaucuugcugaugaggccguuaggccgaancgaggcc

SEQ ID NO: 14317 - RNA, 38 nt, Artificial Sequence
  Description of Artificial Sequence:  Enzymatic Nucleic Acid
  misc_feature (31)..(31): n stands for inosine
gucaaucucugaugaggccguuaggccgaanagcgagg

SEQ ID NO: 14318 - RNA, 38 nt, Artificial Sequence
  Description of Artificial Sequence:  Enzymatic Nucleic Acid
  misc_feature (31)..(31): n stands for inosine
uacucucacugaugaggccguuaggccgaanucaaucu

SEQ ID NO: 14319 - RNA, 38 nt, Artificial Sequence
  Description of Artificial Sequence:  Enzymatic Nucleic Acid
  misc_feature (31)..(31): n stands for inosine
cuuuuacucugaugaggccguuaggccgaanuuacucu

SEQ ID NO: 14320 - RNA, 38 nt, Artificial Sequence
  Description of Artificial Sequence:  Enzymatic Nucleic Acid
  misc_feature (31)..(31): n stands for inosine
acuuuuaccugaugaggccguuaggccgaanguuacuc

SEQ ID NO: 14321 - RNA, 38 nt, Artificial Sequence
  Description of Artificial Sequence:  Enzymatic Nucleic Acid
  misc_feature (31)..(31): n stands for inosine
caucagaccugaugaggccguuaggccgaanccccgac

SEQ ID NO: 14322 - RNA, 38 nt, Artificial Sequence
  Description of Artificial Sequence:  Enzymatic Nucleic Acid
  misc_feature (31)..(31): n stands for inosine
cugacauccugaugaggccguuaggccgaanacagccc

SEQ ID NO: 14323 - RNA, 38 nt, Artificial Sequence
  Description of Artificial Sequence:  Enzymatic Nucleic Acid
  misc_feature (31)..(31): n stands for inosine
gggccugccugaugaggccguuaggccgaanacaucag

SEQ ID NO: 14324 - RNA, 38 nt, Artificial Sequence
  Description of Artificial Sequence:  Enzymatic Nucleic Acid
  misc_feature (31)..(31): n stands for inosine
acugggcccugaugaggccguuaggccgaancugacau

SEQ ID NO: 14325 - RNA, 38 nt, Artificial Sequence
  Description of Artificial Sequence:  Enzymatic Nucleic Acid
  misc_feature (31)..(31): n stands for inosine
agaaacugcugaugaggccguuaggccgaanccugcug

SEQ ID NO: 14326 - RNA, 38 nt, Artificial Sequence
  Description of Artificial Sequence:  Enzymatic Nucleic Acid
  misc_feature (31)..(31): n stands for inosine
cagaaacucugaugaggccguuaggccgaangccugcu

SEQ ID NO: 14327 - RNA, 38 nt, Artificial Sequence
  Description of Artificial Sequence:  Enzymatic Nucleic Acid
  misc_feature (31)..(31): n stands for inosine
gcagaaaccugaugaggccguuaggccgaanggccugc

SEQ ID NO: 14328 - RNA, 38 nt, Artificial Sequence
  Description of Artificial Sequence:  Enzymatic Nucleic Acid
  misc_feature (31)..(31): n stands for inosine
ggaauggccugaugaggccguuaggccgaanaaacugg

SEQ ID NO: 14329 - RNA, 38 nt, Artificial Sequence
  Description of Artificial Sequence:  Enzymatic Nucleic Acid
  misc_feature (31)..(31): n stands for inosine
gcuggaaucugaugaggccguuaggccgaancagaaac

SEQ ID NO: 14330 - RNA, 38 nt, Artificial Sequence
  Description of Artificial Sequence:  Enzymatic Nucleic Acid
  misc_feature (31)..(31): n stands for inosine
agcuggaacugaugaggccguuaggccgaangcagaaa

SEQ ID NO: 14331 - RNA, 38 nt, Artificial Sequence
  Description of Artificial Sequence:  Enzymatic Nucleic Acid
  misc_feature (31)..(31): n stands for inosine
ccacagcucugaugaggccguuaggccgaanaauggca

SEQ ID NO: 14332 - RNA, 38 nt, Artificial Sequence
  Description of Artificial Sequence:  Enzymatic Nucleic Acid
  misc_feature (31)..(31): n stands for inosine
cccacagccugaugaggccguuaggccgaangaauggc

SEQ ID NO: 14333 - RNA, 38 nt, Artificial Sequence
  Description of Artificial Sequence:  Enzymatic Nucleic Acid
  misc_feature (31)..(31): n stands for inosine
gugcccaccugaugaggccguuaggccgaancuggaau

SEQ ID NO: 14334 - RNA, 38 nt, Artificial Sequence
  Description of Artificial Sequence:  Enzymatic Nucleic Acid
  misc_feature (31)..(31): n stands for inosine
cgcugacgcugaugaggccguuaggccgaancccacag

SEQ ID NO: 14335 - RNA, 38 nt, Artificial Sequence
  Description of Artificial Sequence:  Enzymatic Nucleic Acid
  misc_feature (31)..(31): n stands for inosine
gccuucgccugaugaggccguuaggccgaanacgugcc

SEQ ID NO: 14336 - RNA, 38 nt, Artificial Sequence
  Description of Artificial Sequence:  Enzymatic Nucleic Acid
  misc_feature (31)..(31): n stands for inosine
ccugcgcucugaugaggccguuaggccgaanccuucgc

SEQ ID NO: 14337 - RNA, 38 nt, Artificial Sequence
  Description of Artificial Sequence:  Enzymatic Nucleic Acid
  misc_feature (31)..(31): n stands for inosine
ggugaacccugaugaggccguuaggccgaancgcuugc

SEQ ID NO: 14338 - RNA, 38 nt, Artificial Sequence
  Description of Artificial Sequence:  Enzymatic Nucleic Acid
  misc_feature (31)..(31): n stands for inosine
gucguaggcugaugaggccguuaggccgaanaaccugc

SEQ ID NO: 14339 - RNA, 38 nt, Artificial Sequence
  Description of Artificial Sequence:  Enzymatic Nucleic Acid
  misc_feature (31)..(31): n stands for inosine
uggucguacugaugaggccguuaggccgaanugaaccu

SEQ ID NO: 14340 - RNA, 38 nt, Artificial Sequence
  Description of Artificial Sequence:  Enzymatic Nucleic Acid
  misc_feature (31)..(31): n stands for inosine
guggucgucugaugaggccguuaggccgaangugaacc

SEQ ID NO: 14341 - RNA, 38 nt, Artificial Sequence
  Description of Artificial Sequence:  Enzymatic Nucleic Acid
  misc_feature (31)..(31): n stands for inosine
cucagcgucugaugaggccguuaggccgaanucguagg

SEQ ID NO: 14342 - RNA, 38 nt, Artificial Sequence
  Description of Artificial Sequence:  Enzymatic Nucleic Acid
  misc_feature (31)..(31): n stands for inosine
gcucagcgcugaugaggccguuaggccgaangucguag

SEQ ID NO: 14343 - RNA, 38 nt, Artificial Sequence
  Description of Artificial Sequence:  Enzymatic Nucleic Acid
  misc_feature (31)..(31): n stands for inosine
uccagcuccugaugaggccguuaggccgaancgugguc

SEQ ID NO: 14344 - RNA, 38 nt, Artificial Sequence
  Description of Artificial Sequence:  Enzymatic Nucleic Acid
  misc_feature (31)..(31): n stands for inosine
uccuuucccugaugaggccguuaggccgaancucagcg

SEQ ID NO: 14345 - RNA, 38 nt, Artificial Sequence
  Description of Artificial Sequence:  Enzymatic Nucleic Acid
  misc_feature (31)..(31): n stands for inosine
cggggagccugaugaggccguuaggccgaancacgcga

SEQ ID NO: 14346 - RNA, 38 nt, Artificial Sequence
  Description of Artificial Sequence:  Enzymatic Nucleic Acid
  misc_feature (31)..(31): n stands for inosine
gggcggggcugaugaggccguuaggccgaancagcacg

SEQ ID NO: 14347 - RNA, 38 nt, Artificial Sequence
  Description of Artificial Sequence:  Enzymatic Nucleic Acid
  misc_feature (31)..(31): n stands for inosine
gggggcggcugaugaggccguuaggccgaanagcagca

SEQ ID NO: 14348 - RNA, 38 nt, Artificial Sequence
  Description of Artificial Sequence:  Enzymatic Nucleic Acid
  misc_feature (31)..(31): n stands for inosine
ugggggcgcugaugaggccguuaggccgaangagcagc

SEQ ID NO: 14349 - RNA, 38 nt, Artificial Sequence
  Description of Artificial Sequence:  Enzymatic Nucleic Acid
  misc_feature (31)..(31): n stands for inosine
cugggggccugaugaggccguuaggccgaanggagcag

SEQ ID NO: 14350 - RNA, 38 nt, Artificial Sequence
  Description of Artificial Sequence:  Enzymatic Nucleic Acid
  misc_feature (31)..(31): n stands for inosine
agucugggcugaugaggccguuaggccgaancggggag

SEQ ID NO: 14351 - RNA, 38 nt, Artificial Sequence
  Description of Artificial Sequence:  Enzymatic Nucleic Acid
  misc_feature (31)..(31): n stands for inosine
uagucuggcugaugaggccguuaggccgaangcgggga

SEQ ID NO: 14352 - RNA, 38 nt, Artificial Sequence
  Description of Artificial Sequence:  Enzymatic Nucleic Acid
  misc_feature (31)..(31): n stands for inosine
guagucugcugaugaggccguuaggccgaanggcgggg

SEQ ID NO: 14353 - RNA, 38 nt, Artificial Sequence
  Description of Artificial Sequence:  Enzymatic Nucleic Acid
  misc_feature (31)..(31): n stands for inosine
uguagucucugaugaggccguuaggccgaangggcggg

SEQ ID NO: 14354 - RNA, 38 nt, Artificial Sequence
  Description of Artificial Sequence:  Enzymatic Nucleic Acid
  misc_feature (31)..(31): n stands for inosine
uuguaguccugaugaggccguuaggccgaanggggcgg

SEQ ID NO: 14355 - RNA, 38 nt, Artificial Sequence
  Description of Artificial Sequence:  Enzymatic Nucleic Acid
  misc_feature (31)..(31): n stands for inosine
cgaguugucugaugaggccguuaggccgaanucugggg

SEQ ID NO: 14356 - RNA, 38 nt, Artificial Sequence
  Description of Artificial Sequence:  Enzymatic Nucleic Acid
  misc_feature (31)..(31): n stands for inosine
caccgagucugaugaggccguuaggccgaanuagucug

SEQ ID NO: 14357 - RNA, 38 nt, Artificial Sequence
  Description of Artificial Sequence:  Enzymatic Nucleic Acid
  misc_feature (31)..(31): n stands for inosine
gaccaccgcugaugaggccguuaggccgaanuuguagu

SEQ ID NO: 14358 - RNA, 38 nt, Artificial Sequence
  Description of Artificial Sequence:  Enzymatic Nucleic Acid
  misc_feature (31)..(31): n stands for inosine
ggaguacacugaugaggccguuaggccgaanaccaccg

SEQ ID NO: 14359 - RNA, 38 nt, Artificial Sequence
  Description of Artificial Sequence:  Enzymatic Nucleic Acid
  misc_feature (31)..(31): n stands for inosine
uggaguaccugaugaggccguuaggccgaangaccacc

SEQ ID NO: 14360 - RNA, 38 nt, Artificial Sequence
  Description of Artificial Sequence:  Enzymatic Nucleic Acid
  misc_feature (31)..(31): n stands for inosine
ugggguggcugaugaggccguuaggccgaanuacagga

SEQ ID NO: 14361 - RNA, 38 nt, Artificial Sequence
  Description of Artificial Sequence:  Enzymatic Nucleic Acid
  misc_feature (31)..(31): n stands for inosine
gguggggucugaugaggccguuaggccgaanaguacag

SEQ ID NO: 14362 - RNA, 38 nt, Artificial Sequence
  Description of Artificial Sequence:  Enzymatic Nucleic Acid
  misc_feature (31)..(31): n stands for inosine
ggguggggcugaugaggccguuaggccgaangaguaca

SEQ ID NO: 14363 - RNA, 38 nt, Artificial Sequence
  Description of Artificial Sequence:  Enzymatic Nucleic Acid
  misc_feature (31)..(31): n stands for inosine
auggguggcugaugaggccguuaggccgaanuggagua

SEQ ID NO: 14364 - RNA, 38 nt, Artificial Sequence
  Description of Artificial Sequence:  Enzymatic Nucleic Acid
  misc_feature (31)..(31): n stands for inosine
gaugggugcugaugaggccguuaggccgaanguggagu

SEQ ID NO: 14365 - RNA, 38 nt, Artificial Sequence
  Description of Artificial Sequence:  Enzymatic Nucleic Acid
  misc_feature (31)..(31): n stands for inosine
agaugggucugaugaggccguuaggccgaangguggag

SEQ ID NO: 14366 - RNA, 38 nt, Artificial Sequence
  Description of Artificial Sequence:  Enzymatic Nucleic Acid
  misc_feature (31)..(31): n stands for inosine
uagaugggcugaugaggccguuaggccgaangggugga

SEQ ID NO: 14367 - RNA, 38 nt, Artificial Sequence
  Description of Artificial Sequence:  Enzymatic Nucleic Acid
  misc_feature (31)..(31): n stands for inosine
ucuagaugcugaugaggccguuaggccgaanuggggug

SEQ ID NO: 14368 - RNA, 38 nt, Artificial Sequence
  Description of Artificial Sequence:  Enzymatic Nucleic Acid
  misc_feature (31)..(31): n stands for inosine
cucuagaucugaugaggccguuaggccgaanguggggu

SEQ ID NO: 14369 - RNA, 38 nt, Artificial Sequence
  Description of Artificial Sequence:  Enzymatic Nucleic Acid
  misc_feature (31)..(31): n stands for inosine
acucuagacugaugaggccguuaggccgaanggugggg

SEQ ID NO: 14370 - RNA, 38 nt, Artificial Sequence
  Description of Artificial Sequence:  Enzymatic Nucleic Acid
  misc_feature (31)..(31): n stands for inosine
caaacucucugaugaggccguuaggccgaanaugggug

SEQ ID NO: 14371 - RNA, 38 nt, Artificial Sequence
  Description of Artificial Sequence:  Enzymatic Nucleic Acid
  misc_feature (31)..(31): n stands for inosine
aggcuucgcugaugaggccguuaggccgaanucaaacu

SEQ ID NO: 14372 - RNA, 38 nt, Artificial Sequence
  Description of Artificial Sequence:  Enzymatic Nucleic Acid
  misc_feature (31)..(31): n stands for inosine
agaaauaacugaugaggccguuaggccgaancuucgug

SEQ ID NO: 14373 - RNA, 38 nt, Artificial Sequence
  Description of Artificial Sequence:  Enzymatic Nucleic Acid
  misc_feature (31)..(31): n stands for inosine
uagaaauacugaugaggccguuaggccgaangcuucgu

SEQ ID NO: 14374 - RNA, 38 nt, Artificial Sequence
  Description of Artificial Sequence:  Enzymatic Nucleic Acid
  misc_feature (31)..(31): n stands for inosine
gugcuucucugaugaggccguuaggccgaanaaauaag

SEQ ID NO: 14375 - RNA, 38 nt, Artificial Sequence
  Description of Artificial Sequence:  Enzymatic Nucleic Acid
  misc_feature (31)..(31): n stands for inosine
uacacaugcugaugaggccguuaggccgaancuucuag

SEQ ID NO: 14376 - RNA, 38 nt, Artificial Sequence
  Description of Artificial Sequence:  Enzymatic Nucleic Acid
  misc_feature (31)..(31): n stands for inosine
aauacacacugaugaggccguuaggccgaanugcuucu

SEQ ID NO: 14377 - RNA, 38 nt, Artificial Sequence
  Description of Artificial Sequence:  Enzymatic Nucleic Acid
  misc_feature (31)..(31): n stands for inosine
uuccugggcugaugaggccguuaggccgaanuauaaau

SEQ ID NO: 14378 - RNA, 38 nt, Artificial Sequence
  Description of Artificial Sequence:  Enzymatic Nucleic Acid
  misc_feature (31)..(31): n stands for inosine
uuuccuggcugaugaggccguuaggccgaanguauaaa

SEQ ID NO: 14379 - RNA, 38 nt, Artificial Sequence
  Description of Artificial Sequence:  Enzymatic Nucleic Acid
  misc_feature (31)..(31): n stands for inosine
guuuccugcugaugaggccguuaggccgaangguauaa

SEQ ID NO: 14380 - RNA, 38 nt, Artificial Sequence
  Description of Artificial Sequence:  Enzymatic Nucleic Acid
  misc_feature (31)..(31): n stands for inosine
aguuuccucugaugaggccguuaggccgaanggguaua

SEQ ID NO: 14381 - RNA, 38 nt, Artificial Sequence
  Description of Artificial Sequence:  Enzymatic Nucleic Acid
  misc_feature (31)..(31): n stands for inosine
uaguuucccugaugaggccguuaggccgaangggguau

SEQ ID NO: 14382 - RNA, 38 nt, Artificial Sequence
  Description of Artificial Sequence:  Enzymatic Nucleic Acid
  misc_feature (31)..(31): n stands for inosine
caaaagcucugaugaggccguuaggccgaanuuuccug

SEQ ID NO: 14383 - RNA, 38 nt, Artificial Sequence
  Description of Artificial Sequence:  Enzymatic Nucleic Acid
  misc_feature (31)..(31): n stands for inosine
cuggcaaacugaugaggccguuaggccgaancuaguuu

SEQ ID NO: 14384 - RNA, 38 nt, Artificial Sequence
  Description of Artificial Sequence:  Enzymatic Nucleic Acid
  misc_feature (31)..(31): n stands for inosine
auaauacucugaugaggccguuaggccgaancaaaagc

SEQ ID NO: 14385 - RNA, 38 nt, Artificial Sequence
  Description of Artificial Sequence:  Enzymatic Nucleic Acid
  misc_feature (31)..(31): n stands for inosine
cauaauaccugaugaggccguuaggccgaangcaaaag

SEQ ID NO: 14386 - RNA, 38 nt, Artificial Sequence
  Description of Artificial Sequence:  Enzymatic Nucleic Acid
  misc_feature (31)..(31): n stands for inosine
cuuauauacugaugaggccguuaggccgaancauaaua

SEQ ID NO: 14387 - RNA, 38 nt, Artificial Sequence
  Description of Artificial Sequence:  Enzymatic Nucleic Acid
  misc_feature (31)..(31): n stands for inosine
gauaaaggcugaugaggccguuaggccgaanuaaacuu

SEQ ID NO: 14388 - RNA, 38 nt, Artificial Sequence
  Description of Artificial Sequence:  Enzymatic Nucleic Acid
  misc_feature (31)..(31): n stands for inosine
aagauaaacugaugaggccguuaggccgaanuguaaac

SEQ ID NO: 14389 - RNA, 38 nt, Artificial Sequence
  Description of Artificial Sequence:  Enzymatic Nucleic Acid
  misc_feature (31)..(31): n stands for inosine
aaagauaacugaugaggccguuaggccgaanguguaaa

SEQ ID NO: 14390 - RNA, 38 nt, Artificial Sequence
  Description of Artificial Sequence:  Enzymatic Nucleic Acid
  misc_feature (31)..(31): n stands for inosine
ccauggaacugaugaggccguuaggccgaanauaaagg

SEQ ID NO: 14391 - RNA, 38 nt, Artificial Sequence
  Description of Artificial Sequence:  Enzymatic Nucleic Acid
  misc_feature (31)..(31): n stands for inosine
gcucccaucugaugaggccguuaggccgaanaaagaua

SEQ ID NO: 14392 - RNA, 38 nt, Artificial Sequence
  Description of Artificial Sequence:  Enzymatic Nucleic Acid
  misc_feature (31)..(31): n stands for inosine
ggcucccacugaugaggccguuaggccgaangaaagau

SEQ ID NO: 14393 - RNA, 38 nt, Artificial Sequence
  Description of Artificial Sequence:  Enzymatic Nucleic Acid
  misc_feature (31)..(31): n stands for inosine
aagcagcucugaugaggccguuaggccgaancucccau

SEQ ID NO: 14394 - RNA, 38 nt, Artificial Sequence
  Description of Artificial Sequence:  Enzymatic Nucleic Acid
  misc_feature (31)..(31): n stands for inosine
aaagcagccugaugaggccguuaggccgaangcuccca

SEQ ID NO: 14395 - RNA, 38 nt, Artificial Sequence
  Description of Artificial Sequence:  Enzymatic Nucleic Acid
  misc_feature (31)..(31): n stands for inosine
caaaaagccugaugaggccguuaggccgaancuggcuc

SEQ ID NO: 14396 - RNA, 38 nt, Artificial Sequence
  Description of Artificial Sequence:  Enzymatic Nucleic Acid
  misc_feature (31)..(31): n stands for inosine
ucacaaaacugaugaggccguuaggccgaancagcugg

SEQ ID NO: 14397 - RNA, 38 nt, Artificial Sequence
  Description of Artificial Sequence:  Enzymatic Nucleic Acid
  misc_feature (31)..(31): n stands for inosine
aaaaaaaacugaugaggccguuaggccgaancacuauu

SEQ ID NO: 14398 - RNA, 38 nt, Artificial Sequence
  Description of Artificial Sequence:  Enzymatic Nucleic Acid
  misc_feature (31)..(31): n stands for inosine
uucuuguucugaugaggccguuaggccgaanucaaaaa

SEQ ID NO: 14399 - RNA, 38 nt, Artificial Sequence
  Description of Artificial Sequence:  Enzymatic Nucleic Acid
  misc_feature (31)..(31): n stands for inosine
uacauucucugaugaggccguuaggccgaanuuaguca

SEQ ID NO: 14400 - RNA, 38 nt, Artificial Sequence
  Description of Artificial Sequence:  Enzymatic Nucleic Acid
  misc_feature (31)..(31): n stands for inosine
cuaucuggcugaugaggccguuaggccgaanuuacauu

SEQ ID NO: 14401 - RNA, 38 nt, Artificial Sequence
  Description of Artificial Sequence:  Enzymatic Nucleic Acid
  misc_feature (31)..(31): n stands for inosine
cucuaucucugaugaggccguuaggccgaanaguuaca

SEQ ID NO: 14402 - RNA, 38 nt, Artificial Sequence
  Description of Artificial Sequence:  Enzymatic Nucleic Acid
  misc_feature (31)..(31): n stands for inosine
ucucuauccugaugaggccguuaggccgaangaguuac

SEQ ID NO: 14403 - RNA, 38 nt, Artificial Sequence
  Description of Artificial Sequence:  Enzymatic Nucleic Acid
  misc_feature (31)..(31): n stands for inosine
ucuucacucugaugaggccguuaggccgaanucacuau

SEQ ID NO: 14404 - RNA, 38 nt, Artificial Sequence
  Description of Artificial Sequence:  Enzymatic Nucleic Acid
  misc_feature (31)..(31): n stands for inosine
agcaguagcugaugaggccguuaggccgaanuucuuca

SEQ ID NO: 14405 - RNA, 38 nt, Artificial Sequence
  Description of Artificial Sequence:  Enzymatic Nucleic Acid
  misc_feature (31)..(31): n stands for inosine
uuagcagucugaugaggccguuaggccgaanuguucuu

SEQ ID NO: 14406 - RNA, 38 nt, Artificial Sequence
  Description of Artificial Sequence:  Enzymatic Nucleic Acid
  misc_feature (31)..(31): n stands for inosine
gauuuagccugaugaggccguuaggccgaanuaguguu

SEQ ID NO: 14407 - RNA, 38 nt, Artificial Sequence
  Description of Artificial Sequence:  Enzymatic Nucleic Acid
  misc_feature (31)..(31): n stands for inosine
gaggauuucugaugaggccguuaggccgaancaguagu

SEQ ID NO: 14408 - RNA, 38 nt, Artificial Sequence
  Description of Artificial Sequence:  Enzymatic Nucleic Acid
  misc_feature (31)..(31): n stands for inosine
uaacaugacugaugaggccguuaggccgaanauuuagc

SEQ ID NO: 14409 - RNA, 38 nt, Artificial Sequence
  Description of Artificial Sequence:  Enzymatic Nucleic Acid
  misc_feature (31)..(31): n stands for inosine
guaacaugcugaugaggccguuaggccgaangauuuag

SEQ ID NO: 14410 - RNA, 38 nt, Artificial Sequence
  Description of Artificial Sequence:  Enzymatic Nucleic Acid
  misc_feature (31)..(31): n stands for inosine
gaguaacacugaugaggccguuaggccgaanaggauuu

SEQ ID NO: 14411 - RNA, 38 nt, Artificial Sequence
  Description of Artificial Sequence:  Enzymatic Nucleic Acid
  misc_feature (31)..(31): n stands for inosine
uaacacugcugaugaggccguuaggccgaanuaacaug

SEQ ID NO: 14412 - RNA, 38 nt, Artificial Sequence
  Description of Artificial Sequence:  Enzymatic Nucleic Acid
  misc_feature (31)..(31): n stands for inosine
ucuaacaccugaugaggccguuaggccgaanaguaaca

SEQ ID NO: 14413 - RNA, 38 nt, Artificial Sequence
  Description of Artificial Sequence:  Enzymatic Nucleic Acid
  misc_feature (31)..(31): n stands for inosine
uuuaggaacugaugaggccguuaggccgaanauuucuc

SEQ ID NO: 14414 - RNA, 38 nt, Artificial Sequence
  Description of Artificial Sequence:  Enzymatic Nucleic Acid
  misc_feature (31)..(31): n stands for inosine
guuuaggacugaugaggccguuaggccgaangauuucu

SEQ ID NO: 14415 - RNA, 38 nt, Artificial Sequence
  Description of Artificial Sequence:  Enzymatic Nucleic Acid
  misc_feature (31)..(31): n stands for inosine
uggguuuacugaugaggccguuaggccgaanaaggauu

SEQ ID NO: 14416 - RNA, 38 nt, Artificial Sequence
  Description of Artificial Sequence:  Enzymatic Nucleic Acid
  misc_feature (31)..(31): n stands for inosine
uuggguuucugaugaggccguuaggccgaangaaggau

SEQ ID NO: 14417 - RNA, 38 nt, Artificial Sequence
  Description of Artificial Sequence:  Enzymatic Nucleic Acid
  misc_feature (31)..(31): n stands for inosine
agucauugcugaugaggccguuaggccgaanuuuagga

SEQ ID NO: 14418 - RNA, 38 nt, Artificial Sequence
  Description of Artificial Sequence:  Enzymatic Nucleic Acid
  misc_feature (31)..(31): n stands for inosine
aagucauucugaugaggccguuaggccgaanguuuagg

SEQ ID NO: 14419 - RNA, 38 nt, Artificial Sequence
  Description of Artificial Sequence:  Enzymatic Nucleic Acid
  misc_feature (31)..(31): n stands for inosine
gaagucaucugaugaggccguuaggccgaangguuuag

SEQ ID NO: 14420 - RNA, 38 nt, Artificial Sequence
  Description of Artificial Sequence:  Enzymatic Nucleic Acid
  misc_feature (31)..(31): n stands for inosine
agcagggacugaugaggccguuaggccgaanucauugg

SEQ ID NO: 14421 - RNA, 38 nt, Artificial Sequence
  Description of Artificial Sequence:  Enzymatic Nucleic Acid
  misc_feature (31)..(31): n stands for inosine
uggagcagcugaugaggccguuaggccgaanaagucau

SEQ ID NO: 14422 - RNA, 38 nt, Artificial Sequence
  Description of Artificial Sequence:  Enzymatic Nucleic Acid
  misc_feature (31)..(31): n stands for inosine
uuggagcacugaugaggccguuaggccgaangaaguca

SEQ ID NO: 14423 - RNA, 38 nt, Artificial Sequence
  Description of Artificial Sequence:  Enzymatic Nucleic Acid
  misc_feature (31)..(31): n stands for inosine
guuggagccugaugaggccguuaggccgaanggaaguc

SEQ ID NO: 14424 - RNA, 38 nt, Artificial Sequence
  Description of Artificial Sequence:  Enzymatic Nucleic Acid
  misc_feature (31)..(31): n stands for inosine
gggguuggcugaugaggccguuaggccgaancagggaa

SEQ ID NO: 14425 - RNA, 38 nt, Artificial Sequence
  Description of Artificial Sequence:  Enzymatic Nucleic Acid
  misc_feature (31)..(31): n stands for inosine
cggggguucugaugaggccguuaggccgaanagcaggg

SEQ ID NO: 14426 - RNA, 38 nt, Artificial Sequence
  Description of Artificial Sequence:  Enzymatic Nucleic Acid
  misc_feature (31)..(31): n stands for inosine
gcgggggucugaugaggccguuaggccgaangagcagg

SEQ ID NO: 14427 - RNA, 38 nt, Artificial Sequence
  Description of Artificial Sequence:  Enzymatic Nucleic Acid
  misc_feature (31)..(31): n stands for inosine
guggcgggcugaugaggccguuaggccgaanuuggagc

SEQ ID NO: 14428 - RNA, 38 nt, Artificial Sequence
  Description of Artificial Sequence:  Enzymatic Nucleic Acid
  misc_feature (31)..(31): n stands for inosine
gguggcggcugaugaggccguuaggccgaanguuggag

SEQ ID NO: 14429 - RNA, 38 nt, Artificial Sequence
  Description of Artificial Sequence:  Enzymatic Nucleic Acid
  misc_feature (31)..(31): n stands for inosine
agguggcgcugaugaggccguuaggccgaangguugga

SEQ ID NO: 14430 - RNA, 38 nt, Artificial Sequence
  Description of Artificial Sequence:  Enzymatic Nucleic Acid
  misc_feature (31)..(31): n stands for inosine
gagguggccugaugaggccguuaggccgaanggguugg

SEQ ID NO: 14431 - RNA, 38 nt, Artificial Sequence
  Description of Artificial Sequence:  Enzymatic Nucleic Acid
  misc_feature (31)..(31): n stands for inosine
ccugaggucugaugaggccguuaggccgaancgggggu

SEQ ID NO: 14432 - RNA, 38 nt, Artificial Sequence
  Description of Artificial Sequence:  Enzymatic Nucleic Acid
  misc_feature (31)..(31): n stands for inosine
cccugaggcugaugaggccguuaggccgaangcggggg

SEQ ID NO: 14433 - RNA, 38 nt, Artificial Sequence
  Description of Artificial Sequence:  Enzymatic Nucleic Acid
  misc_feature (31)..(31): n stands for inosine
ugcccugacugaugaggccguuaggccgaanuggcggg

SEQ ID NO: 14434 - RNA, 38 nt, Artificial Sequence
  Description of Artificial Sequence:  Enzymatic Nucleic Acid
  misc_feature (31)..(31): n stands for inosine
gugcccugcugaugaggccguuaggccgaanguggcgg

SEQ ID NO: 14435 - RNA, 38 nt, Artificial Sequence
  Description of Artificial Sequence:  Enzymatic Nucleic Acid
  misc_feature (31)..(31): n stands for inosine
gcgugccccugaugaggccguuaggccgaanagguggc

SEQ ID NO: 14436 - RNA, 38 nt, Artificial Sequence
  Description of Artificial Sequence:  Enzymatic Nucleic Acid
  misc_feature (31)..(31): n stands for inosine
guccugcgcugaugaggccguuaggccgaancccugag

SEQ ID NO: 14437 - RNA, 38 nt, Artificial Sequence
  Description of Artificial Sequence:  Enzymatic Nucleic Acid
  misc_feature (31)..(31): n stands for inosine
acuggucccugaugaggccguuaggccgaancgugccc

SEQ ID NO: 14438 - RNA, 38 nt, Artificial Sequence
  Description of Artificial Sequence:  Enzymatic Nucleic Acid
  misc_feature (31)..(31): n stands for inosine
aucaaacucugaugaggccguuaggccgaanuccugcg

SEQ ID NO: 14439 - RNA, 38 nt, Artificial Sequence
  Description of Artificial Sequence:  Enzymatic Nucleic Acid
  misc_feature (31)..(31): n stands for inosine
aaucaaaccugaugaggccguuaggccgaanguccugc

SEQ ID NO: 14440 - RNA, 38 nt, Artificial Sequence
  Description of Artificial Sequence:  Enzymatic Nucleic Acid
  misc_feature (31)..(31): n stands for inosine
aucagugccugaugaggccguuaggccgaancuccuca

SEQ ID NO: 14441 - RNA, 38 nt, Artificial Sequence
  Description of Artificial Sequence:  Enzymatic Nucleic Acid
  misc_feature (31)..(31): n stands for inosine
gugaucagcugaugaggccguuaggccgaancagcucc

SEQ ID NO: 14442 - RNA, 38 nt, Artificial Sequence
  Description of Artificial Sequence:  Enzymatic Nucleic Acid
  misc_feature (31)..(31): n stands for inosine
gggugauccugaugaggccguuaggccgaanugcagcu

SEQ ID NO: 14443 - RNA, 38 nt, Artificial Sequence
  Description of Artificial Sequence:  Enzymatic Nucleic Acid
  misc_feature (31)..(31): n stands for inosine
gcauugggcugaugaggccguuaggccgaanaucagug

SEQ ID NO: 14444 - RNA, 38 nt, Artificial Sequence
  Description of Artificial Sequence:  Enzymatic Nucleic Acid
  misc_feature (31)..(31): n stands for inosine
augcauugcugaugaggccguuaggccgaanugaucag

SEQ ID NO: 14445 - RNA, 38 nt, Artificial Sequence
  Description of Artificial Sequence:  Enzymatic Nucleic Acid
  misc_feature (31)..(31): n stands for inosine
gaugcauucugaugaggccguuaggccgaangugauca

SEQ ID NO: 14446 - RNA, 38 nt, Artificial Sequence
  Description of Artificial Sequence:  Enzymatic Nucleic Acid
  misc_feature (31)..(31): n stands for inosine
ugaugcaucugaugaggccguuaggccgaanggugauc

SEQ ID NO: 14447 - RNA, 38 nt, Artificial Sequence
  Description of Artificial Sequence:  Enzymatic Nucleic Acid
  misc_feature (31)..(31): n stands for inosine
guacgugacugaugaggccguuaggccgaancauuggg

SEQ ID NO: 14448 - RNA, 38 nt, Artificial Sequence
  Description of Artificial Sequence:  Enzymatic Nucleic Acid
  misc_feature (31)..(31): n stands for inosine
gggguacgcugaugaggccguuaggccgaanaugcauu

SEQ ID NO: 14449 - RNA, 38 nt, Artificial Sequence
  Description of Artificial Sequence:  Enzymatic Nucleic Acid
  misc_feature (31)..(31): n stands for inosine
cccaguggcugaugaggccguuaggccgaanuacguga

SEQ ID NO: 14450 - RNA, 38 nt, Artificial Sequence
  Description of Artificial Sequence:  Enzymatic Nucleic Acid
  misc_feature (31)..(31): n stands for inosine
gcccagugcugaugaggccguuaggccgaanguacgug

SEQ ID NO: 14451 - RNA, 38 nt, Artificial Sequence
  Description of Artificial Sequence:  Enzymatic Nucleic Acid
  misc_feature (31)..(31): n stands for inosine
ggcccagucugaugaggccguuaggccgaangguacgu

SEQ ID NO: 14452 - RNA, 38 nt, Artificial Sequence
  Description of Artificial Sequence:  Enzymatic Nucleic Acid
  misc_feature (31)..(31): n stands for inosine
uggcccagcugaugaggccguuaggccgaanggguacg

SEQ ID NO: 14453 - RNA, 38 nt, Artificial Sequence
  Description of Artificial Sequence:  Enzymatic Nucleic Acid
  misc_feature (31)..(31): n stands for inosine
gcuggccccugaugaggccguuaggccgaanuggggua

SEQ ID NO: 14454 - RNA, 38 nt, Artificial Sequence
  Description of Artificial Sequence:  Enzymatic Nucleic Acid
  misc_feature (31)..(31): n stands for inosine
gcagggcucugaugaggccguuaggccgaancccagug

SEQ ID NO: 14455 - RNA, 38 nt, Artificial Sequence
  Description of Artificial Sequence:  Enzymatic Nucleic Acid
  misc_feature (31)..(31): n stands for inosine
ugcagggccugaugaggccguuaggccgaangcccagu

SEQ ID NO: 14456 - RNA, 38 nt, Artificial Sequence
  Description of Artificial Sequence:  Enzymatic Nucleic Acid
  misc_feature (31)..(31): n stands for inosine
ggcugcagcugaugaggccguuaggccgaancuggccc

SEQ ID NO: 14457 - RNA, 38 nt, Artificial Sequence
  Description of Artificial Sequence:  Enzymatic Nucleic Acid
  misc_feature (31)..(31): n stands for inosine
gggcugcacugaugaggccguuaggccgaangcuggcc

SEQ ID NO: 14458 - RNA, 38 nt, Artificial Sequence
  Description of Artificial Sequence:  Enzymatic Nucleic Acid
  misc_feature (31)..(31): n stands for inosine
ugggcugccugaugaggccguuaggccgaanggcuggc

SEQ ID NO: 14459 - RNA, 38 nt, Artificial Sequence
  Description of Artificial Sequence:  Enzymatic Nucleic Acid
  misc_feature (31)..(31): n stands for inosine
uuuugggccugaugaggccguuaggccgaancagggcu

SEQ ID NO: 14460 - RNA, 38 nt, Artificial Sequence
  Description of Artificial Sequence:  Enzymatic Nucleic Acid
  misc_feature (31)..(31): n stands for inosine
ggguuuugcugaugaggccguuaggccgaancugcagg

SEQ ID NO: 14461 - RNA, 38 nt, Artificial Sequence
  Description of Artificial Sequence:  Enzymatic Nucleic Acid
  misc_feature (31)..(31): n stands for inosine
uggguuuucugaugaggccguuaggccgaangcugcag

SEQ ID NO: 14462 - RNA, 38 nt, Artificial Sequence
  Description of Artificial Sequence:  Enzymatic Nucleic Acid
  misc_feature (31)..(31): n stands for inosine
cuggguuucugaugaggccguuaggccgaanggcugca

SEQ ID NO: 14463 - RNA, 38 nt, Artificial Sequence
  Description of Artificial Sequence:  Enzymatic Nucleic Acid
  misc_feature (31)..(31): n stands for inosine
uugcccugcugaugaggccguuaggccgaanuuuuggg

SEQ ID NO: 14464 - RNA, 38 nt, Artificial Sequence
  Description of Artificial Sequence:  Enzymatic Nucleic Acid
  misc_feature (31)..(31): n stands for inosine
guugcccucugaugaggccguuaggccgaanguuuugg

SEQ ID NO: 14465 - RNA, 38 nt, Artificial Sequence
  Description of Artificial Sequence:  Enzymatic Nucleic Acid
  misc_feature (31)..(31): n stands for inosine
uguugccccugaugaggccguuaggccgaangguuuug

SEQ ID NO: 14466 - RNA, 38 nt, Artificial Sequence
  Description of Artificial Sequence:  Enzymatic Nucleic Acid
  misc_feature (31)..(31): n stands for inosine
gggcuugucugaugaggccguuaggccgaancccuggg

SEQ ID NO: 14467 - RNA, 38 nt, Artificial Sequence
  Description of Artificial Sequence:  Enzymatic Nucleic Acid
  misc_feature (31)..(31): n stands for inosine
aacgggcucugaugaggccguuaggccgaanuugcccu

SEQ ID NO: 14468 - RNA, 38 nt, Artificial Sequence
  Description of Artificial Sequence:  Enzymatic Nucleic Acid
  misc_feature (31)..(31): n stands for inosine
ggcuaacgcugaugaggccguuaggccgaancuuguug

SEQ ID NO: 14469 - RNA, 38 nt, Artificial Sequence
  Description of Artificial Sequence:  Enzymatic Nucleic Acid
  misc_feature (31)..(31): n stands for inosine
gggcuaaccugaugaggccguuaggccgaangcuuguu

SEQ ID NO: 14470 - RNA, 38 nt, Artificial Sequence
  Description of Artificial Sequence:  Enzymatic Nucleic Acid
  misc_feature (31)..(31): n stands for inosine
uccccuggcugaugaggccguuaggccgaancuaacgg

SEQ ID NO: 14471 - RNA, 38 nt, Artificial Sequence
  Description of Artificial Sequence:  Enzymatic Nucleic Acid
  misc_feature (31)..(31): n stands for inosine
auccccugcugaugaggccguuaggccgaangcuaacg

SEQ ID NO: 14472 - RNA, 38 nt, Artificial Sequence
  Description of Artificial Sequence:  Enzymatic Nucleic Acid
  misc_feature (31)..(31): n stands for inosine
gauccccucugaugaggccguuaggccgaanggcuaac

SEQ ID NO: 14473 - RNA, 38 nt, Artificial Sequence
  Description of Artificial Sequence:  Enzymatic Nucleic Acid
  misc_feature (31)..(31): n stands for inosine
ugaucccccugaugaggccguuaggccgaangggcuaa

SEQ ID NO: 14474 - RNA, 38 nt, Artificial Sequence
  Description of Artificial Sequence:  Enzymatic Nucleic Acid
  misc_feature (31)..(31): n stands for inosine
ccagccagcugaugaggccguuaggccgaanauccccu

SEQ ID NO: 14475 - RNA, 38 nt, Artificial Sequence
  Description of Artificial Sequence:  Enzymatic Nucleic Acid
  misc_feature (31)..(31): n stands for inosine
ggccagcccugaugaggccguuaggccgaanugauccc

SEQ ID NO: 14476 - RNA, 38 nt, Artificial Sequence
  Description of Artificial Sequence:  Enzymatic Nucleic Acid
  misc_feature (31)..(31): n stands for inosine
cucaggcccugaugaggccguuaggccgaanccaguga

SEQ ID NO: 14477 - RNA, 38 nt, Artificial Sequence
  Description of Artificial Sequence:  Enzymatic Nucleic Acid
  misc_feature (31)..(31): n stands for inosine
guugcucacugaugaggccguuaggccgaanccagcca

SEQ ID NO: 14478 - RNA, 38 nt, Artificial Sequence
  Description of Artificial Sequence:  Enzymatic Nucleic Acid
  misc_feature (31)..(31): n stands for inosine
uguugcuccugaugaggccguuaggccgaangccagcc

SEQ ID NO: 14479 - RNA, 38 nt, Artificial Sequence
  Description of Artificial Sequence:  Enzymatic Nucleic Acid
  misc_feature (31)..(31): n stands for inosine
cgagaugucugaugaggccguuaggccgaancucaggc

SEQ ID NO: 14480 - RNA, 38 nt, Artificial Sequence
  Description of Artificial Sequence:  Enzymatic Nucleic Acid
  misc_feature (31)..(31): n stands for inosine
ucccgagacugaugaggccguuaggccgaanuugcuca

SEQ ID NO: 14481 - RNA, 38 nt, Artificial Sequence
  Description of Artificial Sequence:  Enzymatic Nucleic Acid
  misc_feature (31)..(31): n stands for inosine
gacucccgcugaugaggccguuaggccgaanauguugc

SEQ ID NO: 14482 - RNA, 38 nt, Artificial Sequence
  Description of Artificial Sequence:  Enzymatic Nucleic Acid
  misc_feature (31)..(31): n stands for inosine
cugcuagacugaugaggccguuaggccgaanacucccg

SEQ ID NO: 14483 - RNA, 38 nt, Artificial Sequence
  Description of Artificial Sequence:  Enzymatic Nucleic Acid
  misc_feature (31)..(31): n stands for inosine
ccugcuagcugaugaggccguuaggccgaangacuccc

SEQ ID NO: 14484 - RNA, 38 nt, Artificial Sequence
  Description of Artificial Sequence:  Enzymatic Nucleic Acid
  misc_feature (31)..(31): n stands for inosine
ggccugcucugaugaggccguuaggccgaanaggacuc

SEQ ID NO: 14485 - RNA, 38 nt, Artificial Sequence
  Description of Artificial Sequence:  Enzymatic Nucleic Acid
  misc_feature (31)..(31): n stands for inosine
cuuaggcccugaugaggccguuaggccgaancuagagg

SEQ ID NO: 14486 - RNA, 38 nt, Artificial Sequence
  Description of Artificial Sequence:  Enzymatic Nucleic Acid
  misc_feature (31)..(31): n stands for inosine
augucuuacugaugaggccguuaggccgaanccugcua

SEQ ID NO: 14487 - RNA, 38 nt, Artificial Sequence
  Description of Artificial Sequence:  Enzymatic Nucleic Acid
  misc_feature (31)..(31): n stands for inosine
caugucuucugaugaggccguuaggccgaangccugcu

SEQ ID NO: 14488 - RNA, 38 nt, Artificial Sequence
  Description of Artificial Sequence:  Enzymatic Nucleic Acid
  misc_feature (31)..(31): n stands for inosine
uccucacacugaugaggccguuaggccgaanucuuagg

SEQ ID NO: 14489 - RNA, 38 nt, Artificial Sequence
  Description of Artificial Sequence:  Enzymatic Nucleic Acid
  misc_feature (31)..(31): n stands for inosine
uugcuuuucugaugaggccguuaggccgaancuuuuuu

SEQ ID NO: 14490 - RNA, 38 nt, Artificial Sequence
  Description of Artificial Sequence:  Enzymatic Nucleic Acid
  misc_feature (31)..(31): n stands for inosine
uucucccucugaugaggccguuaggccgaancuuuuug

SEQ ID NO: 14491 - RNA, 38 nt, Artificial Sequence
  Description of Artificial Sequence:  Enzymatic Nucleic Acid
  misc_feature (31)..(31): n stands for inosine
cuucuccccugaugaggccguuaggccgaanuuucucu

SEQ ID NO: 14492 - RNA, 38 nt, Artificial Sequence
  Description of Artificial Sequence:  Enzymatic Nucleic Acid
  misc_feature (31)..(31): n stands for inosine
cuuucucacugaugaggccguuaggccgaanccuucuc

SEQ ID NO: 14493 - RNA, 38 nt, Artificial Sequence
  Description of Artificial Sequence:  Enzymatic Nucleic Acid
  misc_feature (31)..(31): n stands for inosine
ccacauggcugaugaggccguuaggccgaancgucuca

SEQ ID NO: 14494 - RNA, 38 nt, Artificial Sequence
  Description of Artificial Sequence:  Enzymatic Nucleic Acid
  misc_feature (31)..(31): n stands for inosine
gcccacaucugaugaggccguuaggccgaanugcgucu

SEQ ID NO: 14495 - RNA, 38 nt, Artificial Sequence
  Description of Artificial Sequence:  Enzymatic Nucleic Acid
  misc_feature (31)..(31): n stands for inosine
ugcccacacugaugaggccguuaggccgaangugcguc

SEQ ID NO: 14496 - RNA, 38 nt, Artificial Sequence
  Description of Artificial Sequence:  Enzymatic Nucleic Acid
  misc_feature (31)..(31): n stands for inosine
ccccuccgcugaugaggccguuaggccgaancccacau

SEQ ID NO: 14497 - RNA, 38 nt, Artificial Sequence
  Description of Artificial Sequence:  Enzymatic Nucleic Acid
  misc_feature (31)..(31): n stands for inosine
cauugcugcugaugaggccguuaggccgaanccccguc

SEQ ID NO: 14498 - RNA, 38 nt, Artificial Sequence
  Description of Artificial Sequence:  Enzymatic Nucleic Acid
  misc_feature (31)..(31): n stands for inosine
ggcauugccugaugaggccguuaggccgaanagccccg

SEQ ID NO: 14499 - RNA, 38 nt, Artificial Sequence
  Description of Artificial Sequence:  Enzymatic Nucleic Acid
  misc_feature (31)..(31): n stands for inosine
aauggcaucugaugaggccguuaggccgaancugagcc

SEQ ID NO: 14500 - RNA, 38 nt, Artificial Sequence
  Description of Artificial Sequence:  Enzymatic Nucleic Acid
  misc_feature (31)..(31): n stands for inosine
acugaaaucugaugaggccguuaggccgaancauugcu

SEQ ID NO: 14501 - RNA, 38 nt, Artificial Sequence
  Description of Artificial Sequence:  Enzymatic Nucleic Acid
  misc_feature (31)..(31): n stands for inosine
cacugaaacugaugaggccguuaggccgaangcauugc

SEQ ID NO: 14502 - RNA, 38 nt, Artificial Sequence
  Description of Artificial Sequence:  Enzymatic Nucleic Acid
  misc_feature (31)..(31): n stands for inosine
gaagccaccugaugaggccguuaggccgaanaaauggc

SEQ ID NO: 14503 - RNA, 38 nt, Artificial Sequence
  Description of Artificial Sequence:  Enzymatic Nucleic Acid
  misc_feature (31)..(31): n stands for inosine
agcugggacugaugaggccguuaggccgaanccacuga

SEQ ID NO: 14504 - RNA, 38 nt, Artificial Sequence
  Description of Artificial Sequence:  Enzymatic Nucleic Acid
  misc_feature (31)..(31): n stands for inosine
cagagcugcugaugaggccguuaggccgaanaagccac

SEQ ID NO: 14505 - RNA, 38 nt, Artificial Sequence
  Description of Artificial Sequence:  Enzymatic Nucleic Acid
  misc_feature (31)..(31): n stands for inosine
ucagagcucugaugaggccguuaggccgaangaagcca

SEQ ID NO: 14506 - RNA, 38 nt, Artificial Sequence
  Description of Artificial Sequence:  Enzymatic Nucleic Acid
  misc_feature (31)..(31): n stands for inosine
gucagagccugaugaggccguuaggccgaanggaagcc

SEQ ID NO: 14507 - RNA, 38 nt, Artificial Sequence
  Description of Artificial Sequence:  Enzymatic Nucleic Acid
  misc_feature (31)..(31): n stands for inosine
agggucagcugaugaggccguuaggccgaancugggaa

SEQ ID NO: 14508 - RNA, 38 nt, Artificial Sequence
  Description of Artificial Sequence:  Enzymatic Nucleic Acid
  misc_feature (31)..(31): n stands for inosine
gaaggguccugaugaggccguuaggccgaanagcuggg

SEQ ID NO: 14509 - RNA, 38 nt, Artificial Sequence
  Description of Artificial Sequence:  Enzymatic Nucleic Acid
  misc_feature (31)..(31): n stands for inosine
uguagaagcugaugaggccguuaggccgaanucagagc

SEQ ID NO: 14510 - RNA, 38 nt, Artificial Sequence
  Description of Artificial Sequence:  Enzymatic Nucleic Acid
  misc_feature (31)..(31): n stands for inosine
auguagaacugaugaggccguuaggccgaangucagag

SEQ ID NO: 14511 - RNA, 38 nt, Artificial Sequence
  Description of Artificial Sequence:  Enzymatic Nucleic Acid
  misc_feature (31)..(31): n stands for inosine
aauguagacugaugaggccguuaggccgaanggucaga

SEQ ID NO: 14512 - RNA, 38 nt, Artificial Sequence
  Description of Artificial Sequence:  Enzymatic Nucleic Acid
  misc_feature (31)..(31): n stands for inosine
ucaaaugucugaugaggccguuaggccgaanaaggguc

SEQ ID NO: 14513 - RNA, 38 nt, Artificial Sequence
  Description of Artificial Sequence:  Enzymatic Nucleic Acid
  misc_feature (31)..(31): n stands for inosine
cccucaaacugaugaggccguuaggccgaanuagaagg

SEQ ID NO: 14514 - RNA, 38 nt, Artificial Sequence
  Description of Artificial Sequence:  Enzymatic Nucleic Acid
  misc_feature (31)..(31): n stands for inosine
ccuggcugcugaugaggccguuaggccgaancccucaa

SEQ ID NO: 14515 - RNA, 38 nt, Artificial Sequence
  Description of Artificial Sequence:  Enzymatic Nucleic Acid
  misc_feature (31)..(31): n stands for inosine
uccuggcucugaugaggccguuaggccgaangcccuca

SEQ ID NO: 14516 - RNA, 38 nt, Artificial Sequence
  Description of Artificial Sequence:  Enzymatic Nucleic Acid
  misc_feature (31)..(31): n stands for inosine
cuccuggccugaugaggccguuaggccgaanggcccuc

SEQ ID NO: 14517 - RNA, 38 nt, Artificial Sequence
  Description of Artificial Sequence:  Enzymatic Nucleic Acid
  misc_feature (31)..(31): n stands for inosine
cugcuccucugaugaggccguuaggccgaancugggcc

SEQ ID NO: 14518 - RNA, 38 nt, Artificial Sequence
  Description of Artificial Sequence:  Enzymatic Nucleic Acid
  misc_feature (31)..(31): n stands for inosine
ucugcucccugaugaggccguuaggccgaangcugggc

SEQ ID NO: 14519 - RNA, 38 nt, Artificial Sequence
  Description of Artificial Sequence:  Enzymatic Nucleic Acid
  misc_feature (31)..(31): n stands for inosine
uguccauccugaugaggccguuaggccgaancuccugg

SEQ ID NO: 14520 - RNA, 38 nt, Artificial Sequence
  Description of Artificial Sequence:  Enzymatic Nucleic Acid
  misc_feature (31)..(31): n stands for inosine
cucaucgccugaugaggccguuaggccgaanuccaucu

SEQ ID NO: 14521 - RNA, 38 nt, Artificial Sequence
  Description of Artificial Sequence:  Enzymatic Nucleic Acid
  misc_feature (31)..(31): n stands for inosine
ccagaaaacugaugaggccguuaggccgaanuccccuc

SEQ ID NO: 14522 - RNA, 38 nt, Artificial Sequence
  Description of Artificial Sequence:  Enzymatic Nucleic Acid
  misc_feature (31)..(31): n stands for inosine
cagaaucccugaugaggccguuaggccgaanaaaaugu

SEQ ID NO: 14523 - RNA, 38 nt, Artificial Sequence
  Description of Artificial Sequence:  Enzymatic Nucleic Acid
  misc_feature (31)..(31): n stands for inosine
ugccuccccugaugaggccguuaggccgaanaauccag

SEQ ID NO: 14524 - RNA, 38 nt, Artificial Sequence
  Description of Artificial Sequence:  Enzymatic Nucleic Acid
  misc_feature (31)..(31): n stands for inosine
ccuuuucucugaugaggccguuaggccgaanccuccca

SEQ ID NO: 14525 - RNA, 38 nt, Artificial Sequence
  Description of Artificial Sequence:  Enzymatic Nucleic Acid
  misc_feature (31)..(31): n stands for inosine
aagauauucugaugaggccguuaggccgaanuccuuuu

SEQ ID NO: 14526 - RNA, 38 nt, Artificial Sequence
  Description of Artificial Sequence:  Enzymatic Nucleic Acid
  misc_feature (31)..(31): n stands for inosine
uccaaaaacugaugaggccguuaggccgaanauauuug

SEQ ID NO: 14527 - RNA, 38 nt, Artificial Sequence
  Description of Artificial Sequence:  Enzymatic Nucleic Acid
  misc_feature (31)..(31): n stands for inosine
uuugcuuucugaugaggccguuaggccgaanuuccaaa

SEQ ID NO: 14528 - RNA, 38 nt, Artificial Sequence
  Description of Artificial Sequence:  Enzymatic Nucleic Acid
  misc_feature (31)..(31): n stands for inosine
cuaaaauucugaugaggccguuaggccgaancuuuagu

SEQ ID NO: 14529 - RNA, 38 nt, Artificial Sequence
  Description of Artificial Sequence:  Enzymatic Nucleic Acid
  misc_feature (31)..(31): n stands for inosine
uagguaaacugaugaggccguuaggccgaanucuaaaa

SEQ ID NO: 14530 - RNA, 38 nt, Artificial Sequence
  Description of Artificial Sequence:  Enzymatic Nucleic Acid
  misc_feature (31)..(31): n stands for inosine
auagguaacugaugaggccguuaggccgaangucuaaa

SEQ ID NO: 14531 - RNA, 38 nt, Artificial Sequence
  Description of Artificial Sequence:  Enzymatic Nucleic Acid
  misc_feature (31)..(31): n stands for inosine
cuuccauacugaugaggccguuaggccgaanuaaaggu

SEQ ID NO: 14532 - RNA, 38 nt, Artificial Sequence
  Description of Artificial Sequence:  Enzymatic Nucleic Acid
  misc_feature (31)..(31): n stands for inosine
acuuccaucugaugaggccguuaggccgaanguaaagg

SEQ ID NO: 14533 - RNA, 38 nt, Artificial Sequence
  Description of Artificial Sequence:  Enzymatic Nucleic Acid
  misc_feature (31)..(31): n stands for inosine
auggacaucugaugaggccguuaggccgaanaaccacu

SEQ ID NO: 14534 - RNA, 38 nt, Artificial Sequence
  Description of Artificial Sequence:  Enzymatic Nucleic Acid
  misc_feature (31)..(31): n stands for inosine
augagaaucugaugaggccguuaggccgaanacauaga

SEQ ID NO: 14535 - RNA, 38 nt, Artificial Sequence
  Description of Artificial Sequence:  Enzymatic Nucleic Acid
  misc_feature (31)..(31): n stands for inosine
aaugagaacugaugaggccguuaggccgaangacauag

SEQ ID NO: 14536 - RNA, 38 nt, Artificial Sequence
  Description of Artificial Sequence:  Enzymatic Nucleic Acid
  misc_feature (31)..(31): n stands for inosine
cacgaaugcugaugaggccguuaggccgaanaauggac

SEQ ID NO: 14537 - RNA, 38 nt, Artificial Sequence
  Description of Artificial Sequence:  Enzymatic Nucleic Acid
  misc_feature (31)..(31): n stands for inosine
gccacgaacugaugaggccguuaggccgaanagaaugg

SEQ ID NO: 14538 - RNA, 38 nt, Artificial Sequence
  Description of Artificial Sequence:  Enzymatic Nucleic Acid
  misc_feature (31)..(31): n stands for inosine
ucaaaacacugaugaggccguuaggccgaanccacgaa

SEQ ID NO: 14539 - RNA, 38 nt, Artificial Sequence
  Description of Artificial Sequence:  Enzymatic Nucleic Acid
  misc_feature (31)..(31): n stands for inosine
acccucagcugaugaggccguuaggccgaancuacaaa

SEQ ID NO: 14540 - RNA, 38 nt, Artificial Sequence
  Description of Artificial Sequence:  Enzymatic Nucleic Acid
  misc_feature (31)..(31): n stands for inosine
ccacccuccugaugaggccguuaggccgaanugcuaca

SEQ ID NO: 14541 - RNA, 38 nt, Artificial Sequence
  Description of Artificial Sequence:  Enzymatic Nucleic Acid
  misc_feature (31)..(31): n stands for inosine
gaguugagcugaugaggccguuaggccgaanccacccu

SEQ ID NO: 14542 - RNA, 38 nt, Artificial Sequence
  Description of Artificial Sequence:  Enzymatic Nucleic Acid
  misc_feature (31)..(31): n stands for inosine
cagaguugcugaugaggccguuaggccgaanugccacc

SEQ ID NO: 14543 - RNA, 38 nt, Artificial Sequence
  Description of Artificial Sequence:  Enzymatic Nucleic Acid
  misc_feature (31)..(31): n stands for inosine
cucagagucugaugaggccguuaggccgaanagugcca

SEQ ID NO: 14544 - RNA, 38 nt, Artificial Sequence
  Description of Artificial Sequence:  Enzymatic Nucleic Acid
  misc_feature (31)..(31): n stands for inosine
gggcucagcugaugaggccguuaggccgaanuugagug

SEQ ID NO: 14545 - RNA, 38 nt, Artificial Sequence
  Description of Artificial Sequence:  Enzymatic Nucleic Acid
  misc_feature (31)..(31): n stands for inosine
augggcuccugaugaggccguuaggccgaanaguugag

SEQ ID NO: 14546 - RNA, 38 nt, Artificial Sequence
  Description of Artificial Sequence:  Enzymatic Nucleic Acid
  misc_feature (31)..(31): n stands for inosine
aaaguaugcugaugaggccguuaggccgaancucagag

SEQ ID NO: 14547 - RNA, 38 nt, Artificial Sequence
  Description of Artificial Sequence:  Enzymatic Nucleic Acid
  misc_feature (31)..(31): n stands for inosine
aaaaguaucugaugaggccguuaggccgaangcucaga

SEQ ID NO: 14548 - RNA, 38 nt, Artificial Sequence
  Description of Artificial Sequence:  Enzymatic Nucleic Acid
  misc_feature (31)..(31): n stands for inosine
caaaaguacugaugaggccguuaggccgaanggcucag

SEQ ID NO: 14549 - RNA, 38 nt, Artificial Sequence
  Description of Artificial Sequence:  Enzymatic Nucleic Acid
  misc_feature (31)..(31): n stands for inosine
gagccaaacugaugaggccguuaggccgaanuaugggc

SEQ ID NO: 14550 - RNA, 38 nt, Artificial Sequence
  Description of Artificial Sequence:  Enzymatic Nucleic Acid
  misc_feature (31)..(31): n stands for inosine
acuagaggcugaugaggccguuaggccgaanccaaaag

SEQ ID NO: 14551 - RNA, 38 nt, Artificial Sequence
  Description of Artificial Sequence:  Enzymatic Nucleic Acid
  misc_feature (31)..(31): n stands for inosine
uuacuagacugaugaggccguuaggccgaanagccaaa

SEQ ID NO: 14552 - RNA, 38 nt, Artificial Sequence
  Description of Artificial Sequence:  Enzymatic Nucleic Acid
  misc_feature (31)..(31): n stands for inosine
cuuacuagcugaugaggccguuaggccgaangagccaa

SEQ ID NO: 14553 - RNA, 38 nt, Artificial Sequence
  Description of Artificial Sequence:  Enzymatic Nucleic Acid
  misc_feature (31)..(31): n stands for inosine
aucuuacucugaugaggccguuaggccgaanaggagcc

SEQ ID NO: 14554 - RNA, 38 nt, Artificial Sequence
  Description of Artificial Sequence:  Enzymatic Nucleic Acid
  misc_feature (31)..(31): n stands for inosine
guuuucagcugaugaggccguuaggccgaancaucuua

SEQ ID NO: 14555 - RNA, 38 nt, Artificial Sequence
  Description of Artificial Sequence:  Enzymatic Nucleic Acid
  misc_feature (31)..(31): n stands for inosine
aaguuuuccugaugaggccguuaggccgaanugcaucu

SEQ ID NO: 14556 - RNA, 38 nt, Artificial Sequence
  Description of Artificial Sequence:  Enzymatic Nucleic Acid
  misc_feature (31)..(31): n stands for inosine
ucuggcuacugaugaggccguuaggccgaanuuuucag

SEQ ID NO: 14557 - RNA, 38 nt, Artificial Sequence
  Description of Artificial Sequence:  Enzymatic Nucleic Acid
  misc_feature (31)..(31): n stands for inosine
cuaacucucugaugaggccguuaggccgaancuaaguu

SEQ ID NO: 14558 - RNA, 38 nt, Artificial Sequence
  Description of Artificial Sequence:  Enzymatic Nucleic Acid
  misc_feature (31)..(31): n stands for inosine
ccuaacuccugaugaggccguuaggccgaangcuaagu

SEQ ID NO: 14559 - RNA, 38 nt, Artificial Sequence
  Description of Artificial Sequence:  Enzymatic Nucleic Acid
  misc_feature (31)..(31): n stands for inosine
uggccuggcugaugaggccguuaggccgaanacaaccu

SEQ ID NO: 14560 - RNA, 38 nt, Artificial Sequence
  Description of Artificial Sequence:  Enzymatic Nucleic Acid
  misc_feature (31)..(31): n stands for inosine
cauggccucugaugaggccguuaggccgaanagacaac

SEQ ID NO: 14561 - RNA, 38 nt, Artificial Sequence
  Description of Artificial Sequence:  Enzymatic Nucleic Acid
  misc_feature (31)..(31): n stands for inosine
ucauggcccugaugaggccguuaggccgaangagacaa

SEQ ID NO: 14562 - RNA, 38 nt, Artificial Sequence
  Description of Artificial Sequence:  Enzymatic Nucleic Acid
  misc_feature (31)..(31): n stands for inosine
gccaucaucugaugaggccguuaggccgaanccuggag

SEQ ID NO: 14563 - RNA, 38 nt, Artificial Sequence
  Description of Artificial Sequence:  Enzymatic Nucleic Acid
  misc_feature (31)..(31): n stands for inosine
ggccaucacugaugaggccguuaggccgaangccugga

SEQ ID NO: 14564 - RNA, 38 nt, Artificial Sequence
  Description of Artificial Sequence:  Enzymatic Nucleic Acid
  misc_feature (31)..(31): n stands for inosine
caguguaacugaugaggccguuaggccgaanccaucau

SEQ ID NO: 14565 - RNA, 38 nt, Artificial Sequence
  Description of Artificial Sequence:  Enzymatic Nucleic Acid
  misc_feature (31)..(31): n stands for inosine
ucaguguacugaugaggccguuaggccgaangccauca

SEQ ID NO: 14566 - RNA, 38 nt, Artificial Sequence
  Description of Artificial Sequence:  Enzymatic Nucleic Acid
  misc_feature (31)..(31): n stands for inosine
auuuucagcugaugaggccguuaggccgaanuaaggcc

SEQ ID NO: 14567 - RNA, 38 nt, Artificial Sequence
  Description of Artificial Sequence:  Enzymatic Nucleic Acid
  misc_feature (31)..(31): n stands for inosine
acauuuuccugaugaggccguuaggccgaanuguaagg

SEQ ID NO: 14568 - RNA, 38 nt, Artificial Sequence
  Description of Artificial Sequence:  Enzymatic Nucleic Acid
  misc_feature (31)..(31): n stands for inosine
auagaaugcugaugaggccguuaggccgaanacauuuu

SEQ ID NO: 14569 - RNA, 38 nt, Artificial Sequence
  Description of Artificial Sequence:  Enzymatic Nucleic Acid
  misc_feature (31)..(31): n stands for inosine
aaauagaacugaugaggccguuaggccgaanugacauu

SEQ ID NO: 14570 - RNA, 38 nt, Artificial Sequence
  Description of Artificial Sequence:  Enzymatic Nucleic Acid
  misc_feature (31)..(31): n stands for inosine
cccaaaaucugaugaggccguuaggccgaanaauguga

SEQ ID NO: 14571 - RNA, 38 nt, Artificial Sequence
  Description of Artificial Sequence:  Enzymatic Nucleic Acid
  misc_feature (31)..(31): n stands for inosine
aagugucucugaugaggccguuaggccgaanacuauau

SEQ ID NO: 14572 - RNA, 38 nt, Artificial Sequence
  Description of Artificial Sequence:  Enzymatic Nucleic Acid
  misc_feature (31)..(31): n stands for inosine
uaaguguccugaugaggccguuaggccgaangacuaua

SEQ ID NO: 14573 - RNA, 38 nt, Artificial Sequence
  Description of Artificial Sequence:  Enzymatic Nucleic Acid
  misc_feature (31)..(31): n stands for inosine
gaguuaagcugaugaggccguuaggccgaanucuggac

SEQ ID NO: 14574 - RNA, 38 nt, Artificial Sequence
  Description of Artificial Sequence:  Enzymatic Nucleic Acid
  misc_feature (31)..(31): n stands for inosine
uugaguuacugaugaggccguuaggccgaanugucugg

SEQ ID NO: 14575 - RNA, 38 nt, Artificial Sequence
  Description of Artificial Sequence:  Enzymatic Nucleic Acid
  misc_feature (31)..(31): n stands for inosine
agaaauugcugaugaggccguuaggccgaanuuaagug

SEQ ID NO: 14576 - RNA, 38 nt, Artificial Sequence
  Description of Artificial Sequence:  Enzymatic Nucleic Acid
  misc_feature (31)..(31): n stands for inosine
caagaaaucugaugaggccguuaggccgaanaguuaag

SEQ ID NO: 14577 - RNA, 38 nt, Artificial Sequence
  Description of Artificial Sequence:  Enzymatic Nucleic Acid
  misc_feature (31)..(31): n stands for inosine
uaauaccacugaugaggccguuaggccgaanaaauuga

SEQ ID NO: 14578 - RNA, 38 nt, Artificial Sequence
  Description of Artificial Sequence:  Enzymatic Nucleic Acid
  misc_feature (31)..(31): n stands for inosine
ugcaaaaccugaugaggccguuaggccgaanaauaaua

SEQ ID NO: 14579 - RNA, 38 nt, Artificial Sequence
  Description of Artificial Sequence:  Enzymatic Nucleic Acid
  misc_feature (31)..(31): n stands for inosine
acuaacugcugaugaggccguuaggccgaancaaaaca

SEQ ID NO: 14580 - RNA, 38 nt, Artificial Sequence
  Description of Artificial Sequence:  Enzymatic Nucleic Acid
  misc_feature (31)..(31): n stands for inosine
caacuaaccugaugaggccguuaggccgaanugcaaaa

SEQ ID NO: 14581 - RNA, 38 nt, Artificial Sequence
  Description of Artificial Sequence:  Enzymatic Nucleic Acid
  misc_feature (31)..(31): n stands for inosine
uucuucuccugaugaggccguuaggccgaancuuucuu

SEQ ID NO: 14582 - RNA, 38 nt, Artificial Sequence
  Description of Artificial Sequence:  Enzymatic Nucleic Acid
  misc_feature (31)..(31): n stands for inosine
cucaggaccugaugaggccguuaggccgaancauuuuc

SEQ ID NO: 14583 - RNA, 38 nt, Artificial Sequence
  Description of Artificial Sequence:  Enzymatic Nucleic Acid
  misc_feature (31)..(31): n stands for inosine
ucuccucacugaugaggccguuaggccgaanacugcau

SEQ ID NO: 14584 - RNA, 38 nt, Artificial Sequence
  Description of Artificial Sequence:  Enzymatic Nucleic Acid
  misc_feature (31)..(31): n stands for inosine
cucuccuccugaugaggccguuaggccgaangacugca

SEQ ID NO: 14585 - RNA, 38 nt, Artificial Sequence
  Description of Artificial Sequence:  Enzymatic Nucleic Acid
  misc_feature (31)..(31): n stands for inosine
ugauauggcugaugaggccguuaggccgaanaaaacuc

SEQ ID NO: 14586 - RNA, 38 nt, Artificial Sequence
  Description of Artificial Sequence:  Enzymatic Nucleic Acid
  misc_feature (31)..(31): n stands for inosine
uuugauaucugaugaggccguuaggccgaanagaaaac

SEQ ID NO: 14587 - RNA, 38 nt, Artificial Sequence
  Description of Artificial Sequence:  Enzymatic Nucleic Acid
  misc_feature (31)..(31): n stands for inosine
uuuugauacugaugaggccguuaggccgaangagaaaa

SEQ ID NO: 14588 - RNA, 38 nt, Artificial Sequence
  Description of Artificial Sequence:  Enzymatic Nucleic Acid
  misc_feature (31)..(31): n stands for inosine
ccucguuucugaugaggccguuaggccgaanauaugga

SEQ ID NO: 14589 - RNA, 38 nt, Artificial Sequence
  Description of Artificial Sequence:  Enzymatic Nucleic Acid
  misc_feature (31)..(31): n stands for inosine
ccuccauccugaugaggccguuaggccgaancccucgu

SEQ ID NO: 14590 - RNA, 38 nt, Artificial Sequence
  Description of Artificial Sequence:  Enzymatic Nucleic Acid
  misc_feature (31)..(31): n stands for inosine
gaccuuaucugaugaggccguuaggccgaanaccuuuu

SEQ ID NO: 14591 - RNA, 38 nt, Artificial Sequence
  Description of Artificial Sequence:  Enzymatic Nucleic Acid
  misc_feature (31)..(31): n stands for inosine
ucuucccucugaugaggccguuaggccgaanaccuuau

SEQ ID NO: 14592 - RNA, 38 nt, Artificial Sequence
  Description of Artificial Sequence:  Enzymatic Nucleic Acid
  misc_feature (31)..(31): n stands for inosine
agagacggcugaugaggccguuaggccgaanucuuccc

SEQ ID NO: 14593 - RNA, 38 nt, Artificial Sequence
  Description of Artificial Sequence:  Enzymatic Nucleic Acid
  misc_feature (31)..(31): n stands for inosine
uagagacgcugaugaggccguuaggccgaangucuucc

SEQ ID NO: 14594 - RNA, 38 nt, Artificial Sequence
  Description of Artificial Sequence:  Enzymatic Nucleic Acid
  misc_feature (31)..(31): n stands for inosine
auagagaccugaugaggccguuaggccgaanggucuuc

SEQ ID NO: 14595 - RNA, 38 nt, Artificial Sequence
  Description of Artificial Sequence:  Enzymatic Nucleic Acid
  misc_feature (31)..(31): n stands for inosine
ugguauagcugaugaggccguuaggccgaanacggggu

SEQ ID NO: 14596 - RNA, 38 nt, Artificial Sequence
  Description of Artificial Sequence:  Enzymatic Nucleic Acid
  misc_feature (31)..(31): n stands for inosine
guugguaucugaugaggccguuaggccgaanagacggg

SEQ ID NO: 14597 - RNA, 38 nt, Artificial Sequence
  Description of Artificial Sequence:  Enzymatic Nucleic Acid
  misc_feature (31)..(31): n stands for inosine
guuugguucugaugaggccguuaggccgaanuauagag

SEQ ID NO: 14598 - RNA, 38 nt, Artificial Sequence
  Description of Artificial Sequence:  Enzymatic Nucleic Acid
  misc_feature (31)..(31): n stands for inosine
gguuuggucugaugaggccguuaggccgaanguauaga

SEQ ID NO: 14599 - RNA, 38 nt, Artificial Sequence
  Description of Artificial Sequence:  Enzymatic Nucleic Acid
  misc_feature (31)..(31): n stands for inosine
auugguuucugaugaggccguuaggccgaanuugguau

SEQ ID NO: 14600 - RNA, 38 nt, Artificial Sequence
  Description of Artificial Sequence:  Enzymatic Nucleic Acid
  misc_feature (31)..(31): n stands for inosine
aauugguucugaugaggccguuaggccgaanguuggua

SEQ ID NO: 14601 - RNA, 38 nt, Artificial Sequence
  Description of Artificial Sequence:  Enzymatic Nucleic Acid
  misc_feature (31)..(31): n stands for inosine
ggugaauucugaugaggccguuaggccgaanuuugguu

SEQ ID NO: 14602 - RNA, 38 nt, Artificial Sequence
  Description of Artificial Sequence:  Enzymatic Nucleic Acid
  misc_feature (31)..(31): n stands for inosine
uggugaaucugaugaggccguuaggccgaanguuuggu

SEQ ID NO: 14603 - RNA, 38 nt, Artificial Sequence
  Description of Artificial Sequence:  Enzymatic Nucleic Acid
  misc_feature (31)..(31): n stands for inosine
uguguuggcugaugaggccguuaggccgaanaauuggu

SEQ ID NO: 14604 - RNA, 38 nt, Artificial Sequence
  Description of Artificial Sequence:  Enzymatic Nucleic Acid
  misc_feature (31)..(31): n stands for inosine
acuguguucugaugaggccguuaggccgaanugaauug

SEQ ID NO: 14605 - RNA, 38 nt, Artificial Sequence
  Description of Artificial Sequence:  Enzymatic Nucleic Acid
  misc_feature (31)..(31): n stands for inosine
aacugugucugaugaggccguuaggccgaangugaauu

SEQ ID NO: 14606 - RNA, 38 nt, Artificial Sequence
  Description of Artificial Sequence:  Enzymatic Nucleic Acid
  misc_feature (31)..(31): n stands for inosine
cccaacugcugaugaggccguuaggccgaanuugguga

SEQ ID NO: 14607 - RNA, 38 nt, Artificial Sequence
  Description of Artificial Sequence:  Enzymatic Nucleic Acid
  misc_feature (31)..(31): n stands for inosine
gucccaaccugaugaggccguuaggccgaanuguuggu

SEQ ID NO: 14608 - RNA, 38 nt, Artificial Sequence
  Description of Artificial Sequence:  Enzymatic Nucleic Acid
  misc_feature (31)..(31): n stands for inosine
guguuuugcugaugaggccguuaggccgaanucccaac

SEQ ID NO: 14609 - RNA, 38 nt, Artificial Sequence
  Description of Artificial Sequence:  Enzymatic Nucleic Acid
  misc_feature (31)..(31): n stands for inosine
uguguuuucugaugaggccguuaggccgaangucccaa

SEQ ID NO: 14610 - RNA, 38 nt, Artificial Sequence
  Description of Artificial Sequence:  Enzymatic Nucleic Acid
  misc_feature (31)..(31): n stands for inosine
cuguguuucugaugaggccguuaggccgaangguccca

SEQ ID NO: 14611 - RNA, 38 nt, Artificial Sequence
  Description of Artificial Sequence:  Enzymatic Nucleic Acid
  misc_feature (31)..(31): n stands for inosine
acuuccugcugaugaggccguuaggccgaanuuuuggg

SEQ ID NO: 14612 - RNA, 38 nt, Artificial Sequence
  Description of Artificial Sequence:  Enzymatic Nucleic Acid
  misc_feature (31)..(31): n stands for inosine
ugacuucccugaugaggccguuaggccgaanuguuuug

SEQ ID NO: 14613 - RNA, 38 nt, Artificial Sequence
  Description of Artificial Sequence:  Enzymatic Nucleic Acid
  misc_feature (31)..(31): n stands for inosine
aacgugaccugaugaggccguuaggccgaanacuuccu

SEQ ID NO: 14614 - RNA, 38 nt, Artificial Sequence
  Description of Artificial Sequence:  Enzymatic Nucleic Acid
  misc_feature (31)..(31): n stands for inosine
aggaaacgcugaugaggccguuaggccgaanacugacu

SEQ ID NO: 14615 - RNA, 38 nt, Artificial Sequence
  Description of Artificial Sequence:  Enzymatic Nucleic Acid
  misc_feature (31)..(31): n stands for inosine
aaugaaaacugaugaggccguuaggccgaanaaacgug

SEQ ID NO: 14616 - RNA, 38 nt, Artificial Sequence
  Description of Artificial Sequence:  Enzymatic Nucleic Acid
  misc_feature (31)..(31): n stands for inosine
aaaugaaacugaugaggccguuaggccgaangaaacgu

SEQ ID NO: 14617 - RNA, 38 nt, Artificial Sequence
  Description of Artificial Sequence:  Enzymatic Nucleic Acid
  misc_feature (31)..(31): n stands for inosine
ccauuaaacugaugaggccguuaggccgaanaaaagga

SEQ ID NO: 14618 - RNA, 38 nt, Artificial Sequence
  Description of Artificial Sequence:  Enzymatic Nucleic Acid
  misc_feature (31)..(31): n stands for inosine
gagauagucugaugaggccguuaggccgaanaaucccc

SEQ ID NO: 14619 - RNA, 38 nt, Artificial Sequence
  Description of Artificial Sequence:  Enzymatic Nucleic Acid
  misc_feature (31)..(31): n stands for inosine
ugagauagcugaugaggccguuaggccgaangaauccc

SEQ ID NO: 14620 - RNA, 38 nt, Artificial Sequence
  Description of Artificial Sequence:  Enzymatic Nucleic Acid
  misc_feature (31)..(31): n stands for inosine
ugugagaucugaugaggccguuaggccgaanuggaauc

SEQ ID NO: 14621 - RNA, 38 nt, Artificial Sequence
  Description of Artificial Sequence:  Enzymatic Nucleic Acid
  misc_feature (31)..(31): n stands for inosine
uuagugugcugaugaggccguuaggccgaanauagugg

SEQ ID NO: 14622 - RNA, 38 nt, Artificial Sequence
  Description of Artificial Sequence:  Enzymatic Nucleic Acid
  misc_feature (31)..(31): n stands for inosine
gauuagugcugaugaggccguuaggccgaanagauagu

SEQ ID NO: 14623 - RNA, 38 nt, Artificial Sequence
  Description of Artificial Sequence:  Enzymatic Nucleic Acid
  misc_feature (31)..(31): n stands for inosine
cagauuagcugaugaggccguuaggccgaanugagaua

SEQ ID NO: 14624 - RNA, 38 nt, Artificial Sequence
  Description of Artificial Sequence:  Enzymatic Nucleic Acid
  misc_feature (31)..(31): n stands for inosine
uucagauucugaugaggccguuaggccgaanugugaga

SEQ ID NO: 14625 - RNA, 38 nt, Artificial Sequence
  Description of Artificial Sequence:  Enzymatic Nucleic Acid
  misc_feature (31)..(31): n stands for inosine
auccuuuccugaugaggccguuaggccgaanauuagug

SEQ ID NO: 14626 - RNA, 38 nt, Artificial Sequence
  Description of Artificial Sequence:  Enzymatic Nucleic Acid
  misc_feature (31)..(31): n stands for inosine
ccagcuaacugaugaggccguuaggccgaancucuucc

SEQ ID NO: 14627 - RNA, 38 nt, Artificial Sequence
  Description of Artificial Sequence:  Enzymatic Nucleic Acid
  misc_feature (31)..(31): n stands for inosine
uaugcgcccugaugaggccguuaggccgaancuaaugc

SEQ ID NO: 14628 - RNA, 38 nt, Artificial Sequence
  Description of Artificial Sequence:  Enzymatic Nucleic Acid
  misc_feature (31)..(31): n stands for inosine
gcuuaauacugaugaggccguuaggccgaancgccagc

SEQ ID NO: 14629 - RNA, 38 nt, Artificial Sequence
  Description of Artificial Sequence:  Enzymatic Nucleic Acid
  misc_feature (31)..(31): n stands for inosine
gcuuaaagcugaugaggccguuaggccgaancuuaaua

SEQ ID NO: 14630 - RNA, 38 nt, Artificial Sequence
  Description of Artificial Sequence:  Enzymatic Nucleic Acid
  misc_feature (31)..(31): n stands for inosine
gagcuuaacugaugaggccguuaggccgaanugcuuaa

SEQ ID NO: 14631 - RNA, 38 nt, Artificial Sequence
  Description of Artificial Sequence:  Enzymatic Nucleic Acid
  misc_feature (31)..(31): n stands for inosine
acucaaggcugaugaggccguuaggccgaancuuaaag

SEQ ID NO: 14632 - RNA, 38 nt, Artificial Sequence
  Description of Artificial Sequence:  Enzymatic Nucleic Acid
  misc_feature (31)..(31): n stands for inosine
uuacucaacugaugaggccguuaggccgaanagcuuaa

SEQ ID NO: 14633 - RNA, 38 nt, Artificial Sequence
  Description of Artificial Sequence:  Enzymatic Nucleic Acid
  misc_feature (31)..(31): n stands for inosine
uuuacucacugaugaggccguuaggccgaangagcuua

SEQ ID NO: 14634 - RNA, 38 nt, Artificial Sequence
  Description of Artificial Sequence:  Enzymatic Nucleic Acid
  misc_feature (31)..(31): n stands for inosine
aaauaccucugaugaggccguuaggccgaancauaaau

SEQ ID NO: 14635 - RNA, 38 nt, Artificial Sequence
  Description of Artificial Sequence:  Enzymatic Nucleic Acid
  misc_feature (31)..(31): n stands for inosine
ccaacuggcugaugaggccguuaggccgaanaaauacc

SEQ ID NO: 14636 - RNA, 38 nt, Artificial Sequence
  Description of Artificial Sequence:  Enzymatic Nucleic Acid
  misc_feature (31)..(31): n stands for inosine
ucccaacucugaugaggccguuaggccgaanagaaaua

SEQ ID NO: 14637 - RNA, 38 nt, Artificial Sequence
  Description of Artificial Sequence:  Enzymatic Nucleic Acid
  misc_feature (31)..(31): n stands for inosine
gucccaaccugaugaggccguuaggccgaangagaaau

SEQ ID NO: 14638 - RNA, 38 nt, Artificial Sequence
  Description of Artificial Sequence:  Enzymatic Nucleic Acid
  misc_feature (31)..(31): n stands for inosine
auauccugcugaugaggccguuaggccgaanucccaac

SEQ ID NO: 14639 - RNA, 38 nt, Artificial Sequence
  Description of Artificial Sequence:  Enzymatic Nucleic Acid
  misc_feature (31)..(31): n stands for inosine
uaauaucccugaugaggccguuaggccgaanaguccca

SEQ ID NO: 14640 - RNA, 38 nt, Artificial Sequence
  Description of Artificial Sequence:  Enzymatic Nucleic Acid
  misc_feature (31)..(31): n stands for inosine
cuagugaucugaugaggccguuaggccgaancucauua

SEQ ID NO: 14641 - RNA, 38 nt, Artificial Sequence
  Description of Artificial Sequence:  Enzymatic Nucleic Acid
  misc_feature (31)..(31): n stands for inosine
ucuagugacugaugaggccguuaggccgaangcucauu

SEQ ID NO: 14642 - RNA, 38 nt, Artificial Sequence
  Description of Artificial Sequence:  Enzymatic Nucleic Acid
  misc_feature (31)..(31): n stands for inosine
ucuucuagcugaugaggccguuaggccgaanauggcuc

SEQ ID NO: 14643 - RNA, 38 nt, Artificial Sequence
  Description of Artificial Sequence:  Enzymatic Nucleic Acid
  misc_feature (31)..(31): n stands for inosine
uuucuucucugaugaggccguuaggccgaanugauggc

SEQ ID NO: 14644 - RNA, 38 nt, Artificial Sequence
  Description of Artificial Sequence:  Enzymatic Nucleic Acid
  misc_feature (31)..(31): n stands for inosine
ugaaaaugcugaugaggccguuaggccgaancuuuucu

SEQ ID NO: 14645 - RNA, 38 nt, Artificial Sequence
  Description of Artificial Sequence:  Enzymatic Nucleic Acid
  misc_feature (31)..(31): n stands for inosine
uugaaaaucugaugaggccguuaggccgaangcuuuuc

SEQ ID NO: 14646 - RNA, 38 nt, Artificial Sequence
  Description of Artificial Sequence:  Enzymatic Nucleic Acid
  misc_feature (31)..(31): n stands for inosine
guugaaaacugaugaggccguuaggccgaanggcuuuu

SEQ ID NO: 14647 - RNA, 38 nt, Artificial Sequence
  Description of Artificial Sequence:  Enzymatic Nucleic Acid
  misc_feature (31)..(31): n stands for inosine
aaagcagucugaugaggccguuaggccgaanaaaaugg

SEQ ID NO: 14648 - RNA, 38 nt, Artificial Sequence
  Description of Artificial Sequence:  Enzymatic Nucleic Acid
  misc_feature (31)..(31): n stands for inosine
uucaaagccugaugaggccguuaggccgaanuugaaaa

SEQ ID NO: 14649 - RNA, 38 nt, Artificial Sequence
  Description of Artificial Sequence:  Enzymatic Nucleic Acid
  misc_feature (31)..(31): n stands for inosine
aguuucaacugaugaggccguuaggccgaancaguuga

SEQ ID NO: 14650 - RNA, 38 nt, Artificial Sequence
  Description of Artificial Sequence:  Enzymatic Nucleic Acid
  misc_feature (31)..(31): n stands for inosine
cccaggcacugaugaggccguuaggccgaanuuucaaa

SEQ ID NO: 14651 - RNA, 38 nt, Artificial Sequence
  Description of Artificial Sequence:  Enzymatic Nucleic Acid
  misc_feature (31)..(31): n stands for inosine
agaccccacugaugaggccguuaggccgaancaaguuu

SEQ ID NO: 14652 - RNA, 38 nt, Artificial Sequence
  Description of Artificial Sequence:  Enzymatic Nucleic Acid
  misc_feature (31)..(31): n stands for inosine
cagacccccugaugaggccguuaggccgaangcaaguu

SEQ ID NO: 14653 - RNA, 38 nt, Artificial Sequence
  Description of Artificial Sequence:  Enzymatic Nucleic Acid
  misc_feature (31)..(31): n stands for inosine
ucaugcuccugaugaggccguuaggccgaanaccccag

SEQ ID NO: 14654 - RNA, 38 nt, Artificial Sequence
  Description of Artificial Sequence:  Enzymatic Nucleic Acid
  misc_feature (31)..(31): n stands for inosine
ucccaucacugaugaggccguuaggccgaancucagac

SEQ ID NO: 14655 - RNA, 38 nt, Artificial Sequence
  Description of Artificial Sequence:  Enzymatic Nucleic Acid
  misc_feature (31)..(31): n stands for inosine
uccuaccccugaugaggccguuaggccgaanucucccu

SEQ ID NO: 14656 - RNA, 38 nt, Artificial Sequence
  Description of Artificial Sequence:  Enzymatic Nucleic Acid
  misc_feature (31)..(31): n stands for inosine
gaagaguacugaugaggccguuaggccgaancgcccuu

SEQ ID NO: 14657 - RNA, 38 nt, Artificial Sequence
  Description of Artificial Sequence:  Enzymatic Nucleic Acid
  misc_feature (31)..(31): n stands for inosine
ugaagagucugaugaggccguuaggccgaangcgcccu

SEQ ID NO: 14658 - RNA, 38 nt, Artificial Sequence
  Description of Artificial Sequence:  Enzymatic Nucleic Acid
  misc_feature (31)..(31): n stands for inosine
cccugaagcugaugaggccguuaggccgaanuaggcgc

SEQ ID NO: 14659 - RNA, 38 nt, Artificial Sequence
  Description of Artificial Sequence:  Enzymatic Nucleic Acid
  misc_feature (31)..(31): n stands for inosine
gacccugacugaugaggccguuaggccgaanaguaggc

SEQ ID NO: 14660 - RNA, 38 nt, Artificial Sequence
  Description of Artificial Sequence:  Enzymatic Nucleic Acid
  misc_feature (31)..(31): n stands for inosine
uuagaccccugaugaggccguuaggccgaanaagagua

SEQ ID NO: 14661 - RNA, 38 nt, Artificial Sequence
  Description of Artificial Sequence:  Enzymatic Nucleic Acid
  misc_feature (31)..(31): n stands for inosine
ugaucuuucugaugaggccguuaggccgaanacccuga

SEQ ID NO: 14662 - RNA, 38 nt, Artificial Sequence
  Description of Artificial Sequence:  Enzymatic Nucleic Acid
  misc_feature (31)..(31): n stands for inosine
ggcccacucugaugaggccguuaggccgaanaucuuua

SEQ ID NO: 14663 - RNA, 38 nt, Artificial Sequence
  Description of Artificial Sequence:  Enzymatic Nucleic Acid
  misc_feature (31)..(31): n stands for inosine
cgauccaacugaugaggccguuaggccgaancccacuu

SEQ ID NO: 14664 - RNA, 38 nt, Artificial Sequence
  Description of Artificial Sequence:  Enzymatic Nucleic Acid
  misc_feature (31)..(31): n stands for inosine
gcgauccacugaugaggccguuaggccgaangcccacu

SEQ ID NO: 14665 - RNA, 38 nt, Artificial Sequence
  Description of Artificial Sequence:  Enzymatic Nucleic Acid
  misc_feature (31)..(31): n stands for inosine
gccagcuucugaugaggccguuaggccgaancgaucca

SEQ ID NO: 14666 - RNA, 38 nt, Artificial Sequence
  Description of Artificial Sequence:  Enzymatic Nucleic Acid
  misc_feature (31)..(31): n stands for inosine
acagagcccugaugaggccguuaggccgaancuuagcg

SEQ ID NO: 14667 - RNA, 38 nt, Artificial Sequence
  Description of Artificial Sequence:  Enzymatic Nucleic Acid
  misc_feature (31)..(31): n stands for inosine
ucaaacagcugaugaggccguuaggccgaanccagcuu

SEQ ID NO: 14668 - RNA, 38 nt, Artificial Sequence
  Description of Artificial Sequence:  Enzymatic Nucleic Acid
  misc_feature (31)..(31): n stands for inosine
caucaaaccugaugaggccguuaggccgaanagccagc

SEQ ID NO: 14669 - RNA, 38 nt, Artificial Sequence
  Description of Artificial Sequence:  Enzymatic Nucleic Acid
  misc_feature (31)..(31): n stands for inosine
gcauaaaucugaugaggccguuaggccgaancaucaaa

SEQ ID NO: 14670 - RNA, 38 nt, Artificial Sequence
  Description of Artificial Sequence:  Enzymatic Nucleic Acid
  misc_feature (31)..(31): n stands for inosine
cccuaacucugaugaggccguuaggccgaancauaaau

SEQ ID NO: 14671 - RNA, 38 nt, Artificial Sequence
  Description of Artificial Sequence:  Enzymatic Nucleic Acid
  misc_feature (31)..(31): n stands for inosine
aaauacaucugaugaggccguuaggccgaanacccuaa

SEQ ID NO: 14672 - RNA, 38 nt, Artificial Sequence
  Description of Artificial Sequence:  Enzymatic Nucleic Acid
  misc_feature (31)..(31): n stands for inosine
gaagaguacugaugaggccguuaggccgaancgcaucc

SEQ ID NO: 14673 - RNA, 38 nt, Artificial Sequence
  Description of Artificial Sequence:  Enzymatic Nucleic Acid
  misc_feature (31)..(31): n stands for inosine
ugaagagucugaugaggccguuaggccgaangcgcauc

SEQ ID NO: 14674 - RNA, 38 nt, Artificial Sequence
  Description of Artificial Sequence:  Enzymatic Nucleic Acid
  misc_feature (31)..(31): n stands for inosine
gaaggugccugaugaggccguuaggccgaanacauccu

SEQ ID NO: 14675 - RNA, 38 nt, Artificial Sequence
  Description of Artificial Sequence:  Enzymatic Nucleic Acid
  misc_feature (31)..(31): n stands for inosine
gcagaaggcugaugaggccguuaggccgaancagacau

SEQ ID NO: 14676 - RNA, 38 nt, Artificial Sequence
  Description of Artificial Sequence:  Enzymatic Nucleic Acid
  misc_feature (31)..(31): n stands for inosine
cugcagaacugaugaggccguuaggccgaanugcagac

SEQ ID NO: 14677 - RNA, 38 nt, Artificial Sequence
  Description of Artificial Sequence:  Enzymatic Nucleic Acid
  misc_feature (31)..(31): n stands for inosine
gcugcagacugaugaggccguuaggccgaangugcaga

SEQ ID NO: 14678 - RNA, 38 nt, Artificial Sequence
  Description of Artificial Sequence:  Enzymatic Nucleic Acid
  misc_feature (31)..(31): n stands for inosine
cuggcugccugaugaggccguuaggccgaanaaggugc

SEQ ID NO: 14679 - RNA, 38 nt, Artificial Sequence
  Description of Artificial Sequence:  Enzymatic Nucleic Acid
  misc_feature (31)..(31): n stands for inosine
ugacuggccugaugaggccguuaggccgaancagaagg

SEQ ID NO: 14680 - RNA, 38 nt, Artificial Sequence
  Description of Artificial Sequence:  Enzymatic Nucleic Acid
  misc_feature (31)..(31): n stands for inosine
uucugacucugaugaggccguuaggccgaancugcaga

SEQ ID NO: 14681 - RNA, 38 nt, Artificial Sequence
  Description of Artificial Sequence:  Enzymatic Nucleic Acid
  misc_feature (31)..(31): n stands for inosine
cuucugaccugaugaggccguuaggccgaangcugcag

SEQ ID NO: 14682 - RNA, 38 nt, Artificial Sequence
  Description of Artificial Sequence:  Enzymatic Nucleic Acid
  misc_feature (31)..(31): n stands for inosine
ccagcuuccugaugaggccguuaggccgaanacuggcu

SEQ ID NO: 14683 - RNA, 38 nt, Artificial Sequence
  Description of Artificial Sequence:  Enzymatic Nucleic Acid
  misc_feature (31)..(31): n stands for inosine
gccucucccugaugaggccguuaggccgaancuucuga

SEQ ID NO: 14684 - RNA, 38 nt, Artificial Sequence
  Description of Artificial Sequence:  Enzymatic Nucleic Acid
  misc_feature (31)..(31): n stands for inosine
uccacugucugaugaggccguuaggccgaanccucucc

SEQ ID NO: 14685 - RNA, 38 nt, Artificial Sequence
  Description of Artificial Sequence:  Enzymatic Nucleic Acid
  misc_feature (31)..(31): n stands for inosine
caauccaccugaugaggccguuaggccgaanuugccuc

SEQ ID NO: 14686 - RNA, 38 nt, Artificial Sequence
  Description of Artificial Sequence:  Enzymatic Nucleic Acid
  misc_feature (31)..(31): n stands for inosine
caagaagccugaugaggccguuaggccgaancaaucca

SEQ ID NO: 14687 - RNA, 38 nt, Artificial Sequence
  Description of Artificial Sequence:  Enzymatic Nucleic Acid
  misc_feature (31)..(31): n stands for inosine
ccccaagacugaugaggccguuaggccgaancagcaau

SEQ ID NO: 14688 - RNA, 38 nt, Artificial Sequence
  Description of Artificial Sequence:  Enzymatic Nucleic Acid
  misc_feature (31)..(31): n stands for inosine
ucuccccacugaugaggccguuaggccgaanaagcagc

SEQ ID NO: 14689 - RNA, 38 nt, Artificial Sequence
  Description of Artificial Sequence:  Enzymatic Nucleic Acid
  misc_feature (31)..(31): n stands for inosine
uaaaaggacugaugaggccguuaggccgaancauacuc

SEQ ID NO: 14690 - RNA, 38 nt, Artificial Sequence
  Description of Artificial Sequence:  Enzymatic Nucleic Acid
  misc_feature (31)..(31): n stands for inosine
ggauaaaacugaugaggccguuaggccgaanaagcaua

SEQ ID NO: 14691 - RNA, 38 nt, Artificial Sequence
  Description of Artificial Sequence:  Enzymatic Nucleic Acid
  misc_feature (31)..(31): n stands for inosine
uggauaaacugaugaggccguuaggccgaangaagcau

SEQ ID NO: 14692 - RNA, 38 nt, Artificial Sequence
  Description of Artificial Sequence:  Enzymatic Nucleic Acid
  misc_feature (31)..(31): n stands for inosine
aauuacaucugaugaggccguuaggccgaanauaaaag

SEQ ID NO: 14693 - RNA, 38 nt, Artificial Sequence
  Description of Artificial Sequence:  Enzymatic Nucleic Acid
  misc_feature (31)..(31): n stands for inosine
aaauuacacugaugaggccguuaggccgaangauaaaa

SEQ ID NO: 14694 - RNA, 38 nt, Artificial Sequence
  Description of Artificial Sequence:  Enzymatic Nucleic Acid
  misc_feature (31)..(31): n stands for inosine
gguucuaccugaugaggccguuaggccgaanuuaaauu

SEQ ID NO: 14695 - RNA, 38 nt, Artificial Sequence
  Description of Artificial Sequence:  Enzymatic Nucleic Acid
  misc_feature (31)..(31): n stands for inosine
agagcucacugaugaggccguuaggccgaanuucuaca

SEQ ID NO: 14696 - RNA, 38 nt, Artificial Sequence
  Description of Artificial Sequence:  Enzymatic Nucleic Acid
  misc_feature (31)..(31): n stands for inosine
uagagcuccugaugaggccguuaggccgaanguucuac

SEQ ID NO: 14697 - RNA, 38 nt, Artificial Sequence
  Description of Artificial Sequence:  Enzymatic Nucleic Acid
  misc_feature (31)..(31): n stands for inosine
uuacuuagcugaugaggccguuaggccgaancucaggu

SEQ ID NO: 14698 - RNA, 38 nt, Artificial Sequence
  Description of Artificial Sequence:  Enzymatic Nucleic Acid
  misc_feature (31)..(31): n stands for inosine
gguuacuucugaugaggccguuaggccgaanagcucag

SEQ ID NO: 14699 - RNA, 38 nt, Artificial Sequence
  Description of Artificial Sequence:  Enzymatic Nucleic Acid
  misc_feature (31)..(31): n stands for inosine
cauucuuccugaugaggccguuaggccgaanuuacuua

SEQ ID NO: 14700 - RNA, 38 nt, Artificial Sequence
  Description of Artificial Sequence:  Enzymatic Nucleic Acid
  misc_feature (31)..(31): n stands for inosine
agaacagacugaugaggccguuaggccgaancauacau

SEQ ID NO: 14701 - RNA, 38 nt, Artificial Sequence
  Description of Artificial Sequence:  Enzymatic Nucleic Acid
  misc_feature (31)..(31): n stands for inosine
aagaacagcugaugaggccguuaggccgaangcauaca

SEQ ID NO: 14702 - RNA, 38 nt, Artificial Sequence
  Description of Artificial Sequence:  Enzymatic Nucleic Acid
  misc_feature (31)..(31): n stands for inosine
auaagaaccugaugaggccguuaggccgaanaggcaua

SEQ ID NO: 14703 - RNA, 38 nt, Artificial Sequence
  Description of Artificial Sequence:  Enzymatic Nucleic Acid
  misc_feature (31)..(31): n stands for inosine
ggcacauacugaugaggccguuaggccgaanaacagag

SEQ ID NO: 14704 - RNA, 38 nt, Artificial Sequence
  Description of Artificial Sequence:  Enzymatic Nucleic Acid
  misc_feature (31)..(31): n stands for inosine
aaggaugucugaugaggccguuaggccgaancacauaa

SEQ ID NO: 14705 - RNA, 38 nt, Artificial Sequence
  Description of Artificial Sequence:  Enzymatic Nucleic Acid
  misc_feature (31)..(31): n stands for inosine
caaggaugcugaugaggccguuaggccgaangcacaua

SEQ ID NO: 14706 - RNA, 38 nt, Artificial Sequence
  Description of Artificial Sequence:  Enzymatic Nucleic Acid
  misc_feature (31)..(31): n stands for inosine
aacaaggacugaugaggccguuaggccgaanuggcaca

SEQ ID NO: 14707 - RNA, 38 nt, Artificial Sequence
  Description of Artificial Sequence:  Enzymatic Nucleic Acid
  misc_feature (31)..(31): n stands for inosine
uuaaacaacugaugaggccguuaggccgaanauguggc

SEQ ID NO: 14708 - RNA, 38 nt, Artificial Sequence
  Description of Artificial Sequence:  Enzymatic Nucleic Acid
  misc_feature (31)..(31): n stands for inosine
uuuaaacacugaugaggccguuaggccgaangaugugg

SEQ ID NO: 14709 - RNA, 38 nt, Artificial Sequence
  Description of Artificial Sequence:  Enzymatic Nucleic Acid
  misc_feature (31)..(31): n stands for inosine
auacagagcugaugaggccguuaggccgaanccuuuaa

SEQ ID NO: 14710 - RNA, 38 nt, Artificial Sequence
  Description of Artificial Sequence:  Enzymatic Nucleic Acid
  misc_feature (31)..(31): n stands for inosine
ucauacagcugaugaggccguuaggccgaanagccuuu

SEQ ID NO: 14711 - RNA, 38 nt, Artificial Sequence
  Description of Artificial Sequence:  Enzymatic Nucleic Acid
  misc_feature (31)..(31): n stands for inosine
cuucauaccugaugaggccguuaggccgaanagagccu

SEQ ID NO: 14712 - RNA, 38 nt, Artificial Sequence
  Description of Artificial Sequence:  Enzymatic Nucleic Acid
  misc_feature (31)..(31): n stands for inosine
cugaugaccugaugaggccguuaggccgaanucccauc

SEQ ID NO: 14713 - RNA, 38 nt, Artificial Sequence
  Description of Artificial Sequence:  Enzymatic Nucleic Acid
  misc_feature (31)..(31): n stands for inosine
ugugcugacugaugaggccguuaggccgaanacggucc

SEQ ID NO: 14714 - RNA, 38 nt, Artificial Sequence
  Description of Artificial Sequence:  Enzymatic Nucleic Acid
  misc_feature (31)..(31): n stands for inosine
gaaugugccugaugaggccguuaggccgaanaugacgg

SEQ ID NO: 14715 - RNA, 38 nt, Artificial Sequence
  Description of Artificial Sequence:  Enzymatic Nucleic Acid
  misc_feature (31)..(31): n stands for inosine
agggaaugcugaugaggccguuaggccgaancugauga

SEQ ID NO: 14716 - RNA, 38 nt, Artificial Sequence
  Description of Artificial Sequence:  Enzymatic Nucleic Acid
  misc_feature (31)..(31): n stands for inosine
cuagggaacugaugaggccguuaggccgaanugcugau

SEQ ID NO: 14717 - RNA, 38 nt, Artificial Sequence
  Description of Artificial Sequence:  Enzymatic Nucleic Acid
  misc_feature (31)..(31): n stands for inosine
cucacuagcugaugaggccguuaggccgaanaaugugc

SEQ ID NO: 14718 - RNA, 38 nt, Artificial Sequence
  Description of Artificial Sequence:  Enzymatic Nucleic Acid
  misc_feature (31)..(31): n stands for inosine
gcucacuacugaugaggccguuaggccgaangaaugug

SEQ ID NO: 14719 - RNA, 38 nt, Artificial Sequence
  Description of Artificial Sequence:  Enzymatic Nucleic Acid
  misc_feature (31)..(31): n stands for inosine
ggcucacucugaugaggccguuaggccgaanggaaugu

SEQ ID NO: 14720 - RNA, 38 nt, Artificial Sequence
  Description of Artificial Sequence:  Enzymatic Nucleic Acid
  misc_feature (31)..(31): n stands for inosine
agccaguacugaugaggccguuaggccgaancucacua

SEQ ID NO: 14721 - RNA, 38 nt, Artificial Sequence
  Description of Artificial Sequence:  Enzymatic Nucleic Acid
  misc_feature (31)..(31): n stands for inosine
gagccagucugaugaggccguuaggccgaangcucacu

SEQ ID NO: 14722 - RNA, 38 nt, Artificial Sequence
  Description of Artificial Sequence:  Enzymatic Nucleic Acid
  misc_feature (31)..(31): n stands for inosine
caggagcccugaugaggccguuaggccgaanuaggcuc

SEQ ID NO: 14723 - RNA, 38 nt, Artificial Sequence
  Description of Artificial Sequence:  Enzymatic Nucleic Acid
  misc_feature (31)..(31): n stands for inosine
cugccaggcugaugaggccguuaggccgaanccaguag

SEQ ID NO: 14724 - RNA, 38 nt, Artificial Sequence
  Description of Artificial Sequence:  Enzymatic Nucleic Acid
  misc_feature (31)..(31): n stands for inosine
cgcugccacugaugaggccguuaggccgaanagccagu

SEQ ID NO: 14725 - RNA, 38 nt, Artificial Sequence
  Description of Artificial Sequence:  Enzymatic Nucleic Acid
  misc_feature (31)..(31): n stands for inosine
ccgcugcccugaugaggccguuaggccgaangagccag

SEQ ID NO: 14726 - RNA, 38 nt, Artificial Sequence
  Description of Artificial Sequence:  Enzymatic Nucleic Acid
  misc_feature (31)..(31): n stands for inosine
aaagccgccugaugaggccguuaggccgaanccaggag

SEQ ID NO: 14727 - RNA, 38 nt, Artificial Sequence
  Description of Artificial Sequence:  Enzymatic Nucleic Acid
  misc_feature (31)..(31): n stands for inosine
uccacaaacugaugaggccguuaggccgaanccgcugc

SEQ ID NO: 14728 - RNA, 38 nt, Artificial Sequence
  Description of Artificial Sequence:  Enzymatic Nucleic Acid
  misc_feature (31)..(31): n stands for inosine
ggcuagugcugaugaggccguuaggccgaanucuucca

SEQ ID NO: 14729 - RNA, 38 nt, Artificial Sequence
  Description of Artificial Sequence:  Enzymatic Nucleic Acid
  misc_feature (31)..(31): n stands for inosine
cuggcuagcugaugaggccguuaggccgaanagucuuc

SEQ ID NO: 14730 - RNA, 38 nt, Artificial Sequence
  Description of Artificial Sequence:  Enzymatic Nucleic Acid
  misc_feature (31)..(31): n stands for inosine
uucuggcucugaugaggccguuaggccgaanugagucu

SEQ ID NO: 14731 - RNA, 38 nt, Artificial Sequence
  Description of Artificial Sequence:  Enzymatic Nucleic Acid
  misc_feature (31)..(31): n stands for inosine
ucucuucucugaugaggccguuaggccgaancuaguga

SEQ ID NO: 14732 - RNA, 38 nt, Artificial Sequence
  Description of Artificial Sequence:  Enzymatic Nucleic Acid
  misc_feature (31)..(31): n stands for inosine
cucucuuccugaugaggccguuaggccgaangcuagug

SEQ ID NO: 14733 - RNA, 38 nt, Artificial Sequence
  Description of Artificial Sequence:  Enzymatic Nucleic Acid
  misc_feature (31)..(31): n stands for inosine
gagaggaccugaugaggccguuaggccgaanucccacu

SEQ ID NO: 14734 - RNA, 38 nt, Artificial Sequence
  Description of Artificial Sequence:  Enzymatic Nucleic Acid
  misc_feature (31)..(31): n stands for inosine
gguggagacugaugaggccguuaggccgaanacugucc

SEQ ID NO: 14735 - RNA, 38 nt, Artificial Sequence
  Description of Artificial Sequence:  Enzymatic Nucleic Acid
  misc_feature (31)..(31): n stands for inosine
ugguggagcugaugaggccguuaggccgaangacuguc

SEQ ID NO: 14736 - RNA, 38 nt, Artificial Sequence
  Description of Artificial Sequence:  Enzymatic Nucleic Acid
  misc_feature (31)..(31): n stands for inosine
cuugguggcugaugaggccguuaggccgaanaggacug

SEQ ID NO: 14737 - RNA, 38 nt, Artificial Sequence
  Description of Artificial Sequence:  Enzymatic Nucleic Acid
  misc_feature (31)..(31): n stands for inosine
aucuuggucugaugaggccguuaggccgaanagaggac

SEQ ID NO: 14738 - RNA, 38 nt, Artificial Sequence
  Description of Artificial Sequence:  Enzymatic Nucleic Acid
  misc_feature (31)..(31): n stands for inosine
gaucuuggcugaugaggccguuaggccgaangagagga

SEQ ID NO: 14739 - RNA, 38 nt, Artificial Sequence
  Description of Artificial Sequence:  Enzymatic Nucleic Acid
  misc_feature (31)..(31): n stands for inosine
uagaucuucugaugaggccguuaggccgaanuggagag

SEQ ID NO: 14740 - RNA, 38 nt, Artificial Sequence
  Description of Artificial Sequence:  Enzymatic Nucleic Acid
  misc_feature (31)..(31): n stands for inosine
uuagaucucugaugaggccguuaggccgaanguggaga

SEQ ID NO: 14741 - RNA, 38 nt, Artificial Sequence
  Description of Artificial Sequence:  Enzymatic Nucleic Acid
  misc_feature (31)..(31): n stands for inosine
uuggauuucugaugaggccguuaggccgaanaucuugg

SEQ ID NO: 14742 - RNA, 38 nt, Artificial Sequence
  Description of Artificial Sequence:  Enzymatic Nucleic Acid
  misc_feature (31)..(31): n stands for inosine
uuuuguuucugaugaggccguuaggccgaanauuuaga

SEQ ID NO: 14743 - RNA, 38 nt, Artificial Sequence
  Description of Artificial Sequence:  Enzymatic Nucleic Acid
  misc_feature (31)..(31): n stands for inosine
cuuuuguucugaugaggccguuaggccgaangauuuag

SEQ ID NO: 14744 - RNA, 38 nt, Artificial Sequence
  Description of Artificial Sequence:  Enzymatic Nucleic Acid
  misc_feature (31)..(31): n stands for inosine
ccugcuuucugaugaggccguuaggccgaanuuuggau

SEQ ID NO: 14745 - RNA, 38 nt, Artificial Sequence
  Description of Artificial Sequence:  Enzymatic Nucleic Acid
  misc_feature (31)..(31): n stands for inosine
cucuagcccugaugaggccguuaggccgaancuuuugu

SEQ ID NO: 14746 - RNA, 38 nt, Artificial Sequence
  Description of Artificial Sequence:  Enzymatic Nucleic Acid
  misc_feature (31)..(31): n stands for inosine
cuggcucucugaugaggccguuaggccgaanccugcuu

SEQ ID NO: 14747 - RNA, 38 nt, Artificial Sequence
  Description of Artificial Sequence:  Enzymatic Nucleic Acid
  misc_feature (31)..(31): n stands for inosine
ucucuucucugaugaggccguuaggccgaancucuagc

SEQ ID NO: 14748 - RNA, 38 nt, Artificial Sequence
  Description of Artificial Sequence:  Enzymatic Nucleic Acid
  misc_feature (31)..(31): n stands for inosine
cucucuuccugaugaggccguuaggccgaangcucuag

SEQ ID NO: 14749 - RNA, 38 nt, Artificial Sequence
  Description of Artificial Sequence:  Enzymatic Nucleic Acid
  misc_feature (31)..(31): n stands for inosine
caaagauucugaugaggccguuaggccgaanuccucuc

SEQ ID NO: 14750 - RNA, 38 nt, Artificial Sequence
  Description of Artificial Sequence:  Enzymatic Nucleic Acid
  misc_feature (31)..(31): n stands for inosine
aacaacaacugaugaggccguuaggccgaanauuuguc

SEQ ID NO: 14751 - RNA, 38 nt, Artificial Sequence
  Description of Artificial Sequence:  Enzymatic Nucleic Acid
  misc_feature (31)..(31): n stands for inosine
aaagaagacugaugaggccguuaggccgaanaacaaca

SEQ ID NO: 14752 - RNA, 38 nt, Artificial Sequence
  Description of Artificial Sequence:  Enzymatic Nucleic Acid
  misc_feature (31)..(31): n stands for inosine
uaaagaagcugaugaggccguuaggccgaangaacaac

SEQ ID NO: 14753 - RNA, 38 nt, Artificial Sequence
  Description of Artificial Sequence:  Enzymatic Nucleic Acid
  misc_feature (31)..(31): n stands for inosine
uguaaagacugaugaggccguuaggccgaanaggaaca

SEQ ID NO: 14754 - RNA, 38 nt, Artificial Sequence
  Description of Artificial Sequence:  Enzymatic Nucleic Acid
  misc_feature (31)..(31): n stands for inosine
auguguaacugaugaggccguuaggccgaanaagagga

SEQ ID NO: 14755 - RNA, 38 nt, Artificial Sequence
  Description of Artificial Sequence:  Enzymatic Nucleic Acid
  misc_feature (31)..(31): n stands for inosine
ugcguaugcugaugaggccguuaggccgaanuaaagaa

SEQ ID NO: 14756 - RNA, 38 nt, Artificial Sequence
  Description of Artificial Sequence:  Enzymatic Nucleic Acid
  misc_feature (31)..(31): n stands for inosine
uuugcguacugaugaggccguuaggccgaanuguaaag

SEQ ID NO: 14757 - RNA, 38 nt, Artificial Sequence
  Description of Artificial Sequence:  Enzymatic Nucleic Acid
  misc_feature (31)..(31): n stands for inosine
aggugguucugaugaggccguuaggccgaancguaugu

SEQ ID NO: 14758 - RNA, 38 nt, Artificial Sequence
  Description of Artificial Sequence:  Enzymatic Nucleic Acid
  misc_feature (31)..(31): n stands for inosine
ucacaggucugaugaggccguuaggccgaanuuugcgu

SEQ ID NO: 14759 - RNA, 38 nt, Artificial Sequence
  Description of Artificial Sequence:  Enzymatic Nucleic Acid
  misc_feature (31)..(31): n stands for inosine
gucacaggcugaugaggccguuaggccgaanguuugcg

SEQ ID NO: 14760 - RNA, 38 nt, Artificial Sequence
  Description of Artificial Sequence:  Enzymatic Nucleic Acid
  misc_feature (31)..(31): n stands for inosine
cugucacacugaugaggccguuaggccgaanugguuug

SEQ ID NO: 14761 - RNA, 38 nt, Artificial Sequence
  Description of Artificial Sequence:  Enzymatic Nucleic Acid
  misc_feature (31)..(31): n stands for inosine
gcugucaccugaugaggccguuaggccgaangugguuu

SEQ ID NO: 14762 - RNA, 38 nt, Artificial Sequence
  Description of Artificial Sequence:  Enzymatic Nucleic Acid
  misc_feature (31)..(31): n stands for inosine
uugccagccugaugaggccguuaggccgaanucacagg

SEQ ID NO: 14763 - RNA, 38 nt, Artificial Sequence
  Description of Artificial Sequence:  Enzymatic Nucleic Acid
  misc_feature (31)..(31): n stands for inosine
aaauugcccugaugaggccguuaggccgaancugucac

SEQ ID NO: 14764 - RNA, 38 nt, Artificial Sequence
  Description of Artificial Sequence:  Enzymatic Nucleic Acid
  misc_feature (31)..(31): n stands for inosine
uauaaaaucugaugaggccguuaggccgaanccagcug

SEQ ID NO: 14765 - RNA, 38 nt, Artificial Sequence
  Description of Artificial Sequence:  Enzymatic Nucleic Acid
  misc_feature (31)..(31): n stands for inosine
caguuacccugaugaggccguuaggccgaanauuuaua

SEQ ID NO: 14766 - RNA, 38 nt, Artificial Sequence
  Description of Artificial Sequence:  Enzymatic Nucleic Acid
  misc_feature (31)..(31): n stands for inosine
cuccuucccugaugaggccguuaggccgaanuuaccug

SEQ ID NO: 14767 - RNA, 38 nt, Artificial Sequence
  Description of Artificial Sequence:  Enzymatic Nucleic Acid
  misc_feature (31)..(31): n stands for inosine
uuuuucugcugaugaggccguuaggccgaanuuuaacc

SEQ ID NO: 14768 - RNA, 38 nt, Artificial Sequence
  Description of Artificial Sequence:  Enzymatic Nucleic Acid
  misc_feature (31)..(31): n stands for inosine
cuuuuuuccugaugaggccguuaggccgaanaguuuaa

SEQ ID NO: 14769 - RNA, 38 nt, Artificial Sequence
  Description of Artificial Sequence:  Enzymatic Nucleic Acid
  misc_feature (31)..(31): n stands for inosine
uugacugacugaugaggccguuaggccgaanucuucuu

SEQ ID NO: 14770 - RNA, 38 nt, Artificial Sequence
  Description of Artificial Sequence:  Enzymatic Nucleic Acid
  misc_feature (31)..(31): n stands for inosine
auugacugcugaugaggccguuaggccgaangucuucu

SEQ ID NO: 14771 - RNA, 38 nt, Artificial Sequence
  Description of Artificial Sequence:  Enzymatic Nucleic Acid
  misc_feature (31)..(31): n stands for inosine
gaauugaccugaugaggccguuaggccgaanaggucuu

SEQ ID NO: 14772 - RNA, 38 nt, Artificial Sequence
  Description of Artificial Sequence:  Enzymatic Nucleic Acid
  misc_feature (31)..(31): n stands for inosine
uagagaaucugaugaggccguuaggccgaanacugagg

SEQ ID NO: 14773 - RNA, 38 nt, Artificial Sequence
  Description of Artificial Sequence:  Enzymatic Nucleic Acid
  misc_feature (31)..(31): n stands for inosine
aaaaguagcugaugaggccguuaggccgaanaauugac

SEQ ID NO: 14774 - RNA, 38 nt, Artificial Sequence
  Description of Artificial Sequence:  Enzymatic Nucleic Acid
  misc_feature (31)..(31): n stands for inosine
aaaaaagucugaugaggccguuaggccgaanagaauug

SEQ ID NO: 14775 - RNA, 38 nt, Artificial Sequence
  Description of Artificial Sequence:  Enzymatic Nucleic Acid
  misc_feature (31)..(31): n stands for inosine
aaaaaaaacugaugaggccguuaggccgaanuagagaa

SEQ ID NO: 14776 - RNA, 38 nt, Artificial Sequence
  Description of Artificial Sequence:  Enzymatic Nucleic Acid
  misc_feature (31)..(31): n stands for inosine
ucugauuucugaugaggccguuaggccgaanaaaaaaa

SEQ ID NO: 14777 - RNA, 38 nt, Artificial Sequence
  Description of Artificial Sequence:  Enzymatic Nucleic Acid
  misc_feature (31)..(31): n stands for inosine
aucugauucugaugaggccguuaggccgaangaaaaaa

SEQ ID NO: 14778 - RNA, 38 nt, Artificial Sequence
  Description of Artificial Sequence:  Enzymatic Nucleic Acid
  misc_feature (31)..(31): n stands for inosine
cuauuauccugaugaggccguuaggccgaanauuugga

SEQ ID NO: 14779 - RNA, 38 nt, Artificial Sequence
  Description of Artificial Sequence:  Enzymatic Nucleic Acid
  misc_feature (31)..(31): n stands for inosine
auuugcugcugaugaggccguuaggccgaancuauuau

SEQ ID NO: 14780 - RNA, 38 nt, Artificial Sequence
  Description of Artificial Sequence:  Enzymatic Nucleic Acid
  misc_feature (31)..(31): n stands for inosine
uauuugcucugaugaggccguuaggccgaangcuauua

SEQ ID NO: 14781 - RNA, 38 nt, Artificial Sequence
  Description of Artificial Sequence:  Enzymatic Nucleic Acid
  misc_feature (31)..(31): n stands for inosine
cuauuugccugaugaggccguuaggccgaanggcuauu

SEQ ID NO: 14782 - RNA, 38 nt, Artificial Sequence
  Description of Artificial Sequence:  Enzymatic Nucleic Acid
  misc_feature (31)..(31): n stands for inosine
ucacuauucugaugaggccguuaggccgaancugggcu

SEQ ID NO: 14783 - RNA, 38 nt, Artificial Sequence
  Description of Artificial Sequence:  Enzymatic Nucleic Acid
  misc_feature (31)..(31): n stands for inosine
guuuuauucugaugaggccguuaggccgaanuuaucac

SEQ ID NO: 14784 - RNA, 38 nt, Artificial Sequence
  Description of Artificial Sequence:  Enzymatic Nucleic Acid
  misc_feature (31)..(31): n stands for inosine
acagcuaacugaugaggccguuaggccgaanuuuuauu

SEQ ID NO: 14785 - RNA, 38 nt, Artificial Sequence
  Description of Artificial Sequence:  Enzymatic Nucleic Acid
  misc_feature (31)..(31): n stands for inosine
aacagcuacugaugaggccguuaggccgaanguuuuau

SEQ ID NO: 14786 - RNA, 38 nt, Artificial Sequence
  Description of Artificial Sequence:  Enzymatic Nucleic Acid
  misc_feature (31)..(31): n stands for inosine
acaugaaccugaugaggccguuaggccgaancuaaggu

SEQ ID NO: 14787 - RNA, 38 nt, Artificial Sequence
  Description of Artificial Sequence:  Enzymatic Nucleic Acid
  misc_feature (31)..(31): n stands for inosine
ucaagacacugaugaggccguuaggccgaanaacagcu

SEQ ID NO: 14788 - RNA, 38 nt, Artificial Sequence
  Description of Artificial Sequence:  Enzymatic Nucleic Acid
  misc_feature (31)..(31): n stands for inosine
ugaaaucacugaugaggccguuaggccgaanacaugaa

SEQ ID NO: 14789 - RNA, 38 nt, Artificial Sequence
  Description of Artificial Sequence:  Enzymatic Nucleic Acid
  misc_feature (31)..(31): n stands for inosine
uuaauuaucugaugaggccguuaggccgaanaaaucaa

SEQ ID NO: 14790 - RNA, 38 nt, Artificial Sequence
  Description of Artificial Sequence:  Enzymatic Nucleic Acid
  misc_feature (31)..(31): n stands for inosine
aaugauuacugaugaggccguuaggccgaanaauuaau

SEQ ID NO: 14791 - RNA, 38 nt, Artificial Sequence
  Description of Artificial Sequence:  Enzymatic Nucleic Acid
  misc_feature (31)..(31): n stands for inosine
ucucuuaacugaugaggccguuaggccgaanauuaaga

SEQ ID NO: 14792 - RNA, 38 nt, Artificial Sequence
  Description of Artificial Sequence:  Enzymatic Nucleic Acid
  misc_feature (31)..(31): n stands for inosine
uuuauuaucugaugaggccguuaggccgaanucucuua

SEQ ID NO: 14793 - RNA, 38 nt, Artificial Sequence
  Description of Artificial Sequence:  Enzymatic Nucleic Acid
  misc_feature (31)..(31): n stands for inosine
auuuauuacugaugaggccguuaggccgaangucucuu

SEQ ID NO: 14794 - RNA, 38 nt, Artificial Sequence
  Description of Artificial Sequence:  Enzymatic Nucleic Acid
  misc_feature (31)..(31): n stands for inosine
ugaaaaggcugaugaggccguuaggccgaanuauuuau

SEQ ID NO: 14795 - RNA, 38 nt, Artificial Sequence
  Description of Artificial Sequence:  Enzymatic Nucleic Acid
  misc_feature (31)..(31): n stands for inosine
cuugaaaacugaugaggccguuaggccgaanaguauuu

SEQ ID NO: 14796 - RNA, 38 nt, Artificial Sequence
  Description of Artificial Sequence:  Enzymatic Nucleic Acid
  misc_feature (31)..(31): n stands for inosine
ucuugaaacugaugaggccguuaggccgaangaguauu

SEQ ID NO: 14797 - RNA, 38 nt, Artificial Sequence
  Description of Artificial Sequence:  Enzymatic Nucleic Acid
  misc_feature (31)..(31): n stands for inosine
uuuucucucugaugaggccguuaggccgaanaaaagga

SEQ ID NO: 14798 - RNA, 38 nt, Artificial Sequence
  Description of Artificial Sequence:  Enzymatic Nucleic Acid
  misc_feature (31)..(31): n stands for inosine
aaugguuucugaugaggccguuaggccgaancuuuucu

SEQ ID NO: 14799 - RNA, 38 nt, Artificial Sequence
  Description of Artificial Sequence:  Enzymatic Nucleic Acid
  misc_feature (31)..(31): n stands for inosine
auucuaaucugaugaggccguuaggccgaanuuuugcu

SEQ ID NO: 14800 - RNA, 38 nt, Artificial Sequence
  Description of Artificial Sequence:  Enzymatic Nucleic Acid
  misc_feature (31)..(31): n stands for inosine
aauucuaacugaugaggccguuaggccgaanguuuugc

SEQ ID NO: 14801 - RNA, 38 nt, Artificial Sequence
  Description of Artificial Sequence:  Enzymatic Nucleic Acid
  misc_feature (31)..(31): n stands for inosine
aggagcugcugaugaggccguuaggccgaanuaacaau

SEQ ID NO: 14802 - RNA, 38 nt, Artificial Sequence
  Description of Artificial Sequence:  Enzymatic Nucleic Acid
  misc_feature (31)..(31): n stands for inosine
gaaggagccugaugaggccguuaggccgaanaguaaca

SEQ ID NO: 14803 - RNA, 38 nt, Artificial Sequence
  Description of Artificial Sequence:  Enzymatic Nucleic Acid
  misc_feature (31)..(31): n stands for inosine
uuugaaggcugaugaggccguuaggccgaancugagua

SEQ ID NO: 14804 - RNA, 38 nt, Artificial Sequence
  Description of Artificial Sequence:  Enzymatic Nucleic Acid
  misc_feature (31)..(31): n stands for inosine
aguuugaacugaugaggccguuaggccgaanagcugag

SEQ ID NO: 14805 - RNA, 38 nt, Artificial Sequence
  Description of Artificial Sequence:  Enzymatic Nucleic Acid
  misc_feature (31)..(31): n stands for inosine
gaguuugacugaugaggccguuaggccgaangagcuga

SEQ ID NO: 14806 - RNA, 38 nt, Artificial Sequence
  Description of Artificial Sequence:  Enzymatic Nucleic Acid
  misc_feature (31)..(31): n stands for inosine
ccugaguucugaugaggccguuaggccgaanaaggagc

SEQ ID NO: 14807 - RNA, 38 nt, Artificial Sequence
  Description of Artificial Sequence:  Enzymatic Nucleic Acid
  misc_feature (31)..(31): n stands for inosine
caaaccugcugaugaggccguuaggccgaanuuugaag

SEQ ID NO: 14808 - RNA, 38 nt, Artificial Sequence
  Description of Artificial Sequence:  Enzymatic Nucleic Acid
  misc_feature (31)..(31): n stands for inosine
uacaaacccugaugaggccguuaggccgaanaguuuga

SEQ ID NO: 14809 - RNA, 38 nt, Artificial Sequence
  Description of Artificial Sequence:  Enzymatic Nucleic Acid
  misc_feature (31)..(31): n stands for inosine
cucauguacugaugaggccguuaggccgaancuacaaa

SEQ ID NO: 14810 - RNA, 38 nt, Artificial Sequence
  Description of Artificial Sequence:  Enzymatic Nucleic Acid
  misc_feature (31)..(31): n stands for inosine
uggacucacugaugaggccguuaggccgaanuaugcua

SEQ ID NO: 14811 - RNA, 38 nt, Artificial Sequence
  Description of Artificial Sequence:  Enzymatic Nucleic Acid
  misc_feature (31)..(31): n stands for inosine
ugauggaucugaugaggccguuaggccgaanacucaug

SEQ ID NO: 14812 - RNA, 38 nt, Artificial Sequence
  Description of Artificial Sequence:  Enzymatic Nucleic Acid
  misc_feature (31)..(31): n stands for inosine
cugauggacugaugaggccguuaggccgaangacucau

SEQ ID NO: 14813 - RNA, 38 nt, Artificial Sequence
  Description of Artificial Sequence:  Enzymatic Nucleic Acid
  misc_feature (31)..(31): n stands for inosine
ugacugaucugaugaggccguuaggccgaanauggacu

SEQ ID NO: 14814 - RNA, 38 nt, Artificial Sequence
  Description of Artificial Sequence:  Enzymatic Nucleic Acid
  misc_feature (31)..(31): n stands for inosine
uugacugacugaugaggccguuaggccgaangauggac

SEQ ID NO: 14815 - RNA, 38 nt, Artificial Sequence
  Description of Artificial Sequence:  Enzymatic Nucleic Acid
  misc_feature (31)..(31): n stands for inosine
ucuuugaccugaugaggccguuaggccgaanauggaug

SEQ ID NO: 14816 - RNA, 38 nt, Artificial Sequence
  Description of Artificial Sequence:  Enzymatic Nucleic Acid
  misc_feature (31)..(31): n stands for inosine
ccauucuucugaugaggccguuaggccgaanacugaug

SEQ ID NO: 14817 - RNA, 38 nt, Artificial Sequence
  Description of Artificial Sequence:  Enzymatic Nucleic Acid
  misc_feature (31)..(31): n stands for inosine
cuccagaucugaugaggccguuaggccgaanaaccauu

SEQ ID NO: 14818 - RNA, 38 nt, Artificial Sequence
  Description of Artificial Sequence:  Enzymatic Nucleic Acid
  misc_feature (31)..(31): n stands for inosine
acuccagacugaugaggccguuaggccgaangaaccau

SEQ ID NO: 14819 - RNA, 38 nt, Artificial Sequence
  Description of Artificial Sequence:  Enzymatic Nucleic Acid
  misc_feature (31)..(31): n stands for inosine
aagacucccugaugaggccguuaggccgaanauggaac

SEQ ID NO: 14820 - RNA, 38 nt, Artificial Sequence
  Description of Artificial Sequence:  Enzymatic Nucleic Acid
  misc_feature (31)..(31): n stands for inosine
cuacauuacugaugaggccguuaggccgaanacuccag

SEQ ID NO: 14821 - RNA, 38 nt, Artificial Sequence
  Description of Artificial Sequence:  Enzymatic Nucleic Acid
  misc_feature (31)..(31): n stands for inosine
uuauuacacugaugaggccguuaggccgaanucuccau

SEQ ID NO: 14822 - RNA, 38 nt, Artificial Sequence
  Description of Artificial Sequence:  Enzymatic Nucleic Acid
  misc_feature (31)..(31): n stands for inosine
uuguaacucugaugaggccguuaggccgaancucauua

SEQ ID NO: 14823 - RNA, 38 nt, Artificial Sequence
  Description of Artificial Sequence:  Enzymatic Nucleic Acid
  misc_feature (31)..(31): n stands for inosine
aagcacuucugaugaggccguuaggccgaanuaacuag

SEQ ID NO: 14824 - RNA, 38 nt, Artificial Sequence
  Description of Artificial Sequence:  Enzymatic Nucleic Acid
  misc_feature (31)..(31): n stands for inosine
aaugaacacugaugaggccguuaggccgaancacuuug

SEQ ID NO: 14825 - RNA, 38 nt, Artificial Sequence
  Description of Artificial Sequence:  Enzymatic Nucleic Acid
  misc_feature (31)..(31): n stands for inosine
uauuuuaacugaugaggccguuaggccgaanaacaagc

SEQ ID NO: 14826 - RNA, 38 nt, Artificial Sequence
  Description of Artificial Sequence:  Enzymatic Nucleic Acid
  misc_feature (31)..(31): n stands for inosine
auuuucagcugaugaggccguuaggccgaancuauuuu

SEQ ID NO: 14827 - RNA, 38 nt, Artificial Sequence
  Description of Artificial Sequence:  Enzymatic Nucleic Acid
  misc_feature (31)..(31): n stands for inosine
caauuuuccugaugaggccguuaggccgaanugcuauu

SEQ ID NO: 14828 - RNA, 38 nt, Artificial Sequence
  Description of Artificial Sequence:  Enzymatic Nucleic Acid
  misc_feature (31)..(31): n stands for inosine
uuaauucacugaugaggccguuaggccgaanuuucaau

SEQ ID NO: 14829 - RNA, 38 nt, Artificial Sequence
  Description of Artificial Sequence:  Enzymatic Nucleic Acid
  misc_feature (31)..(31): n stands for inosine
auauuauccugaugaggccguuaggccgaanuuaauuc

SEQ ID NO: 14830 - RNA, 38 nt, Artificial Sequence
  Description of Artificial Sequence:  Enzymatic Nucleic Acid
  misc_feature (31)..(31): n stands for inosine
aaaugauucugaugaggccguuaggccgaanaauauua

SEQ ID NO: 14831 - RNA, 38 nt, Artificial Sequence
  Description of Artificial Sequence:  Enzymatic Nucleic Acid
  misc_feature (31)..(31): n stands for inosine
caaaugaucugaugaggccguuaggccgaangaauauu

SEQ ID NO: 14832 - RNA, 38 nt, Artificial Sequence
  Description of Artificial Sequence:  Enzymatic Nucleic Acid
  misc_feature (31)..(31): n stands for inosine
auggcaaacugaugaggccguuaggccgaanauuggaa

SEQ ID NO: 14833 - RNA, 38 nt, Artificial Sequence
  Description of Artificial Sequence:  Enzymatic Nucleic Acid
  misc_feature (31)..(31): n stands for inosine
ucauaaaucugaugaggccguuaggccgaancaaauga

SEQ ID NO: 14834 - RNA, 38 nt, Artificial Sequence
  Description of Artificial Sequence:  Enzymatic Nucleic Acid
  misc_feature (31)..(31): n stands for inosine
gucauaaacugaugaggccguuaggccgaangcaaaug

SEQ ID NO: 14835 - RNA, 38 nt, Artificial Sequence
  Description of Artificial Sequence:  Enzymatic Nucleic Acid
  misc_feature (31)..(31): n stands for inosine
accauuuucugaugaggccguuaggccgaanucauaaa

SEQ ID NO: 14836 - RNA, 38 nt, Artificial Sequence
  Description of Artificial Sequence:  Enzymatic Nucleic Acid
  misc_feature (31)..(31): n stands for inosine
uuuguuagcugaugaggccguuaggccgaanccaacca

(The sequence listing continues in the following parts.)

What is claimed is:

1. A compound having Formula II: (SEQ ID NO: 13488) 5'-u$_s$a$_s$c$_s$ a$_s$au ucU GAu Gag gcg aaa gcc Gaa Aag aca aB-3' wherein each a is 2'-O-methyl adenosine nucleotide, each g is a 2'-O-methyl guanosine nucleotide, each c is a 2'-O-methyl cytidine nucleotide, each u is a 2'-O-methyl uridine nucleotide, each A is adenosine, each G is guanosine, each s individually represents a phosphorothioate internucleotide linkage, U is 2'-deoxy-2'-C-allyl uridine, and B is an inverted deoxyabasic moiety.

2. A composition comprising the compound of claim 1 and a pharmaceutically acceptable carrier or diluent.

3. A method of locally or intraconjunctivally administering to a cell the compound of claim 1 comprising contacting said cell with the compound under conditions suitable for said administration.

4. The method of claim 3, wherein said cell is a mammalian cell.

5. The method of claim 3, wherein said cell is a human cell.

6. The method of claim 3, wherein said administration is in the presence of a delivery reagent.

7. The method of claim 6, wherein said delivery reagent is a lipid.

8. The method of claim 7, wherein said lipid is a cationic lipid.

9. The method of claim 7, wherein said lipid is a phospholipid.

10. The method of claim 6, wherein said delivery reagent is a liposome.

11. A method of inhibiting ocular angiogenesis in a patient comprising the step of locally or intraconjunctivally administering the compound of claim 1 to the patient under conditions suitable for said inhibition.

12. The method of claim 11, wherein said ocular angiogenesis is associated with diabetic retinopathy.

13. The method of claim 11, wherein said ocular angiogenesis is associated with age related diabetic retinopathy.

14. A method of locally or intraconjunctivally administering to a mammal the compound of claim 1 comprising contacting said mammal with the compound under conditions suitable for said administration.

15. The method of claim 14, wherein said mammal is a human.

16. The method of claim 14, wherein said administration is in the presence of a delivery reagent.

17. The method of claim 16, wherein said delivery reagent is a lipid.

18. The method of claim 17, wherein said lipid is a cationic lipid.

19. The method of claim 17, wherein said lipid is a phospholipid.

20. The method of claim 16, wherein said delivery reagent is a liposome.

* * * * *